United States Patent 10,329,575 (REGULATORY SEQUENCE FOR PLANTS) - sequence listing, part 2

SEQ ID NO: 1120 - DNA, 3000 bp, Unknown
  misc_feature (1)..( 3000): cDNA_ID_2130917_gDNA_ID_1620361_Annot_ID_154649 3000 nt of promoter + ATG
gggcgggaaataaaagaggagataactaatggtacggatttatataataaacgtgccatacgacaaaaataaaataaaaacgtgccataatttggccttttcgaaattcaattaagtttttaaagaatttgcaaatggtttgttgtttctttggaaataaaaactcaaagtaatttgtttcttaagaaatttctaccctttttttgtccagttgtatgtagtttctatctctgatgtttataggaaaaaaagaagaataactatcattatcctctgttttttacacttttttcttgctaatttcttttcgttcatattttttttttttttagggaacgaaaataggacaaaaatgaaaattctgaaatttccaaaaaaaaaatcttaaaaacaaaaaataatgaaattttcaaggttttttatattttccaataaagcttcactttgtctttctctttctcaccgttgaaatattttgtaagcaaaaccataaaccgaatccttaaccgtctttggattagcatattagtgagtgggatacgtacatgatcggttctttctccttggaagcggatagggctcatgattatgtccaaaatgctctgttttggagacttgtgtaatagtaaactactaaagggaaaataactaggtttgactcaaatataggttattttcatgaccataatgatggcccagcagatctcgcacttcttgcttgcatcgaaatttaaaaaagaacattttaatgctaacaatgtttccttgctatcttcttctaggaatcttctcgactgttcaaacctggacaacctcttttgcccaaagtcaactgtgctttcccaagtctatttatgcgattgatcattctcttatatgctctgacttagatcgaacatgatctaaaacaatctgtttggtcttgtatataaactgtaataaatcgtctgtttgttcctaatccaatgtcgcttgtcgagatctctggctctgatgctatggcggcgccgatgcctggaagagtaccaccaccaccaccacgtcctcctcctatgcctagaagattacctccgatgtttgatgcctttgatcatacgggtgcaggaatggtgtggggttttccacgtccagctaaaaaaagggcctccctgaagcctttacattgggttaaaataacaagcgatttgcaggggagcttatgggatgagttacagagacgacatggagattcacaaacgtattggactttaactttatcttggcttttctcttacttctatgtgataatacgtactgacgttttattgaccattgctttgcaagtaatcatttcttatttttttttgccagtgcaatagaacttgatatatcagaattagagacccttttctttgttgaggcaaaacctgaaaaaattcgactggtaatgtgaaatattcttaacacatttggttattgcgtcacatatattttttaacttgctcttttctggtggagacttttgaaagtatagtctctcttatggttttccagcatgaccttaggagagccagttacagggtttttaatgttagatcctactatatgagagccaataacaaggttattaatctttcgatgccgctgcctgatatgatggtaagctacaaaacctacattaattacctgggtaagaagtcattacgcttcatagcttaatgataatagtccacatttttttctttgcatcgtccagactgcagtcctggcaatggatgagtctgtagtagatgttgatcaaatagagaaacttataaagttttgcccaacaaatgaggagatggagcttcttaaggttttgacttttgagtagttgcattatttactttctatttatttattttgtgatatttgtcagttcttggttaatcatcattattcactttttattgacacgggttcttgttctttgtcgtgattgactgatttgttgtagacctacactggtgacaaggcagccttgggaaagtatgaacaggtctgttgaagttatcaatctcgcactgtttttggttcctactataaataaatatggttagtaattagcttacttagctaactcattgacttctgccatcaattttgtttatcgcagtacttactagagctaatgaaggtgccacgacttgaggcaaagcttagagtattttccttcaagactcaatttggcactaaggtccggcggttctgttatctgattctttggaggaaaacgttttggttttaccagcgtctatgtaactgtatattcttggttctgttgttactgtgcagataacagaactcaaagaaaggttaaatgtggtaacttctgcgtgtgaggaggtataataattacctctagttcttgtgcagtccatatatgcatttctctttcttagaatttgctccttattcaccaggtccgttcttcagaaaagctaaaagaaattatgaaaaagattccttgcttgggtaacacatcgaaccaaggacctgacaggggtaagtattagggatattttatcttttttgcacaagaccttcaataagatttctttgattcaagaacggcgcctttttgtttctgctgcatcatatatatatattgtttgttctcaaggcaaatcctctgtggttgataagaacctttctttctccagtggaattcaagttggacagattaagtgttaaaaggatgcattatttttgcaaggtaaattactctctttacaaagaaaaagcctctagattctgttttagaaaatggtcttgctcaggtcctgaaactatatatgtattttgcaatagttacctctagtccatatatgaatttctaaacgaaagatgaaaaaaacataacaacaagcaagcaactaaattcttacaaaacggtatgatgaatttcgtttttcttacactttttctcctcatttcttattcatcatgtccgtttcttcacaaaagctaaaagaaattatg

SEQ ID NO: 1121 - DNA, 3000 bp, Unknown
  misc_feature (1)..( 3000): cDNA_ID_3060761_gDNA_ID_1620361_Annot_ID_154648 3000 nt of promoter + ATG
tctaaaatttcccaatctcttcaagtttcctcaagacttgtttgacgtttggcctaagagaaggcgaaggagagcaacaagacattgcaagctgaaaatacttgaggacacattcttcacttagattatcatcacttccgagaatctcaggacggtataaatcagacaacctatgatcaagaacagcattcctcataaaatcaggaagatagaactcatcatcgccagttgcattctcgtttatcggttctttaccagagactagctcaagcatgatcacaccaagactatacacatcactctctttgctcacgtccttcatctttattaactcaggagctttgtatccctcagctgcagaaacatcaagaatctcttgtcctgcagacaggttcaagagcaaatgtaaaccgaaatcagagattctaggttcgaaactcgaactgagaagaacgttcttggacttcagattgccatggacgattggtttttgcattcctgtatgaagatgatcaagggctttcgatattccaattgtgattcttaaaatattgatccattttcttgattcatcatctccacctgtcaaaacaaaacaagaatgtaattttcttattagtctagatatttgctgagattgatgttcttagtgtcaaattttgttcttactacactaaagaagtggaaaatgacagaaaataaaacaaaaatagtaccgacaaaagacaaagatgatctcataccttatattttgaaaagcttgaagaaaataatatttaagacaaataatgaaacactgaattaaatgatccagctaatgtgcttaattccagctgtgtggttctcttttggataatcttaacacattgttaatcttacatagtatttttaatttatatctttatgaatatatatgtatgtatgtacatatgatatcatcatcatgggaatggtaaattatccaggaagattctaagaaactatatatgtatgtatagaatcttcccgggaaaacccatgaaacaagtaaccacgagattccatggggttaaaaggaaaaaaagaaaaaaagttaacattctttgctttctgtcggaaaaaagaaaaagtttggtcctttttaaaacttttttatcaagaaagtagaaaagaaaacagagagacttacttctgatgaagtcggaaagattcccggaaccgaagaaaggatgaaccataagcttctctcctctgtttccagcgtagaaacctaacagaggaaccaaattctcatgtcgaacaaacccaagtgtttcgatgatgccattaaactctttagaatccgatctcactgtacacaccggtctaagaaacctaagaaccctaatcttgccgcttctttgtaaagacgctttgtatagagtaccatagcttgattttccgatgacttctccgggagcatcgaggatatcgcagatcgtgagatcttctccgccttgaaagattacgagttcctctgtttccgaggagaagccttgtttgttgtggtctagtgattcgacgtcgtattgatctgattcagtagatgatgattcttttcttctaaggaagatgataaagaagattactatcaagaatgctgataaagatactcctagtaacaatgttagaagtagagattttctcatctctgaaacacttttttaggtgagagattttttggaagatttatgattatgagtattgtgaggtttgcagggaaaaaaattacagagaaagagagaaagattgatagagacgggagatgaagttgatatataagttcagaggacagatctaagaatatcttttttattttatttccttgtatcaatgttgactttatgatttcttggccttgtaagggtatgtgtatatttgtatttacatatatatgcaaatttactttcctcttatgttctcaaccaattatgatgacctaataattccaaattgtattttcgttacacgtcgacctatatgtacttattttctctctagggttgatgtttttcagtttcacacatgcttgtatactccgtataaaagagtttttggaaaataatatctcgagtagaacgttttagtttctttcaaggtaaaaatattaatgagcgaccgtggtaattaattgtaatgatctcaagaaaaaatgaagaacgttggaagtggtgatgataattaaatgttgggtttgactagtgatggtagttgaagtgcgtggggtacatatttagatccttgattggatgttttatccggcaagttagggtcagactggtggagaggaaataaattgaaggcaagtacatacaactcctaacttgagaatgaaataaattgagaagaaaaaaggatagaggaatacttttctctcttttgttgaggaacctttcttctactaataccaattttttctgtttttcaagctgaaattgttttggaataagtatgattgtgtttagagaaaagactgaaaataatgattgttgagaagtgaaaatcgacatcacgattaatctattgttagctgtaagctttgtctctactccttaattagacagttgacacagatgatgaaattcactttattcaacggctcgaaatcacccatttttggttccactatcccatgtcatcatcattttaaattgttcaccaccaaatacgattgtgaaagcatactcgttcataatcataataaattgcacgatatatattggctagccttttctaagttttctcgtaactaatttatatgtagcactacaaagtactataaaaccatatgagttgaaaaaaagaaacacatcacatgagcccacatattaagttaggagtagttaattagctctagattgagaagatgggaatatagattttctttagcattacattttgaagaaaaatcggaaaaatatcatagcaatattttactaatattgattattgagtacatgggttcaaaataataaaaaaaaa

SEQ ID NO: 1122 - DNA, 798 bp, Unknown
  misc_feature (1)..( 798): cDNA_ID_3060840_gDNA_ID_1620362_Annot_ID_154667 3000 nt of promoter + ATG
gatccaaagtcacttgaaaacccacttaacaatgttgacctttaaaactggaaaagtcaaaacgatgctagtcaaaaacctggttgattacggttggaccggctcatcactcttcacaaacatctctagatgatagcaacgtttagttacaattacaagttacactaaaaagtctgaaattggaatcagtcctaccaaagcaggttataaaacatactactttctttactcgttaaaccaaaaactataataaaacatgcaactttacccaaatgttgaatttccactgaaaaaagtttggaccatttcaacatttacaaaattatataaattgacaagaacacaacaactaaaacttgtagaatatctatggaatactatgtaagtttctatatcctccaactttataaaattcgatttgttgaatcatagaagaaaaaacgaattatgtatatatatatatatacaaaagataagattttatcaaaaaatggcttaacccaaggcaactaactatccggaatttatcaatcaatttcttctccatattaaattccataccataaaacgaatattgcaaaaacattactctatcttatttttattagtagtactaataaatctaggaaacaaataatttaaaatttgacaattgtcttcgtaaattcgtctgcttgatctcttcttcttcttcttcttcttcttcttcttcctcgtcttctcaatttcctcaagctttcaatgccgtgtcgttgacaaaagattaacttgggcaacgtacaggtgcgcacgataatg

SEQ ID NO: 1123 - DNA, 3000 bp, Unknown
  misc_feature (1)..( 3000): cDNA_ID_1442179_gDNA_ID_1620362_Annot_ID_154689 3000 nt of promoter + ATG
ctttcttttgttttagaaatatatacagagaattgatttagttctatttcagaaactcgattttggatcaaattgctttgatatagttcagttttgattagtatgctgctttgacttagtttgtctgtctagagcttagtatctgtatgtataagtgatcttgatccgtcgtagttcaattctgagattgttccaaattgtttcagtagttggatgcatttggctatgttatcaagtaacctctgattaaatgttggtttggttcacagggaagaccacatttgtaaagagacatcttactggagagtttgagaagaagtatgaacgtaagtactctcgcaagcaagccccatcctgaaatatatcacttgtcattaaccttttttattctcacaaaagattctcatgtgttcttgtgtttttgcagccactattggtgttgaggttcatcctcttgatttcttcactaactgtggcaagatccgtttctactgttgggatactgctggccaagagaaatttggtggtcttagggatggttactagtaagtactttcttctcatacaaatcacttaaaaccgaccttgttaataatctagaatcatctactgtcatgctataatctagaatcttctagtgttggaagcttggttatggtttgaagctcaataagatgattgtagctagcaacatgaaaaactattgataactgttgcaaatagtttgtgtttgatacaataatgtgttctgttttgttgcagcatccatggacaatgtgctatcatcatgtttgatgtcacagcacgactgacatacaagaatgttccaacatggcaccgtgatctttgcaggtatgatgaactcactcacagaaactagcatttgttgtatgtggcaaattgctaaacagaaaatgtcatcaaatttcatggtgcagggtttgtgaaaacatcccaattgttctttgtgggaataaagttgatgtgaagaacaggcaagtcaaggccaagcaggtaacattccacaggaagaagaacctccagtattacgagatatctgccaagagcaactacaacttcgagaagccattcttgtaccttgctagaaagctcgccgggtaagaaacaattcatcaattcaaccctcattgtagttattgtgaaacaacggaaaaatgaaaattgagatgttgcttgtttgtctcagggacgctaatcttcactttgtggaatcacctgcccttgctcccccggaagttcaaatcgacttggctgctcagcagcagtaagttctctaaaactaattttgttttaatttgttgctaaggtttgagttcgaggcttttcttcaattaacgattatatatttgtaggcatgaggcggagcttgcagcagcagcaagtcagccacttcctgatgacgatgatgacaccttcgagtagagaaagagagatgtgatctgtcactgattacccgttagggcttgtctgaacttttttttgttcatggtgctatttttatgtgtccgtactttgaaatgaatcgatgacattagtaattttcatttttaagtttttaactgtcgctatgaaagtgaaaaccttttgattacaaaccttacatgcttcacaatttcaattgtatctctattaatcctagccgcgcaatctcatcaattctccacacccaacacacttaatagtttttttttacatcaatcatttcgaaaccacaagttcttagatactcaacaacatttttttttttttttctgtagccaatcgatgttctaaagatcaagaatgttgtattatttctaccacttatggagtcaccaaggatatgtgaagggttttctttgtttatatatttttttaattgcgttttaggacatctccaatagaagtatctaaatgtagatactgatctctatcaaaacagattatggatatcatactagagtacattaaaaatttgcttctaagattttgagttcttggagtcattaacgcatcgctaagggtattttcgtaactttaaataaccccaaataatattttgcttcctccccaagaacctttttgcctctttctacttccgtcggccggattcagagtcataaataaatatataaaaaaaagtttcgatttttgcttttcttcttcgattcattgcgcgaatcatccgtgatgttggtgtctagggttttatcaagagtttctcgcagcgcaggcttacgctcgtctttctcctccgtcgttactccgaagaggaatcagattccgattgttgcaagccgatttcactccctcgttcacggaacccccaacaaggttaggcttttaagctgattttacttgtaattcgttctggattttatcgtcgggtttatgctagggtttaaggggtttgtctaaacaaaagattgttatgttctgattctattgctctggtcttctttattacagtgtcacgaatttaattgtgtatgtctgaatgttaatgttttgattgctctttcatatgtcttaatttggatgtgaaattctggcaatccttgtgaatttgaaagctgagataaagctcattctaggatttgtgtacagtgaatttacttaatttggatcattttttttaatggcagcttgttgcagttccagtgtcgctccgaaaccatggaactctagatttgaatgttcttcaaaggttcggctttttttcctcttcctcagctgaaccgaagggaaatgagagtaacaccgaagtaccaaagaccggcgaaacttctgagaatgtggaggtggggaaagctacaggtgaggcaaaagattcatgtattttgacttagaataaagagagattactgtgtctaatactgaacgagtttctttttctgagttccagatgcagagattgacttcgacgatttgtcaagagacgatttagtgaagcttgtgagtgagaaggaagatcttttgaaggttcagcagaaagacata

SEQ ID NO: 1124 - DNA, 3000 bp, Unknown
  misc_feature (1)..( 3000): cDNA_ID_3060819_gDNA_ID_1620362_Annot_ID_154687 3000 nt of promoter + ATG
aaggaatcaaccgcatcaagctttacgacaccgagacaactgtactaaccgcactcgcgaactccggaatcaaagtcgttgtctctctccccaacgaaaacctcgcttccgccgccgcagatcagagctacaccgacacttgggttcaggacaacataaagaagtacattccagcgacggatatcgaagcaatcgccgttgggaacgaagtgttcgtcgatccgaggaacacgacgacgtatctcgttccagctatgaagaatgttcaaagctctctcgtcaagttcaatctcgacaaatccattaagatctcgtcgccgattgctttaagcgcgttggcgagttcgtatccaccgtcggctggttcgtttaaaccggagttaatcgaaccggttattaaaccgatgcttgatctcctccgcaaaacgtcgtcgcatcttatggtgaatgcttatcctttctttgcttacgcagctaacgccgataagatctcgttggattacgcgttgtttaaggagaacgccgggaatgttgattccggtaacggtttgaagtataacagtctcttagacgctcagatcgacgccgttttcgccgcaatgtccgccgttggatttaacgacgttaagcttgtggtgacagagacaggctggccttctgccggagacgagaacgagattggtgctggttcggctaacgcggcggcgtataacggcgggttagttaaaagagtgttgacgggaaacggaacgccgttaaaaccgaaggagccactaaacgtttatctgttcgctctgtttaacgagaatcagaaaacgggtccgacttctgagagaaactacgggttgttttacccaaacgagaacaaagtgtatgacgtttcgctcaacggtaagtcaacgccggtcaacgataacaaagagaaggttgttccggtgaaaccgtcgctcgtgggacagacgtggtgtgtggcgaatggtaaaacgacgaaggagaagcttcaggaaggtctcgactacgcttgtggcgaaggaggtgctgattgccgtccgattcaaccgggtgccacgtgttataatcctgaatcgttagaagctcacgcttcctacgcgttcaacagttactatcagaagaacgcacgtggagttggcacgtgtaattttggtggtgcagcgtacgtggtctcgcaacctcctagtaagtaccctatctttcctctccaaaattttattttgattagtaagtattttgcatatacagtatagttattttcacgttcttaatagttggaagatggttagataataattatgggagttgggatggtttaacaacaaatgttatttttttgggcttcacttacgtatacagatttataattaaattgtgacgtatagacggaaacgtaaactaaattaattattttttgttggttatgtgtttgtagagtatgggaaatgcgagtttccaacagggcattgaaatggatatagagaagaagaggatcgtgcggatttatttacgttatttattttgatacattgttcttttgtcattcgagtatatgatttgcgtatatttatttttattattgtatatttggttggtttcatcggataaatagtcagattttctttcccccttaagccttaacttctttgctcgtgagtttataaaactgacaaaactttgttgatataaaccattatatcctgcaactgatccaataaacaacattgcaatattattttcaaaatctcaaattgattcgttttgctggtgatcaactgatcatgatccaagcaaaactcaacagtatatattgtccatattgtttcattccaatactccagagtcaaaaccttgagctgcctacttcatcaaacttgattagcgcctaccatcaattgagctacgactacactaccaactcccatatagaagcctgtaactcgaaaaatgggttttgagttatagtttgtcacaaagctctgtgaatacattatactacatgaaaactcatcaagtcttttgatatggaatcttcagaaccaagaatagctttaatgcttttatagttgtgaagtctgttattattctattactgaatgtgtattctcctccagaaatatctaagatcttagatgagtcagtttagacgttttaaatagcaagaatgttctgcttttttatgtcattttaaaaagcttaaggttttggattgtaagcatcgtgtggttgctaatcgaacttccttccctttgcattattgagatagtgtactcgcaaaacacggtggcaatttaaccaaaacatagtacaaacacggtttcaaaattttaaaaacaaaaccatatacagtacttgattaccatcccaagacttacatattcttagatggactatgagtctatggctttttcttcaactactaccaacttgaacttctcctccaaaccaattaagtgggctttcaattggtcatgccttctttccatatcacgagtttcttctagccagcgggagtgatttgatggaaaggtggtcgcattcgtggagtatgcttttgtaagtcttgattggaaaagctgtaaacaatgctctttctgaaatattgagggctagctttggatcgcgccatcgcggctaactcttggcaacaccaatggcttccttgtgtcttcttccatcaaagcgtgttcctttcattaattacattctcttttgtggccttctattatattgttgcgtagttttcagtcttttatttctcttcgttgtatctccgtgttatgtaaaaaatctaaaatttcgtataaaactttaaattttaccaaaaaaataattaaaaacagacaaattctttagaaataaaatctaacaccttttatattttcttcataaacaattgaaccaaaaaaaaaaactcaaatccaactcctctcccctataaaactctatcttattgatgattttgctcaaaatgtagtagtaataaca

SEQ ID NO: 1125 - DNA, 3000 bp, Unknown
  misc_feature (1)..( 3000): cDNA_ID_3060792_gDNA_ID_1620362_Annot_ID_154694 3000 nt of promoter + ATG
tcccaattaagtatcacatatcattagtcaataatctcctttcgcttctcattaccctttttgtagctcattttataattgttaaaatgtgccaaaaagaaagatgagtttgttacgtaattaattaggtaatttagagaagaatacataaaacaaatatagcaagagagaaagataggaattaacaacggcataaaaaacgataaaaacctaagaagagcaatttaatcataaaaaaggggtttaaacatcgacattaagtggaaataacaaatttcaatgactgtgaatttagggaaacaagaatgacaacaaccaaaaaatattgaaattttcaagacttttacatctgaagaaaatataaaagtctaagaataccgcaaactttgggcttagtgtaaaagaaaaactagtaaccctcctaaacctgaagtttgttattttataaagtttaatttggtggttattttgggaattaaatatctaatgtactactaattacccaaagatcttgattagatagtagaagtatatagaacagtatgactttcttttcacgactattgtggcatgctaatgaaagtttggttgttggcttaatataagatatatgggacccacttgtatcttttattctttgtatatcttttgctaattattctttttcatctaacatcatatattcatatcaccaatgaaattcatgcaatacctatccgtatacatgtaacaatcgtcttagaaagaaaaaaagtgacattttcccatatttaaaaacatccattagttaaacttcaattaaatgactagaaaagccttaaagtactaatgattgtagattaagatattcaatttttattttattttcgttactaatgatcgtagattgtagattacgagcataaagaagtgtgtttactgttacgaaaaattaaatctgaatctaaccttttcaacccaaaagtgtaagaacaagcaaattaaggaaatctgaagtcaacatttcagtaagattaatacgtactaaacccgtctcaacctcagagatctcaaatctaaaacttgtaaaaaaaatgggatgccaaaatcatgtttggaggaaaaataatgaaataataacatctagttttaggatagagatgatgaaaatgtagagaaatggatagagagtaaaaaaaaccggcaacatgatgaagaaactagtctcttttactatattgcttcacctctctgttccattggattccatgaattttcggcgtcaatctcgtgccttacccactcttattcctcctatatgctacttttatattttctcaatatagactatttatggagatttaaaccttaatacttaagctagcaaaaaaaaaggagaaccacagatgaatatgccatgtaagaagaaccacgataattagttacggatgagttggtaatttggtatatatattgacaattagaattgctcgtaaaagtttaattatgcatacaccttattttggatcactgaccttacgttcgatcggtgtgattatttaactatacaatgcctttaaggctttaaatattattcgaccatttcatcgtatagaaaccaggaatcaatataaaaaaaagatctaaaattttaatgcatcgtcatgccacatttttgggctagttgataaagattggctgacaatggttaggaccaatacttgggatatgaatgaaactttattggatagaaagcaatggatgaagaatttttgaaacatgcatgaatctaactaagatcgtatcatagctttaatactccttatgtcccctcgggtggtagcctatggaaacacaatcattttccttttgatttttctcatcatgattgttttaagccaaccaataggttcttactcttaagactcattaattaaccctaaccttataatgctattaataatctcataactaattttttttttgtaccatgcatatttgttatatattctcattcatcatactcattacataatcttaacatgcatattactacactaagattaaggaactactatccactgatctaattacccgcgatgagatatgattgacgagtcaacaaacaacacatttcactaattacgatcgagtatcccattcaaatttgaatccagggcatgatgtagaaacaaccaaccaaaattgtttccacaacttacttaaatttttcttatatatatatctcaatcccaaaaaatgaaaataaattaattaataaaattacatcaaaatgaaattaaaaataccaatattccctttaaaattatatattaccatgaaaacaccaaactaatcaaatctcaaaactagtgctgctttatagaaaagtaaagttaacacattatgatatatcaaatttaatgtacttatgtacaaatgctattttgatataaaaaattattaacaattgcgataatacttaacagaaatgtcattttaagatattctcattttaaatcacaacctcaaaaatacttgacaaaaaaaatatcacatcagatattgaaaattatacgtgtacatcatatattgattattgtgtacatcatatatatatgaccaccatatattgttcaactctttactccaattagccctacacaaaatgtggttgacaaaataaaaacaacctacagtgcacaaaatgacaaaccatgtatatatactataacatgtgacacaagtacaccatataattgtattttgttttttgggaaacaaacataatgatgcgttgtttttgcatgaataatcagtatatacaaaatatgtacgcaatggcacatttaataatatgtttccccattcaactaaattcatacatttatcatttcatctctttgtcctcttttcctatatatatgtgtcgtctcctcgagcttgtctcattcacaaaaagaaggtgtagagaaagttaaagagagaaggagagatccatagagaaagagaaagagaatg

SEQ ID NO: 1126 - DNA, 3000 bp, Unknown
  misc_feature (1)..( 3000): cDNA_ID_2130862_gDNA_ID_1620362_Annot_ID_154692 3000 nt of promoter + ATG
aaattgcttcctggatgcaccactttaaaggaggtaatgaacacatggattttattttcaacaaattatacaatttttttttttgtcttatatcagtgtaattcgctaatgaaacaagtaaacaggttgaagaaactctggctaaaagatgtcaagagatggagcaggaagccaaggagcaagcgacagacaacgccatccttgagcagattcgaaaggtcatcatctaattccatatatcatttgaagcattaacatcgttgatcaaacatcatttgcttctttttttttagatggttgaagtagagattcctcaatctttatttgaggaacaaggaagacagttttatggagctaggcttctagagattcaggcaagtgttttcagtgactgttgttgatctcttactctcttttactgtcactcagattcttaaggttgaatatggtgctgcagggaaacatgaagcttaacgaagaccagttggcttctctttcaagtcaaaaagcagtaaatgagtttctagaaactcaaagagagagcatcaccaacataatcaagcagaatatagctgttggagatatcttcaagcgcgaaaacttagaggtatatttatatgcatgatactctgtctccaagaaagaaacaatacatttttagtaacaaaaacattgtcgaaatacttgaatgcagttctcaacagatgaactagttaaagaggtcgaaaactcgatctcagaattcaagaaacataaacaagagttcgacgaggagcgtgtgaaagatcaggttagttctcttgtgaatctaagcactatcagtttcttgagcctatataagataactgaaagagagaggttcttcttgaattggtggttggttaggtacaagagattttagaaggagcaaaagtgcttgaatggttaaaagaccgagccgagattcaatacatcactcgttgattagcatataggtaatgtatgtatgattggcatgttctgtttttgtatgagcaatttggttttgatgtacaattatgattgattttgtcagaagaagagaactttgactatatttgaattgataggtgcaataaattattaacagaaacgttgctttttattttgtaatttaggtcactttttgattctatagtcaatgtgttttattggatatagatggtatagatataagtatttacgtcgatttcatattgaatttgccaactaacattgagtcattttgactatgacttgttttttatttcgacaaaaaaaaaaagagactcttcgtcttttctagtttggttctatatggactaatcttccctctgacctcatcacttttgctacttgtcttagctgtatttacgaactacttcctcatgatccatgttaaattatggaaaggtaaattaaatttcaccaatccgagtaggctagtacttacaccattttcccaactaataataaacacagttcaatacaaaaaaaagaagtttctaaccaactagtgattggatttattaataaggaataatatcgaagatactgctaatttgaaaacagaattttattcaaaatcagcaattctccggagaacttttcatctattttgaatgcaagactataatgtcaaagatgtcaatgtttgatctgagtatttcaaactaacatttataattccagtttactttacagatatctgataattaatttatgtgtttatctttgtcaactgtatttgatattaattcaaaattcctaaaaatgttttatcctcttgcatcatactttaaaacaaatatgaatttcgactgatagcgataataaatatttacaatattgtaattggataatataaatctagtgatatatatatggtccctaaaactggtaaacaactttggttgtacagtaaatgtttttgtagagctacacataacatttacagctttaaataaccataagttaacttggttagagaaaaccaaaaactattgaagcatccgagaatctagtggtgaattataacgatattattgcactgtaagaaaagaaaagaattaaaaaaaaaagtaaataacttgtgtggtcaaacaagcaaagaaccaagtcaaggaagagtaaaaaaagacacaagtctgtctgtgaacagtgtcatgtttgtaaataaagaaggaaactaggggtgaatattttgctaattggagtttccatcgtacttcaaaaaaaaaaaacgattgggtcccacactcacctctccgtctcttccacctccatagatagattttttttccttaagcaaaaaagattttatctcactctcaatagtgttagtattgtcacagagaaagcttcagatctagaagaagaagcagagttcataaagagaaacccattttaaaccctagaaatcaagtgtcaatctcggtaattaaagtttatgcctttttctttttactgttagatttgatcaattttgaggtctttagtctgttccttaaggttttgattgctttggttttatcaccaatgctgtccgattctcttgaagattctgttttttttgttcagagatctgcttcttctttctgtgctttgcttctgcttgatcggattttagatattgcattctgagcttgacttcgtttgctttctgtgtcatggtgaaaaaagggtttttgagcttcgtaagtcaaattttttgtttccgattcttaatgtttggtctgtggagtttaatctttggttagagtgattaagaggttttagattccgaaaaagattctaactttgattgagaatatctacagcgtatcttttggtgtttgttattgttttttcttagcttcgtaatcttagttcagtttcattataatctgatgcagaagaaagatctgatttgagcgatgtataattcattcttagtttagttttagtctctcattggtttttgtttttgatattttctgcaggaaaccttctgattccgcaaca

SEQ ID NO: 1127 - DNA, 3000 bp, Unknown
  misc_feature (1)..( 3000): cDNA_ID_2130856_gDNA_ID_1620362_Annot_ID_154691 3000 nt of promoter + ATG
cttcgattcattgcgcgaatcatccgtgatgttggtgtctagggttttatcaagagtttctcgcagcgcaggcttacgctcgtctttctcctccgtcgttactccgaagaggaatcagattccgattgttgcaagccgatttcactccctcgttcacggaacccccaacaaggttaggcttttaagctgattttacttgtaattcgttctggattttatcgtcgggtttatgctagggtttaaggggtttgtctaaacaaaagattgttatgttctgattctattgctctggtcttctttattacagtgtcacgaatttaattgtgtatgtctgaatgttaatgttttgattgctctttcatatgtcttaatttggatgtgaaattctggcaatccttgtgaatttgaaagctgagataaagctcattctaggatttgtgtacagtgaatttacttaatttggatcattttttttaatggcagcttgttgcagttccagtgtcgctccgaaaccatggaactctagatttgaatgttcttcaaaggttcggctttttttcctcttcctcagctgaaccgaagggaaatgagagtaacaccgaagtaccaaagaccggcgaaacttctgagaatgtggaggtggggaaagctacaggtgaggcaaaagattcatgtattttgacttagaataaagagagattactgtgtctaatactgaacgagtttctttttctgagttccagatgcagagattgacttcgacgatttgtcaagagacgatttagtgaagcttgtgagtgagaaggaagatcttttgaaggttcagcagaaagacataatggaaatgaaagataaatttcttcgcacttatgctgagcagcagaatcttatggacaggactaaccgtaatgctgaaagcgccaaaaagttcgctgtacaggtttacttctctactccgcgaatcctttttcttctttcttgtattaactcgttttgctttgtgtataatccagtgctgaatatgttttgttgtgctgcagaactttgcaacgagccttttggatgtggcggataatcttgaaagagcttcttctgttgtcaaagagagtttttcgaagatcgacacttcaaaagatttggctggtgctactccactgttaaaaaacctattagaaggagtggagatgactgagaaacaattagctgaggtaaaaacgtccattatatatatcttttgaggtaaacaatgataataagactggtgctgagaatgcaattttgtatgtaaaactgcaggtgtttagaaaagctggtttggtgaaagaagatcctttaaatgaaccgtttaatccaaacagacataacgcagtgttccaagtcccagatgcttccaagccaaaaggcacaattgctcatgtcctaaaggtactaaactattcaaaggattgctctctttcttgctttaactcttaagcctatgttaacttttagaaatccacacaatatcatggattctctgccatcattttataactgtttttttttcttccatatttgcagtctggatactcattgtacgatcgagttataaggccagctgaggttggtgttacttgcgccgtggagaatcaagaaggcggcaaagagtctgcagcttgaaatacttaaaacatcgagagttaagcttttgtttttaacatcttcatgagttctttttttagttaatagttctctttctttgcatattcattggaggaacaagattcccataaggtagcatgactatgctctgtacttccagggaagccctggttctgtaacttttacacaaattcataagccaaagccaaactcttggtaaaagcttcaaatcttacatttatataacttcttcctaacttacaaacacactacatagagatctagaagacgtcaaagtggaataaccgcctagcataagatacaatataagacatcatcacagctgaacacattttatagttgctcatcccaaatcaatatgattctcttcattcttcagtcccttcagaattcagacacagtcccagattcaaattaccagtttttgcttcctgcagagtaagtttataaaacacaagtatgaacaaacactaaccactttcattacattgcttgagttttaaatgaagcttaccttagtttggtctgagtctgttaggttcatgtctagctcaacagctttaggtaatggagattcagtgtcgaattcttcagtctcttcaatttcagaatccttagaaatcactttttctctatgctcaagcatcgcaatctacacaaaatcaatcattttccactaatcccacacaactaaaaccctaatttaatgatttggggaaaaaaaacttactggagcgtatctgaatcttcgcttaggcgactcctctgtctcaccggaaccattagcgtcggaggcagtaaccgtcgctgaggtaagtggagtccacttatggagaagtagatggtgtggtgagttactgttgttgctgttgttacgaccgttggatttagatgctctgaaaacaccgacggatgaggttgagacacgtacccacttcttcttccatttccttacacggccactgaacaccgccgtcgccgccggaccactgtatctcgatgacgtccggctcaatctcgatcctacaccttccattctcttctctctcttctcactagccgggaaaatagttgctttatctatcagctagaaaacgctgcgttttgatgtgatatagccacaaacgcggcgtatttatgtgatatggcttcaaaacgcggcgttttagtgagataattgttaattagttgaaacgtagcgttttaaagagagatttgttgattagtcgaaacgcagcgttttaaggagataactctgtttatctgaaagtagaagcaagaagaagtggcgcttcattcattagctctgttcagtataagcaagaagagagagcgaaa

SEQ ID NO: 1128 - DNA, 3000 bp, Unknown
  misc_feature (1)..( 3000): cDNA_ID_2130854_gDNA_ID_1620362_Annot_ID_154690 3000 nt of promoter + ATG
aatgtattgtttctttcttggagacagagtatcatgcatataaatatacctctaagttttcgcgcttgaagatatctccaacagctatattctgcttgattatgttggtgatgctctctctttgagtttctagaaactcatttactgctttttgacttgaaagagaagccaactggtcttcgttaagcttcatgtttccctgcagcaccatattcaaccttaagaatctgagtgacagtaaaagagagtaagagatcaacaacagtcactgaaaacacttgcctgaatctctagaagcctagctccataaaactgtcttccttgttcctcaaataaagattgaggaatctctacttcaaccatctaaaaaaaaagaagcaaatgatgtttgatcaacgatgttaatgcttcaaatgatatatggaattagatgatgacctttcgaatctgctcaaggatggcgttgtctgtcgcttgctccttggcttcctgctccatctcttgacatcttttagccagagtttcttcaacctgtttacttgtttcattagcgaattacactgatataagacaaaaaaaaaaattgtataatttgttgaaaataaaatccatgtgttcattacctcctttaaagtggtgcatccaggaagcaatttatcagcgagtgagtcatctaatgttggtaaatctctgtagaaaagttccttgcagtcaaccttaagaaaacatacacaattagctgtcccaaatatgatctctttgtaatcatctttttctatgtttggtatatagaaagacgagctcacagtgaattgagcacgttggccacgtagactttcttgtttccatgattcaggaaacacaagcgtgaatgactttgattcgcctgctcgaattcctatgattgcatcaaggaatccaggaagtaatctattcccttcttcagtgtcaaagtgaaaacctgttcacacaaccgccaatctcagtattcatttgcaagcaatgatttcaatggactaagagatttcaaccacaaatctctgttgaaatataacagttctaaaacctttgctttcagcatctggaatcgcttgacccgttgacccgtcctcatctatagttgtagcagaaatatcaacaactgctagatctcccacctacacggttttaggacataataaaaaagcaattctagcaactatatcatctttgcagagttaactacgaacaaatgaagccagattcatagccaaattattttaaaaaaacttaaatctataataagctatagtggatgaacttaaatgtaacgactaacgaggtaaaaggtcggtcctattttaactcagcaattagcaaccttacactagtttcagaaaacaatgcaaggacatggggaatttatgcattcctttacctgtagccctcgctcggttacaatcttcaacgcaccaagagacttgtatttctgtcttagttgtctttcacaagctttttttgcatctatctcatcgcctagttctacaacgaccttcatatttttatacccatcctcaggattccattttagttcaggtacaacatcaacaaccacctcataactaaggaacaagagaaaatcagaaaaaaaaaaacaaaaaaaacatgttaagttagttagcatcattactccaaaagatttttagtatatgtgatgaagaaacaaaaacctaagagtcttgagcttagaataagccttctccatatctggaaaactgcttacaatctgtatcgagtcttttaaagcccttccagtcacctacaaaaaccaaaatctcatatgcataatgttccaagacaacaaacaccgaatttagatacaccacaagacttgttcttgccaaatggccaaaacattatattaaaccgcggaagattgaaaaacataaacaaactaatataaacatttgaaaacttactgattccatggcgtgaggaagtgttctctttaagatagattcaacagttgctctcagaacatattgcctcccaacgaaaccaacaataatattctctggaactcttgttttaggacggaatccaggcacctgattcaaaccaagtaaaatcacaatcaacagcaagcattacatggatcaagtttcaacatttcatcttcatgtaagatgaatattagtttacctttgagagtttcatgaattcggtaaggactcgttggtaacaatcttcacagacaatttctggaacttccacactcaatttcacctaaattgaacagtaaatcaaatttcaagtcatgtcaaaactcagaccaaacacaatgctacacatattctccaacaaatagacaaaaaaaaaattgaaagtctcttacacttgaattcgcctgtacagtctccgtgaccttaagatcagctggaagtttgtcttcctttacactagtttcaaccgctggagaagccgccgcgaatagcctaaaattaccaccatgtgacataaaatctccgaaaaatccaatttttctagagacacaagacatgtccaaaggcctgctaattggtttcttcaacctcccaccaaactgtagcacactatctgattggaagagacgggaactaacacgacgtgtaatagacggaagaaacggattaattgccttcaccgtcgtagtcgtgctgataacacagagctccattttcgctctctcttcttgcttatactgaacagagctaatgaatgaagcgccacttcttcttgcttctactttcagataaacagagttatctccttaaaacgctgcgtttcgactaatcaacaaatctctctttaaaacgctacgtttcaactaattaacaattatctcactaaaacgccgcgttttgaagccatatcacataaatacgccgcgtttgtggctatatcacatcaaaacgcagcgttttctagctgatagataaagcaactattttcccggctagtgagaagagagagaagagaatg

SEQ ID NO: 1129 - DNA, 3000 bp, Unknown
  misc_feature (1)..( 3000): cDNA_ID_2130810_gDNA_ID_1620362_Annot_ID_154672 3000 nt of promoter + ATG
tgacgcgtgaaatgtggtgaaaaaggttaagtaaggtttcaagcgatcgatcttttcttggggagaggtgttcttttttccttctcatttcagtaattaattttgtgcatgtacatgcacatgcttattcgcttacgcgttcacaacataagagtaaaaataaattatgtgtgatatacgtaatcaaaacatattaattttagacagcctctcgtactaataatgtagtaatgcatttgtaatatgttaccaggtgtgagagaactatctttggaatatggttgattttacatgtggtgatcatttgaattcattattataggttagcacttaccaatgctaactttcatgttatttttttattgataccatgttaatcagagtgttctatatatatcggtttttttaaaaaaacttcaaattataatgacaacatataacaaaaatagaaaataaagatgaggattctaactctttcgaccaaaggaaaccatgcaaatggctgaactttacggttcagaatcggtgttttttcatggatctccgctaatcgagttttcgtttatgtttttcttgtttgtgttgtattgtagtttttggtggtttttttttttatgttctctgtatgtaaatttcaaaaatgatataaatttaactttttaccaaaaaaatataaactaaaataaaaactgcatatgcgtgacaaaccatgacggaatccatcgctttgcctcatgggacggtctgagatgattcaggcgagatgcaaggagacgcaaaggcgtgattttgattaaaagaaaattacttattgattttatttgtcgtgaaaaccacgaaccactaatttatatatttctaaataaagcaaattgaagctatatacatcctgcctctaatggacacttgctttaacttgaattctaaagttctcgatccgcatacgcccaatcaaccacgattatataatttaatatatgaaaggccatttttacattgtaacttgtaacaatagaataatatgaaaataatctatataagtcaataaataaaagtttttactttagaaacacatgagcaagctttgtaaggctaagttccttccatcgtcactagtcttctgttcatatcagacaatctcttacataaatgatgtacaactccgttctctttagtcttttccatggagtaattcaactctttttttcattctatctctaatcttctaatatggtaccatagttccaagtataattacccgacatatgatttctcatagtatacatatatagtcagtggcggatctagaaccataattaacccgaggcacaacatatttataaatttttaaaataaagtacaatatgaacatttcttaaaagacatgtaaatggaagaaaattttttgaagtgtcaatcaacattggcagtaccttatattagcataattccttcaaacagttatagaaaaagataaataaagtaaaaataagttaaatactgaaaacatttattacttgaaaatagtaaaattaatgagtaataaccaactgactagaaaaaaagtcactctaacatggggcacaacaaacgaattctttcatctacaatacaaattgcacaacaaacttcaaaattatcaaatcttgcatggggcacgtgccccagtacttatacacttgcgtccgccaatgtatatagtccgttttgtagtgatatgtccgagacaatgaatatctcacattacaaatgaaaatacaaggtatatagatctttccactttattttaagttacaaacaaacccgtgattcctgatataaatatgtgtaatggaatccgaattatgatgtccattagtacgatgatgaccattaattaaactaatacaacttgctttgttaaatgtatgtttttgcataaatgtgtacaatctatatttagtttttgaaacagttatataaaatttgaatgtccctatagtagcttacactaatatagctctatacaccaacgatcgaactatcgaagaaaattcttgaataaaccagtcaaagacgtccacaaggcacaaatattatatacggtgttgaagaaagcaatagagagaggtcaacgctttcctccaatttgttaaacaatgtataaactttacgtcaaaaaagtcaaaaccattcccttgttgcttattggtcattttccgacctatacgataatcttattgtttctctacgatatctttctgttgcattaactattaagccacacgcaaagtcgttttacattaacgttagtttaattagataacgttagtttaattagtattatttctacagagtaattgctttcgaaacttttgaaaacaatgtgccatacaggttgttcaaacatggttagatagatgcataaaattacaaaaattatatagagagaatattaaatcacttaaccattgtatcatgaggagatagcttgaaagccctgacaaagaaagagggttcataagttacctaaaaaagaaagaaagagagctcataatattttcatcaaagtaaaaactcaatgtggataaccgtcacatcaagacgaggcagatactagattgagcaaaattctccaatgaaatcacaaatgttgaagcactttaaatttggagatttcactgctttttcactcttagggtggcttacatttattaaagttaaggttatggggaaaaaatataaactttcttaagcagggttgaaaacgcaaaaacataaagaatgcacgtcgttgttagttattttctcccaaatgcgtgtggttttattacttttcaaacggcaagtaaaaaagtcttataaacgacgtcatttagtcgacttgatctcttttgtaagtcatcacatctttgggtcaatcacgaatttggaacatccggttccaaattacggattacacagaccctagcctcttccccaaatcccaattctccattgctttagaagaatcacacaatg

SEQ ID NO: 1130 - DNA, 3000 bp, Unknown
  misc_feature (1)..( 3000): cDNA_ID_1712051_gDNA_ID_1620362_Annot_ID_154679 3000 nt of promoter + ATG
cagtcaacggacaaaacgttgactatttttattgacgccgtggtggatctctgtctttaaccggtatttaaccgcgaaccaggttggtaggccgggttgggttttaagagaattcatgcacttacgaaatttattaatttacctagttaaataaactaaatttggatgtcttttgaatgaaacataatcccaacatatggcagataatgaattcatgaatctttgaatgaaacataattccaatatgtatatgtatgtatgtctatataaatgtacacccaagaccaccacaaatcattctcaataagtattaaaatattacaaatacaaaaggtaagttaaattacaaatatttagaatatgctcctcttatactagattttcgtttttgttttaacaataactttgaaactcgattttagtaggttttgctttttcctgagacttaaatactatagtttgagaaggagttatagaatcctctacaaaaataacaaatgacaaccaaaatggtttcatctcatcgactactcacgttgatggtgtttgctctcctcctcatacctatgatttctggtaacatgtttatttgttatatatattatattttttttcaatatttgttcattttttatcttaaaaataaaactctaaaatattaaattggacatttttgcttttaaattttttgttgatgaatttgtttatgaaccgaataggacaatcatcaaaatgtacaaaaggatgtacgagcacaccagaatgcaatataaaatgcatgaagaaaggcggagggcattgtcaagcatatataggcagaagtcacggccgattggctattgaaaattattgttgctgcaataattattcaaattctcccatctccagtccggtcatgaattgattgatctcttattctatatgtactctcgattataagaatcaaaaacgtatgttcaaataataataactgatattatctcatccccccccctctcatcatgttgtttgatgtacatgtataagaaaactacatcgatcggctcgacttatagttttgtttattgtgtcatcaggacatcgattttgtcttacctctctaatcttcgcaaccaaaaaaactacttctttcaatgttcacttccaaagatgattttgtaaatacgaaaacttatgcatgaaactgtaaatacaaaatcaatcgccaagcataatataagatcatgtatttactctttttatatcaaggtacatatatatttctgagattcctacgttttcatggaatatagaaataaattgactatatatatatacaataagataatattttggggtgttttctttatatgtagagaggatgtgcgagtgggggggagggaagaaggaagagttccttcgacggcggaggagttcacaagacaaggtgttgctagccagacaatgatgataagagattgtagaaggtttatgacggagctgcagcggctgcaaacgtctctggtgattctgagatggaggtggagaaagtaaaccgaacttgtttaaaggaaacgaatatctagtttgttttgcacaagtacaaacgtcccatgtctttgaatcaaaattactgctagaaagaaaaaaaaaaaaatcgacaacatctccaaagttttatttcaaggacccgaaacgacaatgcctaacttccatggattggtggacaaggctaacgaaagaagaaaatattgattagtggagaaattggttgtcgttcccaaaaaaagttagtaactcttacgatatgagaagaaaattagtacctcttacattttttttaacaaagataaatgttgtgattagttctgtttgaaaggactaaacccttacatgaaaagtttaacatgttctacatagtttggatttgtcacttaaaataatattggtgcttaaactcttacttttgtgataatatttttctcgagattgtagtaaaagatgaagaaaggatatcttgtgtaatctggatacaacacaatctggatatcttattgtcaatctctatgtattgtgagaagttgatactaacaagatgatttgtgcaagtagatacaaatcttgcatgtgtaagttgatactcgacgataccttgaaactgattgactgtttgttgatcggatcataaccaaaaatttggataggcaacaacactgaactatagactttaccggctatctcgacaaaatgatcatcatgacgagatcaacatggatcataatcaaagtatacgtcgtcgtaccgttcaactgccaccgtatcctggagcttagcttcgagggtcgaaataaagtgctctatttctgtcttcttgagcttttaactcttccaattaccgaacaatttccgacgaatctccgacgtccgactccatcacgacaatgtttaaagagccaatagtagaaccctagaggttaaagcagcaaagaagacgatgtcagtcaacgggacaaaacgtacgttgactatttttattgtcattaaccggatttaaccgcgaaccagattggtagaccggttgggtttttaagagaattcatgaacttacgaatttatttatttacctattaaaataaactaaatttgaatgaaatataatcccaatgacagataagaataaataatgaaacattttgactaaaattattatctgacccaaataagactataaaaaagaagaaaaaatccttgaataatatggaagatttattatttacatatatatatatatatgtatatacgtatgtctatataaatgtacatccaagaccaccacaaatcattctcaataagtactgaaatattacaaatacaaaaggtaagtcaaaaataatataaaatatttagaatatgttactagatttttgtttttgttataacaataactttgaaattcgcttttaataggttttgagaagcaggtatagaatcatcttgaaagaataacaaataacaaccaaa

SEQ ID NO: 1131 - DNA, 3000 bp, Unknown
  misc_feature (1)..( 3000): cDNA_ID_2130832_gDNA_ID_1620362_Annot_ID_154682 3000 nt of promoter + ATG
atttgatcttaaaccagcccaatagcccattacgaatgcttgattaaacggcagtgttttcatgtacgaattccacgctctcctagccgtcggatgataagctacaatgattatgagccgttcgatatatcaccacaagaatctgtagatcaaaagtgagtgcgatcaagaactggtttcagtcacttttttgacaagtctctctttctcaaaagtcaaccccttattttgcaatactgtattgtgaatctctctatcaggccttcgtatttctcacagactggagtttttgtttcataaaatctgataaaaggaaagatgtctaaccctcaagatgacaagcccatcgaccaagaacaagaagctcatgtcattctcaaggtcaagagccaggttttttcactgtgttccctctttaatctccttgaaattttctgtcgttgctgcttggttgataatactatatatacagtttcttgatatgaaaactttgatgatactcttttccaaactgtgatgatctaaagtatagagtgattaaaatcttttttcttgattggtgatactaaggatggagacgaagtcttatttaagaacaaaaaaagcgctccacttaaaaagctcatgtatgtttactgcgaccgccgaggtttgaaattagacgcattcgctttcatttttaatggagctcgtataggtggcctggagactccagatgaggcaaatcactctctttttcatttcccttttacaatttatatgtttgtcaaaagtgtatcatttactaaaccaagattctccaattttaaagcttgatatggaagatggagatgtgatagatgcgtgccgggcgatgagtggtggtctacgagcaaatcagcgtcagtggtcttatatgcttttcgatcataatgggctttaattaggaataatttggctggctttgtgatatttgactactttcttcaagcaaaattacttgaagtttaaatcatggtcggttatcgtgtgtgtaaatgactcatgagtgattggatcttatgaattatgatattaatggtatctggttacggatttttagaatctttgtactttgttaattttacaaccgtgaataaacaactcatcaaaacctctaaaactcaagttggctaattgtaaaaggtcacacaacaaaaccatattaaacaattgaaatctttactggtttgatcaaaatcaaacggttcactttgaacatcttcacttttcccaactcaaacaaatctactcgaaagctgagattttcacattttaaaattcttgggtagacacagaagtaaccagcccatttgagcccattaagaatgctaaaacgacatcattttaagttagagattatactcactcacagccgtcgaatgatatagatcaatgattatgaaccgttagataaacaagaatccgatgcgaccaaagatagtggtttcagtcttttttattctctgccgagtctctctctctccctcaaaccctcaagttctgcaatcccgcgaatctctcttagggcttcgcttatatcgcagatcgaagttcttgtttccaatcgccgaccgtataatctgataataaagtaagatgtctgctactccggaagaagacaagaagcctgaccaaggagctcacatcaatctcaaagtcaagggacaggttttctatttctcactcactctctcgacttctatttcttgcattgtgtaacgattcgttgtctggttaaagttttgagtgtgattaggatctttatagcttctgattgcttcaattctagggttttgagtttgtctgcgttattcccaatttctattctggttagcttgtctatgaggtagtgattattgtgtaagcgtgacttttaattggcttaaatttgaagcaaacaaaagttatctgagaattgtgaattatgttttgactcataattgtagcaaacaaaacattactactcttgtatgtgtgagggtgtgtattggtggagacagtgattatcttcgaagaaattgttgtaatgttgtgagttgtgactaagctaacaatttataaccttgaactctcactatagcctattgtagttatgcttttggagtatggagcatttgtttcatgaaagcttttcgttgctatgatttgttttgcttatgtttctgtacccattggtaggcatttttcgttgttggtacttggttggttatagatacagtttttggtattgagaaaatcgtatataatactcttcttgaagtaacaatcattggtaatttttcttgtgtaggatggtaatgaagtcttctttaggatcaagagaagcactcagctcaaaaaactgatgaatgcttactgtgaccgtcagtctgtggatttcaactcaattgctttcttgtttgatggtcgtcgtcttcgtgccgagcagactccagatgaggtaacatcactctctgtaccccattctcttttactgttttccgtttttcaaagttgtatgatttccttaaccgagaatcttcaattttacagcttgaaatggaagatggagatgagatcgatgcaatgcttcatcagactggtggtggtgctaaaaatggcctgaagctcttctgcttttagtggcggttattttaatggttttccataagattgtgtgatattaatggatttagtgaatcggctttagattaaatttggcaggctttgttttactttgaccagtttctacttactggtgaaagtctatgtgaatcatgaaacttattggatcttaaaatattaatgggcttgtttatggattttggaatctttcgattggctttagcttaaagtaaacgcacaagttgccgagtatggtaattagtcaaacttgctccccacggttccttggatcccaagtttctactggctatataagaacagttctcttcttttttttccataagctccggtttctctgtaccctcgtaaataatg

SEQ ID NO: 1132 - DNA, 3000 bp, Unknown
  misc_feature (1)..( 3000): cDNA_ID_3060823_gDNA_ID_1620362_Annot_ID_154686 3000 nt of promoter + ATG
tcaagaaaaaagattttaatcactctatactttagatcatcacagtttggaaaagagtatcatcaaagttttcatatcaagaaactgtatatatagtattatcaaccaagcagcaacgacagaaaatttcaaggagattaaagagggaacacagtgaaaaaacctggctcttgaccttgagaatgacatgagcttcttgttcttggtcgatgggcttgtcatcttgagggttagacatctttccttttatcagattttatgaaacaaaaactccagtctgtgagaaatacgaaggcctgatagagagattcacaatacagtattgcaaaataaggggttgacttttgagaaagagagacttgtcaaaaaagtgactgaaaccagttcttgatcgcactcacttttgatctacagattcttgtggtgatatatcgaacggctcataatcattgtagcttatcatccgacggctaggagagcgtggaattcgtacatgaaaacactgccgtttaatcaagcattcgtaatgggctattgggctggtttaagatcaaatatgctcatatgtgggcttaattacttctacacagtatataaagttggaacccattttcgtgaaccgaccaaatagtttttagaaaatttataaatcatatttaaaaataaaatctaattaccacggtaatctaataatttcaaaaaaaatacaacagttagaaacttttaaaaatcttagcaaacataacttttgtggtattttaaaaagaaactcaaaattatgatattatttgacaaagtttagggcaagctctctttataaaatttatatatttcttgatgttctaaacttctaatgcatgcatggttattatttaatattaaaaaataatgtacgtcgaccgtcatagtgtgtaaatggttagtctatgtttcgtgacgacttctatttcggcccgacataatatatttccagtttttaatttgataaactaataggcattgtatcgtaacgtaaagatcagggacaatgctaacattcctatctaaaactcaatttgttggacagcatccaagtgacctaccacattgaattctttctcttggttgataagaaactaataatgatgatgttatatttatacgaatatattagttaacgtttatatttagaaattcgtcataaactcataatagttacaaataagtcaatctgaaggtgacacacctctctggatattataatgttttcaattttcatatggacttgtcattgtgtttcattttcaatttcatgtaccgacttaagacttaagggccttgtcgaaacataccgtacgatgtcgacaacctccatagatacattattaaattattgttactttcataatccaaaaattaaattgttatactaaagtatatgtaaaccagcatacattgatacatataagattaccacctagtggacaagttgatacacaaacaaaaacatgtatataatcatcaaatacaatattaccaaatgatgatgtctattattttctcttttgatagtggagttattatgatgtctactcttaattagtttcattattcaggtctcaatcaccgaagataaaactatatttcaaactgtagtagtaattaccgtatgtgtattaacattctatgcctatatgtacataaccgttaatattcggccacaattattaaattcaaataaatctaaaaagcatctttcaccaagtaattagtaaaactagccgtaaatgtcatccaaaattcttggttttacatcagaaggaaacattaattgcttagcgatagagttctatttgtataggacaactaaactctacaaatatcgttttttgtttatccatggacggagatggaccatttagattaattcattattatactactggaaaataatttgaggtgtttgcttagcttagctaaccttaaaatgttcatttttcctccgcacatctaaacgcgttcattagcccaatttgctaagtcaaaatattagttacaaccaacttgtgaatcagtcaatgttactatcaaatatttcatataaatctatacttggatttacaaatttatcgaaacatatctaaacacaattattaacataataactccaaccattcaaaataataataaaaaggacggaatatttaggacgtacgaaaaagagacgttggaaatcagagagctcaacgttcaaaatttggtacatgtatagaacaatgaatgacacatggccccattgtagattcttcatttctcgacgagacccagttaccattaatttacataataattctaattccgaccaatcaatgcatcacattatcgattaataattatcactcctccgaccagtttttttcacctattaatcctaactttaacggataattagcagctgttttcaaccagtgattaataggtatttattaccagctgatactacatgttttatttgcctcagtgcccaaatcccaataattatggaacgtattaaaagtgttgttgcaaatgcaattgtatgtctaaacaaattcgttttgttatacaattcattttatgcagaacataacgttaataaaatcccccaaaaaaggaaaaaagctgcagtaaaatcgaccctaattaattaaaagtgaatgctaattttggcacgtacccccacaatctctgacaacatttggtacaacaatctccaatcagtacacgactgaaacggtcaaatccacaattaaaataatatttactttagacacgtcatcgagttgaaatatttacatcacaaaaccgtacagttaaaaaaaacaaagtcatccccaatatctcacgtgggtcctacccactacatccacctccctcgttctccttcttcttcgtctctctatataaacaccatctttagcttctccttcaccggaatacaaaaactgaaacctttctctatttatctctctatacacaaca

SEQ ID NO: 1133 - DNA, 3000 bp, Unknown
  misc_feature (1)..( 3000): cDNA_ID_2109489_gDNA_ID_1620362_Annot_ID_154675 3000 nt of promoter + ATG
atgtaagagattgtctgatatgaacagaagactagtgacgatggaaggaacttagccttacaaagcttgctcatgtgtttctaaagtaaaaacttttatttattgacttatatagattattttcatattattctattgttacaagttacaatgtaaaaatggcctttcatatattaaattatataatcgtggttgattgggcgtatgcggatcgagaactttagaattcaagttaaagcaagtgtccattagaggcaggatgtatatagcttcaatttgctttatttagaaatatataaattagtggttcgtggttttcacgacaaataaaatcaataagtaattttcttttaatcaaaatcacgcctttgcgtctccttgcatctcgcctgaatcatctcagaccgtcccatgaggcaaagcgatggattccgtcatggtttgtcacgcatatgcagtttttattttagtttatatttttttggtaaaaagttaaatttatatcatttttgaaatttacatacagagaacataaaaaaaaaaaccaccaaaaactacaatacaacacaaacaagaaaaacataaacgaaaactcgattagcggagatccatgaaaaaacaccgattctgaaccgtaaagttcagccatttgcatggtttcctttggtcgaaagagttagaatcctcatctttattttctatttttgttatatgttgtcattataatttgaagtttttttaaaaaaaccgatatatatagaacactctgattaacatggtatcaataaaaaaataacatgaaagttagcattggtaagtgctaacctataataatgaattcaaatgatcaccacatgtaaaatcaaccatattccaaagatagttctctcacacctggtaacatattacaaatgcattactacattattagtacgagaggctgtctaaaattaatatgttttgattacgtatatcacacataatttatttttactcttatgttgtgaacgcgtaagcgaataagcatgtgcatgtacatgcacaaaattaattactgaaatgagaaggaaaaaagaacacctctccccaagaaaagatcgatcgcttgaaaccttacttaacctttttcaccacatttcacgcgtcaactcgtctcgatcacaactataaaccctaagtccaccctctcctcaattcttcacagctcaatctctctctctctctcccaaattctcttcctagctctctacattcacataatttaaacaagaagaagaagaagaaggagacaaagaaaggaagaagaacaatatatctcgctgtaactcactaacacattcatagatcaagagaaaatggcccatttcatgaagctactcgtgacaattgcattaacaaccgtggtcacaatcgccatcgtcaccaccaaaaccaccaccaagaccgcaacatttgctctcgaagaccctttcaaggaccttacaccaccaggaacgatcaagatcagaccaagtcggttcttggcagaaaaagtcgacaagggtaaagaaccaaaagcccgtaacccaaacgcagctgaccattgcaacaaggacaatgaaatctgtagcagcagcgattacagcacaggagcaaacgctacaatggcttgttgcaacaacaagtgtatggatttatcaaccgacgacaaaaactgcggtttatgtaagaacaaatgcaagttcgggcaaacgtgttgtcgtggtcagtgcgtttacgtggcctacgataaacgccattgcggtgagtgtaaccatcgttgcgatctcggcgagttctgcgtctacggtctctgtaactacgcgtgatgaatcaatcattcattcacgccaacgtaaaaaaaaaaaaaaaaaaaaaatttaactaaaattatacggatgatttatttacatggacgctgattaaaaaaggtcggtccaattaattatttacttaataattaattaaagtgttgtgtgtatttttggattcccataatgttttgaggggtatataaaggagattattttttctattttcaatgtctacgaataaaatggaacatcctcgttccaatatatactgctgttttattactaaggtttataattggagtgtataaaaacactccaaaataatatcatgaataatgtttttatacgtataatacataaaataaaatctctttcctcatagctggtcctctgattactatcaaacatatgattcaattgcaaatttgcaattattaatgcaagaagaatgagtggaacattaaagttagatcaaaaactcttcattacaaacataaataaattcattttggtgctttctaaattaatttattgatcattttttggtatgtagctaggggttaactcatcaggaagaacattacctagatgatgtcattgtcaaagtcaataggttgacttatccgatggatactaatccaacgggtcaaaaagtgccaaatcgggtcaaaatcaaaaacctcaaagatgacccgtgaacacttgtttttatcttcctcacaaaatccacacgtccaaatcacaacctcaaaatctcacacatcaaacacgtgaatttgctctctttctggttcactcacctaccattactataagtctgaaagagtgattgaaacccacctcgaaaaatctatccttttttttgttttccttctccggcgaatccccggggagattggtaatcggtaatcacggctatttacgggataaagccacggcctttgagctttcatgtccaacgaaagggttgtttaatcataactaatcctttgcctcacggaggacgtggagctctgccgtctgaaggcggcagtccctccgatctcctcttcctcgccggaggcggttccacaaatagccactaaccctaaccctttttctaattaggtttttagttcttagagtcctgtattaatctgttatttcgagattataatatttgtgagca

SEQ ID NO: 1134 - DNA, 3000 bp, Unknown
  misc_feature (1)..( 3000): cDNA_ID_2130798_gDNA_ID_1620362_Annot_ID_154668 3000 nt of promoter + ATG
taccttttctatctctgaagtcttagtgtttatatccttgtaggaaggtccgctgttgacggaagatcttattagagaaacagaggaattagtacttcggacagggaggtcagtgccatcttttatttgttgtagtttgatataaaatttacactccacagcgattctggtgattgaaagtgaaccaatctgctaatgaattctgagttggtgattgaaagaccagtaacagtcagttagattgaaataatagacgtattatctggctgaataatatataattccgtttcgttattcagacatccaattatcttgatagattggattattgtctttcttatggttcagcatgggggctggatgttctcaactcttgtctgacatgcaggctttcaaggtgatcatcttaatgaataatcttattactgtttggtatataagcactcatgtaaggaaagaaattgtagctgatatgaaattgataagatctgtacctctgtattaggcagcaaatcctggctgtattttggaagattttgtgagatggcactcgccaccagactggactgaaaatggtaacatgtctggagatgactcttcacccgttcgaggtcaattaagtacccggatgcagaaagaaggtgtgaccatttctcagtttctctatgttgttaaaccattactgtaatatttcaagtcgtattctcaactggtcttaccaacgttttaaaaaaaatattattaggtaatttatggcgtgagctgtgggaaacagctaaaccactccctgctgttaaacaagcacctctctttgatgaagatttagctgtgtaagtttcaatagcatgtcctcttaaacgtagtgaaatctgtatttgatcactcatggagatcttgtccatttctcatttaacttatacagagaaggaatcttgaattatttggaagacattccagctgctgaactttttgagcagctgtttacttcgctagtaagtttttcccaacaaattgcgtatttttctttttgtgaagctttctatctgtaaggtcaatctcaaattctctcacttgcgctacgttaaatggatgtcattggttacacagttaaggttttagctgtaaatagcactttgacgattggattggttaaaaatatttcaggtttccctggggtttgtgatggtggagccagttttagctacaaacgatgacttgtcaaagcttttctttgaatgcaaggattatgtagtcgctatttgtcaggggggcgcatggaccgataagcttgatgatctatgccaggtactttactagagagctttgcacagattcaaaaacgtatctacatgcttggaaatctatcactttaatagagttaagaatgttttatcagatgccaaagtaaggccatgtggatatgaacattatgctcactaatcatacatcctaattgcatttatttggtcataataggtatacgagaccgtggaaacaatgttattacgtccagaagaagttttgagatcaatgaaacaaacagaggagtcgccatcaagtggcagcgaaacgaaacggcggtttaagcggctaggtttcatctttcgtggtagtaaagaaagaaagcagacaagagttccatcagaaactgaacagaaaagcaccgaacctagcccacgccaatcattctctagtctttttgatggcaagtcgtctctgttttcaaagagacctcctagacctgaaaatgtgacgcttgtctgaatccatattatttatttgatttgtttcatctgcttttaagtcatttctcagttttttgtattcttcttctggggttttaggttgttaagttgatcaattggttggtaactgtaaagttatcttatttaaaacatttctgaaggtatggtgaaatgcaaataaatggaaatgaataagatgtgtaaaagcttttagaacatttgtgtaaattattagatttctgagatgctgttttagatggttgcctaaaattaagaagttgaaagagttgaatgaacattcaaaccaattttttaccatttaagataaataagttggaaaaatgattcaacctaaaaagttgaaaaaatgaattaattataaagaattttttctcaacttgttcatctcctattttgcagagaaatgaactgaattttattcatttcttttttcaactcaaatttttcatccatatgcaaccatttgcaccttaaggtttctacacaagatatacataagaaaaatcaaaactctctagagttggttactttcccacaataaacttttcctaatgtttaggttgttgtttgatcaattccttggtaactgtaagtaaattgtttcattataacatttctcaaagtgatggcaaaaaaaaagaaaaaaaacatttctcaaagaaaataacatgggccgttgggcctatggactatttgatgttactaaaacgcagacgttttcgagagttcatattactgaatccaaatttagaagcgtaataataatcagagatcttataataataatgttcatattattcgttttacacaaggaaataagacacgtgtaaaatcctctgaattttccatattctttcgtgacttgctcaaagcagagaaaggtcatatgcttttctccagttcctctctctgtctatctctctcctccttcaataatttctgcaaaccctaactttctcattcggcgctcaagtttctctccaccccttcggtgagatttcaattcctcggttttctcttgttttcattttcgtcttgttgctgaaagtcacgaatctgagcagtttttatgttttgaaagccataatagcaggatttaggtttctgattttgagaaagtagtgttgaggatgaacagattccattttccgacgatttttgattgattgtgttgcgtttatgattacgagtgttgaatctcaccgacatcttgttgttacagagatttggtgcg

SEQ ID NO: 1135 - DNA, 661 bp, Unknown
  misc_feature (1)..( 661): cDNA_ID_3060879_gDNA_ID_1620363_Annot_ID_154713 3000 nt of promoter + ATG
gatctctcatcttgttcataatacttttttctcctctaaccaactagacagtctatgaaactcaaataatataatttttaattttcggtcaaaactgtaaaaacatgtcaaaatcaaataatattttttttttgccaaatcagaaaattacatttttccgccaatgtaaaaataatttttagagtgacattgtcagtataaatcctaatttatgttttaatattatagctaaagtctataattatttttggctgcttcttgcatattattattctaagtttggtttttgtttttatctgagaaatttctactatataatgaatatttgaaactgtagtctatatatttagatttaatattttatacaacaagttgatatggccgagttggtctaaggcgccagattaaggttctggtccgaaagggcgtgggttcaaatcccactgtcaacattcacttttttctctttttccattatttacttgctgacgtgtactcaccttatcttacattatttgatgacgtgtaattttagtggtcactaatcgagagagtgagacgaaacgataaggagaagaacttcttcttcaacctcagaaaaccctaatttctccatttcgaaactccaacgaattctctggtgattttaccaatggcgatg

SEQ ID NO: 1136 - DNA, 3000 bp, Unknown
  misc_feature (1)..( 3000): cDNA_ID_2131097_gDNA_ID_1620363_Annot_ID_154725 3000 nt of promoter + ATG
gaaccaagtcgttgaagatgttgagtgatcagaaaacgaagcttctcttcgccgttgatggtagagccaagttcgagcctcaactgccaaaagggtacttcggaaatggaattgttctcacaaactccatctgtgaagctggggagcttatcgaaaaaccgttgagtttcgcggtgggattagtcagagaagccattaagatggtaactgatgggtacatgagatctgctattgattacttcgaagtcacgagagcaagaccttctctttcctcgactcttctgatcactacatggtcaagattgggtttccacacgacagatttcggttggggagaaccgattttatccggtccagtagctttgcctgagaaagaagtaactctgtttttgtctcatggagaacagaggagaagcatcaatgtgcttcttggacttcccgctacagccatggatgtgtttcaagaacagtttttacagatataatatgaacaacgacaaaatacaaatatctggcaattattgtcaaaacctattcgttttactctgtttttcttgcttccttttttttttatctttttgatttatgctgaattattattgttatcttcatcttaaacttgtctgtatcttgcatcaagtttcaaccataaatttatattatttcaaactatattgtaataatattattacttgaactgtttcagagatgttgatgtttttaacaaactaaaactcatatataaataaaataacaaaagtctaaagataaaatacagaggacaagaagacagaacagagtgatcctgttcttgtcttaaggacaaagttagagtagaaacaaacaaagacttagattattgcagtttgttctctattacttgccacacaaatgaagattcttctctaaaggtctgaaatttaaagcagtaaacccatagacacagagattagatatcttggacttaaacacaacctgctccgttgtagttctgaagccaggaacgttgcaggaatctttggacctaccgatcaagcttgcttgacaggaagccattagagaatctttctttgcttcagcggcgcaagcaacgccttccagagacgttatgtctagcttgtagagtccaagctcatttgtggttcgatttgcagagaacgtaatcatctctctagttctcgatgaagctgaattgaatctgcagattattctcacttccacacctgtatttttttgttcagttaaaacaaaagtgagagacattttaactataatttcaaacaatgttgataagattctttaccgggaatgaaatagctgtgattggagaaactgttgttggagcagacgtcgcagtaaacaagacccattacagtgatctttccatttggtttggctgaagaatgtttcagagacagagagtttaaggacagaagttgcagaagtaacagaagcattatcagtttctgcttcatgttcacaagtttcagtttttttctttatccttggataaacacttgtttacagatgaggtttcctttttgtttatgtggttgatgaaagaaacagacaaagaatgggccaagtggttaaagacaaaagaacaaacaaagatcaaacagtaactccattcaaacaaagcttcaagcttgtcttttttataaaactcaagactcttgtggaaaaagagatgagtaaagagaggcacaaagagatgagaggccaattaaaggaaaagtagagaaactgagagattggttggttaggtttaacatttattgagctctcatgctctctattttaagggtttttgtctatgaatccccttataaaaaatggctaaaactggaaaatggaagggagaaggtaagccactagtgtgtatatatatgtgtatggaccactgaaagtgaagtgtaaacatcatcaattcatcagcataaacaccaagaaagtagtcagaggatatggctctttaaatatcaatacaagaagccaaactatgatattttcccggtttactctcggttgtggctgaattctggaaagagaatttcaggttaactaactatacaaagataagctcacattatagacttttgttcgtcacattatagaacagcataagactttattgcataacaatttcaggtttaagtgtactagagaagataagcttacattacaagttcatcagttggaaacaatatatgggcttgagctttaaagaaggcccattaagcttgaaattgttcttcatgtaagattgctgcagattttactttaattttttttttctttttttcttttgcccttaaattcttgtaatgcttctaggtgactccatccactttatgtgttgtttcccaatcatttctattttcaactttattttttcctttcacaaattattttaagttttaacattattttcttcaacatacgaaatttatacagtagtttttttttgcaggtacatataaatcaatagttgagaaaaagtggaaaacaatagagataaaaaaaattagatgtaaattcgctgtaaaacaaaatgtttaaatttcttttccgttatcgaatctcttttatgaataacaaggtcgagtactcaaggtaaggaaacagaccattagaaaagtgccacgtcagcttatttcgttcttcacttttagcttctgaaaagtactttacctgaactaaaacgacggtgacagactgactccagtagctgctaacagtcgatttttaaaatattatatttatttgcaggaaaaaaaaaaagtgaaggaagaagaagaagttggagaagccaagagcaaatctaattctctgactactctcattttcatgtcggagacttgccgaaatctaaagaatttcttcaacggagactgaaaagctttctcttttcttctttcgttatcttcgttttagtgttttcccctttgcttacatttgaagaaatcgagagcaagcgatagaaagtgagagagagag

SEQ ID NO: 1137 - DNA, 3000 bp, Unknown
  misc_feature (1)..( 3000): cDNA_ID_3060869_gDNA_ID_1620363_Annot_ID_154727 3000 nt of promoter + ATG
gtatatcttcatgtcactctttatacaaggatgagacagggatttacaagaacctgcttcaagagacagcacatagagctggtcttgatctaccaatgtacacaagtgtgagatcaggatcttgtcacttcccaggtttctcttgtactgttgaacttgctgggatgacgtttacaggagaatcagcaaagacaaagaaacaagctgagaaaaacgcagccattgcagcttggtcctctttgaagaaaagtatatataactatcttccaaattgttccatcaaccccaaaaaagcttctcacttttctacttgaaaccatttttctgtttctctactgtgcagtgtcaagcttggattcacaagatgaagagaaggaacaagaagcagtagcaagagtactctcaagatttaaacccaaagaagtaagaagacgagagacaacaaaccaatggagaagaagaacaagtcaacaagattcaaacaaggatttgttgattgagagattgagatggatcaatcttttgaccaatcaagcttcttcatcatcatcaacatcaacaccgaatcaacacaaaaactccagtttcatctctctaattcccccaccaccaccacctaaatcctccaaaattttgccatttatccagcaatacaaagacagatcatcacaagaagctaagacagagacagcgacagagatgatcaacagcaaagccaaagtcaatgaaacatcaaccagattgagtaagcaaatgcccttttccgacatgaacagatacaactttgtcggagggtgtagcgtaaacccttatagtctggctccagcggttcaaatgagatcagtgattccagttttcgcagctccaccaccgaaaccaaaccccaaccttaacccatcatcattatcatcatcagtcaatgaattcacctcatccaataattcctgctctgttctgaatacgccgggattgggaggccaagagaagaagaatctaactcgcgaaatgatcaaacttggttcagaatcgagaattttggatcaaacccatgatagttagctaaatttggttaatgggttaatctcaaattaaatccttgtcaagtgtttgtcacatagataaattatagaccagtatgtttccgtttcttgaatgtgttcttgttttttttgaagtgtttgaattttctaaaagtccgacatgaactttgaatgcttgcgaattgcacagagaacgaaaacaaagagagagcattaattagggaagaagatgaagaagagaaatgggagtttgcaagaaaacaattaatgggttttgttttgtcttcctccattaatgcgccgaatgctctgctctgcttcccactcttcatcattaatggttttgctctgtaacgtcggttccaacaaataaacttaataattcgaaattataaatttcacaagttacatttttctttgtgtaaagattttggaccatataaacattatggtttgcgagaatgacgtttgtgtcattatccgatttagatccgtataatctatgttgttaggaactcaggattttgctcaaatattcaaattggtatattttgactttgatgaaattattttggtcagaccacgagacttgattgcttctcaattatttgggccggtccattaatttggggccatctaacttttacgtgggccgtaacaaaccgaaacataaaactagtgacctacctaaccatattaccccaaccggacaggaggtaacgagttaaccagccacttgttcggcttggaaatttttttaatcgtctgacaatttatgacgtggatccaagtagcaagaaagctaacatgttgttggatctgatctgatccacgaacctaccataaatcaattttctcattatcttgacaggtatatcttgcattattatacgtcagattttcgtggatacaatatttttaaaatgcaatccatatttacttgatttccaaaaatgggttttttcaaaagcacaatttccaaaaatggatcacaatttattaacggattctcaacttgcaaatcaagcttaaattataatcttttttaactcagaatttaatataatctttttttactcagaattgattaaactaacagttatattgatcttgaaatcacctttaatatcttgttttaaatcttgtgtcttgcaaatcacggttcataaatattggagaatcgaataaataaattatttctattcctatattgcgtaattttattttttgactctctattgcgtaattacactcgtcagatttcgtggatgagtactcagtaaatcttattttaattaaaaagcttactagtctaattgctgcaaatttgaccaactatacagttgtgttgcattacaatatttcaaaccattaataaaacgtgtaaaacatatttggagttgaatgaaactacattttcctttatgtcaaacgcacttttcaagatatatctcgaacaatttacgtattattttcacaaattttgttccacaataatttaggttattttggtttttgttgttgttttttgagtctgaaatttcaaatttgtatttttttttaatatatatttaggcaggaatctttaaaatgaaaccaataatatattcactaagtttggaaaaaaaccaaaatttcataattaacgggacaatgactaagctgtggaaaagataacataatctcccaatgactcaatgccacgtataagatgagaaccgtactcttctgtgttcgtaccagatccctcaaaaggcgggaagaaaccatcaagaaaggcacattgctgacgtggaatggaatattcgaacacgcatatccagctccttcctcctttttcctcatatcccttttttctcaatataaatactctgcaaaaaaacacccacaaatcctcacacaaaaacgttttcgaaatccctaatctactctctcttctctatatctctactcttgagaa

SEQ ID NO: 1138 - DNA, 3000 bp, Unknown
  misc_feature (1)..( 3000): cDNA_ID_2131128_gDNA_ID_1620363_Annot_ID_154732 3000 nt of promoter + ATG
ttctctagatattctaggccaaagttatgtaagaacgatggttcaagctcaaatatgtgtcatgagaaaattacgtactttatgatttaagcgtgtcgttttgtttgttgcagtcacacgtgtcaacaacttcatgttgcaacctttatcgagtctattggaaattttgccagacggagttcccagcttcctggaggagaattttcggtttgaacaaggtgaactttcaactccttgtatatcttccagtcgaagacaaatgagatgcagagacttctttatttattcgatctccaagatgggtttccagtgtcaggatttggttcaaatcacagctaactgtgttcctattatataggttatccgtttgcagcaatgttcgagactatgctgaatgaaactgatgccgcacagatcggtggagggctattaggagacctctttgcaacttcagttaacctgccggtaagactttgttttagaaaagcaaatgatagatgcatgtttgtcttgctgattatagagttaaactagtaatgtgctcttgtttgttcttcattttgttgtttcagctatgttttcatgtgattaactcacgaaaacaaatttcttacagactctggctaggatctttccaaaggacacacttctatggaagcttcaactgcttaagtctgcttcagcatctgctaagtctcacatgtacacagtcaaagcccaaacacttatacttttgaggttaataaacttgtaaacttccctgcttcaataagtagaagttcagcgatctcttttttcgtcaaaaaatttcttagctggcagctgagttgtagctttaataagactgtatattgcagtggacgcgatcagtggttactaaacaaggaagacattgagaaactccattgtacattgccgaattgtgaagtccgtaagttcgagaattacggacagcttctctttttggtaaggtgctctttttcctgatgtaagaaagtttttcttgtatctgtttataactagtagttagctcagcaaactttcagattgataattttatgtcatgtcaggaggatggggtagatctggtgactatcatcaagtgtacttattattatcgccgtggaaaattgcttgattacgtttctgatttcattctgcctaccccatttgagctcaaagagtatgaagaatcacaaaggtaaaatgaatatcctctgtgtaatacgctttcttgacttagatgtagtgaaaatatttgtatagtactacttagctagaataggatatttccttctgctactgtaagcaaatactgaagtgctgttattatttttctggtccagattgctaactgctataacctccccagtctttctctcaactctagataacggtacagtagtaagatcacttgcgggaataccttcagagggaccggttctctatgttggcaatcacatgttgcttggtaccgaattgcgtccagcagcaattcatttcctgaaagaaaagaacattctgttgcgaggacttgcacatccagtgatgtttgccaaaaaatatggctcaaaactccctgatatgcatatgttcgactcagttaggatgataggcgcagttcctgtctcaaatatcaatttctataaactacttcgctcaaaggctcatgtggttttgtatcctggaggtgtccgtgaagctttgcacagaaaggtaatgattagatatctcatatttggccttcgttttaactttgaagcgttacatagaatgacacatttctacagggtgaagtatacaagttgttttggccagaacattcagagtttgtaaggaccgcatctaaatttggaacaaaaatcattccttttggggttgttggtgaagatgatctctgtgaagtaagcaaaatctcttcttcttcgttttcgtttcagtatctggaattctttaaaactcttttgaaaaatggaattgattctcaggtggtcttcgattacaatgatcaaatgaagatccctttcctgaagaatcttataaaagagttatcacaagactctacttacttgaggtatttagtttttgtttctttgttttgttttcgactctctgttaaatgtaattatatgaatgttatataacattggaatgatgataatatatgtttaggaacggtgaagaaggagaagtaggaaaccaagatttgcatatgcctggaatagttcccaagatgccgggacggttttacgtatactttgggaaaccaatttacacagaaggtagagaggacgagctaaatgataaagagaaagctcatgaggtttacttgcaggtcaagtctgaggtagaaagatgtatgacctatttgaagatcaaaagagaaggtgatccttatagaaacattttagcgaggtccctctatcacttctcacatggtttctcttcccaagtcccaacctttgacctccgaaatcaataattttagttactggatttgtgacttaattaactttgtggaatttggatatgttattgtaacttctaaaagtacaaggctgttgatgtagaaattgagtaagttcggggtgttatgttaaaaattcatgcaagtttgtgttcttacaacatatctagaacgtttacgttgaagccttgaaggtttgtgtattttgactattttctattttaatagaattgagtaacttttgggagtgttgggtgaagaatattgcaatgtacaataaactgtgtaatattcgaggttagttttattaataaatagttaaactaacccagatttggtttaaccaaaccgaaccagcttgtcgtgtttaatttaagcaaatttatcaaatttgaaaatattcaaactgaaaaaatcaacgtggcatattataatcgtttttctcgtgtgcacgagcttgtcgtgttcgacctatcagagatgaagaagctaaacaacaaaaaccttcttccaactttctctgatcgtctatg

SEQ ID NO: 1139 - DNA, 3000 bp, Unknown
  misc_feature (1)..( 3000): cDNA_ID_3060860_gDNA_ID_1620363_Annot_ID_154737 3000 nt of promoter + ATG
gtatcttaactttatatatatattttttattttcttagaaaaattgtgtatatttattattactttttgtttgatacattttcatataaatttgtacttttaactatatagcattcatttatacattttgttatctatatcatcatttgtttcctaaataactgtcaatttttgtttttttgtttttttcgaggattgtatgtcgttaacataacacagtcttaaatgtttgtgtctgtttatcataatgttttaatgagtatatttatgtatttctatcataattgtttaagaaattaaaaattgcgtctactcattttatttttttctaataatttttacttatggttgcattttttcaccatcatggtttctaatgtaatattataaatcttaataaatgcttgagagtcagagtaagctatttgtaacattaagcattttacctttaattttttaaaagatataaggcccaatagtagtaagagctcataagaccgtttgtatttctgaggtttatttcttctctcaaaaagaaccgcggcgattcgattgaaccaaccggttagaaaaaccgaaccggtgaagtggctcaaaaaatggattaaaggtgcttcacgtgggcagattgggttgtcgctcatgtgagcactacttgatatgctcgtaatcattacacatccttttacttattatttattttctcactacatcattaatctatagcactaaaacatttgacaaaaagaattatacattagattcttcatcagagccacactaatagtacagtttgtttaatctttgtgcaaaagaaaaagtagtacaacagtttgtttaatcttcgcatatgatttcatttgccgatttattatatgaactaaatacaaagttatgttctttttttttttttgagcaacaatacaaagttatgttctttatgaaaacatagtaataaataaataaaatacttttgtgtggttttaaccaaaacatcttagattataaaaatatattttgatgattattaaagtgatgaattcaatattactatagtaataaaagtcactagtgttttgagaaatttccaaaaaataaaaaagtcatcaacgttgtaattataaaaataaataaaatcatttccaactaatcctttttaggtatataagtatattcaaacaattaatttgatcggtgactttgtaaaactgtgaaatattgttttataatgtgcttagtgaattatttaccagtcacattctgcatgtctcaagagattagatgagtgacattttatgacgtaacacaataatgttatttatacgtttacaagaatgaaaaaaaaaatatctattcatcatttgtaagcacacatgagaggattaaagctttacagaggaaaggaaatgtcacttttactgtcacatgctgaaagtgagaaatggctgagagagaattatttgttgaattatacttatcttatttctcaagccatcaaccaataataagaattaagaaataaagactagtatcaaatcttatattggtggtgtaatgctgatgacctcttagccactccgtttggcttcttctggcatagagatatcgtgaaatatatatgtagactaatgagtccaaaaattggattggtgcattaattatcatgttaaaaatttaagatgcaacctatctagagtgaaacatatatatactttgatatagaactatggttggtgtggactcgatactgaaacatataaatatgattaattcgattgttaggtttggatggtgcaatcaatatgctaaatgattctagtataagtaatctaattcttactaactttgtagctgcaaaatgtatattctagtataaatatatttcttattatacattctcaaacatgcacatcgtaaaatgttaattttgatatattaagatgtttaaaactaaaggcaccaaaacccaccaaaaaaatttaagagtctataatagattgtgtgtttcacaaatttggtatactgtgtttgattgcttggattaatgcttatagaatattaagacaaaattaacatttatagcaatagttggtgtgtcatgtcaagtaaacttatgttgttagctgtcagattgaagcagatagatagagaaaaatcttttgcgaagcagttaggtatctgacgttggggcactccgtgacttcatttatgatttgtttttatgaactctggtctatggcatcgaattatagtcgatttttagagggaatataatgtacaaacctacaagaaaaattaaacaaaaacacaactctaattattattcaattgtagaatttacaagaagacatttttattaggttttgtagtttttttttaatgaaaacacttaaacctgccctaaaaaccaaacaaacaaacaaatgaaacaaaaaaaaaaatggatataactactacgtacgagcttttttttttttaatacaattacatacgagctatatggactataacatattaattgtttttgtgtagctatgtaaatctttatttagcatatagaagtgcacctaaattaggtaacatatcctcctttttagtttcatacattaaaaaatagtaatttcttaaagatcaaataataaataagaagtccgaaataaagaaaaaatggaccttaaattctatttttcaaatgaaatactttcataaaattaaattcaactaataccacaaagacaccaagtttttggtagtatcccaaaaggcctatcaatgaattattttttttgttattaatttttagttaattttgttgtataagctaccaagaaaaatacagctgcttatataccccacaagtattggaatttagaacgaaaagacaaaataataactataaggttttgatgtcacacatcttatgaattggcatgttccatgtccgatctaaccaatgatggctttaattgcttttgtaaaataaaaaggactggcaaaact

SEQ ID NO: 1140 - DNA, 3000 bp, Unknown
  misc_feature (1)..( 3000): cDNA_ID_2131149_gDNA_ID_1620363_Annot_ID_154739 3000 nt of promoter + ATG
atccagaagataacgtaaaattctggttaatagtttcatctacttggtctgattcagtttaataatattaacttgttttagcaacgctatcactaattgagttgttctaatgtactttcaaatcaaaactgtatactttaaagcaggaaacaaaagtcacacaggcttcgtttcatttgaaatgttgggaattgagtttcaaacctgatcaacgggaataatcatcgaagacttttgcctgatcaatgattcaaacgcttcattttctcgacgtatgcttgcttcaaacttctgcacttctgtggactcatcatagaaaataaaataaactttcagctttctgagagggttctctgctttgtaaacctcaagttctctgacaaaacccatgtcaggatggtagacaatgatcacagagggtttcaagatatctagtataggttgatcgctttctaaggcataaaaatgcacaggcggtagctttttagcaccgctggggcgaacagcattggcttcttgaggggctgacgtgctagcttcattggctttttcttcattctctgggcctggtaagatttcaggtttactgttcgtcgttttcttattgcaacttcttaaggatctccggagacttgttggatcctttttagcttttcctttggtacacgaagccttatcaacatgaggctctgggttgttatttccagaagccatatctgttgtctttcctagcttgcgaatagaagacgcagcagccataagagcctcatgctcttgtctgccaacactgctaccttccgagttctgtattgtagttaccggaacaactccatcaagaatcccaaaacccttgggagtcttttgtttcttcttttgcggtgtctgcatactgcggagctcaattttgctcagcaggtacatttcccattcttcccgcattacctgcacacgtgtaggtaaaatgggaacttgaatgctagtttctagtgacagggtacatatcggttgttaatgaatgatgtaagatctagcaaaacggagttatctgactggaccttctgtggattgtttgtgatgcaatcttcaagctgcatgcaggaccgttcatctttgcaagccacaagaactattccattgttgtcactgttatcttcctcagaaaaagcctgctttagtctttcttcttgtgtctcctctaaaatttcctgtattaatcacaggcataccattacgtttaaggctaatccatgaaaacatagagtgtggcgaccaaatcaaagaggtaaacaacaaagaacagatatggtcactagctaaaccaacttccatcatcaaattaacagtaacagagatacggcattgaaactgaaactcactcagtcactcacacgtaagactttccattttggtgcctcttccagaacttcttctacaacaacgccagtagccacatttgttgccgtttccccaccaactgattcaagtccaattatcaggaaatttttcgaatgcttataacacacatgtcactagatgcaaaatacaaccattatagatcaagaattagttacctgcttctacagagtcagtttcgcccttcgaatttctctttttaccactcttattcttaacatgttcttttgacttgacatcacttgccttcacgagacgatacactcgtttctttgcaaaatcaaatattttatagctggactctgcaaataaccaaacagaccgatagctctctgatacccttagtgtatccaagaacttgagaaaactcacagcatcatacctacacagaaataccaacttgaaggttttgcataagaacattactgatctacagagaagagagacagagctattattacctaacaagataatcaagcaacttccttaaagtcttcaaatcagaaacaagctgttttgtccttttccccaaagtatgccaaataggatcaagctgcctcctcacaatctcatcaaaggacttaaacaaaccactctctacagtcaaatcatcaacatcaactttattagtcttcttcatctccttgagacaagcatccattacttcaatgatagctttctgtattcccaccatgtaattcgacatcgaaaccctaatatccacaacctcaggtggttctcgctccaattcctgagacacatccaactgaaaccttggccatagatggattttacggaggaagagagcacgcatggtgcgttcagtcttggcgaaaccggaaaccatagcttgcggtctatcggaaaaagcgcgtatataagcagagctatttagggatttgacaattcgtataatgaatgcttcagtggaggtttcggaaatcgaatgagcattgaggatgaagattccggcgagtgaagaaactggaatccgttgagtcaacagatcgacgatgagaatccgcggcgtgatgaagaaaggagaaccggaggtgtaaagcgagtaacgctgattcgccggaagatctgcggtgatttccgtcggagtaggagaatcaagagaggagatgtaatggatgattctggattttagagattgagcggcgggggagaggaggagaagtagagttccttgcgacggagagtgaaggatgaggagagaagcgattaatttagcgagggagagaccggaggaaaggattaataatccgccattagagtcctcgagaaggtctgatatgatctgttggtgatatttcagcgccattgaagaagacgacgacgcaaatcggagaaactgattgatgaagagtgaagacgatagaaaaaacctttcctgggtcaaaaacgttcaaacttcaaaacggcgtcgtttaaataaagtatttttcgaaaccggtttcgatatttcctatattaattctttcttaaccggtttaggttagctaagaaaaagaagaaaggtcctgagacttgtcttataatcctcaaccagacttgatccattagtcaactcttctcttcaca

SEQ ID NO: 1141 - DNA, 3000 bp, Unknown
  misc_feature (1)..( 3000): cDNA_ID_2131145_gDNA_ID_1620363_Annot_ID_154738 3000 nt of promoter + ATG
tgttgtaatgtatacaacaatcattgatagtctttgcaaaaacgggcatgtgaattacgcgttgagccttttcgatcaaatggaaaactacgggattagaccggatgttgttatgtacacctctctcgtgaacggtctttgtaactctggtagatggagagatgctgattcattgctgaggggtatgacgaagaggaaaatcaaacctgatgtaatcactttcaatgcattgatcgatgcgtttgtgaaagaaggaaagtttttggatgctgaagaattgtacaatgagatgattcgtatgtctatagctcctaatattttcacctatacttcattgatcaatgggttttgcatggaaggttgtgtagatgaggccagacaaatgttttatttgatggaaaccaagggttgttttccagatgtagtggcttatacttctctcataaacgggttttgcaagtgtaagaaggtagatgatgcgatgaaaatcttctacgagatgtcccaaaaaggattgactgggaacactatcacttacactactcttatccaaggttttggtcaagtgggcaaacctaatgtcgcccaagaagtttttagtcatatggtttctcgtggcgtgcctcccaatattaggacctataatgttttgttacattgtctatgttataacgggaaggtaaagaaagcgttgatgatatttgaggatatgcaaaagagagaaatggatggtgtcgctcccaatatttggacttacaacgtcttgttacatggtctatgttataatgggaagctagagaaagccttgatggtattcgaggatatgcgaaagagagagatggatattggaattattacatataccatcatcattcaagggatgtgcaaggctggtaaagtgaaaaatgctgttaatttattttgtagccttccttcaaaaggagtgaagcctaatgttgtaacatatactacaatgatatcaggattgtttagggaagggttaaagcatgaagctcatgtgttgtttaggaaaatgaaagaagatggggtttcataattaggtgacaccatagcataactgatcatagtgttgaggattctctgatgatgcttcttcaacttacagagaatgatggtgtagtagcagtttacacggtctttgcgaagcgagggtttcgtgaagctgtgaggttgttttgttagtgaaaatgaagaatgactaattgaatagtgtttattccagacagtgtattgaacaaaaagacttcgtaaagaatgtgcagagaagcaaatgagttggtagaccacaatttgtaagttacaaattcataagttattgaacagtataggttcctttagacagtgcacaaagattgaactgtattacgtaacgacaaatttaagtatattttggagacatgcaaccgagaaatattactcaatgtcaatctttagagcttttttagtagagtttaataaatcattcggcctgagcttctcgtgctctttgtactttcaagtcatcaagatagttctggtagatataaaacgtgaatcctgtgaaggcgatgggcatcgccaccatcttaacctcagtcagcttgtcatggaacaccgcaatggccgcgagaggcgtaacaatgagtgagagcgtactaataaggtttgaaaacagcgaagacaccagaaatataagcgacacggctcctacacaacccaattgacacgaaaccgctgccccgaccaaagtcaaaacataaatgacttgaccttcctgaaactcttccatctccacactcaacaacatccattccccgcttgcgaacaatccgataaccgctacacaagaagccacaagcgacgtatagatttgcatctcgagaaccatagagagagtctcactcttgagaaccttctcgaaagaaaactgcataagagagagctgaagagaatagataagagaagcaaaaactgcacagaaacacccaatcaagtaactccacttagaatctcctgatgggctatttgaatcatcgtcaagagaaaccaacacagcagagatagagagaaacaacactgagaagaaaatcaaacaagtgattttctgagaattgatgtaataatagaagacaccattgaaagctaactgtgaagcacatagaatcgaataagttgaagcagagagatacaaaagtccaacagagtataaaaaattatctaaaccaatagcaaaaccaagagaaagataaatccaaaccagagtcttgaaagaagaagaagaagaagaagaagaagaagattgtgaagcaggaaggagagaaagagggagataaagaatgggaaagccaccagtttgaacaagagtagagatccatttactgtttccaccttcattgtaataaaaccgaccaagaagaacagaaatggcttgagcagagatgagaaagaagatgcttatgaaaacaagaatccaccattggcttctatttagtttcatgagttgtgtaggaacactagttcttcgtcttccttcatcttcttccttaagcagcaacattgcttcttcttcatctgttaccaacaaaaacaacacataaaagttcacatctttcaagaaattttgtcccttttatgaaaactttgataagaatctgggaattgggttttgatcattacacaattcactacatttctagaatctaaattgaaatgaggaaaattagagagatttacccattgtgaagagaagagttgactaatggatcaagtctggttgaggattataagacaagtctcaggacctttcttctttttcttagctaacctaaaccggttaagaaagaattaatataggaaatatcgaaaccggtttcgaaaaatactttatttaaacgacgccgttttgaagtttgaacgtttttgacccaggaaaggttttttctatcgtcttcactcttcatcaatcagtttctccgatttgcgtcgtcgtcttcttcaatg

SEQ ID NO: 1142 - DNA, 30 bp, Unknown
  misc_feature (1)..( 30): cDNA_ID_2994873_gDNA_ID_1620363_Annot_ID_154744 3000 nt of promoter + ATG
ccacaaaatcagacgaaaaagaagatgatg

SEQ ID NO: 1143 - DNA, 3000 bp, Unknown
  misc_feature (1)..( 3000): cDNA_ID_2131161_gDNA_ID_1620363_Annot_ID_154742 3000 nt of promoter + ATG
cctctgaatccgaaagcagctgctgaagctgagcagttactaacaaagtctctgtccactctagagactttttggcttaagggcaatgctaaattcttgctcggaagcaaccaaccatctatagctgatctcagccttgtatgcgaacttatgcagctgcaggtactcacttaatttcactgttttgtgcgtttttttaattcatcgaaataccaatccttgctatgttttggcttttgattgtaaaatttatgcaattttgtaggttttggatgacaaagatcgtcttagattgctcagcactcataagaaagttgaacaatggattgagaatacgaaaaaagcaacaatgcctcactttgatgagacccatgagatccttttcaaagtcaaagaaggattccagaagcggcgagagatgggaaccttatctaaaccgggtcttcaatccaagatctaagaacttagaacaaaactttggcaaaaccggtttcaggggtcagtcactggttcgttgaagaaaagccgattatctcctattctccattgtaagaaaaataaggaatgtaataatcacttgttttttgaactatatgtaataatcactttatcaaaggtttttaccgaacccgagcattttgaacatcacaacatgaaggtttagatttatatgtaaattatagttgaaccagctcgcagtttgtgctgtccatctcactggcttacttcctttgggccttagactgttaggatcgtttttagctggtaaaggtcgagaaaagtgggtagctgcactgctaaaactcaaaggaaagcaaggtggaaatataatggaagtatggaaacttatggaaccatcaggagatagaggccaagaggggtgggaaactgcagctgacataatggaaggggagggactatcacaagataaaggtcaagaggagagggaagttgctgcagagtgcagacattatggtagggaaggaatcatcatcacaagacaaaaaataacagtagtgtgaagagtcacctgcacaatttatctttaagcttgcaaacattagtgtccaaacaccacccccacccccccccccaccccacccccacacactgttctcatgtttactgaaactgtaatgcttatgttgttccgtttaataaacatgcgatgattattatttcttagaacagagaatcactgaaacaggtttgaaaagagaggatgttatatctgtgaatagaaaagacaaagacaaagtggaggaatcagaactcagccacggttattgctctgttgagagtctattggaaatttggctttattatgatagagagcaatcagaaatagataaaattggcttttagtaattaatgtttctagggatgatgattcaaatttattacaatagctgaatacagatcaacaacaacacatcaaattgattcaagatgttcttaataaatcataagaatttaacaaaagcctgcataaccgtaaccgtaaagttcattctgcattaactgattcaaccaggggttcttcacagattcttctaccgccgagtaatgttgtgtgtttgagacgcaaggattttgaaagctgttgctattgatgttacccatagacatgttttgatcacaaccataaaactccttgtacatcaattgattcaacccaaagttgttgacagattcttgtaccgcttctttgtttgagacgcaaggatcttgaaatttgttgtttgtgatgtcacccatgctcatgttctgattctgatcataaccacaaatctccggcttcattaactgattcttcaactcagattcttcaagtaacgctgagaaataatcctgattgaaatttgatgcagagactgggatctgagacagagtattgtctccatggttatacataaacagcgagaactggctagggttcaaagattgggtgtaatgattcagagaggatggtgttaaactctgatgatccggttttgtctgattctgtttctgcgactcaagaaatcgaagcctttcttggaatttagagacatggagttccaaggactgaatcagtggagaaacttggtcgggagggtaatgatcagcgagtggatactttaaaatattcacgttcttaagactcgtcttcatcttcttgttcggattcttcaaacccttgttcttcttcttgttcaggaacccatgaagattaacgcttttcttgcgtctcaatgcttcgttcaatagactatacctaagagcaatgtctctcactttctctttctccttaggccatgtcttaagttctccgtctggtccgtaatagataacgcaggcttcgatatcacaaagagtgcaaagctctgaagctttcttgaagatggtctcaagcctattgctcaaacttgtgaaagcgagtgaataagaagaagaggacgaaggtgaagatgatcgcatagtcatcttcttgttgattgcaaagacaaactctgtgttttttcacgctcaaagttaagagaaagcacgaagacaaactttggctttgtgaaaaagatgatgaactatgaaatagttagaaagaattagatatatttatagatgatcggtgataaaaaaacgcgtaaagatgtgtgcatagatagattcgtttcgatttccatatatttgcatagattcgatttccatagattttacgttctagagccgttaagggttgataaaaaggaaacacaactataatttgatatcattaacccttgatatgatctagtttggtttggttaatactagtcttcaaattctagctctaatcagatagtattttatacatctacgcaattatttgggccttgtgaggcccatttaaaattatggacaaaaagcgacgtcgtctcggatctgacctaggtttttgtttacactcttcttcttctctccatctctcagtctcttcgttaaacccacccacatttgaagcggcaaataacgaaaaccatg

SEQ ID NO: 1144 - DNA, 3000 bp, Unknown
  misc_feature (1)..( 3000): cDNA_ID_2131157_gDNA_ID_1620363_Annot_ID_154741 3000 nt of promoter + ATG
tttcactttaccagccttgcacatcccttgaatgatgatggtatatgtaataattccaatatccatctctctctttcgcatatcctcgaataccatcaaggctttctctagcttcccattataacatagaccatgtaacaagacgttgtaagtccaaatattgggagcgacaccatccatttctctcttttgcatatcctcaaatatcatcaacgctttctttaccttcccgttataacatagacaatgtaacaaaacattataggtcctaatattgggaggcacgccacgagaaaccatatgactaaaaacttcttgggcgacattaggtttgcccacttgaccaaaaccttggataagagtagtgtaagtgatagtgttcccagtcaatcctttttgggacatctcgtagaagattttcatcgcatcatctaccttcttacacttgcaaaacccgtttatgagagaagtataagccactacatctggaaaacaacccttggtttccatcaaataaaacatttgtctggcctcatctacacaaccttccatgcaaaacccattgatcaatgaagtataggtgaaaatattaggagctatagacatacgaatcatctcattgtacaattcttcagcatccaaaaactttccttctttcacaaacgcatcgatcaatgcattgaaagtgattacatcaggtttgattttcctcttcgtcatacccctcagcaatgaatcagcatctctccatctaccagagttacaaagaccgttcacgagagaggtgtacataacaacatccggtctaatcccgtagttttccatttgatcgaaaaggctcaacgcgtaattcacatgcccgtttttgcaaagactatcaatgattgttgtatacattacaacatcaggtttaatccccatctccaccatctgattcaccatagacatagcctcctccattctattcccgagacagaacccattgatcagagaagtaaacgtgacaatatcaggctcaaaaccaagtttcatcatcttcccaagaaaagatgaggcaagataaggctgagaagattggcagaaacaattcatcaaaagattgcaagtatagagatcatgtgaaactcccattatctgcagatggtcgcagagattgatcacaacatcaaacttcttcattttggcaataacattcaataacttagtgaaatcgataattgaaggaagaggacgagactcaaccatgtgagtgaacaaatcgagagcttcattaaactgaagagagtgaagaccatttctcaaaatctctcggtaattacaaaaagctcgaacccagaaactaagatctaaaaggcggctaaaggagagagcttttccagaattacctttcacaagacgatttcggtgaagttgaaaaaatctcatcgccattaacgcaaatcccagacgaaattgattatgccgttgatcgatttactacaaaagctacaaaaaagtttggatgagatcgaaggtcgttgtatttaagaagcctaattttcgtttacttggaagatacgaagaagatgaaatttgagatttgagtaaagaagcggcggaagagaagatggcgaatatttgtacacgtgtattggtttgacttttgtataatatcgttgacttcacgtaaccagtctacaacgaccggttaactaaatcggtttgttcatttacagatccctagaccaagacttcatgttatgcctgattgcgatcacttgcagaagaattcctcctattattgaaaggaagtataaattgaaattttgtctaatttggtctcaattttgattttagttttggattgtgttctttgctattcaaaattcttaagagtaatttggtctcaacaatatcttaaactttatatgatccgatttaatccaaaccgttcaataaaattaatttctatcaatctaaaccgttcaacaaaaataagtaaataacaaccaaaaaaaaattaaacacattttaacacattcctcttatcactagataacaaaaaaaaaatctcaattattatttagttatgtttgattaaaaaatttatatttataagtttagtatatcaaatttattcaaatatttagtataaaaactaaataaaccgattgtacgcggtaaactgcgggtataattttagtataaaaccaaaaatgaaaggaaagatcttcacaataattaaactctatggcttaagaatcttattaaacgctaattccgtaagaattatatgaaacgctaattcggtaagagtttagtaaaccagattgtaacaaacgtgtaaatatttttctggttatgaattttttaatgaaccggattaaaccaggaattaaactgtgcgtttaattaaatatgaatttaagtactcaatcagcaaattggtattgactcaacatgatggacataagaggtttgtgacttctcataagagctttgtattttattgatttgaacacttttcttagtagtaaattaaattcatggtcgaatctttgtttatatatgagtagttttatcacatagccgtaccttgcctttggttggttttgttctgcttttctaacgaaccatattaaaaccatgtatttagttatatattaaaaaggtttaagtataattaaatagcaagaagattaccaaatccggcccaaaaaaatggtagtgactcagcttgatcagagagtctcaccaggattcgaatagggatattgatattcttaacttaattataaattatatttaggacaaagaactatatcttaaatcttaatagaggtggagctatggagtgacttttgggcgactcaatcaactaggttctcgagtgagatctcttttcacaaagagcccttatcaacataacccaagactttaggtgaaagtaacgcgtaccacaaacaccggtgaaaagaaacctatatcttaagggtttgtgacgtgaatatgatgaatcca

SEQ ID NO: 1145 - DNA, 3000 bp, Unknown
  misc_feature (1)..( 3000): cDNA_ID_2131132_gDNA_ID_1620363_Annot_ID_154733 3000 nt of promoter + ATG
atatacattttgcagctacaaagttagtaagaattagattacttatactagaatcatttagcatattgattgcaccatccaaacctaacaatcgaattaatcatatttatatgtttcagtatcgagtccacaccaaccatagttctatatcaaagtatatatatgtttcactctagataggttgcatcttaaatttttaacatgataattaatgcaccaatccaatttttggactcattagtctacatatatatttcacgatatctctatgccagaagaagccaaacggagtggctaagaggtcatcagcattacaccaccaatataagatttgatactagtctttatttcttaattcttattattggttgatggcttgagaaataagataagtataattcaacaaataattctctctcagccatttctcactttcagcatgtgacagtaaaagtgacatttcctttcctctgtaaagctttaatcctctcatgtgtgcttacaaatgatgaatagatattttttttttcattcttgtaaacgtataaataacattattgtgttacgtcataaaatgtcactcatctaatctcttgagacatgcagaatgtgactggtaaataattcactaagcacattataaaacaatatttcacagttttacaaagtcaccgatcaaattaattgtttgaatatacttatatacctaaaaaggattagttggaaatgattttatttatttttataattacaacgttgatgacttttttattttttggaaatttctcaaaacactagtgacttttattactatagtaatattgaattcatcactttaataatcatcaaaatatatttttataatctaagatgttttggttaaaaccacacaaaagtattttatttatttattactatgttttcataaagaacataactttgtattgttgctcaaaaaaaaaaaaagaacataactttgtatttagttcatataataaatcggcaaatgaaatcatatgcgaagattaaacaaactgttgtactactttttcttttgcacaaagattaaacaaactgtactattagtgtggctctgatgaagaatctaatgtataattctttttgtcaaatgttttagtgctatagattaatgatgtagtgagaaaataaataataagtaaaaggatgtgtaatgattacgagcatatcaagtagtgctcacatgagcgacaacccaatctgcccacgtgaagcacctttaatccattttttgagccacttcaccggttcggtttttctaaccggttggttcaatcgaatcgccgcggttctttttgagagaagaaataaacctcagaaatacaaacggtcttatgagctcttactactattgggccttatatcttttaaaaaattaaaggtaaaatgcttaatgttacaaatagcttactctgactctcaagcatttattaagatttataatattacattagaaaccatgatggtgaaaaaatgcaaccataagtaaaaattattagaaaaaaataaaatgagtagacgcaatttttaatttcttaaacaattatgatagaaatacataaatatactcattaaaacattatgataaacagacacaaacatttaagactgtgttatgttaacgacatacaatcctcgaaaaaaacaaaaaaacaaaaattgacagttatttaggaaacaaatgatgatatagataacaaaatgtataaatgaatgctatatagttaaaagtacaaatttatatgaaaatgtatcaaacaaaaagtaataataaatatacacaatttttctaagaaaataaaaaatatatatataaagttaagatacatgaaagtttaaatagacaccatttgtaaaagatataagtattggaacgaagagtttgtgattataaacacgagtaaaacatggtgacaatatacaactctaattgaacaaatttaactttaattgatatcctcaaaaatattttataaagggcaaatattgcaacgattcatcaaatataccaaaatttgatagtttatcaaataaactaaaggttacaagtgtccaaaaatatatgggattaacatcactgagatgacaaacatgcttcttaccaacattgaaactcttagagaggtggtgtgaactgtgagctgcctcttcttgtatatccaaaaaggattctttacaaatttaccaactatatctgttttgaaattatgcccttttataacagaccacaacatatcatcacccaaaaccagtgtccctttttagtatacttccaaaatcttggagaattggtgagaggatatagctgcaaacaacttttggattcctatatgtgaagaatcgcaaaacgaaaagatgactgtcgattagtttgcaacggactttaagcttttgaatctcatattttttgcaatataggtttttacacccgaaaaccaatgccaagaaaaaatgtcagtttttgttttagcatagatccaacattctccaacaagactgtagatacactagccagatatggattacctaataattatagcttttactttcattcttacgttccctctcttcttcttttttttcatcgattcttatgttccctttctaattgttaataatttacatcgtgaccatgttacaacaaatatctaatacaaaagctaatgtcaaaaaaaaaatatatattttgatatttatatttctaaaatataaaataatataaattataatattaacagtcataagttaccctaaatttaaaccgtgccaaattccaacagcagcatctaaattgattttaaaattcaaacagaaatgcggaccctcgataaaagaatggcggagtagtcactgctgttttctcgtgtacacgagcttcttgtgttcgttccacctcttgaagatgaagaagttcaactacgaaatcgttcttctctcgatctcggatttttctgatcgatg

SEQ ID NO: 1146 - DNA, 3000 bp, Unknown
  misc_feature (1)..( 3000): cDNA_ID_3060865_gDNA_ID_1620363_Annot_ID_154729 3000 nt of promoter + ATG
agtttgcaagtaaaaaccacaaaacaaacgagtctgtaggcacgaccgcacgagtgctaaagtccgctgcatattgatagttcgaagacggtgttttgtcgatattattcactatttacgtgtcgcggattgattagcgactaaagaattagccttaacatatgttttgttgaaatatattttgagtcaagattattcttaattcccaatagaattttgaagtatttgtctttgttccaacctttaaaaggatgcttgaagttccaatcaaactacaactcatgctctctccctcttctgccttaactatgaagaaaacaaaagacattcgtttttatttttctcttcagtatcaaattcaagaatccaattccaatagccacaacataaattctctttgatataataatctaaaattagaaactgattcacgtctctaaattaaaatttctgatctattcaagtaactgttcttatatgagttttgtttccatacatgctttgatttaaacgttttctactacaattatatctacctctcaacactggaatccaattttctttatacggtttatatcaagtattgattgtttttgtccaaaacaaaaaccaagtattaattgatatagctatagtacactcaaattttaatttgctcactataattctgatattactttgaatagaaattcaaaattatctaatcacaaagttcagtttatttataatatggaagctttgagcaaaataatgtaaatataattataaaaaataattagaaataatttaggacaactgaaaaaaatatggatttcggtctataagtttctattatatatcaaaggaagtacttttttttttttgataaaccctaaatatcaaaagtacttttcgtttttgccaaatatgtttaattacttattttcgagatgttatcttccatttttttcagtatcattgtaatcaatgataattataacaaaatcacgatatgaaaaaaaatattccattaattgatgtaaaaaaaaaagtcaaatatcataacattaaaatgtaactttccccttatttactaactaaagctcatgcatgcgtggcgtgatattatctattcaattccttttctaaaaaggttttcctagtcctattaggattaggaaacagaggttgctatataaatacttgattcgctcgcgtttatctcagtcacaaaatccctacttcttcgtaacaacttactaatatataggcagcttggagcttattcattggacgacgaactctttttcttcatctctttctgttttctttttctcttcttttgttctgagaataatgggcccaacatacagagctttgccagtaggtatgaggtttcgtccttcagatttggagttggctgtttactttttgatcaagaaagctttaggacttcccatgaaagctcttactgtgcccgacgaatgtaatgatatcttctcaacacatcctcgcgacttgcctggtgagaatactttctccgatccttttgacaaaacagatttgatagagtttttgagtttcttgatttaactttggctacttctttcttgcgtgacaagctttattttgtgaacttgtttttgctctgttctttcaggctatggaagcgaagagcattggtacttctactgcaagaaacccaagaatcaagttactagaacgaaatcttataacctctggataccaacgggagaaaaaactgatgtgttagatccaaagaagaatggcggcgaattagtcggtatcaagcattcgtttactttcattgagaacgaagaagaagaagaatctgataacaagaacggcgatgaagaagaacctccacaatgcaattggttcttggatgaaatcagcctcccattgacagttgtggatactgattggactctgtgtcatatcttttacgagaaggttaaacctgaatttggtaatttgcatatagtcgaatctgaatccgaatccgaagaagaagaagaagatgaaagtgttgataagcctgcagagagtttggatagtgttaaagagaaagatggaactgttcttcctccacctcctgctacaccttagcttcttcatgatatagtgttttactgttagtgttggtggattgtagattctctcaaaacctgtcaacgtccaaatctttattacctctagttgcatacctattgttttaaagatgcttatttcacttcaatatatcggttaggttttttttctttttctttccacaatatatcgattaggttatgtggctcgagagactcacttgctcgctgatacaaaagttccagaacaaagagatcatccctcatctaatggctcatgttagcaattgtccgcctaccttgctaaattgcgctcctacacctaaagaaaactattgatatgagtcgtagtaataatcaatcgatctctctattccaataattgttaggagggtcataatatatagaagaagatagatgatatatgttatataatatgatatattgatatgtccaaaaatcaaattgttcaaaagccttaatgaaaaagagaaagagatgtttgaccagcttaaaaacttccggtcaaacacctaaaaaccttttttccgcctttgtcataaatctttgactttttgactttttccctctcaacatctcttttcgagatttcaccacgtgtcaaacctctcatctgaaccgttcatcttacacgcgtgagattatctcattttctcctcctccgtctttctgctgtttcttcgatctgtttctttgaccagaaaaacaaaagcttcaaactttttagcttcttcttcttccttcaatgtcgttgaacacatcccacgatacttgacaaaatatctcactctttcgtctctctgttttcgactcgcaaaccatcgaagcgccgattaatcttagaggaatttcttcgtgattagggttttgtttagttctatctggagat

SEQ ID NO: 1147 - DNA, 3000 bp, Unknown
  misc_feature (1)..( 3000): cDNA_ID_2131101_gDNA_ID_1620363_Annot_ID_154726 3000 nt of promoter + ATG
cctttgcttacatttgaagaaatcgagagcaagcgatagaaagtgagagagagagatgtatgtggtgacgcctcctcaaagatccggttttggatccgattgtgatttacgggtttaccaaacatggaaaggaagcaatgtgagttttaatgtgaaagctttaggttttggaattacttgcttctgtgtttatacttgagctagttttctgttatttttcctattattgtgtataaattaattattaatccgttcatgggctcagtttactctgtttccaatcttgtaaagcttaaaaattgggacttgggtttgtgttagaagtgtagctttctgggtagttgtctacatttaatcatgaaatctttacctttaatcaataccttaggacattatctgaatatgcttgctacatttataggaatgcttcttcatacaaaggttatatagttgatgctgtctgtatattgctttcaatgtcgaatttaaatctggtttagtagtaacctagtggaattaaacattttgaggtttgttccttaaatccttctacccaaagtgttaacatattttctaaatttgtcccatttctgcagatattttgtcttcaaggaaggtttatcttcgggccggatgtaagatcacttggtctgaccataagtcttattgtggcacctgttacaattttctgcatcttcgtcgctagcaaactaatggatgacttctctgatagttggggagtctcaataatccttgttgctgttgtcttcaccatttatgtgagtacaaaagtttagctttgcattgtaaaacgttttgtgactggatcattcataacaattaatgcttccctcaggatttgattttgctgatgcttacatccggaagagatccagggattatcccaagaaattctcatcctccagaaccagaagttgttgatggcaacacgggctcgggaacaagccaaactccaagattgcctcgtgttaaagaagtggaagttaatggaaaagtattcaaggtcaagtactgtgatacttgcatgctctatagaccgcctcgctgctcacattgttcgatttgcaacaactgtgtagaaaggtttgaccatcactgtccttgggttggtcaatgtattgctcaagtaagtttctcggtttttcgttttcctgtccgttagtttctgacatcagtctatataattcatctcattctccttgggaatttgcagagaaactatcgattcttcttcatgtttgtcttctccacgactcttctctgtgtatatgtgttcgccttttgttgtgtctacataaagaagatcaaagagtccgaagatataagtatcttgaaagcaatgctcaaaactccagcttccattgctctgatactctacacattcatatctacattcttcgttggaggcttaacatgtttccatctctatctcatcagcacaaatcaggtaccctaatcatttgcctctttctgaaaaaacctctctcattcgatatgcgtgtttaatcgtttgatctttctttattctgtagactacatatgagaatttcagatacagttatgatcggcatagcaacccacataacaaaggagtggttgataacttcaaagaaatctttttttctccaatacctccttcaaagaacaacttcagggctatggtaccaagggaaaatccaatgccgtcgagatcagttgttggcggttttatgagtccaaacatgggaaaggccaatgatgatattgaaatggggaggaagggtgtttgggcaatggctgaacatggtgatggcaaagatggcaataacaatgaacggtttcatgttaacgacaatgagttaaacgagttatcaccagacatggggaacatagtgaatggtgatgagcaaatcaataggccaaacaatcacccgaggaacgcaaactgggaaatgtcaccagaagttatggccttatcagcaagaagagcttagaagcaggttaagagaaaattgaaaggtgttttaaatgtttgatgtattgatgtgttgtgtgtttacacgggaatcaattgtgaattggtgtgatattttcagatgttatgagtatttttagttgttcttcagacatttaaatcgtaaatcattgtgtgttagtgtaatctatgacttatctttcacagaatgagaaaacaaaatgaataccgacgattttcatactgtactttgcatatgataaaaattgcagaaactgaattttcagacaagtggaccagaagaccagacaactcttattatagtcttcattgaagcacggctctgtaataaatgcaaaagagctctaaaggcttcttatttgttcttcaaagctctaaagtctaaaggttagagatttaacatcacaagccaacatttttggtttaggaaattgaagattagcaataatataaagtttttttggcattgaacaaagacaaaacacaatgaacataatcaacaaattggtcaaactaaacattaataagtgcctcaaagtatcagactaaatcattttcactaacatttatgaaaaaataactgttattaactgaggacgaaggtaactgaccagtcaaacatcatagacaaagacaataaagagagtcaatagcattgttcataattgttatttgtatgcacatgttataaattatataaaaagactaaccttatttcaattgagatgtcactattactgttttagcatcctcttctactctttatttagaacctttagtaccttaccatgtgagtgaagagttcaaaaacctctgcaaaaactttcttttttatctctctctcttctttaaacttactttcaaacactaaatagccaaaacttaagataccaaatttcaacaggtcggctttttcgtttgtcttctcttaagactttaccaaaagagatttgtggtttctggagttgactttggttgattttggtgtatttacaggggaaaaa

SEQ ID NO: 1148 - DNA, 3000 bp, Unknown
  misc_feature (1)..( 3000): cDNA_ID_1011560_gDNA_ID_1620363_Annot_ID_154723 3000 nt of promoter + ATG
ttaaacacgcatatcgaatgagagaggttttttcagaaagaggcaaatgattagggtacctgatttgtgctgatgagatagagatggaaacatgttaagcctccaacgaagaatgtagatatgaatgtgtagagtatcagagcaatggaagctggagttttgagcattgctttcaagatacttatatcttcggactctttgatcttctttatgtagacacaacaaaaggcgaacacatatacacagagaagagtcgtggagaagacaaacatgaagaagaatcgatagtttctctgcaaattcccaaggagaatgagatgaattatatagactgatgtcagaaactaacggacaggaaaacgaaaaaccgagaaacttacttgagcaatacattgaccaacccaaggacagtgatggtcaaacctttctacacagttgttgcaaatcgaacaatgtgagcagcgaggcggtctatagagcatgcaagtatcacagtacttgaccttgaatacttttccattaacttccacttctttaacacgaggcaatcttggagtttggcttgttcccgagcccgtgttgccatcaacaacttctggttctggaggatgagaatttcttgggataatccctggatctcttccggatgtaagcatcagcaaaatcaaatcctgagggaagcattaattgttatgaatgatccagtcacaaaacgttttacaatgcaaagctaaacttttgtactcacataaatggtgaagacaacagcaacaaggattattgagactccccaactatcagagaagtcatccattagtttgctagcgacgaagatgcagaaaattgtaacaggtgccacaataagacttatggtcagaccaagtgatcttacatccggcccgaagataaaccttccttgaagacaaaatatctgcagaaatgggacaaatttagaaaatatgttaacactttgggtagaaggatttaaggaacaaacctcaaaatgtttaattccactaggttactactaaaccagatttaaattcgacattgaaagcaatatacagacagcatcaactatataacctttgtatgaagaagcattcctataaatgtagcaagcatattcagataatgtcctaaggtattgattaaaggtaaagatttcatgattaaatgtagacaactacccagaaagctacacttctaacacaaacccaagtcccaatttttaagctttacaagattggaaacagagtaaactgagcccatgaacggattaataattaatttatacacaataataggaaaaataacagaaaactagctcaagtataaacacagaagcaagtaattccaaaacctaaagctttcacattaaaactcacattgcttcctttccatgtttggtaaacccgtaaatcacaatcggatccaaaaccggatctttgaggaggcgtcaccacatacatctctctctctcactttctatcgcttgctctcgatttcttcaaatgtaagcaaaggggaaaacactaaaacgaagataacgaaagaagaaaagagaaagcttttcagtctccgttgaagaaattctttagatttcggcaagtctccgacatgaaaatgagagtagtcagagaattagatttgctcttggcttctccaacttcttcttcttccttcactttttttttttcctgcaaataaatataatattttaaaaatcgactgttagcagctactggagtcagtctgtcaccgtcgttttagttcaggtaaagtacttttcagaagctaaaagtgaagaacgaaataagctgacgtggcacttttctaatggtctgtttccttaccttgagtactcgaccttgttattcataaaagagattcgataacggaaaagaaatttaaacattttgttttacagcgaatttacatctaattttttttatctctattgttttccactttttctcaactattgatttatatgtacctgcaaaaaaaaactactgtataaatttcgtatgttgaagaaaataatgttaaaacttaaaataatttgtgaaaggaaaaaataaagttgaaaatagaaatgattgggaaacaacacataaagtggatggagtcacctagaagcattacaagaatttaagggcaaaagaaaaaaagaaaaaaaaaattaaagtaaaatctgcagcaatcttacatgaagaacaatttcaagcttaatgggccttctttaaagctcaagcccatatattgtttccaactgatgaacttgtaatgtaagcttatcttctctagtacacttaaacctgaaattgttatgcaataaagtcttatgctgttctataatgtgacgaacaaaagtctataatgtgagcttatctttgtatagttagttaacctgaaattctctttccagaattcagccacaaccgagagtaaaccgggaaaatatcatagtttggcttcttgtattgatatttaaagagccatatcctctgactactttcttggtgtttatgctgatgaattgatgatgtttacacttcactttcagtggtccatacacatatatatacacactagtggcttaccttctcccttccattttccagttttagccattttttataaggggattcatagacaaaaacccttaaaatagagagcatgagagctcaataaatgttaaacctaaccaaccaatctctcagtttctctacttttcctttaattggcctctcatctctttgtgcctctctttactcatctctttttccacaagagtcttgagttttataaaaaagacaagcttgaagctttgtttgaatggagttactgtttgatctttgtttgttcttttgtctttaaccacttggcccattctttgtctgtttctttcatcaaccacataaacaaaaaggaaacctcatctgtaaacaagtgtttatccaaggataaagaaaaaaactgaaacttgtgaacatg

SEQ ID NO: 1149 - DNA, 3000 bp, Unknown
  misc_feature (1)..( 3000): cDNA_ID_2131080_gDNA_ID_1620363_Annot_ID_154718 3000 nt of promoter + ATG
cggcattttccgaaaagtaaaattgaagggacgcaaataatatttatacttatttaggtattttattttatatccgaaaaagtaaaattgaagaaataaaaattgaattttggaaaataaaaattgaatttttgaaaataaaaataaataataaattaattgaaatatgagtgaaactcaaattatatgaagtctatgcaaatgaaagttaacttgaattattcttcatttaaatgatcaattatccttcatttaaactcaaatattaaaactggacttttaaatagtatctaacaattcacaaaaaatatctaggagatgtgaggataaaaagtttggcacattcttaaataatttaatataaatatgcaaactcaaatttaaaactcaacccaaaaactttttttaccactatcaaaattttgtagaaatatttaagaaatttgtatttgataatcagccaaactaaaaagataattgttgtgtgattacatgaacatggtacatcaatagaggagcaaaaccaaacacaaacaatctaaacaagatggactcctcaacacgaaacattaccaccaaatacatacaacttcgtcaaggaccttaaatttaagactactctatgccgaaacatagatagtagaaaacagagcaaggaacataatggcgagaggttagatagagtaaagtttaggtaaaatgaattttatatagctcctttacgtctttgtcaatttcatacttttatcaacaagacatatttccgacttcgattcaaagtcgtacattggaaaattatgctttagaaaaaacaaacttgacgaccaaaaatattttttaaaacttaaaaataaaaaaaaactgttaataaaaaaagtttcaaaaatagcttgagcaatgcatgaaagagagctgggagtgatagtagaagcaaaaaaaaacctttcaggagatatatataacccaaaggccaaagctctatattagaacacaaacattaaacattaggcatggaaaactctcaattagtttcgatcactttcttagcttacactataatcatatcaatcggctccatcaactgcatagacaacaataatcttgtaacaaaccaatccgctctgttcgtgtttggagattctgtgttcgatgctggaaataacaactacatcgatactctctctagtgtccggtctaattactggccgtatggtcaaacaacattcaaatcccctactggaagagtctctgacggacgtttgattcctgatttcatcggtaccaaaattactttttcgtttccttattttattttaaaacattttctttgtaactgatcgataacatggcagcggagtacgcatggttaccgttgatcccgccaaatttacaaccattcaacggtaacagccaatttgcctatggggtaaactttgcgtcaggtggcgccggagctttagtcggaaccttttctggattggtattcattagtaactactttacattggttttatttatttgttttcttttgttgaatccatggtaattgtttgtcttgtctatttttttttctttttcaaaaaacattttcaccactgcaaggtgataaatttgagaacacaattaaacaacttcaaaaaggttgaagaaatgttaaggtctaagttaggagatgctgaggggaagagggttatctcaagagctgtttatttgtttcatattggactcaacgactatcaatatccattcactacaaattcttccttatttcaatccatttccaacgagaaatacgtagattatgttgtcggtaacatgacagacgttttcaaggtaaaaaattttcaaaagggtttttgtagagtttctattgtgaacaacttttggtctgaaaaatgagagatgatgttgtgttcttaggaagtgtataatcttggaggaaggaagtttggaatcttgaacacgggaccgtacgattgtgcaccagcctcattggttatagaccaaacaaaaataagatcttgtttccagccggtcactgaactgatcaatatgcacaacgagaagcttctgaatggtttgagacggctaaatcatgaactatccggattcaaatacgcccttcacgactatcacacttccctatcggaaaggatgaacgatccttcaaaatatggtaacaaaacttggttaataattgcaatatatataacagagtctttactataaactttttgatcgttttgaagggttcaaggaggggaagaaagcatgttgcggaagcggaccattgagaggaatcaatacgtgtggaggccgaatgggactgtcgcaaagttacgagttatgtgaaaacgttacagactatttgttctttgatccttttcatttgacggaaaaggctaatcgacagatcgctgagctgatttggagcggacctaccaacattactggaccctataatctcaaagcgctgtttgaacttaattaaagctcactatctcgtcgtgtcatcttgtttggttttcattcaaaattttttgtgtatttgaattgtcaccagaatctttcagttttcttagactcttggtctccaaggctttacgcgagcgatatatatcactcgtttcgattttgagtttttgaccgtttgaactttgaagagtgtttcttcaaattaaaccaaaccaattttacaaaaccaaaattcataactgattcttttggttcacactaaaccgagtttatcaaaactactttaaaatatggtttggtttaaccaaattatacgtcttaatcaatgattaggagactttattaaagtctataaccgcaattcgtcatcaactaccatttccttctccaatggagttcttctctgagagtgagaggaatcactgaaaaaataatactgaccatttcccaaaaagttatgtacttattctgacgaaatctgcaggaaattctcaatttttttaaaagaagtagctttttggagtt

SEQ ID NO: 1150 - DNA, 3000 bp, Unknown
  misc_feature (1)..( 3000): cDNA_ID_2131093_gDNA_ID_1620363_Annot_ID_154722 3000 nt of promoter + ATG
catgttgatttgattgagctttggattggaatttttttttttatttttttttttttttttttttctttggattggaattcattcggtaagtaagaatatttcgtgattatagaacttctaattatgtaaaaaaaataaaataatgcgtgaaaataataaaaagttgttaccctttttttttacttaggtcaagaggtcacaacacacgccccaccttgaatctgagagagagagagaagtacgtccccacaccttgacatggtcatggagcccaagaagaaccaaaatctaccaagtttcttaaacccatcacgacagaatcaggacaacgacaagaagaggaaacaaacagaggttaaaggtttcgacattgtggtcggcgaaaagaggaagaagaaggagaatgaagaggaagaccaagaaattcagattctttatgagaaggagaagaagaaaccaaacaaagatcgtcaccttaaagttgaaggaagaggtcgtagagttaggttacctccactctgtgcagcaaggatttatcaattgactaaagaattaggtcacaaatcagatggtgagactcttgaatggttgcttcaacatgctgagccatcgatactctctgctactgtaaatggtatcaaacccactgagtctgttgtttctcaacctcctctcacggctgatttgatgatttgtcatagcgttgaagaagcttcaaggactcaaatggaggcaaatgggttgtggagaaatgaaacaggacagaccattggagggtttgatctgaattacggaattgggtttgatttcaatggtgttccagagattggttttggagataatcaaacgcctggacttgaattaaggctgtctcaagttggggttttgaatccacaggtttttcaacaaatgggtaaagaacagttcagggttcttcatcatcattcacatgaagatcagcagcagagtgcagaggaaaatggttcataaagctcaaacctttaaatggcttttaattagatatatttagcgagaatgtgattgctagtgaaatctcaaacttgatagcttattcatagcttattttacttcgatcagcaagagaacaatggttcctaaagctcaaaccttttttggcgtttgctttagattgtgcatacataaagtgagaagatgaaatatggttttgctgaaatctcaatgtgctcattcatagtttattttgctcgacctttctttaatcaatagctttgatgtactgattactttataaagttaagaagtaagttctgctctttaaactgtactgaatggaggcttctctgcataattaagcaaacactctgatgattgagtttcgttgtacaaaggaaagtttttgccttagttagaaattcatcttgtttctttgcccagaagctggcttgctgatagaatttggactacgctacgttttcttgggtgaaaaacaatccgcgtccttccacgagaacagtgaaactgtacgatgttcttattgtattgtgtcaacagcccataatcaatgaaatgggcctcaatgacagtataagccgaaaaatattcgaatgcgatctagaactaatctgaaaccaaacttctcaaatcattaacatttgattagggcctaaaagtccatccgtattttaaaaaaaagttgataacaaatgcaaaaatacaaatatacattactattaaaactcaatctttctgattatatgtggatggagaagctgttttgcagtgtggatttgaattttgaagttcttgttcaaaaaagaaaagaaacttggtcaagcttcaaaagaaagaaagaaataaagacaagtatacaaatacgttgacttcaattaatatgaagatagaagagaaagatatagaaatgcgttttaaattggcggtgggagatatgtgattcccttggtcccgctttctcgtttgattcggtaacctaaaccttctccatccaagaagacacaaacaaggaagaaattaacctacgtacgtacatcatttgaactacttatatctattataaatggaaaatctattttcttcttctctctcttttaaccgaaaaaggaaaagtcctcgaaataactctttaatataattcatgtggaaaccttctatatattttttgcatgcttttttgaaattaagtaatggcatactaattagaagaagacgaaaaataatatgtctaagtaattgagtttcgtggtcaaggcaaatcaagattgcattctttaattaagtgtacaaattatgatgtaagaaccgttatttggcataacctaatatatattaaaaactgattttttttttttttaacttctgtaagaaatggttttcttaattaccaatcatgatctattattgtaaaatgtgtaattttgtgttgcgattgaagtgttcttagataaagatatgtcatatgcatgatatcatctatttgattttgagaaaataaaaacataacatgagaacatcgtagagagtaagatacatgacaaagagaaagaataagctaagaagtcatccaaaaattgggaggcctactctcaactaccaaaaatacaagtgtttgttgtgttaggtcatttattcagtcacctaaccctaactatatgaaatacgttaaaattcatatatagaaaaataaagaagaaatactattagtcaatataattttttttaacaaaataaaaataaagaaagaaacactattagtcaatgaattaaaaaaaaaaaaatccatctttcgatcaagaccgtccaagtattctcctttcacataactcttacgttttacactaaacaagacgagatttttatgagcttgtggctcccacaacaatcctcattgatttctccatatatatcacatgagaatccaactcgacttcatactaacattcatcccaaaagttccattctttttcacaaagccattgtgctgttttctccatttggatcaaa

SEQ ID NO: 1151 - DNA, 3000 bp, Unknown
  misc_feature (1)..( 3000): cDNA_ID_3060888_gDNA_ID_1620364_Annot_ID_154755 3000 nt of promoter + ATG
atctctctttgcagaaacagaactatccggtttggttatacctggactctgtctactcacactccccaatgacttccttgtcgaacttggtgtctcaactttgatcacaactgaaccttcaacactctttctccttgcaatcttccacggcttcacagcatcatcttgatcacatttcttcccatgtttacataaatcatgagtcgaacccacacgatgattcccacgataacgggactgaacctgcggtttacttatcgttccagtcgaatggcgtctcaaagtcccaccttgaggcttaggcacttcaataatctctggtataatctcttcttgatccttggctaccacagctataacatcttccacattttccacatcctttacacgtactgtttccaaagagccttcttcagacatcttcggagggtttgtatcggaagaattctcaatatctttgacctctgaagtattctcttcagccattgacaaaataaacctgtagaggaaacagagtgcattaccaaaaagatctcgacgtttatgaacagagcatattagaacaatttaatggattctaaactgattctttgtcttttattacctattcactaatcagattctagaatttgacatcataaagaacaaatctttagacaaaaatctaccaaagatgactcaatacattcaaagaaggacaaatgttgactttaagagtcatgatcaaatatgtgtatatttcctcgttgatcatcaatgacattaatacctaaacgacaaaattgaattttgatcatgatccgttacgaaaattaatcacttgtattacaaaacaatgaaaaaaactccgatctttttttagataaaaaatttgacttctgatcgagattgaaggacaatgacctaatttctacacagtaacgcaataaatactccacacgcttaaaaccctaccaacagtttcacaattcaaacaaacacaaaaataaccaaaaacgtatatcaaaaaagaaatcaagaattaagaaaaaagatacctttagattgctgcctaatctaactctcagagaatttccacagaataagaagagagaaaaaacaaagaaaacagtaaaatatgagaaaaatgtatatatgtgtaccagaaaattgctttcccaaattatctttagttggaaacaaatatgaagaaagaagaaaggtagatttgattagttaggaaaagaacacgcaaaaatacacagaggagggaagaaatcttcttgtgcagaagtcttgtgagagagggagattctgatttttatattaaagaattttgttatttaatttactttggctcgatttgttatttaatgttttacctaattttataatctatttattcatttatataaaactgatacacttggatgcatttaataaaaaatcggtgttgtttaaaaatctcattaatctctcttatatatcaaaatcatgaaaaatgcatgaataatcggtcacgaaaaatgaatttgacaaattcaatctataatctccttagatcactatattaaatctcaaaagtatattatcatacaaggaattccaatcgctcggaggatattttggctaaagcacaaaatccataatttttctttaacataaaaacaaagagttattagttttgtaactattttctttttttacataaactgactttactttgtgagatcatattcatatgtatgacatttaagggatccgataccttaagttaagtctttttggtactttttctaaagaatgattcttgccaatgaacatctctagattcttttcgtaatttctttagaataagataagatcaaggtgttgacccacgaacaaaaaatatatgaattgttatatcgcaagaaaatgattttaaatatagataatgtggccgtcgaaaaagataatcatgatttagcctaaaataaatctttgagatatggaatttggcaaaacaaaaacaaaaaatgttttattgagaagacagagcccacaataatacaatgtcaagatgggttacttgattttattctttatgggccaatgaacttgggctcattagattcaaactgtgtgtttgggctccttagattagaaactgattctcctaaatgtgtgtttgggctcctttgtaacatttgctttctcatggttttcaatagaatatcaattaacaaaaaaattggtacagtttcggtttggtgtaaacggtttaattagattaagcatgcttaaaagagagagactttgatgaagtgttgtcaactccaagaacaaaaagcacctctgctctgttttgagatccaaccacagttcaaactaatcaaaagtcccaatttctaacttcagtctaggctttttctctccatggatccttgattctgaggtcagtttctgttcttgaggttttttttcattctgctttctctctcaatcagattttcatatcatctcttcgagaaacataaattataaatatttagttatgacttatgaaggttacaagattaaaattagaaattaatgattaaatcatccaaaaagtcaactaatgcccttatccatgcttctctgacaccaacatttgactaatctaattaaattaggaacaaaattattatcattaacaaatacacctccaacattaagtaaaatttctatatacacaaattttcaaacactaatggtttacttttcaactcaaaattcgaaataaattttccaagaaatataattcttatatcattgaacaagcctccaagttttcttaataagtttttcctctgtaatcatcatttgcttgttaagataagcaggtttcagttctattattcctcttttctaatttttttggattatattttccatcttcttgatatgtttttggttgtaactgattactaattcttgatcgctctaaaagttcacttttctttcttacagatcaaccaatcgaaagaaaccaaaatg

SEQ ID NO: 1152 - DNA, 3000 bp, Unknown
  misc_feature (1)..( 3000): cDNA_ID_2131006_gDNA_ID_1620364_Annot_ID_154763 3000 nt of promoter + ATG
caaattgttatctgaagaatttgctatatatacgaattcaagaggaagaatcctaaaagcataacaaaaaaaaagcagagaaagaatacaagaaaaatggcgacatggtttcacatcttctgcgtctctttcacagtcaacttccttctatatctcttcttccgcagaactaacaacaatcttcctctacctccgaaccctaacttcttccccatgcctggtcccttccagtggctccgtcaaggcttcgatgatttctactcctatctccgctccatccaccaccgtctcggcccaatcatctctctccgcatcttttccgtccctgccatcttcgtctctgatcgttccttggctcacaaggctcttgttttaaacggcgccgtattctctgatcgtccaccggcgcttcctaccggaaagatcatcactagtaaccaacacaccatcagctcaggatcatacggagctacgtggcgacttctccgtcgtaatctcacctccgagattcttcatccatcccgtgtcaaatcttattccaacgctcgtcgctctgttcttgaaaacctctgttctcgaattcgtaatcacggggaagaagcaaaaccgatcgtcgtcgttgatcatctccgttatgcaatgttctcgcttcttgttctcatgtgtttcggagataagcttgacgaagaacagatcaaacaagtcgaattcgttcaaagaagagagctcatcacgttaccaagattcaacatcctcaatgtcttccctagtttcaccaagttgtttctgagaaagagatgggaagagtttcttacgttcaggagagaacacaagaacgtcttgcttccgttgattcgttcccggagaaagatcatgatcgaatctaaagattccggtaaagaatacatacaatcgtatgtagatactctgctcgatcttgagcttcctgatgagaagaggaaactaaacgaagacgagatcgtgagtttatgctctgagtttctcaacgccgggactgatacaacagcgacgacacttcaatggataatggcgaatctgtgagaaaccaggaaattcaaaagaggttatacgaagagataaaaagtgtaatcggtgaagaagaagagaaggagattgaagaagaagagatgaagaagatgccgtatcttaaagctgtcgtgttagaaggtctccggttacatccaccgggacatttgttgttaccacacagagtaagtgaagacactgagctaggaggatacagagttccaaagaaagggacgtttaatatcaatgtggcgatgatagggagagatccaacagtgtgggaggagccaatggagtttaagccggagagattcatcggagaagataaagaagttgatgttactggaagtagagggataaagatgatgccgtttggagcaggaaggaggatctgtccagggattggatcggccatgttgcatttggagtattttgtggtgaatttggttaaagagtttgagtggaaagaagttgaaggttatgaagttgacttgtctgagaaatgggagttcactgttgttatgaagtatcctcttaaagctcttgctgtgacaagaaggaaggagaagacacatatcgtcatggcttagagacagagtagcagattgatttcttggggatgtttttgttctttagtttttcagttttttttttttttggttttctagagtgtttttggttcaatctgttgtggtagaaacgttgtcgtttcaataaaggcagccatttattgaaacgttgtcgtttagatgcctctcatttttgttgaaagccctagaaaatggaattagacgtataaattgatttcatctttctcagcttttgctaaacgcagataaacaggtttctttctgattcttcttcgtattggaacatacaattatacaattgggtataaccattttcttggatttcagtgtatgattccttttaatgttcaaagttctctgctttctcttgcgtaattttgctctctgttttttttttgtcttcatctgtataatggaatctcccgaaaaaactcgaagtttataaactggattgattcctttcttctccattgtggtcttaggtttcgaaagtttctcactttagacttgtgttagctctagaatgcttgtatgatatgtttgtgacattgtggtggagatgatgaatgttaagtaaaaggtctgagtaggttatgagtaaagtgtgtagcttttgattttaatttagtttcgaggagacaattttttaacttaataggagagggcccttgtccatgccttgagtcatggcatctgtggctccgcaacctctccaacaatgaacctgattcaccacgtgcttgtgtgtgcaatctgatgggtcgatttttaaaggcttggggttgctttctattattgattgccaatctagaattctccctatatacattggtctccttgtgcttctttatcatcaattagctgccctcataagtcctgcactgatcaaagacctccttgactgatccacgcgaaagtatctaaatagttctttgtattgctatgttgaagtttgaagctttttgacaaagcttgtttgatataggcattgcttgtggatgatgtttatgattccctcattattgtatgtgtggactacagaactattcatgtattagcatttacccttttgtggttaagctgaagaagtataccataccttctagtgtttgtttgattgggtttttcactgtggccattagagtgtttaagataagtactctgtttgtcgatactctaggatctctctttcaagtgggtttgatttgaagacgtattatatgtgtatatataaccgaagaataatgttatgttttgctaaatgttgatgtttagattatcaaagagaatggatttttgtatattcatgatctattgcaatgtttgattggtttagtgtgagcaggagagtggcaaagagatg

SEQ ID NO: 1153 - DNA, 3000 bp, Unknown
  misc_feature (1)..( 3000): cDNA_ID_2131018_gDNA_ID_1620364_Annot_ID_154767 3000 nt of promoter + ATG
gtattgtttttgtaaagtactgtttgtctgtctcttataattcgataattattttaaatattgctctattgaactactacttgttcgtcttattgtatgtttctaagtcaacttaactttggataaactctaagatttaatttatacactaaaccatctgcaatatagttttattttggatcgatcccactgctttacagatcagaagtaaataatccagccgtagttgcacgtgatttttaacaattttaaccattctagttatataaataagtactcgtgttgacaaagactaattatatatagtcaatcattagaggtaactttgttttataatctctatcaagattcggttatagagtctttgatacggttatatacatcaaggaaatatattctaggtcaatgagtgaaacaaataacggttttgctttattaatggttatacttttctattttgttgtgtattctaattatgctatagagagttacatgtatataagtataaagttgcgacttgtgatttcatttaccagtacatactcaaatgtataattgattaggtagattacatgtcacaatactctggatcggttgataaaacaacaccatccaaaatcacatataaacaatgattgattggttcttcgttattcaaattatatgtggtaataataatgatgatggtgatggtataaaatatatatagagagagatttagtatttaatcgatatctaattgtacattaaatgttttgttaattatcgttgtgaatgtagatttaaataacatgaaatataatttgtaagtttctcgttataattgtctacatcataattcataagtttaacctgtggcatgtaattcaaattttgtagttaataaaagaagaaccaaaaaaagtataacaaagttgtgatgtgaggaatgttgactttagatttggttgtagcatattgtccattctagtttttggaggtccttctaattgcaccataccagagtttggaagtatttcctttattgcaaaaacagaatttataggatccatattcatcctttcgattttgactttctacaaaaaaatgtgaccaatatttattgatcaactaaaaagtaactatatgagatcatgatatccgacattgtttgtgttaaagtcgtgttgtcactcaaattcagaatatgtatattgttgatgaaaataaataaactaggtcattatgggtgttgtatatcaaattagttgattattaaggaaattatatatatgttttttatgataaaacaaaattcagaacacaaatggtcaactaacatcaaaattaataaactttatgttaaaaaaaaaatgagaaatcacttaattttaaacaaaaatttccaaaaacattatttattaagaaacagatggaataactaataaacactttttctcaaaaaaacaaatattaatagaacacttaaatgaaagtcgtgtaagaaagaggcatggcaacaagaaggattaattttggtaatttaccttaaccatagtgttgttagtttgttagatgttcggttgtactaagcaccaacactacaaccttttctgttggattctaccatccttatttttaaaaattctaacatcaataaaagaaaatatatactcattttgtagaaatacattattgcgtctattgatgttactaaattataaaattgatcagaatataatttaaaaattaaaactgtgataatacaatgtcataataaacaaacaaaaaaaaacacatcaacatttcagcaaataaccaaaaatagacgttcaacagtcatggtcgacgccaaaatatcaattattattgatggacatatacttttctctaacattacataatctttgtataaactaaagaaaatagaatgaatattcgtaagagaccttcagtagatatcacatataaaaaatgttttgagtctatgttcttgcttttacacatatgtacggtcgagttcctttttgttggagtagcttagaatcaaacattatagctcactttataaaatggttataactccaattattagtagactaatacctaattacaagtagactttatacctataactattaagattattccatttaagattttagcaagctttttctagatttatttctccatggactatatgtagatttatataaaacaagaagatgtgttacctggtaaacgttaaaccattcaactaaaaatagatatgaaaataaaattgcaaatttccaggtgtattttctcgttgattttgttcgtctaatggaaactcaataataatggttcacgcttaaactattaccatatgccattaattaaagtatattattgcgagtggatatatttctatatataagaaaatcagaaatttcaaacaaggaaatggagaactccctaaccaccaagtccaagtcaataagactgcacaccaaatgcatgccacaggttggacaaagtttgatgatttcttctatctaatttccattttctcttgattattttaaaataaattattaacttggttaacatattattgtattggtacaagaacacaattggtaattaataagtattcaagtgttctaggatagagtttttttttaaacattcttatttttcattaaagctaaacttagtaggtttggtaagcatatatatgatcaagtcgcctcaagaaaagttaatagagtttggaattttctcactcaaaaatcatttttgttgtttacattatgatcaaaagcataacaagagtaccatttttaccaatataaatttggttattaaaaactttactcttttgagctcttatcattattcaatttcttgaaagctaagcctccagtttcctcaaacctatcattattaagctttcaattgaatactaatacatgactcactctgtcacaatttaatatatatatatatacacaaacacacatatatatatatacaatg

SEQ ID NO: 1154 - DNA, 3000 bp, Unknown
  misc_feature (1)..( 3000): cDNA_ID_2131039_gDNA_ID_1620364_Annot_ID_154773 3000 nt of promoter + ATG
gtgaatgacgatcaccagaagtcccagatgttgtcgttgtgtctccattcgccataacattcacaagaatcaaactcaatatcttcaaagtaggctcctctatactattctgtaccattgtcttgtaaattgaggatatgcagattccatacattttgcaatgaaacactgtgataagaaatatgttgttacatatgtgtttttgacttataataaagcatttcatttgtcttgcgactcttgcccaaaaacccagagataatcactttgctctatctcctgtaaaagttttatccttatatacaacgaagagccgattaacaaagattgactaacaggaattgctgacagttttcaaacgacttgaattggtcaaaaaacaagctgattttacatatccattcgcttggtaaaacctggctagcaattgattcaccaaaaggtttggcaatatcccagttttgatcatgtcacactgcaacatcattgtatcagtaatacgcttttcttggaggtggccctttaacattgaaacgtaactgcatatgtcaggggttatcccgcaggatctcatgtctgagaagaatctgctagctctaagaatgtagccgttctgacacaacccttcaatcaagcatgtaaaccccacatgattccaacagctcctctgttgattgttttcttgataaaaatcgatggcaacagagagtcgtccttctttccagaatccatctactaggcaagcgaacgtgtgatcattggggtggattcctgcctctagcatgtcactatacagcctgagtgcttctttcatgttggcctccttgaaatgtgcatcaatcaaagctgtgtaggtcacaacatcaggaactatacctttgatggtcatctcgaagtacaagcccattgcagcttttatgtctctcacattgcagtaaccatcgatcaaagtagaaaaggttatgatgttgggttctacaccacttgctgtcatctcagagcacaaatccagagcttgctccatattgtattctttacaatacccatgaatcagcgagttgtaagtcgcagagctcggaaaaattctctcattcttcatcttctgaaataatcgatttgcttctgctacctgatcttcaatacatagcccgttgataagtatagtgtaagtgaatacatcaggcgaaagattcaaactttccatctcagaaagtaatcccactgcttccaacatgttccctgatttgcaatgtccatgaattaaacagttataaacatataaattaggatcaaccccaaacttcaccatatgcacgaaaaggctcctcgcagttaccaattcgcgagctttgcaaaatccatcgaccaatgtaccgaaaacaacaacatttggcagcaattcagcaacaagaatctccttatacaatccgtaagcttgtctcacgttaccggtcttgcagtaaccatcaatcattgcactgtaagtatacaagtttggaagaacaccatgtttcttcatcaactcgaacattttctccgcttcctccatcttattatccctacagagatcaaggatatatatggtatagatataaacattcggcttgatccctaacgacgtcatttcatcaagaagtttctctttcttggagtaaagaccttgcttgaaacagcattgaaacaaaacaaagtaaatgtggacatcagggaccaacccacgagagatcataagttggtaatcaacccaaactgaatcaaaccgtctccttctaaccaagccattcaaaatcgaaagacaagcttttgaatccggtgaacatttcatctctcgactcacccaaagagcttcttcaaacaaacccatctccagaaactccataatcaatagactaaacactccgatactgaattttggactctgaatatcttccagagcattgaaaagtctatgagacatgttactcggctcactgtggcgtttcagacgttctatgaggctttttatcaaacatctggcgagcgtatacttgtgagctccggttaaaacatgaatcactgccgaaaaagattgaagatcgtttgacttggagactcgagatctcgaagacgtttcgaacagcttgaacgcttcttccgctgatctgcatttcagtattgcttcagccagactcgaagaagagaaagaagatgccgaatttgacagagaaggagattgagataagaatctaaagttgaaaaattgaaacttgaacaagtaaactgatgttctatgttggggaagcagaagcttcaacatctggagaggagattgtacgaatctactggtcaaaactgaaaactacgttactcttcttcgtgtaaatggtacagtactctcattggtttattattccggttaatattggtttattagataattcttataaccaaaattaatcttcgtaatctatgttcgttatagatgttaatgatgttaatgatatagactacagaagtaatttgaagccacatgaggaggttaaaacagagtgaaaataagtaatttggtgcattttggtatgtaagaaaagtagccaaaattgttaaactcagtcaataagtcaagggactttgattacagacgaaggaagtagcatctaatctaaggggcgatccggcgatgcactaaaaagtaaaaacaacacaatgtacttagttctgtacttatgttataaaatttgattgtttgaccagtaatatattttcccttgatttgagagaaagaatcttttttacatgtaaaacgaatctaaaccaaaacaataatatagaaattcctgaggaaaccgactgagaaagagaagccaaatttagaagatggccttttcctagcaaattgggcaaaggaaacccaccttaccaagttatcttcatacttcatataaatctctgctcattttcgataaaaagttgaatccttttcacattttccgctcaattcgatcttacatgttaacaatg

SEQ ID NO: 1155 - DNA, 3000 bp, Unknown
  misc_feature (1)..( 3000): cDNA_ID_2131052_gDNA_ID_1620364_Annot_ID_154778 3000 nt of promoter + ATG
tgagaacacaactgacagcacaactgaaatcagtgatctcccgtcgggccgttaaatccatttcaaaataaaaagtagacaaatattcatttcttattcataaagaaaatcattatttttcaaatgttaaaagtaaaagggggcagtctaaaagaaagaccttttaattttaatttttggggtgagtggatatttctcatggtcccaaattccccaattaagaatcactgaagttctctatcacctcacagataaaatcattttattattctgttttattttaatctaattgtgtaagtgtatccatttttttttatcagataagagtttccataactcagaattctaattaatgagtcctaattctacgtcccgattcagaatcagtagtgcctttgggaacgaaactataataattggcgtgtagaagtgtttaagcatgatataaagttaaacaaaaagatgattaactacaagaacattaaaaagaaaaagaatttaacctcgtgtgatgtggggattaatataacaaaaagtatattcgcatataatcggaacaaaacaagagtgacaacagtcaacaggaaagaataaataaattgtcgaaaatgctagagatcacataactgtggttttgagtggataaagcaacctgtccaagtataaaatttacgtcactagaaaaaagttaggacacaaaataaaatgtagagcaacttgttttgcaaaatgatagtggagaataagataaaaccgcaacaaaaaaagctacaaaatcacgaagagttagaagaattgaagcaatgtaaatgctcggaagtgagtcgttgcgaaaatttaggtttgtaaaatgaaggattatggtgagttttagtttgcaaaataactaaaatattatgggaccaaggaaataatcaagaataagtgaagatacactatgggaccgtttaagtaggttgacatatataactgactggaaccagcggatcttagggatataatcaatacttattgactaaaattttcccaaaagaaagaagaatcaaatgattactctatgtagtaacccaaactgatcctaacaaaattgtagaaatgcagatggtttaaatatgtggcgctctcataaaactcctacttcaggtaatctttttacacagtttggagctatcgtagctcttaacattttcactccagcaatgactagaaccaacagaacaatgagagattggcttctatccatagaaagcttcaacacgaaaaccgaccaaaacgaaatgttaaacccaagccttcttcaagcatagctgtatcatattctatcttccttgtaagagttccttttgttaaaaactaaatactaaatccgacttaaagaataataatcaagaacttcaaaatagcaaagtaaaatatacacacgcacaaattgataagagttcacttagcttgcagtacgagaactaggcaggggcagacctagcttaagagtgtaggtgtggcaggtgtttaattatatagaatttactttgtggcactaacatatttttgttttataatgcaaaataagatgttaaatttgattaaatttatatacaatacaagtttgtgttctatgtaaaatatttttctagatcaaacaaggtctagttttaaacgatccatgggagtataaattttatctttttcactctaccttgaaaaatgcgcatgagataaaatcataggtacatatacatacgtgaagaatagcatcagaaaatattgttctaactattccgataactaacaaaaccttaggaaacctcatcaagactagttcgaattaaatcataaggtttaggttgagagagtcaaagagggaatgatataaatagaagaatattttttgtttaagaatgatttttagacaatggaaagaagaatatgttaaggtggtatagacgacgagcaataatacaacagccacaaaagtggcaaacaaaaaggacctacgctggaaaaaaaacacgtgatgttacaatcaccctttcattctcaatgatgaacaataatgtttattattgataagaaaaacaataatgtaaatttatactttctcgttaaccagatttgttttttcattatgcgtttgcagtataaaaatagtaaaatacgttttaagtattaaactgtttgatagtttttttttatatatatacctaacagaaaccaactatttaaacaatacaaaaatatctgcaaagatatatatataatacaatcgaattcttaaaagttatatatatttgcaaacgtccctttagttattcccctccaactctccatgttggatcaatcattcaatttttttttaataaccaaaagttaaatgtacaaatatgcaagaacctacaggtacgtttacgtgatatataaattaaaatattgcatctcgtaccgaagcgcattaccgtatttaaaatacctgaaagtaggaaaatatagtactatacaaacaccacttttcggacattattttcatagaaaagttacgaattatcctttttaactattgatctatttaaataatttactaaccataactatcttgttacgttttcacaaaaaaaaaaaaaaaaaaatctcattacgtacgtgtatatatatggaatagctcataacctcaccactaccacagaaatcatgcctcttggttcttttccataagcttataacatatattttttttaaaatctactctgcgttaaaaaaatgaaaacacgtagcagcagtgtgggtaagatcaaagggtgtttctcgatcagtttcatattcagatgtatcagagttctcattaacagatctgtttctttttccttatctgattaaacaatttccttcagaattttacttttttgaacatatatagtttttctctgttcctatatcttgagttttgtgagaggttaattatatgaaattttacgcattattgttcatctatatcgaaaaacaatg

SEQ ID NO: 1156 - DNA, 3000 bp, Unknown
  misc_feature (1)..( 3000): cDNA_ID_2105020_gDNA_ID_1620364_Annot_ID_154775 3000 nt of promoter + ATG
gaaaaagacgttgcaataatagtgtatttgtgtggtcaataaacaatttacatgaaagccaaaagatcacgaggtgaaacagaagtctaattggatttacaaatcttgtctaaacacaaaatcgaatcttaataataatgtaattatattataatatataaagtatttatgtgcatattatttgaattcgctctagcagtcaaagaattagaaataaattattcgatttctaattttcactttttaaatgatttttaattctttatttcaattttttcgaatgatattgtataattttatgtggttaccacacacaaaaaaacgtaatatatagtgatatagaaacatgatttcatatattaatacactcattgattccaaataaagaaaaaaacgataagaattaagatgttttagagtttttttgtttgaccaataattctgataagaagtcttactcacttttcataaatggcctttagacccactcatcgctcaaaaaaattcagaaaaaaaaatgaattgtacaaatgcccctaagatcttacaaagaggcacaaaacaatgcaacttattacaagaccaaatcatcgtgactgctctcaaccccagtcatgctatgtatctcttgcatcgatcgtcaagagcgtaattgtgttacttcatatcagaactccaccatcgtccacgaatggttcgttactcaatattgtttgcaaattttgttttggttacttttgtttgtattacgcgaatgaagataagacacaatttagggtaaagtatataattcagagttacaattaatcaacaattttatatataggtaaattcaatcaaaacatatgttgttgatatgcagtgtattaatatgatcactcgttagtatagtatctgaaattctctttccaactactatacatttggagtcgctatattttaaaaaatataaataaaaaaaattgaaaacttaaagccaacacattgtttatctgaaattgtagtggaaaataaaagatgaaaactttgttggtcaaaaactccttttggtattataggtttttttttacattaagcacgtttttgctatatatgggagcgctttatttttttgtcggcatgtgtggagattttaatctaaagtaatttgatacttttcttttaatttcactggttgtcaacttgcaaaaaaagagcccaagcccactcaaattacgataatcatatggcaatattattaagccaaaccaatactgtatataatccaatgtcttcttttgtgacaaagacactttatttaatgattaaacgaatacattatatgcatcatctaacaaaaagtaaaagtgctgacatatcaaaagactagattcttattgcgagcatttcatgctaatagatcggtcttcttccgatggaatccactacaatccataaaatgttaatcattggagttctgtaaacagaggataagccacacaaaaaaaactatatagatctgcatataaataattaggcctcatgctaatgggctttacttaaaataaagcctaaaatagtattgtgacgaatatggagagacgttttggattctcattcaaatttcaacccattaatggctaatcactttgtaaatgtaagattgtactacttatatcttttacgaggtgatttgaatcaattaagtaatgcagagattacgatataattttgggaagcacaacttttgaccaacactccgaatcgggtctctttctctataaatagccatttcctaaacacacaattttcatactctctcaaacctccaaaattcttgatcaatatcagataagaagaatgagtggaaaacgcagcaatgtcggtggaggaaagagcggtggcgctggaggtaagagtggtggtggcggacaaagcagtggcggaggaaaaagcggcggcggaggagcaggagcaggtaatatggtagcaccagggacaaatgggggtgcttacatctcaagaggtggattcgagagtaaccctcaaggttactttagtaacttgcatggcagtggacaaagcaagaagtgacttgagtgttgttgttatactacaaccatgagccatcttctttgatctattctctatttaataaaatgctatgaagtacaaacaagtattgaataaatgagatttttatttttatgaggtgtttgttgctttgtgcttaacccactcttcttatttcttaatcaatctcgttagtcctcgtgaactatgtgcctaatcctatggatcatgggccttcttttttcagtatggccccatgatataaaagcatcatgtaaatagattacgaaatctatcaaatgggactaaatttggtattctgtttttttctataaaatgacctaaaacattttttgtatatataattggttgacaaaattataaaatttaaaacgatgagtttttcatgttaattaaaattttctatcaattgttttagtcatacatctcaaattgaatcttgattttagtatatacattcctattattttttatttatcaaatattttgtaaaaattataaatgacctaaaatttttttttttattaattaactttttatttaaacgacaatttatttagaaattatatgttttgtatcactagtaaaaatagatttattattttgcaaaattagcatattcccacaaatgtacaagacccgtcatcaaaagagagccaaccgtttgagatagcgataagccgctgcattggatcatccgaacaaggaagacgttacccacgagaccgtaatcacacgtggcggattctcagatattctctctttttcttctttacccggaaaaataaagtttctgttcttcttttttcttctctgggtttgagaattggtgtaagagaaacgattgaggttttctcttattatctaaacccaccaagtctttcaggattttagccagagaagcttgagtctttgattagggacatg

SEQ ID NO: 1157 - DNA, 3000 bp, Unknown
  misc_feature (1)..( 3000): cDNA_ID_2104953_gDNA_ID_1620364_Annot_ID_154772 3000 nt of promoter + ATG
ttctagcgtgaatcttcaagttaagagcacgacgatccaccattgcagcttcttctttcatcttcataggtttgaaaacctctgtgacagatggatcaagcaaactaatggagcaactaagtgtaacatcaattgacaatgcctcttcccaaagctctcttcctttctcaaagtttcctcctttacatagttttggtatgagcagatcataaacctgaccataaccacccactgagcttctcttcatcttctcaaacaattgaagagcaaagttaacccgctcgaccccacaaagaaccccgatcagatcataatagaatttgcgttcgggtctaaatcctctctcgatcatctcatccacaatttggttgcctttaccaaaccttcctgtcaaatacaggaccctcacaacgaagtaatagctccctgtatccggatcacatcccgatcttttcatctgttctaaaatctggcaggactctctcaccctcctagtccttcccaaacaagagagcaaaatgttgtaactcatagacgtaggttggattttgtaagacctcatctccaacataatattcaaagcttcaggaacaagcccagacgggtttcgattcacgtttctttcgcaaaggcaggtcagcaacgagttgaaacagaacaaatccggtgtaatccctgctgatttcatatcttgtataactcttcttgcttccttcacgtttctttgtaccgaccacccgaataaaagacttctatacacagacaattcattcccggatattacatccttgtgatgatgcataactcccaatgctctcttcacatgtcctctggaacaaagagcgcttataatagccgtcacagtgaaaccatcttgtgggcaagaaaatttgtccaagatcttgaagatacctattgcatcttcttccttaccaaccttaaccagagtttcagcgacaatgctaaacgtttgcttgtccatcgcccgattctccttcctgagatctgataagagtatctgcatagctgtgtgatccttcttctcagccaaaactcttaggacatagttgaattccttgtcgtgtaaactagatcccaagcttttacacgaccaggagaaaaacctcaacagccttctcggtgaagtctcgttcttgcaagactcaatcacttgggtaacaaggtttgatgatggagaaacagaaacctggttcaagttttcttcaaggtcatctagaccaccaactggagaagaaactatccgaataacttcatgcaacgccgtttccgatcggtcaactaaatggtgagagcaaaagtaacgtgtcagttttgcagtactcgttagatacgtaaacctgtttaatctgactgtggtggacatcatcttctctgaggaatttcatcaaacacttgatatgcgtatgcttcttaaaagccgccaaatataaaccatagaagggactctctcctgacttacatgtttctcagagtatttacaacttcgttgtaaattctttcagcaacatgaaattcagatttctattaaaagacctaaatttgcagatttcatgagatcgctcggctcaacaacaatatatattcatttgttggaaacattgcccgcgtgtctgaaaagggcattttagtcttttacattccatcacgcttcaaattcagaaccggataaaaccgataatcgtgagatacgatggttataacttataagtcactaaccggaatgattactctcgaaggccgccgatgcatattggaaaatcgaactcccgataaaatagttctgaaattacacgaataattaacatcataaagtcataaacaagttattggtcaatggtcgatggcaaaacgtaataaaagttggaccgggacaaaacgtgtcttacggtggatgaagttgagaatatatcatgcattattggtccacttgtactaacgatattcgcagctactaatatgagccaatcggtaatacgaaatattttagcttgtcgactacttactttctatataaaagtttagcctactaattatctctttttatgattatgacaacttgattatttgtttcccaaccactgatgatgagattaaccatcttttttgctaagaaggtaaatatttcatcttgctaatgtcctgtttacaagacaatttgcacacatacacttataacattagaaaaaaacacttgaaactttgttacaacatatcatttagcttgatttttcaatcactttaagaagttaatgaatcataatgcctaaataagtcctctataacaaccatgaaaggagtgttatatctataaccctgtgcttttagaaagaatcataatttttaggagtcttttgtgatgagaaattgagatgtaataaaagtaaaattttctatatctgtatctttcgttttttatttttattttgtttgtatctttaattcttcagtacctaaagataacagaaaaataaaattctgataatagattttcttgttgttataaatatattttaataaacgaaacgaagccgaatcctaaaatttggtttctgatggtttggtctgatctggtcatatattttaaaagaatttgcaattttttctttctgtcgaccttttgatatgtttgttgattttgatatggagatgcatcttcttatcttgtatcttaccacaataatatcaaaaacaaaaataaatatcatgagatattttctccaagatgacgtggccttttctctatctcaaccaaactatccaacacaacctttttttttatggcctgcactttttattgtccacgtcatctccttggcctaaaatatcccaagtcccaccattaagctacacaacaacgcgtaagaaaaagacttaatctccaccgtccaattctatcctctttcaacggtctctgatttaccatctctctctctctttttcgcgtctcataatttgaccattgattgacaaaacaaaaca

SEQ ID NO: 1158 - DNA, 3000 bp, Unknown
  misc_feature (1)..( 3000): cDNA_ID_2781970_gDNA_ID_1620364_Annot_ID_154766 3000 nt of promoter + ATG
tcaagaaacacacatattcaaacttctccaaagaaaagaaaatagcaaaaactagaatgaagaagacaatggaggatccaagcaagatcatgagaaggtcaattcacactttcctccaaaactaccaccgtgtcaccaccgcagccgccgtggccctccctttctccgccggtctcctcctctctcagcctttcttctcttcttcctcttccacccttcacatgaggcttaacatgctcttccgcggagcgggtttctcttcttctcatgacttcttcaacatcttaagccttaaactctcacaaaccctatcttcctctttattcactcttcctttctccctcacattcctccttttatccaaagcttacgtcatcaaacttctatcaaacaatcactctgcagattcctcctctgttttctacctccggcttctcaaaacttacgtttgcaacttcttcttccttctctctgcaaacgcctctgcttttgctctgtttttcttagcatacaatacccttgaagcctttggattctcttcaagaaacttctacactttcctctccctatcctcagcaatcatctactcaattatcatcgcaaacgcctttgtcatctctaatctagccttggtttcatcaccttcttcttcctcgggaggatacacaaacatcctcaaggcgtgtcttctgattcgcggaagaaattcaacagcaatggctcttgctctgcctaccaatctcggcttagcaggagtcgaagccttgtttcagtaccgagtcatgagatcttattacaatggagacagagatatcatatccatagctcttgaaggaaccttcatagcttacttatacgctctcttcttggttcttgacaccatagtcaacttcctcttttaccagagctgcatcaaaaacgaggaagatcaaaatatcggtagagaagacgagtattcaatcaagatccaaatcagcgaaacagagaacacaaagatacacatcaaaggatcaaagaacttgcaagaaatcttgtgactctcttgtgttggttgatgtaattattacttatacaaaaaaagtgaaaaactttatgagattattgattctttaaggataatctcaagtagctttcacttcaaagaagagcaaaggtacacacacagtaaagaacaatcacaggatctgcaaaactttttcttcttcctctgtttctgcttttctttattttagtctcttttttttccacattgtaaagtcaaatataccagaaattttaattaatgcaaatcttggaattcacatttggttaatcctacagtataatttcattgccgacaaaatatattaattagcaatgattttgattacttccttaagttatgaagatgttgactagattcacactttaacaagagtgaagagtcttttgtttttgagcaaggataagttcaagcaaaatctttcattacaaagagagaagaagaaatgtcacaattatctttaaatagacggtagaggcgaaagcaattgaactttttgtatttttcgttgaatgaaaatcctaataatacattgaaattgtgttaatgataaaagctcaacttaaaaagacaaaaaatggctagtgggtggtctacatcactaatctctctacttgaacctctttaacaaaaagccctttaatacaatagttcagtactacctaaaatttcttctaatggagaaattatgaatgaatctaatttacttttataggttaaaaagagtggaatccggaaatgttgcatctaaagagatcaagaaacaattaagcacaaaaagatgaattttataacaagcaaaattttgtagctttccaaacatacaaaacaatgtaatcattcatggtccatatttaggaattaggatcaagggtttataatcccaggtccgaccgaccgaatcgtataatctggtcctatcaaaccaaaattaaaacatttaaaccggatttttggttgaaccggccggttcatgggttaagcgaaacctctagggttttaatatttccagagttggttgagagcttcttcttacttttacttttcctctgctcgtagacagctttgtgcttgagacgattcccagtttctgcgattccaagtcgaagatataacctctcctatttgcgtctcagcttctacagagcttttaggtaagctcctctgcttgtatgattccttttaattttcaaaattcactgctttctcttgcgtatctgctcaaagtctctccctttttcatttaatcgtttctcttcctgaaacattcgaactcataaactagtttgattcaaaagttttcttgctttaaacttgtgttagctctagaatgttgttctttgtaatctgtttgtgacattgtggtggagatgatgaatgttaaagtaaaaggtctgagcaggttatgagtaaagtgtgtggcttttgatgtttaatttagttacgaggagtcaatctttgaactttataggagagggcccttgtccatgtcttgagccatggcatctgtggctccgcaacctctccaacaatgaacctgatttgtgtgtgcaatctgatgggtcgatttttaaaggcttggggttgctttctatcattgattgtcaatctagaattctccctatatacatttgtctccttgtgcttccttatcaccaattagctaccctcgtgattctgcactgatcaaagaccctttgactgatccacgtgagctgtttttatgagattatctataggtctctgttttttttttttttttttttttttttttttttttttatgtttgaagcttttgacaaagcttgtttgatggtatggttacctcattgttgctctatatttggtccttctttatttgtttcaatatttttattgcttaatccactgtataatagtttctccttcctcaattgagttagtttttcgtgattgcagcattaaaagttgttaaaatg

SEQ ID NO: 1159 - DNA, 3000 bp, Unknown
  misc_feature (1)..( 3000): cDNA_ID_3060884_gDNA_ID_1620364_Annot_ID_154758 3000 nt of promoter + ATG
aattcagacgactagctaatatattattttgttttataaagagtgaattggagaagagaaaagggattaataatcagcattataagtcaaaattagcaaggattcaactaatagctgatggagccaagaaacagcttgaggagaagagaaggagcaaagaagctcaagttcatggaaaagtaaagaaaatgagtcgaacagggaaagttcctaataattatttctgctttcggtgttactaaaatcaaaattacttatatcaatgaaactatatttgtatgtgttaaactcaaatcataaataaagagtaagtacctataattataaattttggtagatatcatcaccatggataatattgcagttttcaattgtctctcaacctaattccctattttcttttcttttctaaagatctgtctaattcttaagctttaattgttatgtcaaatatcataataaaatggagttatactccataaaaatcaaatattgatgtgatagtcgatgtttacacacgctctcgaccatatttcacacatgaaatgtatcatattatagacgagtaaacaccaaaaagggaccataaaggattttgatagatcgttaaactcaatttgtgatatgctctcaaaaggaaaatgaggcattctttggtccaaccaagttactctcttacccgaagtttctttctccattggtacgtagcaacacctatgtggtggccaggaccattcacatttactatcctctcttcttattaggaaaatttgtaatatatattgtcgttgtacaagtctcaatcaatagaatttcgacgatttaaattttattcaccaactattgatgtgtgtcctttcaatttatgatgcaaagagtaagttcaccgatcctatgccatggatacgcgttgcgtgaccttgtaatgaattcaaatgttatatacatttataaacataatacattctatataactttctcatagttacctagttaaaagtagaactcacttaacttgataaatatgatgttttcttcttatataaaagctatctttctcactttgttaaactcgtgtgttcttgaaagacttaagaaaaatagaaacttgaaatgaaagaacacatgaatagttaacaagtacgaatccttaaaataaatcctaaaaattcttcggaagatccactgattaaactttgctcaatcaagctttcaatctcttcactttttatctacctctttatctctcacacgtacgcacacatacatgaacacatgcatgtcctctgcttttatattacaaaagtgacgactttaggattctagctaaaacttgttatgataaattgaaaccatattaatattctttaattttgataagtaacaattgtttttcgggtttgtgttgagttgcataggcaaatttgtaaagtctcacggaaaactacgagtgttaattgaaagagtacattcaaatatcaaaagaacattgacagtgacatttaattttaatttgtagtttaatgtattttttatttatttattttttagttttatgtaaatctataacatcatttggtcaatacagtcattaccatcaactagtgatcaaagaataagttatcataaatcaaatgattagcagaaaacaattgatgtgaagaatctaattcgtataaaagagagtttgaacatcaaagaaaaaaaaaagcttgaaattgaacagataactctgaggagcgttaggattcgctgtcaagaatctaatgcgagaagttgattggctgaatttcacagatcaacactgggtcccaaaaaaccatccaataagatctttccacgtgtcattatgacgacatcagttttgaagctgtcggccgtaactcgagagcggagtgggtgaaatcacttaagattttgatgtgacatcaaatgattgggaaagaaaatctcacaatacaaaggggttgatccgtatttatccatttctctgtactttatagttttcgtattcttttcttctgactcaacatcacatatttcattcatatcaacttgttgttccactacaaacaaggcttataagcctcaacttatggttgcaagttgtaaccaatctgatacaaaagtactgaaccaatgattgaaaaagtcgtctatttttacctatttacgtacaaaactacctagacggctatgtattaggtaatctctggaccagtgcacatgaggtcctataagaaatttaataagtgatgctccattttgaagagtacatataaaaatatcttagatagcaatataaacactaactacagtaagaaatcaaaatttgaaaaacataatatgtcattttaagaaacaagtaagaacaatctttgcttcaattattcatggaaatcaatgagatatctctttgagaaatctaaaaaacttcttcttattcttgttcttctttctcccatggtagactagaaactttcttcccatacattactttttgtaaaatgaacttcttaaaaatgcttttcttttttttttactttttaaaaatgtttttatggtgatcatatgaacaagtcatttgatatattgtgagatgggaatggacagagaaaaattaaagaagtgattaaaagaggctgagaagtgagaacatattgattgattcctagcaacttgcatcaaatatctctagttgatgcatcaacctcacatctcactctcatttttgacattcgaataccatactatagtttcggattcttacgtgtttactccaataaatatatcttgttttctattctttaatgcgtctacatatatgtatatatttcaactacgtttattatactgtataacgataaaaatttacatttttaaataataataataaattctattattagaaatgtgtttgtttctaaatcggtgaatcacacgctttgctttgctatgctttctaccgagtagtcaaatgcatgcaataacacattcatg

SEQ ID NO: 1160 - DNA, 3000 bp, Unknown
  misc_feature (1)..( 3000): cDNA_ID_2131002_gDNA_ID_1620364_Annot_ID_154762 3000 nt of promoter + ATG
taacaaaatagaccaaattaacacccactccttcttgttaacctcacgttataattatttcaagaaaatttagatttcatcatttcctgttgtttaaaaaaaattataatctcatacgtgttagtccacagcttcggaattaaaacaaggttcgctctgttttaggactgagtttcgacgtttctcctgtagactgggttcttcttctttctctgttcttcgtgctctgtctgcaggtggaagacgagtctgtgctgggtttttcgtctgggcttctgagctctctgctttgtttctttttggattcaaggtttttcttgttttattttcgggcatgtgtgcttggttggccctagtggctttgtatgttttcagggcctatatgtccttttgggcttttggccttgtaatgttttaatggaaatataaaattttaaaaataaaaaaaaatagaattaatcataaagctctctcaaaaatatgtcatttacaatcacacctaaacgattctgcaccaattaaggtttcattgctgctcagcaactcttttcttctttcttttttttggttttgcaagagttccaaaataatttgagtagtctattgagcttgttaccgttacgcgctcatgacactctgattatagtgaccagtgaggcagtgaccactctcaactaataatgatatcaatgatcttgctacaagttgtctgtattaactcatccttgtttgtatccaagtaattattttagtgactaaggcaataacacatgcagattcacgtcaatcagtttgtcccattcctgacagataacttatcatattcgttacaatgttgtcatttttttaaaacaaacacgtacgacatgtataatttagaaggtaatactcaagaagttgtcaataaattcagtatctattattttatgaagatgatatgatttgacctaaccaaattcttcagcttggtgacggacgtataacgaatacttattggttgtcatctacaattatatatgaattgcttcataaactatttcgtcggcaaaaatttctttccaatcctgaagcgaaattattcatgttggtaatagactaataggctaattaacagcgcttaacgcgtgaattttcttaaatcatctttcctttaattaattatcttctcaaatactctacaattatataaatgattaattatgatccatgactttgtctattgtatataaaaatatatatattataatgttgttaatatttacaagaaagaggacttttttgaaaaggaaacttttttgtctcctctataattttggtgcaaagaataattatatatgaatgtaaacgtttagtaagacatgctttgatgaaaaaagctcatttggtagcttactggaaagagctttttaacggggtcaattataaaaccttaaaataatatctaggcatccctcttggaggacaaccaaaaaaaaaaaaaaaaaactactctgtagagaacaaaaagatgaagtctagttggtaaaaatttaaagttttcgtgttaatattaggttgaaaaaactatattctgttaaaaaaaaaaaacatacacacaactaattaaattggacctacagttattttttcaacgtactacgtatttacgttaggttagattatgattgatcaaacgggttctatttattaaaattaaacaaatttaattgatacattaatgtgtcacgagttcaactaaggaattaaaatactgtgcatggaaatattgaatttgcatatactgtacacgatgagaattaaataaattaaaatatatatatatatatatataccccagcctcgatttgaagtggacaggttattttatttcaaatagaacgatataaatccactgtatatctattattttttaacagaattggacctacaaaaaaaaatctgaaattgttgtatcgaagtgagttggtcagtcagagattatgattgatcaaaccaggtcccattcatcaaaataaatgatatttttagttttttttgttgttggaggaaatcaaaattaatgaatatacaatgtactagaggcattcaacatatttaatcggatatattaatgaattcaaatatattgtttccatgaaaagaatttactatttagatactaatcgataatcatactattgaacttcgatattcacggagagaaattatagaatattaaattttggataaggattagctccgatttgaattgtggctgagaatgatatcggttcatgctggtcaaacaagtcccatggtttacttaaaaagggagaaattagcaaaatgggtgaaatagtctgttttctttaaaaattataatttatcaaacgacacatatataattactttttatcttaaccatgcatataacacataaaacaaaaacaaagttttccaaaatgtgatcatagagtaattatgtatatacaaatcaacaattgtaagaaaaaatgaatcatctcataatatataattaaccaataatgattagcaaatgatgtaaaaaatcaaaattaattaattaaatttcctaaaaatataaactaaacaagtacagtatttagcttgaaaaaagatatttatgaacaatcaatatatcacatgttgtctgtcgacaaagacaaatgtaaaaaacaatcaatgacctttaatttcatcattttgattgtacttgactcgtgttttttgtctaccacgtctcgtcgtctctttgatttattattgattgattcattcatttataatttccacgtttcaaaaatgtcactagctagctaagtttatgtagctatattcttttaaccttagttctcaatgcagtaataaccaaaaaaagcaaaaaaacaattgttgaccaacaacaacaaccaaaaaaaaaaaaccactatataagcatgccccatgacccatatatgacaccacgagaagcaaatcaaaatcagttactctccgtccaaa

SEQ ID NO: 1161 - DNA, 3000 bp, Unknown
  misc_feature (1)..( 3000): cDNA_ID_3060955_gDNA_ID_1620366_Annot_ID_154836 3000 nt of promoter + ATG
aatgcgtctcattcggatgatagtttaaggagtttggaggttgagctaaatgaacttagccggattaaaccgagaaatagtatattaaaccgaactgaagataaaccggagcagcttacccctacttcggcttggagagccgccgagaaattagctaaagtggctattatgaggaagcatttaaatcgagtcagcgatatgcacggcttggaaaacgccagattttaattttaatttccctttttttcgaaaattcgatttcaatgatttttgaatatataatggtacataatttatataaggaggataagcaataatttagtaaggtataaataatagaagtatgattattcagaaaaagacccacataggtgcatgatagcgacaagcagtagccgacgggtgtggccttttgtattgcagagagattgagaccctacattagaaggaattaattggtcttttagcatttttatcttcttcttcctttttgtaatcttcaaaaactccaaattaatgactgaatagttaaaaaaagttgtagatcaaataaatgaagtctgctttttttgtgtactatatagaattaaaagttgaggtatagtggattagagagtgtgcttgtaatgctggacttcaaaatcaaaagttaagtttatattatcatatgccgtttaacttaagaggatctataatatattatatctttccaaatgaatgatcatgattagtcatgtgatcatcattatagcctattttgttatagaaggcaccgggtttgaatgatttgaatagtgcgtggggattgtctttgttggttgttggtgaatggtttggtgggtgcaccgtggtagaaaccaggtcatgcgccgttgcaaagctttcttctcgcttaaattcattcattttatatcattaagacatttactaattatatgtagctagcgccaagttgcaatttgttttgaatgcaatgattttgtatacttttaaaatggatgaaatgattaactattgtcaaaggtccacttctcgatgtgattcactaaaatgatcagtggcagaagaatctcgaactatatatatggtcaaatcataactaaaaaaactaagctattattttttcacaaaaaaaaaaactaagctatcattcatcacgcagttacatattgcatatggacaatgttaatgtcaactaatgaaagggaaagaatctcgaactatatatggtcaaacggtttgacgcaccatacttaaaaaaatactaatcaaggtgcattacattcattgatgttacaattacttgtactaatgaactctgtgaaaatcagaataacccggtataacacactatttggagttataatggctgatccaacttttgggagattttgtcacagttgggctacagtttgtgcaatcggcaactgtaaagcccattgagaattccaaaaataatgtaaaccaattaataaagcatttacctttggcgcctgggacgaaaataagataccgaaaacaacctttactctacaaacataggtccatgtaaaataggcttaggcccaaataatgtaactctaaaacaaatctatgaatctattaatcaccaaagttatcttttacataatgtaatgggttatttaaggagagatttaataatttcgaaaatgtttggtcaactccgaaaaggtgaacgtgttaattaaaaagtcctggtactgcggcagagagagagattagcccatatgacgtggttgtgatgtgtccgaaagctgtcaacattgaaaatcaacggtccagatcagtatactgacacttggctttgtaaatttgttaattttcttctctggtcaaaagtgaaagtgttaattataattaaattttatctagttttcaagtaaccatccatttagtacagccaagattggattatctttaagtttttaagttattctaacagtctttattgatgactttgtatttgcaagagttgcaaccaccaatatcttctattacatatttacatcaaattcagagtatatgtcatccatacaaaataatacattatcgtaataaccacacaaactccgttaatccatttgttttcattggcggtggactattttaaagaagaaaaatatatttatttttttgtcagaaagtaaaatattataatggtgttgaaactgttaacaccattataatatatatataaaatctaagtcaaactactgtggggaaatttgattaggaaaacaaaaaacgtgctttaaaaactatgtttgtacgctgtacggataagatatttggaaacgacacactatatttataatccaaacatattttaaaagaattaccggactgtattagttgaaatgttattggaactgtttcttaattacatatattaaaagtattaccggactgtataatctgtattatttgaaatgttattggaattgtttcttaattacaaacgtgaagacatgaatacgacgacaagtattatacaaagttatccacacccatgtgcacgtaaagtatgcttaataagatttccaaatctatctataatcaacgtaatgtctagtcacctaattatcacaatagtggacaaatagttgcattatctacaaaatcaagattatactctctatatgagtataacgtgagtgtcatcatttaattatagaaaaaacacgattatgcaggctaattaaaacgcgttaattactgagtcaatgaacctataaaaccggcttatgctacccctcccaatctcatcacaaccattagtctctctttcagacaattttggttctttttcttttgtatttatacattcttaatcttctacaaaacaaaagaagaaagacacatttcggtactaacattgttcttcatacctctctttaaattcatatacgtgtatatactttgtttatacgtgtgtttgtgttaattgtgttgtttaatcttaatcccaagttagtagaa

SEQ ID NO: 1162 - DNA, 3000 bp, Unknown
  misc_feature (1)..( 3000): cDNA_ID_2045650_gDNA_ID_1620366_Annot_ID_154851 3000 nt of promoter + ATG
ttgtctttggtagcaaatcccagtcacttggaagcagtagatcctgttgtgataggtaaaaccagagcgaaacaatattacacgaaagacgagaacagaacaaagaacatgggtattttgatccatggggatggtagctttgccggacaaggagtggtgtatgaaactctccatcttagtgcacttcctaactactgtaccggtggaacagtgcacattgtggtgaataatcaagtggctttcacaaccgatcccagggaaggaaggtcttcacagtattgcactgatgttgcaaaggctttgagcgccccaattttccatgtcaatgcagatgacattgaagcagtagtgcatgcttgtgagcttgctgctgagtggcgccagacgttccattctgatgttgttgttgatttagtatgctaccgtcgctttgggcataacgagatagacgaaccgtcattcacacaaccaaaaatgtacaaggtctggctattatatcatccatctctgtgaaataatctaataaccaattcaagtttccatttcatacttttcttgtactttttttttgtttaaaaacggatgttacttgttggtgataggtgatacgcagtcatccctcgtcacttcaaatctaccaggagaagctcttgcaatctggacaggtaacccaagaagatattgataagattcaaaagaaagtaagctctatcctcaatgaagaatatgaggcaagtaaagattatattccacaaaaacgtgactggctggcaagtcactggactggattcaagtctccggagcagatttctaggattcgaaacaccgggtaaaaaacatttttatttcatttagtttgtcaatgccttttggccttttttcttttctttttcaatgtaacattttgctggaaaactattcccttgttcttttgcagagtgaagccagagattttgaagaatgtgggaaaggcaatctcaaccttccctgagaactttaagccacacagaggagttaaaagagtttatgaacaacgtgctcaaatgattgaatcgggagaaggcattgactggggacttggagaagcacttgcttttgctacactggttgtggaagggaaccatgttcggctaagtggtcaagatgttgaaagaggaactttcagtcatagacactcagtgcttcatgatcaagaaaccggggaggaatattgtcccctcgatcacctaatcaaaaaccaagaccctgaaatgttcactgtcagcaacaggtatgcatttttttttaatctctagagatgataaccactcttcaattgtttttacatgatctttacgttgtttgtgtatgcagctccctttcagaatttggtgttctcggtttcgaactgggttattcgatggaaaatcccaattctctggtgatatgggaagctcagtttggagactttgctaatggcgcacaagttatgtttgatcagttcataagcagtggggaagccaaatggctccgtcaaactggtctagtagttttacttcctcatggatatgatggtcagggtcctgaacattccagtggaagattggaacgtttccttcaggtatattatatgaccgatacttaccgttaagattctctccactttttgtatttgtttccctctcatttgaaaattttaactgcagatgagtgatgacaatccttacgttatccctgagatggacccaactcttcgaaagcagattcaagaatgtaattggcaagttgttaatgttactacacctgccaactatttccatgttctgcgtcggcaggtaaaatatctatttatcccaagttcgtaaaatgttgttacttaattttcgtattcttcacactcacatgcttgatatcatccatttgcagatacacagggactttcgcaagcctcttatagtgatggcccccaaaaacttgcttcgtcacaaacagtgtgtatctaatctctcggaattcgatgatgttaaaggacatcctggatttgacaagcaaggaactcgatttaaacggttgatcaaagatcaaagtggccactctgatcttgaagaaggtatcagacgtctagtcctctgctctgggaaggtataaaaaaaaagatccactttttccgtcattaactaacaaagttcccacattctgaaatttaatactttaaatgtcaatgaatcaggtctactatgagcttgacgaagagcgaaagaagtctgaaacaaaggatgtagccatttgcagagtagagcagctttgcccatttccatatgatctcatccaaagagaactaaagcgatatccaagtaggcgtcgaaaactcaagtttgtgttcaatagttttggttgattatggaattctttgaaacttttgttcttgtgtttaacagatgcagagatcgtgtggtgtcaagaagagccgatgaacatgggaggataccaatacatagccctaaggctttgcaccgcgatgaaagcactgcaaagaggaaacttcaacgacatcaaatacgttggtcgtcttccctcagctgctacagccacaggattttaccagcttcatgttaaggagcagactgatcttgtgaagaaagctcttcaacctgaccccatcacccccgtcatcccttaaaaaaacacagcttgagaggcttgagcctgtataaaaaagacacaacacaaaaataaaagattcatgagagaatctttggttaccaaagagtgtcactggaaaataaacagatgtttgctagacttacaaatttaagtttattcgatttgtttggtttgttataggatttaatcgagataaaaggaaaaaagatttaaaccgtttggtttagtatgataattcattaatttggttcaactttggattgattttggttcggtttggttttatcagtgactgtatcagcttgaggcagttgcaatcttgtaactggagagaaaaagctatcaaagttaaaagtt

SEQ ID NO: 1163 - DNA, 3000 bp, Unknown
  misc_feature (1)..( 3000): cDNA_ID_1822768_gDNA_ID_1620366_Annot_ID_154855 3000 nt of promoter + ATG
gtaaataggcgataacattataataagttcaataatacaaactttataagagtttattgaatttttgttgggaaaattgaaaaagaagggatggcctacgatgcaaagaccaattcctgtttcctactagtgttgttgaaatctgaatacacattttgtcatgttgattagtgattacccttagcttcaaagttcaaattaactttacactaacttttccataagtaaagatattttattcatgacgatacatattttattctacaaaaacatataaacagtgcattgtacctcaataatttgaagactttatatttttccaagtgctttgacttttaactctttattaaccatcaggagacaagtcaacctttatttccctctagaagcctttggctaatttattaaacttaaaaacgaaccaattaaaagttacaattcataattatttttgtttatgattttttcactattattaataggctattcgcatgtatattcaatcgtatttcacttgttttgcaaggaactaaattataataaacaatacacccaaattgaccaacttatcttacacaaaagattaagagcatacgtttatagaagaaggtccaaaaaattgtgacgccatttaataagaggtatagtgggttttcttgttccttaatctcagctgccgtggaaaataagtgttagtagtaaatttattgaattaaattataatagttagatttgtaacatccctatcaaatctttgattaaaatttgattttgggtccatgggacaggcgtcattaggttcaattttaatactgcatgattattaagtggctacatttataaatgaattaaacaaacccatctatcaattcagtattgtcaccgtgagtttgaaactttgtcattttataagttataatccgttatattttattacaattttttctcttaaggagattaataatagataaaatcgtacctgatccagaaaagttttaatatccataaatttgttagtggtaaattttctccgagggttggcaaaattttgttcaccaaccgtaacggaatttacactcacaaatttcaatatctctaccttcttttcatctcttttggtacatatcattaactcctttccttttcaaaagacaaatgtatattaaatagcaagtgattcaccatccaccaaatgtgatcttctgattagtgatatttctttagacaatttaattgatggatttgaaaggaaaaaaactttgatatatatagtatgaagaagtttctttgtatttatccaagaactgttagttcaatcacttgcgctttgtttacgaatgattaatgacgttaactattcaaatacgatgctactctgttgttgaattcatgcgctttgttttcgtctttgatttttaataaatttacatgttcaatacaaatatcttttttattggtataacaaagaaccatgataagactgatacataaaataagatgttgtcatgttcttatttaactactatatacttatattgatcatgctcaatgggagtttgtgtatataaaaataaatttagaatttttctttgtttttttttttttgggcaaaagaatttttctttgttaattcacacatttccatcaccaaacattcgaagtatttgtctctatctcgacaacatttatatatatttttttcttttttttgaacacgactcgacaacatataatacactcctttgtactgtatactacaaaataaactactaaacaatattgactctataatatataatttatatatacatacaatacaagtctaattcaatcacttttggttcaaattggaaaaacattgaattcttctattattcttgatgaccaagtctatatcacatgtaataaaagtacacataaccggtctttctttcttattcgtaagctgccatgcaagtggggcttcaagctttcgtaaaatctctcatgtattccacattattaatcgaatttaaagtattttgcatgttatttagattagaaatgtcgttttcttaatcacactcctaaactgcggatcagatataatcaccaagattaaataatataaaaatataatcactacttgccaagacatgaatcatgaggaaagttctatagcgtgtactaacatacaataaatcatatttatgcgtatacatttactagaaccataggatcgatgaatcagatgcaactcatgcagtcatattacaatatatatttagatatgttcatcttgatctttcaacttaaaactcgttcatattcatcatttaaaaaaatatatatatgaatgtaaaaaaatggtaatttaaaattagatgagaatggggaacaaattaatcaccaaacaaaaaaaacggaatagagtaaggaagagagaaagagtcaatgagtgggggcggctaagaaaacattataagtttataacttatgagttttatgattaggaaaattataataaaacttgttgtcgaatagtaaaattataagaaaactaagatattatttctcagtcaaattataaatgatattgaatatctagattctgatgtaggagcaaagacaaaggagaaaaacattagtctccccccttctctgtcatttcttaactctactaatattttatcacataatttatcatccaattttccaattccataaagtcactttttgattcaattttattttaattccctatactttattgacatcttccatcacatgaaggactatctcctccagctattatatactctctctctctctcctttattttttctcaattcacatataattttcacctttacacacatttccatgtaagtatatataaacctcacacacgcattatcatacaccatcctcctcattctcttcatcatcaacataagagagagagaagaaaaaaagaattacaattaataagaacaagatcaagaatcaagaatcaagaaa

SEQ ID NO: 1164 - DNA, 3000 bp, Unknown
  misc_feature (1)..( 3000): cDNA_ID_2045658_gDNA_ID_1620366_Annot_ID_154848 3000 nt of promoter + ATG
gccgaacatggttcccttccacaaccagtgtagcaaaagcaagtgcttctccaagtccccagtcaatgccttctcccgattcaatcatttgagcacgttgttcataaactcttttaactcctctgtgtggcttaaagttctcagggaaggttgagattgcctttcccacattcttcaaaatctctggcttcactctgcaaaagaacaagggaatagttttccagcaaaatgttacattgaaaaagaaaagaaaaaaggccaaaaggcattgacaaactaaatgaaataaaaatgttttttacccggtgtttcgaatcctagaaatctgctccggagacttgaatccagtccagtgacttgccagccagtcacgtttttgtggaatataatctttacttgcctcatattcttcattgaggatagagcttactttcttttgaatcttatcaatatcttcttgggttacctgtccagattgcaagagcttctcctggtagatttgaagtgacgagggatgactgcgtatcacctatcaccaacaagtaacatccgtttttaaacaaaaaaaaagtacaagaaaagtatgaaatggaaacttgaattggttattagattatttcacagagatggatgatataatagccagaccttgtacatttttggttgtgtgaatgacggttcgtctatctcgttatgcccaaagcgacggtagcatactaaatcaacaacaacatcagaatggaacgtctggcgccactcagcagcaagctcacaagcatgcactactgcttcaatgtcatctgcattgacatggaaaattggggcgctcaaagcctttgcaacatcagtgcaatactgtgaagaccttccttccctgggatcggttgtgaaagccacttgattattcaccacaatgtgcactgttccaccggtacagtagttaggaagtgcactaagatggagagtttcatacaccactccttgtccggcaaagctaccatccccatggatcaaaatacccatgttctttgttctgttctcgtctttcgtgtaatattgtttcgctctggttttacctatcacaacaggatctactgcttccaagtgactgggatttgctaccaaagacaagtggagatgtttgcctcctctagttggacgatcataagatgtacccaagtggtatttcacatcacctgttccggtgtaaagcccaacttcatctactggcctagtaccaccgctaaactcgctgaatatttggcgtagaggttttctaacaacattacccaaaacattaagtcgacccctatggggcataccgataactatgttctctaccccgagatctgcagacctatcgaacatctccttcatgccaggaatcaaagattcagcaccttccagtccaaaccttttagccgtggtccacttagtagccaagaaattctcaaactgtgtgctccaggtaagcctatcataaataaccatccgacgctcactattgtactgtcgaggagttggggtctcgatcttgtctctcaaccagttacatttatccctatcagcaatgtgcatgtactcataccctatagtcccacagtaagcttgctcaagcctcgacagtatcgacctcagtgtttgaaccgggcggttctcagagagaaaacccgacatcctccatacacccagaaagaattcccgatcaagatcagcctcagtaaacccataaagacctggcgtgagatcctctggaatctctctcttctctagacctaaaggatcaagcttggccttcatgtggccattaacctggtaagctctaactagcaacaacaaacgcatgctttcttgaatggtttgccccgagataccaggcgatgtagaagcctgacccacaaaattcctaaaaaagttatcccacgactcatcaacactgttgggatcagcctcccaagctctttgtaactcctctagatacacactgcttgttccatctaagaagctatcagttagcttagaaagtgggacaggacgtggaacaggtgcagcagactctgcctttgatttgagtattgtagagtgaaaacatctggtttgacaaggcaaaacccttgttctagtggcatatgaaccacaacgagactgagacagtgtccttcttatggcaagctttgccacagaagaaccgattctaaaccaaaccatagcttaagtaatctatcagtaacaacgaaccatacaatcccagagtctccgatttttcaaattgtttaatctctgaacctgaaaatgatccattaaacaacacaataaaatactcaacaacataaaaagaaagtagataagtcaaaaatggctaatcaagtaacgacttagttatatatatatatatatatatatatatatatatatatatcatgcaaacatacaaaacatagaaaatttaaaacgaaaataacctataatcccatattttctcagcgatctgacctcattcagatcatcgaaatgtttttgaattcccaaatattttggctttaacaactttcaatttcggagaatttccatcagagaaaattaacaataaccaaaaaaaagtagtaactgaaaaaaaaaattaagcaggaagattcacgaagaagacgaacctggatcaaagatggagacgatcccagtgaagtggcttctaggagacagagaaagaaggaaagaaaagtaagaaagtgcaccgccttgaaaaatccatgtttggctacaaggataactatatacctgttattttaatacttatataaactgggcctcaataagattcattaaatattgggcttttaggcccaacgtaacactcgaagtcctcactcaaatacttgttcctaattattaactgcgccataataagattcatcaaatattgggcttatcggcccaaaacatagcactcggattactcgagatgcagaaagtttcagaggttgaagatgatctgcgtagatg

SEQ ID NO: 1165 - DNA, 3000 bp, Unknown
  misc_feature (1)..( 3000): cDNA_ID_2050499_gDNA_ID_1620366_Annot_ID_154838 3000 nt of promoter + ATG
ttctgaacattatatttattaccactcgtaagtcactttccatttgcaggatttacttatacctaatggtgtcagattgagtttgtgtctcttttacaacagtatcgcaccttctacatccaatagacaactaatgaaagctagaatcaatcaaaacagatttacactagaaagaaaaggatgataccacattgaaaaattgatgaatgtatgaacaggatggtaacaatttaacttagaatcgaaattttggtatgaaatcctctgaagtctgaagagttttaggtttagttgaaaattagagtactgtagtagtttgagatcctctagacgaagcagaaggttccatcaaattctatttgtttcgcgggccaacccgcaagcccgatattttatggacatatgtagagttcaagcccgccctgtgatgatgcttattggggcaagctggtgggtttgtgggccgcttgacaaaagaacattaaaaaaagacaaatttgatggacaatcatgattgttgtggttagtatacatacttttgaggatcggatcatgcaatgagtgaattcttcactttaattaaactcatcagattctctcacagtaacaactaacaaacaaaggaaacaaactcatgaaaagccatccaaggaaaaaaggaaatctttatgtgaccgttaagtgtttcttgtcaaatattatgtgaccgttaagtttatcttgtcaaatattatgtgattgtgaccgttgttaattgtgattagcaatttccttgtttcttttgaacctctttgctccccttataaataaatagatgagagacgctctcacgcagtctcaacaacgcttcttctaattcttccttgagagacaaatcaaaactctctctatttctttctttctcatcttcttccttcagagacaaatcaaaactctctctttatacataaactctgtggattccgatcgatgatgatgatccaagtagaagccgacgacgatgatccaagcaaaagccgatgcaacatccgtaagatttcagactgatcggagccgaaattaaagcatatcatcgtttcatagattgaatgataatctccttcaatccacggccgtcgtctaccgtccaaaacaaaatagatttcagttcaccggataatgatctagccaccgagatgctttcaccggagacaacgaggaactaagaggatggcgaaagaaaacacgaagacgctctcgtttgtggtttcaagtttcagaacaagcacgagtcgccgcctgagtatatcacgacttttaggtatattactttactaccctttttcttttttaataaagattatgattttgattttaaaaagaaaaaaaagattttatgtttttccgttctgatttttctgatttaaaactaatcacaaggttttcacaaatatttttttaaataaattgttttaatttttgtttttaatagattttttagtgttaaattttaaatatgtgtaaactattagatacattatcccgtccataatatgaggtctttaagaggtgttttaggtttaatatgttttgcacatataaatttttaacacttattctttttatttaaaattgtttttaaatttgtattttatgcactatttaatttttgttttgatttttaagtaatattttagataaaatgttttattttttaaaatatacataatatttttgtttttaagtgttaaattttaaatatgtgtaaactaattggacacaacatcccgtccatagtatgaggtcttttagaggtgttctaggttcaatatgttttacacatataaatttttaacacttatgtttttatttaaaaattaaattactactattttaaggttttcgattttttaactaatattttagataaaaatattttttatttttaaatatataatatttttgcttttaaatgttaaaatttaaatatgtgtaaactagttggacataacatcttgtccatagtaagaggtacttaagaggtgttctaggttcaataaattttatacatatataaattttaacacttatgattttatttaaaaatatatatattttttttaataccactattttaaggtttttgatttttaaagtaatattttaaatatatattatatttatgtttttaagtattaaaatttaaatactgtatgtgtaaactaattggacataacatcccgtcgatagtatgaggtccttaagaggtgttttaggttcaacatgttttacacataaataaatattgtaacacttatatttttattgatttgttttttaaaaatttgtatatttttaatacacattgtgttctaggttcatagtaaaaggtgattaaaaggtgttctaggttcaacatgttttacacatataaattttaaacacttataattttatttaaacatattttaaaatttatattttataccactattttaaggtttttgattttttaagtaaaattttatatttttaaatatataatattttaaaacaaaaatattaaaatttaaatatatgtaaactagttgaacataatattcggttcatagtatgaggtctttaaacacttaagaaaattaacttactatgttttttttatgtatttttgggttacttttatttaataaattatggggtcttccctctctcgaccaaaaaaaaaaaacattgtaaggtgagttttgagagtaacaataatattggggtatatttttaaaaatattgtagtggtaaataccgaatttccatatagtttctgtgtggcttatatttgtccttttatagggtgcaattttagagtaaagatagtatctaggtttaatgttaaagattctaataatgatggggcgttttcgtgttttctatttatttaagctccatttattattaccggctgttttctattttgtcgttcccggtaaattttgccggcgaagattgaaacttttccaaacgatg

SEQ ID NO: 1166 - DNA, 3000 bp, Unknown
  misc_feature (1)..( 3000): cDNA_ID_2992487_gDNA_ID_1620366_Annot_ID_154847 3000 nt of promoter + ATG
tcttaaagaaaaaaataaaaatagtattgggcaacttataggcccattatgtatattaacaggccagtttctcataggcttttgatactttcatggactcgaaaatttagggtttcagagacgaccacgttaccaccgtcatgaaaccgccagtgaccgtaacatattcacctctcgcatcttcttcttcttcacggagaagcaatcgaagagaatcaatcaactagacaaaaatcggaagaagaaacacaaaccgaggttttagaaacatggcgtctaaggtaatctctgccacaatccgcagaaccctaaccaaaccacacggcactttttcccggtgtcgctacttatcaaccgccgctgctgcgacggaggtgaattacgaggatgaatcgattatgatgaaaggagttcgaatttcaggtagacctctttacttagatatgcaagcgacgactccgattgatcctagagtattcgatgcgatgaatgcttcacagatccatgagtatgggaatcctcactcgcgaacgcatctctacggctgggaagctgagaacgccgtcgagaacgcacgaaaccaggtcgcgaaactgatcgaagcttcaccgaaggagatcgtattcgtgtccggtgcaacggaggcgaacaatatggcggtgaaaggagtgatgcacttttacaaggacacgaagaaacatgtgataactacacagactgagcataagtgtgtgcttgattcgtgtaggcatttgcagcaagaaggatttgaggtaacttatttacctgtgaaaactgatggattggttgatttagagatgttgagagaagctattaggccagacacagggctagtttctattatggctgtgaacaatgagattggtgtggttcaacctatggaggagattggtatgatttgcaaagagcataatgttccgtttcatactgatgctgctcaagctattgggaagatacctgttgatgttaagaagtggaatgttgctttgatgtctatgagtgctcacaagatctatggaccgaaaggtgttggtgctttgtatgtgaggaggaggccgagaatcaggcttgagccgttgatgaatggtggaggtcaggagaggggattgcgtagtggtacgggggctacgcagcagattgttgggttcggggctgcttgtgagttggctatgaaggagatggagtatgatgagaagtggattaaggggttacaggagaggttgctgaatggggttagagagaagcttgatggtgttgtggtgaatggttcaatggatagtcgatatgtagggaatttgaatttgtcgtttgcttatgttgaaggagagagtttgttgatgggattgaaggaagttgcagtgtctagtggaagtgcttgtactagtgcgagtttggagccttcttatgtgttgagagctttgggtgtggatgaagacatggctcacacttcgattaggtttgggattggtaggtttaccacgaaggaagagattgataaagcggtcgagcttacggttaaacaagttgagaagttgagggaaatgagcccgctttatgaaatggttaaagaaggtatcgatatcaagaacattcaatggtctcaacactgattcaacagttccactcaaactgtgcgggacaagagggaatctccagtctgtggtcagccggggtatatgagagccatactgagatgtgagtatgaacgatgatatgatcctgtgttcttactatgttctgttggtaagttatctatctatattgctttctagagagaattgcatgtgagagtttcttgtgtggttttgtaataaaacagaaacaaaggttcatttctggttagattgtgatatcctttgaaattgaatgattaatttttaggtgttgtgagcttagcttttttagctacggtaatggtgaagtttgttttgtttttcttcttatttatgaaaataaaatacaattttatgtgaatattttttttattcctcttttctcactctctaaaaatgtcggcgagtctcactaagatgttgaagtaacaaaacatgaaatgagaaatgaaattaatgttcttaccttcatgttaagttgaagtagatcataattatcccatgtgatttggtaccaaagttttttttttcagatctacgtacactcgagtcgacctttgctatgaactcaaatatgatccaataaaattttatattcttctgtgttttttttttttgtattcaaatttggatagaaacaagtatttagtaggtcgtaggtgccataggtggcccttgggaaacatccaatggatacaaacctcatattataaattctctatgccaaaataattaggaccataggttatgttatgtacctcaaccatcctttgattgagacattaaattccttcacgtttgtaaaccacactttcgtatacattttcttccctaacacttcttggcactgtttcttttattaatttgatttttgaaacatatgtcaaaagaaaagaaaagaatcgaaacatttaattaattaatgtttgtaattgcacgttgtacattcattacttttataaagagactgatcaaatgatgattgataatccttttagtgtatattaggcgtgtcaatggtgtatatattatatagtgtctatatgtcataagaaacgtcataaattttatcaaaggaacaacaatttaagtctgattaatctataattctcatccttacattttcattggcatcaaatttaggtaatttttagaatatagcttaataaatgagtaggccaagaggacggctcgcaattagctgtgtggaaagctaaacgatgtctcctaccgtccacgtcagcgtcttaaatcctcaaatcccattggcaacaaaaaaaacattgtgtatataaatacatgcatacttatcactctctactcacttttacaactaactcataagtaaaacacagacagtttttag

SEQ ID NO: 1167 - DNA, 3000 bp, Unknown
  misc_feature (1)..( 3000): cDNA_ID_1822752_gDNA_ID_1620366_Annot_ID_154840 3000 nt of promoter + ATG
gtgacttacgagtggtaataaatataatgttcagaacatgtttcctctctaattctctctgttttcccaatatttaaaatacagtttcgcaagtattgaaagtgttttaaaaagtgatcatacatagtaagagtaactcgtagagagagataagttatgggaactgactgtatcaaattagttggaccatgttttatgtccgtgatggtcggactcagaaacagagtggtgatgtgaagatgacatgtttatggtcccattttcacttttattgggtcgtgtttcacctttcaaatgaaccactagaaaattgaagcaacttttttttttcaaaccaaaggaaaaaagatgactttgttaagacctttgtcttggttttttttgcttcatcaagcgtcgctttcgcaacatgttctctctattattacatgatttcaaaacaagcaaaacatatcactgcctaattcttaactttgtgcttcagtctttccataaataatagttaactttcaaattcctaaatgtactaaaatcaactatggttgttgagctttattattcttccgtttaatcttggttcgaaagaaaaaagatatggtataatcattccattcatatacgtattactaatcatagttatctttttggtgagtaaagagatttgaatcaagattgtgtgttggtaataagaatccttatagagatgtgcatttaaggagacagaaaggaacacagcacgagacgatgcggttagagaataaacaaaacaaaaagaaacttggtaatggatacaacgtgattccatcgttaaacaactttgcttttggctttggattcttctctattttaactcttaacccaatgttatctcattatccttcatctcaatctatttttctatttacttaaatttgagttttcaagacactttttaaaaaaatgaaaaagggttagaaatagagaagagagtaagaaagaagtgtaaaatcaaataaacgaatctcattaagcacctacttcccacatctttcttaaagtttcttacataaagctcccttcacacgtgcttaccaaatcagattgtcaataattcttgctcaataatttttcgaaatttatttgaatttatctaataaaaatacattgtttgagtatgatattttgcttaagaaggttgattattctccctatcaaagtctaaaaagaagattacaaaacaattgtatggttaaattcatataaatttgtgactagtattttaatatttacatatatacaaatacttatagatgaaacgagaatgcagaaatgattatagatagatcagtgacagtgaactgtagcaaccggcaaagaaacctcgttagctggacacacgattacgatcatgcccccagtctcctctgtccagacggctgcattaataacaacgagctagagggtgttttcgtcttttcgatacttatcccaaaaccgacaatctctggtttggactcgaaggctgatttggtcaattcatagcaaccgaacgagcagtccattcaagtccaaagagctccttagtggtaaaagatgtaattacgtagatgttccatggtcaagaatgtattcagtcaaaataaatatttgaccaaaactttcggttaatttcctaccaccagcaaaattataactttttctaataattatcaatcattttcaatctcttttaattttctttttcacttttttttattaattaaagtcaattcacactatacaaaaagaaggaagtctaaatatttttttactttcatgttgcttttctaacttttatattttgctcttctcaacagattttgctggtttttgtattagaaatattattatgtttccagaaatgaattttttatatgtcgtctggattcgtatatatatattggaaagtgaaattaattcatttgatttttttctttgatatatcgaccaaatcaaataaatacgaccccattgtggcattgttaatgcaaaaaggcacaagtacaaaaaaaacataataattcactattttatttacagacacatgggcccaattcatacggcccaattaccataaacctctcttttaaagagtgggttccacagtggtaaactttttgactatccattggaatgattgcatctggaccgttcatctacattaattattgggttttttcgctttaaagcatcaattaacttattacgtataggattagattaccaataacgatctttttagcttttgtcgttttccgataaaaccatacgattaagaatatgacctcttgtatcttttgagggattttagttaatctttctacatttattttgttggatgctcatacaattatcctgtgtctctcaaaataaaacaaaaattactctatttattagtacattacacatgattatttagaaaatgtatattgtggtcatatgaaatgagaaattaaaggaaatttgtcaatacttgagaacatcaccattcaaatgtttcaagaacaacatgactccaaaacaaaataaatgaacctttccctaataatagtatattctccatcgtacaaagttctaaataatacaatattcatttcgtcaaagcatatgatgtgttggaatcagaattatctgcaaatgtttgaatttcaaatgttagtatcaggctatttttactgttttatcaaatatcgtttcttctgcaatctatcacttgattgttttatcaaatcagcactagtattattgattttgtaatttgtgtttgtctacctccaattactttttagtgttatgattagtaatgtaataaaatcacaaatctgacgtggcacctatatacaattccaaaaacaagtggaacgaatataaaacaaattcacaccttcctcatcttcttcttcgtcttcacttaccttctctctacactcacaccatctcacaaccctaatctctcccacacaagagagatagagagaaaca

SEQ ID NO: 1168 - DNA, 117 bp, Unknown
  misc_feature (1)..( 117): cDNA_ID_3061003_gDNA_ID_1620367_Annot_ID_154861 3000 nt of promoter + ATG
gatcttattcttgtggttatttttttggctatctctacaggcttctctttgtgttttgtgttgtcaacttaatcaattatatagatcgaggagctatagcaagtaatggtatcaatg

SEQ ID NO: 1169 - DNA, 3000 bp, Unknown
  misc_feature (1)..( 3000): cDNA_ID_2131349_gDNA_ID_1620367_Annot_ID_154870 3000 nt of promoter + ATG
atgtatattattcaaagattaggtcaatttttgttgttgtaaataaatgtaaaagacaatcttgaagaaattataatactatacccaattgtttctttatgaaaaagtaatctctccgaaaagttaagattctagtggcgaatcatgcaaatttaaaaaaattgcgcacaatacaatggtaaactgataagtaagaaacgacaattagatgattgatatgcatcataaaaatagtggaacaacaaaataattgactagctttcttaaaacactaaacgcgaaaaatggtatatacatttgatttttaatttaaacaaatgaaaatagtaaaataattgagcatatattatgattccgtaaaattatgcagccgagcgcatatgtgaactaaaaacacatgcatttcaaaaacgtttatgtggataaagttttcatgaaactctttaacaaaaaaaaaaaaaaaaggttttcatgacacatttggaattatatgatagagacattgttgtaacgtagttaagacgtaaataacctaattgatatctttgtccccaccatttgctaacacgtaaccatgcaactttaatttgtttttgattggagccaatatatatgtaatattatcctaaatatgtatgtctccaaatgctgcaaacctaactactcattattaaataaagccaaattgattttgattttaataatgtttgtgattggaatttattatcagaccaggctttattgtagtagcaaattagcaaccgacattaaactagtactaatataaaatagacatagttattacttaatgctaattaatccaaaaggagaagtatactcatagtaatagttagagctcacctcatgttttcctgtaaaacaataattaatatttgcagacattacttagcaatcattatctttgtgactttatttagtttaacgaataaagtgtaaatcccttttttacttgtgaattaaatgtgtcctatgcaaagtccaaacaaataaatctactcatttcttctacttgttatatatgtataggtgggtttttactttttagtttatacaaatatttctgaaaatcccttattacaaataatgataataatttgttagcacatgtgacaatacttgcaagttgcaacgttttaaatcctttttggctttttcggttaaagcttgcaacatttctttggcgacactaaatctacatgtaatttttttataaatatacatatatcgtccgtaaaaatgtctgaggaaattttttgtttcttgttttgttttattcaaatttggaaattgtgttttattggtccaagcaaactaaaataaaatcagacacatgcattggatgttgatgtggaaattcgatcgcttatctgttatatattgttgtaatacatattttcagaaaatattcaaatagtaaaatccaagtggtgcatacttatttttaaaaaaattcatttgtaaaaatacaaatattagccttcatatgttatgagtcaaatcaactgtttagctaattggatttagttgaaaaaacctacgccaaaaagtaaacaaaagctataaactacgaagtaactaaatgttttaggactatagaatcttccattactagatggataattttaatcatgcttcccattaagcttatgttttcatcaaattaagtatataaaacggcgttaattgaactaatttatatgtagatcaagtataatgtgaatgagtcacgcgcatgaaaaaacttaaagtgacaggctgtcatgcaaatgaaaacaactgttgaaacttgaaagtcgaaaaccattaagattcacgggctcgaaacaaagaatgcaacttgctcttggacctcgacaaaaacttaccatttgataactaatacgacaccgtcacgggtcactaccaaacactttcgcttattggggatctatgacttttctttttacacacacaacgtaaaatggtgattagttactggaaaactagacttaattgtcacattgtgaacagtatataataacaatttttagggcattcacttttgttaaaagatgtgtctatgtgggatcatcaactggaccacattaagctaaatgattccacataagtttcagtatttcaaagtaatcttaaaacactttgtctttcttgtttacacgcaatagttagccacagctcttaatgatcattttcaaccaaaaaacgacttagcaaactctctctttcatatatgcacacgacacagtccattggactcaatcgtgttgagtatccaaaccacatatatcgaattgaccataccttaacgcttaaccaaacatagttatttcaccaattatctataaagatattgctacacttaaagaagatgcctacttcttgataaaaatctaccatgcttttggacgtgaagagatacacagaccaaaaaactcaaagatctcgttattttgaaaaagaaaagcatatgtaaaaaagtttgatatggggtcgtctgaaacattgtactctatagccaaacgaaatctatacttacaattttattttataccgaaaaaggtaagtttatacgttgagacaaaaagaaataagtaaattttatacgtagaatattcgatgtacactttatgtataaagtttaaacccactatgctttattcctttttgttgcaaaactatataaagtaaaatcagatttatgatttaacaaacacatgacagaggtcataaatcctaatactagtatccacaaacaccgtatggtccgtatcattatttctttcctcgaagaccgtatcatctttttcacataatcttaattataataggtcaaaataaataaataaatgtcacaataatttatattaaccacagattctttagtgagagcgtagtagtagcttaccactctttattactataaaaccagtctcactaaaccaaagccaatatcccaagaaatcgaaacacaaagcaatg

SEQ ID NO: 1170 - DNA, 3000 bp, Unknown
  misc_feature (1)..( 3000): cDNA_ID_2131363_gDNA_ID_1620367_Annot_ID_154873 3000 nt of promoter + ATG
tattatgcataccagatagaaaagacataaaaacaaccagaaacctttgaataaaagagtcaaatgcgatcttaggcagagccagaccgagtagaagaaggctacaaggatctttgcacgcagagaagttggagacccataaaaagcaacacaatcatttcaaactcgacccgttcagcagcttagcattcaacgctagctcagcgttccgtgcagctgataagcttgaccaaagccattttgtaggtacagctttaagtagctgttgtgatgcgttttgaggctgtgctaagaaaacagtgaaatttagacatctcataaggtgagcagccaattcgaactcactgtgacccgagaggtctcccacgatgagcatcaagttatctatttcaggattgccaattgcgcagcaaagaaagtctacaataatcttctcaagtctggcatctttatccccgagtggcctgagatgtctcccaggatcagcacaaattttgtttgggaaggtgatctgattgcccggcaaagaaattccactaaaatcttgctctgtctggtacgtctgtctcctgaaaccatattatcaactcaggatcaacaacaagatacatacctatatatatatgtaaaagatagagagagtgtgtgtaattgacctaaaggggagcacatcatcccgattccagcgtgtttcgtggccagagagtaatcaccaaaaccggtgatttcgcaccttccaagatactcaccattattcgcaagggccattctcatgttccgccaaacagcctcagcagtgagaccatcagggaccgggcaatcctcgacatcccaaaagaagactgtactatgccctcctcctaggttttaccatattacaaaactgattagatcgactaacttgctatgaaagatcgatcacatcaaattccaaactgcatcacaacagatctaacgctttcaaggacaaggagattacaatttccagagaaaacatatatatcttaccgctgaacttaggcatcgttttggatcggtcgagaaaactagatgcttgcttgctgaagattaaagagagaacaaggttggcgctaatcttcttctttttatgtttctcggtagcggtgtcaagtgggccacaaacctacgggcttggcccaataaatgggttgttgatgtctgcaaatcttagtaaaacggtaatattccgagtatgatgtctagggaagacaaatttcaaatccatgaacagaatctaatccaaataaatttagccatcttaaatcttaatcatactacgtatattgttcctaatatatgtaaatctccaaagacgtaaaaaaagataaggaacttaccggggtcaaaatattgtaatataaaaccgtatatttctctaaatacttagtcttttatataacatatcacatttaaacaaaatttccaattacagatttttaaatgatatttttatcatcatttaaattaaaaatatttggttaatttataaacataataaatgcgcatgaagaaaaagaaaaaaaaaatcaaaataattgaattatgggttatgaccaaggaataaataatactaaaaacataaaaagagatctaaaagaaggttcaaacttgaactaggtgggtcaagtcatagagatctcaaccaaatgagccaattgacttgaaagcttgcaaacaatttaatttatatattttaattgatgtcagttgacctttttctttcaacgtgggtttacttgtggttgcatcgtttcttgaatgtgacagaaaaggatcggtaaaccgttttaaaggacaaggacatatctcgtcaaaaagcttagagagtacctcacgatctctctcacttatactttccacattttgagagattcacattttcttagttatcctcgataacaacttactgcaatataggagaccaatcaaatcagcgcaaacaaaatagtataagattatgtttgtgtatgatttgtacaagacatcaagtaaacttatagattgtatagatcaagctgatgataatttttggcagatctgtgcctagggttacggatgccaaagacgatgtttttcaaaaaaaaaaatgaatcaaacataaatccaaaatttaacctacctaatattgataaataacaaatgtgtaattcaaaaaagttcacttgtgattatagattaaaaataataaaaaaaaatcaaaaaaaaaataactttaatcgtgaaatcgtcataaatatgatctttaaaaaaaaaagatgaatgagttaattatccttaaaaaattgatatcttagtctctaatttaaattcaacatattttttttttaaagccacttggctctattaaagtaaaagctctaagttttacatgagcttaatattactatacaaacaaaaattaaaaggttttaaatgttgagaatttttgagaaatgctttcttggtgtgtgttttttcttcaaaaatatttctttgagatgtgcattttcaaaataaccctttttagttaaatttgaaaaaaaatatataaagtctataaggtttttagaggtgaaatttggagctgtgcacttgaaacggtgcgtttacattaattggaaaaggaatcgcaccggtgatgcgataaccggacgttaccaatcgaatttccgataaaacagcaattttcgaaaccaaaccggttttgaacgagcaaaagcttgaaaacgccgcgttttaaacagtttctcgaagacgcattatcggttttattttaaccgaacaccaccactggttcactatcaaatactaattatgaagataccggtatctttggaacggtgtttttaaaatgttgttattaccggtgatgcgagaaccggacgttatcaaaaattccggtaaaacagcaatttcaaaaccggtttggttttgaacaagcaaaagctcgatgtccggaggaggaaagagaccgttgtagatctgtcttcttcatcgaag

SEQ ID NO: 1171 - DNA, 3000 bp, Unknown
  misc_feature (1)..( 3000): cDNA_ID_2131378_gDNA_ID_1620367_Annot_ID_154877 3000 nt of promoter + ATG
tgacacatcacgcgagtaccaacctcgagcggaagcacccccattcttctcttcttcgaagcatccgattctgaattcgtgagagcgagtatcgcaccagaagtatgattctgattcgcatctccgccgttggttgccggattattatggttcgacgccggtgtggcgattatcatcgccgtctctgtatccgcagacgatcccatttctttagtcgggtcggagattttttccgggtggattcttttctcatacggataaagaacatcatttggaaggagtgtggcccaataacaactttgaatgctcaattgggcctatctttataattggcctgtactatatgtctctcttaccgtcctttttttttgggtgcaaaaaatctcttaccgtcgttaatacacgttttataactgttggcttatgtttagttttataatcgccaggttacatttaaagaatgattagtaggagcaaacaatttataaaaactaaagagataatgagagataaataataagtgacagagtcagtattttgtcgtgaatgggaaacagccaaacaaggctttatgattcgtactaatcacaagattcacagatcaaaaaatcacaaagttccaagaagcaaagacgaaaaacacaactcatcatcgtgtccttgaagttatggtcatagattcgcacaccatgttcctctagattaaccaaaatgattttttatgaacaaaaaagattcacatggtcactttactgtatcttgtatgtgaaattttacatctcatttttcttaaagaatgttttacttttacatactatcaatttacttttatttttcggttatgaattgaagtggatgacttacttacttttgaaattcgaatgaagaaaaatagaattgattcctatttcagttgttcacatgtaaacacgttatatacttatatggcaacttgactaaagggaaaatttaaataaaatgatttaatttggtgacatatattcatctttctaatttttgtagctactacacaccgtgtatcctttttcataataatgatgtgaaattgtataattgtaagaaaaaatgagaaaagagtgacgaaatctttaaaacagacagaatttttttggttgagcaaacaaaacttagttatcaaattttggaaataacgtgttgaagtggctgattcttttacctacaatgattgattcatcgacaaatatcttgttcgtatatcatcaattctaaattcttcaaaaataaagtaaagatactcaaatgtaatgaaatgacgaagctggaaaaacgtattttaatttaattcattatttgaccaacaatttgcatcatgtgaatttaaatcttgataggtcaatattagtataaactaccacactacatgcgaaaatcattcctcatttagtgcaattacaaatgataaacggaaacgttatcatttgtatttattttgtaaaatatgtaattcaagaaactgctcagaatataaagacaagaatcctctttcttccatctctatctctccgtaaacagttgctcaaaaccttcttcctgaaatggcttcttctctcatcttcctcctcctcgttaccctaaccttttcagcatcaaccctaatctcagccaaatccaacacaacaacaataatcgaatcaacttgcaaaaccacaaactactacaaattctgcgtctcagctctcaaatccgacccaagaagtcccacagccgacacaaaaggtctcgcctccattatggtcggcgttggtatgacaaacgccacctccaccgcaaattacatcgctggaaacctatccgccaccgtaaaagacaccgttctcaaaaaggtcttacaagattgctccgagaagtatgctctcgccgctgattctctccggctgacgattcaagatcttgatgatgaagcttatgactatgcctccatgcatgtgttggcggcgcaggattatcctaatgtttgccggaatatttttaggcgggttaaagggttggcttatccggtggagattcgccggcgtgaagctagtctgagacgtatttgtggtgttgtctccgggattcttgatcgccttgttgaatgatttacatttgcattaactactttcgtaaaatctctatttaaattatcgtatttcatgaatttaatatgaccgttactttattactttcgtctttgctacaactttcaaattgccaagaagaacaatctttagagatcacctgaatatttggaatttaatatttctcaatcaattgactaatcataccaaaaattttaagtgacgaagatttgggggaaaaggcttcttaagaaatgggaagtactagagatatttgtatattcgttatatatctttaggtaactttttgctttatctgtatgcattatacgtgttatcgcttcagagatgttttacactttaaaaattgcgataaggttacaaaagtgtcatcttaaaagagaaaggtaacgtcgtctatatatttttttataacaattttaatgcagaatagttatcgacctcataaactagtactgcttttaagacgacgtcgactgctatgcgaatcaaaatcaaaagacgtatgactttttttaatatcattttaggtggaaacatttacataaattattgaaagtgaatgttcgtaggtcattgactagtctacagttttcgatatcagttcaaataatcgactcataattgaactaaaagcatcaaaataattaaaccatatacgaacactaataagaccggttttagaataaaccggactagtcggtggataaaatcgtcatttgacacggagactactatttcgcgcccaaatgatcccagaagacgcgcccagagtgacagtccttttagttattcttcttcccagtaatccacaaaccctagaaaattttctcaagaaaatccgaatcacgattctgggcattgtggaggattgacaaaa

SEQ ID NO: 1172 - DNA, 3000 bp, Unknown
  misc_feature (1)..( 3000): cDNA_ID_3060984_gDNA_ID_1620367_Annot_ID_154880 3000 nt of promoter + ATG
tatatcagattttatttttacgtttaaataagaatatatagtttttcaactttggagtgtgctgaaatattattctaattttgtagtagagttattttataatagcataaagagaagagaaaaaaaaagttattcgatttatgttaaaagaaaaagttttattcgatttagtcattaaaatagtatttaaagatatttaaacacaaaaattctcgtcaaaaaagtgaaatttgacgtcaccaaagtttgactctttttctctttcatcttttaaaccaaaccccacgcactaaaaccatagacaaactctctctcttctctctctctcccacacacacgcttttatttattttggagctaatcggaaaacaaaaaagcaacggccaaagcaatgaggaaagatgatctctgcatcactgttcctaccttcttccgatgtcctatatctctcgacgttatgaaatctccggtgagtctttgcaccggcgttacctacgatcgagctagtatccaacggtggcttgacggcgggaataacacttgtccggcgacgatgcagattcttcagaataaagatttcataccgaatcggactcttcaacgtcttatcgagatttggtctgattctgttcgtcgtcgaacttgtgttgaatcggcggaattagctgctccgacgagagacgagatcgccgatgcgatcgatagagtgaagatcgagaaagaagaaagagatgatcgcgaggttttgtcgaagattgttcgattcgggagagaatctgatgataacagaggatttctcgccggaaaagatgatttcgtgaaacttctcgtggatctgattaatcaggtggatttcgaaaccacctccgccgcgaaatctctggttgttcaagaagcggtgaagattctgagtacgattcgaagcaaagtctcagatcggagacggttttcgaatctgattttaaccaacggtcgagatcggttatcggtgatcgtctacttgtttaaaaccgggaatgtcgaattgaaaattgattgcgccggtttacttgagttcatcgccgtcgacgctgaatcaaagctgttaatcgccgagagagatggattaatcacggagctaatgaaatcgattagtaaagattctgatttaagtttaatcgaatcgagtttatcgtgcttgatcgcgattagctcaccgaaacgtgtgaaactcaatctcctccgagagaaactcatcggagatgttacgaaactgttatcagattcaacgtcgtcgttgagcgtttcggtgacggagaaatgcttgaagcttctggagattttagcatctacaaaggaagggagatcggaaatttgcggcggagatggcgagtgtttgaagacggtggttaagaagctgatgaaagtgtcaacggcggcgacggagcacgccgtgacggtgctgtggagtgtttcttatctattcaaagaagataaagctttggaagctgttacaagtgttaacggagttacgaaaattctgttactgttacagagcaattgctctcccgccgttagacgtatgttaacggatcttcttaaggtcttcaaggtgaattcaagatcttgcctttcggcttacgacaccaaaacgacacatatcatgccgttttaaatcaattcttttactacttactagggttcgtttttaggatttgtttcttgggaaagaggtaagaacaattgtaaaactaaaatgaaatttttgaatagtgaatataaactaaaaaagaagattcaattcattgctcattgaatgtgtagtctattattctcttattaatgtaaagtaaaatcaattaatgatgttcttgaatttccaatcatattgtttcgtatcattgatatgaaattgcttttttctaaatacgaattttgaatatattctgttggtaaacaggtccagaattgtcaaaaagatgaatacgtcatatagttccgatcgacccacaatttgtaacgatgttacatgtgatttttcaatatgtctttagaagattcgaatacatcatagacgacatagacataagcctatataagtcataatcatctttatcttttccctcatcttgtggtgttatttctgtgtcaaaagtccatataacatcttagcctctaataatcttctgttcgtgatcactccctaacagttaattaaaaactgttctagctacaatcactaactaaatttgaaccgatcagctaactcttgtcttcgaagaatatgtgtgtttgattatttattgtatgatactaattaatttaaaagtatataagaataaagtgtgggagggtcagaaaacccataatgagctggttccagatcatctttgttgaataaacaaaagaaactatatactgtagggaaccatttagaagctatattgctttttagatgattgactatatacatcgaactgaccttttgtgtttttggattctcaagtgttgctattatcttatatgattgttagaagatacatactaacacattagattattaaactctcaaacgagtccaactttgaggcctttgacaaagaatgcgaatgagaagagtcgacaaaccgcccacaaaatatgaaaattgggatctagtgttttatttttataacaatagtctttggttttggtcagctgaaaagttaggtatttcaattgttattttgattcttaagtataaagtacaaagactaaaaagtagccgatagaaacattatatgaaattatgaatcatcttaaatcctaaatttcattctaatattcaaaaacaatttttttctatgacacaaacggcttatttttttattgggctacaaatgacacaagcgctttcatttgattgggctaaaaacgaaaagatccggcccattgagctgggtttatcgttcacctttgtaagtttatttcttcttcatcttccgaatcgcattctccgatcgaatcgccgacggagaaatg

SEQ ID NO: 1173 - DNA, 3000 bp, Unknown
  misc_feature (1)..( 3000): cDNA_ID_2131382_gDNA_ID_1620367_Annot_ID_154878 3000 nt of promoter + ATG
ctgtggtgacgagtgttgttctatgattattttgcaggggaactacttgcctcgggagcagacggtatgcctcagaggcttagatgcaatgcaagtgtgttttgcatattttgaatgagtagtgaaaccaattgtgcagttttgtttttgttatgatgcaggaggtgagctttttatatggaagttgcatcctagtgaaaccaatcagtcctggaaagttcacaaatcattatcgtgagtcctttcatctaaataataagctacgctgactgggcttctaagagccacggttttttgtgtttgaatactgttgctctatcaagaagggagaatgataccttaggctaatttggtgaaatgagaatgaaagtttcaccaaaattgcaactgtgacccaatcgaatgtaggctaagagatatattttgacttttgtttgccctgctagatttcatcgaaaggatgtcctggatcttcagtggtctcctgatgatgcatatcttatttctggctcagtggacaactcttgcattatatgggacgttaacaaaggtgaaaaagtcaaagtgtagatagttttatttttttgttggctccagctttcctgcttctcacaattttgtatttgctaaaaggttctgtccatcagatactggatgcccattgtcattatgttcaaggtgttgcctgggatcccttagcaaagtatgtagcctctcttagttcagacagaacatgccgtatatatgccaataagcctcaaacaaagagtaaaggtgttgaaaaaatgaactatgtttgccagcatgttatcatgaaagcagatcagcaacggggtgatgaaactaaggttagagagaaaatagtttcttccagattcatcacggatacacagtattcctaatttcaaaatgacattttatgcagacaataaaaacccatctctttcatgatgagacattgccgtctttctttcgaagattgtcatggtcacctgatggatcttttttactcattccagcaggttactatcccttaaaaccattcttgtttttcagatagctgtgctagatcatccacattgtttactcgggcattattcatgtctctaacagtccctgttatcactgtgttgcatgtccaggttctttcaaggtttcacccacatccgaagctgtaaatgctacctatgtcttttctaggaaggacctttcaaggtaagataatcacctcaccatctcttgtttgaaagtcgtaaggctttgtggaacatattgtaatcatataagctcttctttaagctgagccaagtggccttaactggtcaagcttatgtatgagataattagaaatcagtacaaagtctcacactagctcaattcctttttccacaagcagacctgcactgcagcttcctggcgccagcaaaccggttgtagtggttcgtttttgccctgttgcatttaaactccgtggttcaagttctggtacatattatcttatctcacaccatttttttagtttcttttatgatagaaaagcaaggccttcatgacgttgatagttttcttaaatctgttacttttggtgatctcaaatggtgttttgaatcatgcagaagagggtttcttcaagcttccttaccgtcttgtctttgccattgcaactttaaactccgtgtacatatatgacacagagtgtgtcgctccaattgcagtcttagcaggtctccactatgctgcaataaccgatataacatggtgaaaagactatgcacattcttatagatcggaatggtttttctctaaattttcttagttttaattctaaccaatgatcttttggtttgttcaaaaggtcacctaatgcatcgtatctggcactgtcctcacaagatggctattgcacactagttgaatttgaagataaagaactaggagaagctgtctccatttcaggtttgctcttagtcctttcactcttgaaccttccagaacccgattgacccatcaatccaactacagttggaaagaaacctgttgatggtgaggagaaaaagcatgatttagagaaaggcgatgaactaatgacagaaacaacaccagacgagagcaagaaacaagctgaattagaacaaaacgaagagagcaaacagccattgccaagcaaaattaccacggatggtaaggaaaaagagcatattatgcagaaaaccgatgatgaagtaatgacagaaacaagacatgaggaagagaatcagccattacagagcaaagttaacacaccggtctcaaataaaccagcaaggaaacgcatcacacccatggctattgacccctgatgtcgtcattttccatcagtgttttttttttaactctgatacaaatagctttctcataggctacatttagacatcaaaatgaatcgtattgacggccatgttggaaatggacttgtttctttagtcatacgtctcgtctctaaaggcaatgtacatatagacacatgtatgaacgttcacatgagatggttttgcgtacattgtggatcattattgggctcgtattaatacataagttagttagcttggcatcaatgtctttaaggcccaaatttcatatatagctaaatgcaacaatgtcaagggatgttgtgttgatctttaacggcccgtttaattaattgtagaataacaataatagaccagtaaaagaaaacataattttaccctaaatttaattttctaaaccctttcttccataacagccgtaaaaaaggttaaaaaataaatcaaaaacccagaaaaaccaaactctctcatcgtctcaaatggctatggctctcaatctctgaatttgatcctctgtctctttctctcaatcagatttcaataattcttacaagttcaaattttcatttttcccagtttcaattaaatttgtataaacaattcccacctatacacacaaacatatacagaaaatatcttctctctccctcca

SEQ ID NO: 1174 - DNA, 3000 bp, Unknown
  misc_feature (1)..( 3000): cDNA_ID_2131367_gDNA_ID_1620367_Annot_ID_154874 3000 nt of promoter + ATG
attccaaaattacacaattagtgactatttgatcaaactcagatcctgaaaatggatacaaatcgattttgatttgagaattaaattaccttgatatcgtaatcggctccggcggtggcgagtaaaccggaaatcgggtgaaaatctacggttagcaccggcttcccatcgtgccaacttatctgtatcgtacctcccttcatttttgtcaatcctccacaatgcccagaatcgtgattcggattttcttgagaaaattttctagggtttgtggattactgggaagaagaataactaaaaggactgtcactctgggcgcgtcttctgggatcatttgggcgcgaaatagtagtctccgtgtcaaatgacgattttatccaccgactagtccggtttattctaaaaccggtcttattagtgttcgtatatggtttaattattttgatgcttttagttcaattatgagtcgattatttgaactgatatcgaaaactgtagactagtcaatgacctacgaacattcactttcaataatttatgtaaatgtttccacctaaaatgatattaaaaaaagtcatacgtcttttgattttgattcgcatagcagtcgacgtcgtcttaaaagcagtactagtttatgaggtcgataactattctgcattaaaattgttataaaaaaatatatagacgacgttacctttctcttttaagatgacacttttgtaaccttatcgcaatttttaaagtgtaaaacatctctgaagcgataacacgtataatgcatacagataaagcaaaaagttacctaaagatatataacgaatatacaaatatctctagtacttcccatttcttaagaagccttttcccccaaatcttcgtcacttaaaatttttggtatgattagtcaattgattgagaaatattaaattccaaatattcaggtgatctctaaagattgttcttcttggcaatttgaaagttgtagcaaagacgaaagtaataaagtaacggtcatattaaattcatgaaatacgataatttaaatagagattttacgaaagtagttaatgcaaatgtaaatcattcaacaaggcgatcaagaatcccggagacaacaccacaaatacgtctcagactagcttcacgccggcgaatctccaccggataagccaaccctttaacccgcctaaaaatattccggcaaacattaggataatcctgcgccgccaacacatgcatggaggcatagtcataagcttcatcatcaagatcttgaatcgtcagccggagagaatcagcggcgagagcatacttctcggagcaatcttgtaagacctttttgagaacggtgtcttttacggtggcggataggtttccagcgatgtaatttgcggtggaggtggcgtttgtcataccaacgccgaccataatggaggcgagaccttttgtgtcggctgtgggacttcttgggtcggatttgagagctgagacgcagaatttgtagtagtttgtggttttgcaagttgattcgattattgttgttgtgttggatttggctgagattagggttgatgctgaaaaggttagggtaacgaggaggaggaagatgagagaagaagccatttcaggaagaaggttttgagcaactgtttacggagagatagagatggaagaaagaggattcttgtctttatattctgagcagtttcttgaattacatattttacaaaataaatacaaatgataacgtttccgtttatcatttgtaattgcactaaatgaggaatgattttcgcatgtagtgtggtagtttatactaatattgacctatcaagatttaaattcacatgatgcaaattgttggtcaaataatgaattaaattaaaatacgtttttccagcttcgtcatttcattacatttgagtatctttactttatttttgaagaatttagaattgatgatatacgaacaagatatttgtcgatgaatcaatcattgtaggtaaaagaatcagccacttcaacacgttatttccaaaatttgataactaagttttgtttgctcaaccaaaaaaattctgtctgttttaaagatttcgtcactcttttctcattttttcttacaattatacaatttcacatcattattatgaaaaaggatacacggtgtgtagtagctacaaaaattagaaagatgaatatatgtcaccaaattaaatcattttatttaaattttccctttagtcaagttgccatataagtatataacgtgtttacatgtgaacaactgaaataggaatcaattctatttttcttcattcgaatttcaaaagtaagtaagtcatccacttcaattcataaccgaaaaataaaagtaaattgatagtatgtaaaagtaaaacattctttaagaaaaatgagatgtaaaatttcacatacaagatacagtaaagtgaccatgtgaatcttttttgttcataaaaaatcattttggttaatctagaggaacatggtgtgcgaatctatgaccataacttcaaggacacgatgatgagttgtgtttttcgtctttgcttcttggaactttgtgattttttgatctgtgaatcttgtgattagtacgaatcataaagccttgtttggctgtttcccattcacgacaaaatactgactctgtcacttattatttatctctcattatctctttagtttttataaattgtttgctcctactaatcattctttaaatgtaacctggcgattataaaactaaacataagccaacagttataaaacgtgtattaacgacggtaagagattttttgcacccaaaaaaaaaggacggtaagagagacatatagtacaggccaattataaagataggcccaattgagcattcaaagttgttattgggccacactccttccaaatgatgttctttatccgtatgagaaaagaatccacccggaaaaaatctccgacccgactaaagaaatg

SEQ ID NO: 1175 - DNA, 3000 bp, Unknown
  misc_feature (1)..( 3000): cDNA_ID_3060988_gDNA_ID_1620367_Annot_ID_154871 3000 nt of promoter + ATG
ctcattcatcttttttttttaaagatcatatttatgacgatttcacgattaaagttattttttttttgatttttttttattatttttaatctataatcacaagtgaacttttttgaattacacatttgttatttatcaatattaggtaggttaaattttggatttatgtttgattcatttttttttttgaaaaacatcgtctttggcatccgtaaccctaggcacagatctgccaaaaattatcatcagcttgatctatacaatctataagtttacttgatgtcttgtacaaatcatacacaaacataatcttatactattttgtttgcgctgatttgattggtctcctatattgcagtaagttgttatcgaggataactaagaaaatgtgaatctctcaaaatgtggaaagtataagtgagagagatcgtgaggtactctctaagctttttgacgagatatgtccttgtcctttaaaacggtttaccgatccttttctgtcacattcaagaaacgatgcaaccacaagtaaacccacgttgaaagaaaaaggtcaactgacatcaattaaaatatataaattaaattgtttgcaagctttcaagtcaattggctcatttggttgagatctctatgacttgacccacctagttcaagtttgaaccttcttttagatctctttttatgtttttagtattatttattccttggtcataacccataattcaattattttgattttttttttctttttcttcatgcgcatttattatgtttataaattaaccaaatatttttaatttaaatgatgataaaaatatcatttaaaaatctgtaattggaaattttgtttaaatgtgatatgttatataaaagactaagtatttagagaaatatacggttttatattacaatattttgaccccggtaagttccttatctttttttacgtctttggagatttacatatattaggaacaatatacgtagtatgattaagatttaagatggctaaatttatttggattagattctgttcatggatttgaaatttgtcttccctagacatcatactcggaatattaccgttttactaagatttgcagacatcaacaacccatttattgggccaagcccgtaggtttgtggcccacttgacaccgctaccgagaaacataaaaagaagaagattagcgccaaccttgttctctctttaatcttcagcaagcaagcatctagttttctcgaccgatccaaaacgatgcctaagttcagcggtaagatatatatgttttctctggaaattgtaatctccttgtccttgaaagcgttagatctgttgtgatgcagtttggaatttgatgtgatcgatctttcatagcaagttagtcgatctaatcagttttgtaatatggtaaaacctaggaggagggcatagtacagtcttcttttgggatgtcgaggattgcccggtccctgatggtctcactgctgaggctgtttggcggaacatgagaatggcccttgcgaataatggtgagtatcttggaaggtgcgaaatcaccggttttggtgattactctctggccacgaaacacgctggaatcgggatgatgtgctcccctttaggtcaattacacacactctctctatcttttacatatatatataggtatgtatcttgttgttgatcctgagttgataatatggtttcaggagacagacgtaccagacagagcaagattttagtggaatttctttgccgggcaatcagatcaccttcccaaacaaaatttgtgctgatcctgggagacatctcaggccactcggggataaagatgccagacttgagaagattattgtagactttctttgctgcgcaattggcaatcctgaaatagataacttgatgctcatcgtgggagacctctcgggtcacagtgagttcgaattggctgctcaccttatgagatgtctaaatttcactgttttcttagcacagcctcaaaacgcatcacaacagctacttaaagctgtacctacaaaatggctttggtcaagcttatcagctgcacggaacgctgagctagcgttgaatgctaagctgctgaacgggtcgagtttgaaatgattgtgttgctttttatgggtctccaacttctctgcgtgcaaagatccttgtagccttcttctactcggtctggctctgcctaagatcgcatttgactcttttattcaaaggtttctggttgtttttatgtcttttctatctggtatgcataataactcggatctttgagtattactttgcatctatctattttgctttccctgttttgtttaaaactcctaagtcgtaaccaatgctttcctcttaaccattaaccaatttgaaagtttagcaaaaaggtcataagtttttgattcttttggaatcatcctaattaatagagagaacatgttgtgaaactgatgcatgaccaagcaaaaaacaaaattaccgagacaaaaagtccccttttcttttgcttttaacacggaaccatccgattccacaaccaaagcatggaagaggttttgtcatatgatccatgttcaaccttatcgacgtcttttacaattgtgtacacatcatctatatcatacatacagagcaaatgtctcttagttgactagagaatgaaccagaatatataatgatacatattgaaagagtttcctttatggattgagaaagagcttcaccggttcggtatcttcataattagcacatttgaaagtcaaccggtgatgtccggttacaatagaaccggtaatctcttaaaacggcgcgtttgagaaactgttaaaaacgcaccgtttcgatcgtctttttcaatcttcgtgaagaacccaccagcttcaaatttcacctctagaaagtttgttgctatcgtttctctttgcacttagaaatcgaggggaaatttttcccagctctaatctaatgactgaacaatg

SEQ ID NO: 1176 - DNA, 3000 bp, Unknown
  misc_feature (1)..( 3000): cDNA_ID_3060992_gDNA_ID_1620367_Annot_ID_154869 3000 nt of promoter + ATG
atccaagatggggaagagggcaagagactccaggagaagatccattgctcgctagtaagtatgcttcagggtacgttaagggtcttcaagagactgacggtggcgattctaaccgtctcaaagtcgccgcctgctgcaaacactataccgcttacgatgtcgataattggaaaggcgtagaacgttacagtttcaacgccgtggtaaaaatctaaaagctaaaaagacattttccagtgttttaactgtttttgtcaattgtgtatgtgatgttgtggtttatttggttaatccggttcaatggtactaagttcgggttgggtacaacatttggttagaccaaatacatttttgagtgttttaagtaactttttttgtgcgtttgttttgatggagtaggtgactcaacaagatatggatgatacgtatcaaccaccgttcaagagttgtgtggttgatgggaatgtggcgagtgttatgtgttcttacaatcaagttaacggcaaaccgacatgcgctgatccagatctgctctctggtgttatccgcggtgaatggaaattaaatgggtaatgatctgatctgatccgatcagctaagtttaaatccttttcgtgtgttttggttttgattttggttctatttttataggtacattgtttcagattgtgattcagtagatgtcttgtataagaaccaacactatacaaagactccagctgaagctgcagccatatctatattggcaggtttggatttaaactgtggttcattcttgggtcaacatacagaggaagcagttaagtcgggtttggtaaacgaggcagctatcgataaagcgatttcgaacaactttttgacccttatgcgtttaggattctttgatggaaacccaaagaaccaaatctatggcgggttaggtcctaccgacgtttgcacgtctgcgaatcaagagctagcagcagatgcagcaagacaaggcattgttctactcaagaatactggatgcttaccgctttctcctaaatcgatcaaaacactagccgtgattggaccaaacgcgaatgtcaccaaaacaatgattggaaactacgaaggcacgccgtgtaaatacacaacaccactacaaggactagccgggacggtatctacaacatatctaccaggctgctccaatgtagcttgtgctgtagcggatgtagccggcgccacgaaactagcagccactgcagatgtgtctgtgcttgtgatcggtgccgatcaatcaatcgaggcagagagccgagacagagtcgacctgcatcttcctggacagcaacaagagctggtgatccaagtggctaaagcagcaaaaggaccggtcttgctcgtcattatgtccggtggaggtttcgatattacattcgctaagaatgacccaaagatcgccggaattttgtgggttggttatcccggagaagccggtggtatcgccattgctgatatcatctttggccgttataatccaagtaagagactctgtttcaaaccggtttttgtaattgcaaatttgaataaaccggttttggttatgtaggtgggaaattaccgatgacgtggtatccacagtcgtatgtagagaaagttccgatgacaataatgaacatgagacccgataaagcaagcgggtatccgggtcggacttaccgattctacaccggagaaacagtatacgcattcggagatggactcagctacaccaaattcagtcacactttagtcaaagctccaagtctcgtttctctcggtctcgaagagaatcacgtttgccgatcatcggaatgtcaatcgctagacgcgatcggaccgcactgcgaaaacgctgtctccggcggtggatcggcgtttgaagttcatatcaaggtacgaaacggaggagatagagaagggattcacacggtgtttctattcacgacgccgccggcgattcacggatcgccgaggaagcatttggtaggattcgagaagattcgattggggaagagggaagaagcggtggttaggtttaaggtagagatatgtaaagatctgagtgtggttgatgagattgggaagaggaagattggtttgggaaagcatcttcttcatgtcggagatttaaaacattccttaagcattagaatctgattctatatttttatttgaggaagaaaaaaagaatattaatatgcttaagcttttgcaagttggaaaagaaaagtaataaaaaaaagaaattgtgaatctctttaaaattatagcattagtagccgaaaatgtggggcatatataaacataattcgaatatctaaaatatatcatgtgtaattcatgtgtaacataaatctagctaatatcagttagagttagatttatgtttggtatttcaatttaagtaaatttagtctttttttttttaattagttgctcaaactaataattctgataacaagcagataaactcgtagtatatcccgatcaaaaataaattaatttttattttcttaatctaaactaaaccgggttttgtgtcgaatttaggtgattcgactcaaatatgaacaacatttaccagaaatcagggttattattaccggtttattgcggtttacattttaaatataaataagattcacctctaacagaatatatcacgttttcctttttttctgaaactgtaaaactctctcacaaagcaaaaaaaccaaacctaaacaaaaatctagaaagaaagatttccgaaaatctttttaatgaaaaaagagcagacaggacgagaattcgcttttctgaatcctttagagtattgttttctccgtcgaattcgcatgaacacttgagctcaacaaggtcagattctcttgttcgcttttttttttttgatgaagaattcgactgttgtgttgatgctggtgctctgaattttacagacggcgtggaagtggacggtgaggtagttttttttagtttttgaaagacatg

SEQ ID NO: 1177 - DNA, 3000 bp, Unknown
  misc_feature (1)..( 3000): cDNA_ID_3060996_gDNA_ID_1620367_Annot_ID_154863 3000 nt of promoter + ATG
cgataatgccccacatgatcaggtagttgcttctggaatgtatctgttctctcaatccatggctttagataaaggatggtaattaattgtctataggaaggaagctgattattcacattggcacttttgtttttgtttaacccagaaatcagcgtggcttgctgtattctacatgtgcattccgacaggctatgcttttggctacgtatatggtggagtggtgagttactttttgttattcgttttgtctatgtcatgagattctgattacatggttctgttttaccccacttccagtgacctcaattccctccttctgttttcttgtaggtggggagtgtccttccttggcgtgcagcattttggggagaagcaatacttatgcttccttttgctgttctaggttttgtcatcaaacccttgcatctgaaaggtgcgtgtctgaagttgcaaacacacacatcctatgttcctgatggagttcagctatttctaataaatcttgtatcttcaggttttgctccagatgatacaggaaagccccggacagataacttaaacgttttgccagttggttatgggttctcagctgttatgaaagatttgaaattgcttttggtagataaggtttatgttacaaacattcttggtaaccattttcccttgtcatgtattaaaaagcatctgtgttcttgtatgatttattgattacctgcaactgttttccttcttttctcagggtatattgcttacaactttgttttaggcgcctattcatattggggaccaaaggctggttataacatatacaagatggtaaaatattaccagagcgtttcgtttccatgtgtagaacagtagaagtatatctcttgatgcctttatcccattgcaggaaaacgctgatatgatatttggaggggtcacagttgtatgcggaattgttggcacattatcaggaggagtgattctagattacatggatgccacaatttcaaatgcttttaaggtaagatcatcaacttggaagacaaattatccgcacatggatggaaattttacattccaaacatatattcctaccacttatgatcttggaaaactagtacttgatcgcctctttctgtattttgcaggttctttcagtttcaacgtttataggagcaatattttgctttgctgctttctgtttcaagagcatgtatgcatttttagctctttttgctgttggtgaacttcttgtctttgccacacaggtaatctcgacttccaccattcatatacttcatgttttgcaaatccacctcttctgatttatttcatgatgtttagggtcctgtgaatttcatagttctccattgtgtcaaaccaagtctgagaccacttgcaatggcgatgtctactgtctctatccatatctttggagatgtaccttcctcaccactcgttggagttcttcaggtttggtttctcagctgtatccacaaaattcttgattcagagctctaatgtcttaatcaaattaagcttcagttaaacgcgattattcatctagattagtttgagccatcactgtatccaacttcagaatgttttctcatttactcacgcaggactacgtgaacaattggagagtgacttctcttgttcttacattcgttctctttccagctgctgcaatttggtccataggttaggcttttagccacaccgggatctcaaagttcaaatggttctttttttagtataatgtggtaatgatttgttgtgtttgtgactctacagggattttcctgaatagtgtggatcgatataacgaagattccgagcctgatgcagtaaccagagaatcaaccgctgcgcctcttctccaggaagcatgagacaaaaaaactcaaaaggtcactgtgagaattttatggtttattctcagttctttatctactttcttgtacaaatagaattgtggctgaaacataaacaaatgtcaaattaccttcatttgtatattcttgtttcactgtttgcaaaattatgaaaggaccatccctatttctctacagaaaaaataacttaatagtccattacgacatgaatctcggttctttgagatcataccgggaaatgtttttcaacatcatcattcacaagatagagcttaaggagcatccaaagaaatcgcaacaatcttccaatctagctctccttcatcaatcatagccaaaagcagctaaaggcttaacctttagaacgtcaccaatctcaacaacatcaactacaaataaaaaacacgaatccatattaagctacgctctgagaatgaaacccataaagaagccaaaatcattttacctacctggatcattatctccaaaagcaccatcaaccttagagtttgatcttcccatgtttgtggaaacaatccatagttccagcttatgttgtaactgtacatataaccaaaaaacaagaaaatattatagctactcaataacatgttatatttttgatgttacatgcaaaggtttcgtggtgtagttggttatcacgtcagtctaacacactgaaggtctccggttcgaacccgggcgaagccattgtcaatacttttattttaacgtaatttttacttagcttcacgacgtcgtttacataaaaccgttttcatgtgactcaacaccacgtcacacatcgtttattctcgcgccacatcagtctctacattcttattggctaatactctccacgtcatcatctcttcccgtgaaaacccgccatttaaaaagactccagaaccatccacaaccttcttattccgtcttaacaacaacaaaagaaaaaacactgatccaaatttgggtccttctaattttgcgcaatcaaataccttcaaagcctcaaatttcgttcgttctttgtgataattctctcgcagctttgcaatatataaatctcgagggtttactcttttaaggcctggttttttttggtcaatccaag

SEQ ID NO: 1178 - DNA, 3000 bp, Unknown
  misc_feature (1)..( 3000): cDNA_ID_2131337_gDNA_ID_1620367_Annot_ID_154867 3000 nt of promoter + ATG
gcttgacaatttcggcgatactgctcttagcttgaaatgtcttggaagcagtgcagggagattgattgggagctctcaccataaccataagctttgttctgatgtttctaattgtcctgatggtggttgccggttggttctcggtttgggtccaacaccgccttcgtattattacaatgtcagggtcaatgataataacaacaaaggctctgcttcttctgggagtgttcaggaactctcatcaggaggtaactcaatcctgcaacttggtcctcctgctgtgaccatggatactttcagcggacttgagggttctctgttgacatatgcggatactaatgtgtcccaagctgctgttgatgagggttctacctcagcaaggcgatcaggtggctatatgccatcgcttcttttcgctccaaggacggagaatgttagaaaaccttcaaggatgcaagagtgtagtactaattgtggaactgatgcttataattcacagctgagccatgagtcagagttctctgtaagcgctttctctgacaggtcggcctctgccacgtcttctcagcaaaggatgagcaacccgaagaagtgcaagtttatgggatgtgttaaaggagctagaggagcttcggggctctgcattggccatggaggtggccagagatgccaaaagctaggttgcaacaaaggtgctgagagcaaaactactttctgcaaagcccatggcggaggaaagagatgccaacacttgggatgcacaaagagtgctgaaggcaaaaccgatctctgcatatcacatggtggtggaagacggtgtggattccctgagggatgtgctaaggctgcacgtggcaaatctgggctctgcatcaagcacggtggtggtaaaaggtgtaggattgaaagctgtacacgaagtgctgagggacaagctggactctgtatttcccacggtggtggacggcgttgtcagtcttcaggctgtacaaaaggtgctcaaggaagtacaaactactgcaaagctcatggtggtgggaaacgctgcatatttgcgggatgtacaaaaggagcggaaggtagtactccgctttgtaaagcacatggtggaggaaaacgctgtatgtttgatggtggtggtatttgtcctaagagtgtgcatggtgggacgagtttctgtgtagctcacggtggtgggaagagatgtgttgtggccgggtgcactaagagcgctcgtgggaggactgattgttgcgtgaagcacggtggtgggaaacggtgtaagtctgatggttgtgagaagagtgcgcaaggtagcactgatttctgtaaggcacatggtggtgggaaacgttgctcatggggaggagactggaaatgcgagaaattcgctagaggaaagagcggtttatgcgctgcgcataacagtatgtcacaagataaagctggaagcaaggttggtttgattggaccgggacttttccgtggccttgtctctacttctttacaaaccacaacaactgcaactactactactactaccactgatcattctcaatctggagtcagtgcggtctctgattgcatggactccattgatcgcccgctgccaccgttgcatcatcaacccgagaaaagacagaagctgatgataccaatgcaggttcttgtgcctccatcaatgaaatccttaagcttctcaaacaccgagagacccgatatcgaaacaaacaacaatagtagtggcagcaatgggaggaacatatttgactttatgattcctgaggaaagagttcatggtggcgggcttatgtctctgcttaatggtaacatgaaacaaacactccgttgatggaatctgaaagcttcctctctatgtggtaacaacaaggctagagtctgtgtaaagcttcatgtaatatgtatagttttttggttttctttttgtttctctttcactcttgggtcctttgtacatttcatgggtctctgtttttgtatggtctctggtcttgacttgaccatctagtcgatggcttgaacccaagtctttgtttatttgatcattgttatgaatgttgcaatgtacaagtaaaatgtgttcttatgttttgtaccaaaaaaaaacagagcttactgggtcgaatcagcatttccggttaaataacttttggtttaattcgccttgaccggtttaatggaaggtcaaagaaacagcgtcaaagtcaacatacagaaacaaccaaaccaagtcatcaaatggataacggaatctttccgccgttatattttccgttagccctatatatacaccgaggcggttaacaaacatttcgtctctttgaaactaattttttccctcttctctctctctttggccgtggagatttttctgagcaagcttcgtgatgctatcgaaccagaggaagacgaattagcttctcgatcacgattcttttaggtatgtgattatgatttaagttccgatttcgagctttaggtttagctctatcgcgattgaatctgtgtttttttcccgttcccgattcctctacaaccctaggttttgatcggaaatttcggttcttcttcttcgttttctacttcaatcgttctcgcttttgatttcttcaagttctgatgatgattatcggtaaatttcaaccttggatctttggtagattttgctgttgtctcgtgaatattcatcgccagttttggcgggaaaatgtttctgcggtggtttgtttttgattgaatctgaaacttactattgtcttgtgctctcgattacattcttcagatcttatcggaaagctttagcggcagagagaaagagtgaataagtcgagacttctctggtgatttgttattttctttgtggtttttggtgattgcaaatcctctggtgatgttgattaaaaaaagtctcattttgaagtctggtgatacaaggatccacaaaggaatctcagattctcctactgtagcaatatgatg

SEQ ID NO: 1179 - DNA, 3 bp, Unknown
  misc_feature (1)..( 3): cDNA_ID_2131421_gDNA_ID_1620368_Annot_ID_154897 3000 nt of promoter + ATG
gat

SEQ ID NO: 1180 - DNA, 3000 bp, Unknown
  misc_feature (1)..( 3000): cDNA_ID_2131473_gDNA_ID_1620368_Annot_ID_154916 3000 nt of promoter + ATG
tggttatgaataaatctgaatcaatcggctctcttgatgaagttgcttcagaggcccttgcactaggttttggcgagcctatagctatttcagccgagactggacttggtatgaccacactttatgaagttctgcgccctctactagaggattacacggtcgaaatgttaaacggtaatatacccgtatcaagataatcatacctcccttaaatttcttcttcactgaacctcgcagtcttataatagatataggcagtcaagatgatgttctgaccgatgagaatctctctgatgaaatcgacgagtccaagttgccattgcagttagctatcgtaggtaagcctaatgttgggaagtcaaccttgctcaatgcattgttggaagaagagcgtgtattagtgggtccagaagctggcctcacaagagatgctgtgagagttcagtttgagtttcagggtaggaccgtttatctggtaagattagaattcttatttttcttatactctgactccaactattattctcttgatgttagacagagaagtggaaccagcgttcaatattattcactttgtttgatgtttataccggatatctgttaaggttgatactgctgggtggttggagagaacagagcgagacaaaggaccagcatctttgagtatcatgcaatcaagaaagagtcttatgcgggcacatgttatcgcgttagttctcgatgctgaagaggtttgtatacacacatactctcgtgattcatgttttttttttcctgcagaactgtgaaaacagaagaaagaaaatcaagagatgctcacgctatgttttgtatttgcaatatccagatcataaaagctaaatgtagtatgacacattcagaagtagttatcgctagacgtgctgtagaagaaggacgtggtctagtcgttatcgttaacaaaatggatcgtctaagaggtagagagaactctgagatgtacaagaagatcaaagaagctgttcccattgaaattcagacagttattcctcaggtaataataaaaattgcatcttttattaattctcatttcttcttttgccattcttcgtatttcccggtgatggaaacataatatttgcttgcagataactggaataccagttgtgtttatctctgcattagagggaagaggacgtatggaagtaatgaaagaagtcactgatacatacaagagatggtgttcaagactttccacaggccgcctcaatcgctggttgcgtaaggtttgtactttaaatgttacagactatagtatatacaacaaaacatatgacatcattatttgcttaatcgttttttgtgtgtgttggcgtaggttatgagccggcattcatggaaagacacggcttcacagccaaagatcaagttctttactcaagtgaaagctcgaccgccgacttttgtagcgtttgtgagcggtaaaacgcagttattggaaagcgacataaggtttctgactagatcattgaaggaagattttgatttaggcgggactcctattcgaatcatacagcgggttattcctcgtgcaccaccctccggtacaggtggtggtggaagcggaaacagctcgagtcgagtagtgcaaagaaccacctcagacaaacggactctctcggcctaagaacccattacaagtgaagaaattttccctacattaactagtttgtgtcccgttttgtatgatcatacttaaatacatctttttcacctatacacattcgaaaatctaaaatagttggatggagtttaaccttaaacttcattagtgtccattaggtacaattaatagcagtaatataaagaatctataatattgtatagtacacgaaaaatatgtcatcgtatgcaaaatatttggtcatagaaaaacaaaattttaactaagaaatatgtatatagattcactttttatcacgtagatcattgaaatagtcttcgtaagctttgataggaatacgagcatccatccacgaaatcttcaacatcttacgttgtgagtccaaactcatccacgagactagactcggtaaggttacaatggctccaatcatggctatgactttcgttgcgatatcgtaaaacaatgtccagttctcatctttgttatctttctcctggtcgttgctcatactgattacaaagatctaacttcttctgctctcctttttttttttttttggttgtgtatgtgttttgatttataatttcaaggttgctaatgtgacgcgacctttactattatttattgggatctctgaagacagtcccgaaaaggaaataatataatttgacaatatcaaaaaaggaaacatttaacaaagaatctttcattaattaatttcgagcaattgtgtcaacaataaaaattcataatcatcttctgacatgactttaatgtataggaagctcatgatggagaaagcaaaggcaattaattacactatcggacttgtccaagattgcttagcattttttttgcacagagcttgaagattgtttatctctatgacgttttgtttacttggttatgttttttattttcagtgcggtgacatcatcccttgttgttgggatcaaataattgaattgaggatgatgttctgttctttcttgtttttaaagtatggagaaagacacaagtttgaaatcaaggtcagctgatttctttgacgccaataattcattctgtattattttattggctttaaaccaatttgcatattagatttattaaaagattctgctagttgtctgcttaaaaagtctccatttatttaaaagttctaatcagttcttgtctggggctttggtcttccctttgatttcttggtaagagttccattcctgtggaatctgtaaacagaaatctctatgagctatcttttttttttccagattgttttcatcggtagatgctagactcaaaacaactgattctttgttgttgaaagaaga

SEQ ID NO: 1181 - DNA, 3000 bp, Unknown
  misc_feature (1)..( 3000): cDNA_ID_2131435_gDNA_ID_1620368_Annot_ID_154906 3000 nt of promoter + ATG
tccgaaattcttgaacttttctcgaagtaacctcaattgaaattgaaattgaatttggacagtacgagttaagggtttttcaagcaaagtaaatccaaatcgatttaagaaattgcagagatttggaggaaatgacaagagaattggatttggtgttttacggttgaaagagcaaacgagagtgtagtgtgaaaagcagtggtggtggacagtgacggaggagatggatatctcgtcgccggagtccccttttcgagaaattgtaatttaggattttttattggatttggatttttacgattctggaaaaaaaaattaaatcacaaaggcaactacaaaatcgtggctccgtaaatctgaattggtttagtgaaaatggatttgatttgtttggttatagaaaaccgacgatatgagggtgaacaagtaattttaattattcaaagtgcctaatgatttttaagtgcctaattacggataaactttcaaaaaagtgtctaatcacgtaatattctcttttttgtatgcattaaggaatttttatgatagttttggttaagactaataaagattaaaaagtaatgaataatgatgatagatgagaacaaatgaaatctctttgatttgtcatcgtttcaaataaataaaaataaaatgatcaatagttaacgtgatgtagatagaactgttagatagattcactcattgcccggatttgatcaccctataggtaaaatatttatcagctattaattcgaaagtgagcccattaattaatatgtatgcgatacgaacgttatttattaaacatgttgcaacttttacatagttacatatagacaaataacgcacggcatttcccttccttcgtattttgtcgaaaaacaaacacattatattaataaagatgaactcatggcttccttcctctgttgtgaaaaaatggataaaattatgcttctgtcgaagcaaaatgtttaacatgtgccctgttcagtgacctgaatccatcatctccggcgactttcatctttcccgcggcatcgtattgagctttacctccaaatccaacattgaagaaatttttaaataaaggagcttgagcatatagttcccttcgaattccttttcttccgtgagctttggcgtccaaagaagcatgaatagcaattttttcatcggcgaattcgcctgctggtacttggtaaaagagttctcttcggtgacctccaagataaccattaaagaagtcagaaaacttatcgataatggattcaaatccttttacgtcagcaccaacgtgagaatccgcgttgtatttagcttcagttagttctcttcggtgagttttacctcctagataaccaccaaacttcttgaaaaaacttttgaaagcatttcttactttctcacggttttctccaagtgctcttgcgtgaagacctattttcttcatcttcttattctcaagattgttaacaacattcatgaaagcattgatcgaattcttgaaacttatcatagcgtgattgagctttttcgcttcgtgagccgtgatctttgcatcagcctggtaatcatgtttggctgatatctttacaatagtttctttaattcggagaaacccttttgtcaaatcagcatagcttttctttagcttcaaagaagttttcttattgactttaccgccaacactagcttgcgcagcaagaattgccttgttcatcagggtgtatctggtcttggcaattcctaaaacatctacaatgggattctcaaacttgtagaggctctcgaggtatgtcacgtagcctttgcacattgtgaacattgccttgaactcaggggttttcggggcagaccgctcttttcggtttaggatctcagtgatttcggtaaaaggtaaggtctggagttcggatactgtttttggacatgctgattttctcggtgtcacgggaggagcgtgaccggaaacggaaaggaacactgagccgagggctaaaacaaaggctaatgagaacaacagagagatccttgccatggttgtattgcttatggcaaggcaaaaattgttaaaaaaacaatccctaaaagagaaaatacaatacgaaggaagtgcgttttgatttgagatctaggaaccctatatatactttgttcttttaactcttataagctaattataggacacataaatggttactataaaatgagaaaacagaaagaaaagacagagagagattcatggaactcggttacttttttttccttattaagaattttcttaaatgagaaaaaaaaacaaaatacgggatatcagtttcaaacaaacgtacgtttcctaggttaacaataatatttcgttacctagtttcttaacttttaagggtagacaccgagattggcttagtgtacatagtgtaaactggaattgtacgacaataatcgtgtagggcaaatgaattaaaaatcgtgtagtttaaatgaatgataacaacaaaacattcatttcgattttctcttcgctctcgagctcatcttcgtttctcttcgattgagcttccattcctttctgttcaatctctaattcttatcaaatatatatatgcacacactaattaagtaatatatatatatatatatatatatatatatatatatatatattacttctagattgtaatcataaatgcaacaattttctatagaccataatataagtatcaattttatactgtcacagtgaatgtatacacattgtagacctaagggcaacaattttcttttgcatttactccaaaagaatgtaaagaggagaaccactaggtcctttgctattctttttttttttttttaatctctatccaccagttttcctcttaaataaattctttgttttcatgattctaaagatagagtccttcatatttctatatatgagactttagagtcttcaaaagtaaaacaaaattgtcaatctatgtttctcatacaatg

SEQ ID NO: 1182 - DNA, 3000 bp, Unknown
  misc_feature (1)..( 3000): cDNA_ID_2131445_gDNA_ID_1620368_Annot_ID_154908 3000 nt of promoter + ATG
gaataagaagatgaagaaaataggtcttcacgcaagagcacttggagaaaaccgtgagaaagtaagaaatgctttcaaaagttttttcaagaagtttggtggttatctaggaggtaaaactcaccgaagagaactaactgaagctaaatacaacgcggattctcacgttggtgctgacgtaaaaggatttgaatccattatcgataagttttctgacttctttaatggttatcttggaggtcaccgaagagaactcttttaccaagtaccagcaggcgaattcgccgatgaaaaaattgctattcatgcttctttggacgccaaagctcacggaagaaaaggaattcgaagggaactatatgctcaagctcctttatttaaaaatttcttcaatgttggatttggaggtaaagctcaatacgatgccgcgggaaagatgaaagtcgccggagatgatggattcaggtcactgaacagggcacatgttaaacattttgcttcgacagaagcataattttatccattttttcacaacagaggaaggaagccatgagttcatctttattaatataatgtgtttgtttttcgacaaaatacgaaggaagggaaatgccgtgcgttatttgtctatatgtaactatgtaaaagttgcaacatgtttaataaataacgttcgtatcgcatacatattaattaatgggctcactttcgaattaatagctgataaatattttacctatagggtgatcaaatccgggcaatgagtgaatctatctaacagttctatctacatcacgttaactattgatcattttatttttatttatttgaaacgatgacaaatcaaagagatttcatttgttctcatctatcatcattattcattactttttaatctttattagtcttaaccaaaactatcataaaaattccttaatgcatacaaaaaagagaatattacgtgattagacacttttttgaaagtttatccgtaattaggcacttaaaaatcattaggcactttgaataattaaaattacttgttcaccctcatatcgtcggttttctataaccaaacaaatcaaatccattttcactaaaccaattcagatttacggagccacgattttgtagttgcctttgtgatttaatttttttttccagaatcgtaaaaatccaaatccaataaaaaatcctaaattacaatttctcgaaaaggggactccggcgacgagatatccatctcctccgtcactgtccaccaccactgcttttcacactacactctcgtttgctctttcaaccgtaaaacaccaaatccaattctcttgtcatttcctccaaatctctgcaatttcttaaatcgatttggatttactttgcttgaaaaacccttaactcgtactgtccaaattcaatttcaatttcaattgaggttacttcgagaaaagttcaagaatttcggaacaactaaggtaaagttttgtcatgttgacttcagagatcttgttcgtaattctgtgataatgtttgataacttctctgcccagtttgtttgaaattcagtacttgaggttctctattggacagaagatgaacatatggactacaacacttggacaatccgtaatggacaaccacacattttggttgcagcgtatgtgtcgttacaaaattgaaaatcaatgtccacgaccatacatgactgcacagcttggtgtttgataattcaaggaaaaagccacataaaggttctatttcttaatcttacattttggaagaaatcaaatcattgatttaagaaataatatgtaagcttggatgctagagctttaggtgatcctgtggccagattaggatattgatttaacttttcttactgctactcaacattgattgtctggtattaagttgtaaaagagtaatttgacttatccatttgtgttgatataattggttattataatgtgattagtcaatagaaaaccttagagtacataatatcaaacttttaactttgttaatttttttaggcgagtgggtgaatacatcagttagacttgcttttgcacatcatgtgatcatcgtttaattgttatatgatcggacggtcattatttctcattaacttctatttaaactgcaaatcttaccacgttcatttgatccgaattaacccattattctacacgtgtttggtacacacaattacaaaccaaaaccaatgaccggttattcttttttcgtgattcagtttatttggggtataatggtctattttcactccaaaaacaaagaaaaatatctcaaccttggaaaatacctgttttgtctaaactttttcccaaagtgccttattacggaacattccctacaaaaaaaccatcgtcatgtactggacaaaatattcttcaagtttgttttcatgttgtgttgggccgtttaattcgcatgtatcccatatcggaccttataaacttataagttataaacattaaaatataatccatttgtcaatccttttttccactttttttaattaagataaatcttaagtattaccaaatcattattaaatttttatatttattattctagctttaccatttacacatactttacccccattgtattttcattgccgaaatgtttcaaaaaaggatgatttaaggggcaataataatatttaaaaaaactgtgtttagtgatgaaacaaaacccgccgttggaaattaaaccagcccatagagagaaaaacctctcttaacgaagaaaaacaacaacatggcccctggtttctcttctctttcgaatctatcttcttcttttatccaatcctttcctatttttattctcaccttctcctcgtttttcccgaaactgttcttttgccctcttctctcaattttaatccaccaaacaaatcgaacagtgttcgataacttttagattgcaagtcctgtttttgatttggtcgggagaaagaaaactagggttttg

SEQ ID NO: 1183 - DNA, 3000 bp, Unknown
  misc_feature (1)..( 3000): cDNA_ID_2131469_gDNA_ID_1620368_Annot_ID_154915 3000 nt of promoter + ATG
aaacagagaagtatggatcagtcaaaacaagagacagagacacaaaagttgaaactttgattggcaaagtataaccatgacagagatgcaccaagtttagatatttttctcattacaaaacaccaaatctcatgttatatcagaactagattgatctgcacttatgtaccataaagctatccaatttcttctcacaacactccaatggaggaattttaggtaaaacaaaacagtaaactatagtctatggatcaatcagagacaaataaagtcagaaacttttgatagcattacaaaaaaaagatgaagactttatgacagagatacttacaggaagttcatcaacatctaatttgacgaaatcaacatcattgaacttatcagccatggcatgaatcgcaggctcaatcatcctacatggtccgcaccatgaggccgagaaatcaaccaccagctttattattcacagaaaccaaatcagttaaattccattgaaacacgaaatcgattgaatcgaatcgagagtctgagagacgttaccagtttgtttgattctttgatctcgttgaaatgaagttgccaccgagcggaagagctaaactttaggacgcgacttggctcagattcggtccctgcagctgttgcatcttctccacttccaaacacagttgataaagctcctcccattatcgtctctcgtctcgcttctctctctgattgcgtttaagaacgaccctgctttctttggtcaacgatcgtgtcgtttaatattcaaacatcgtgccgtttctaccactagagctggtcaactatgggcatgcccacctcatttagcccatttaaaatctaccccatttaaaattatttaattttaagatttataaaattgcccatttaaactcatatacccatttagatataaattaaaaaagcaatttaagtgactcggaacacaaaacaactactaaatcaagaatgtgtctaaccttttataaaacaaactaaaatcaacacttaccatcaaatttcaaattcttaccaatcgaaagacactaatatctataaatcaaactcaaacatgttcaagttttcaaacacaataagtttcttattcttcttagttccaaaacatgttgcttcttctacatttgtttcatggtgcacttgaattttctgatcttgaagattctgctcgggtactaattgcaatcatccttgcatattggttgcaaatcatcaatgtcttttagggtacctacaattcaaagtatgaattcgttttaaaacatgatcactgcaagaaacctcgttttaaaacataactacacaatatttttaccttcatattccgcaaatcctcgcaaccaattatgagtacaaagcagagtctgaaagttcttcggaagcaaccagttcatgtatggactcgagacccgtgctctgatgctaaaagcagactcaaatgctactgtcgtgataggaatgctaagtatgtcatgcaccatagatgctaagttaccaaatctgtgttggttttctttccaatagctcaaaacatccaaatttcgaaaagcctttctatgtaaccttggctcatccaaataaacatctaattgcgtcttcatgttgtccacatcactttctaagcttctttctagctcaaaaaggattacaatatcattttggctatgggtgcaatcttggatcctagatgaagttgcagattcttgaaaaaacttataagcttatgagtatgtggatctttctacttctaagtcgaaagctaaagaactcaaaaatgtattgaaagaactctacaaagattatgagaaaaggaagttggcaagtttatgtggagcttttgtcggctctctcaactatgattcgcttgtggagctttttttgactctctcaatattaatgtgaaaaataaagaaccggaccaaactgaaactgtataatcaaatcgaaccaaaccgaaatattaataccaaagatttggattgtagctctttcgattttagattttgttgtaagtatggtttttttaagagagaatgtaaaatttattcaatctttttaaaaatgcatcagtttacaaatgtatcaaactactgttttcattttagtgtcgcaaaaaattagtcgttaaagcatagtataacacataatgtgttattgcatttgaaaatttttatttgttggcaaaatgttcaccaagttgtattttgttgtggagcattcataagctttggaaaaaagtatgaaaaatttaggagataaacaattttgttaagaattaaaagataaatttgtacaaagatttcatttgatgaattacggatcaaattatttaggtttcagtttataggacctgaatcaaaaataattttaatttaagtaaaactaaattgagctgaaaaataatagagtttattaaaaatatatattttttagtttttttatctattatatcatcattagaaatatttgatctaatcctattatgaagtagtttacctacaataataatgtttaaaacgataaacaaaaaaaaaaaattgaacataactatcataaattgggttaattggtattgttccgtcagtcagcttaattagtattgctcagtcatattaaacgttacaaagtccggatcgaattctgaccgaattcaaacggtaaataaatcgaacttacttattacatggatttaaaagcaacccactataaagcccagtggggttttagaacccaaataggaaaacgacgtcatatcatatgtaaatctcacatcactcacgtcgacaaatcggcatgaccaaacaacggcagagttctctcgattctcatcaccggtgaaccaaaaggtttagggttttagcttcatccttctgcttcaaagcttcaatcttttctctcgattctcatttccaatttcataactgattcacaaatgcaaagcttcgtatacccataaagttgaatttgtcgtctgca

SEQ ID NO: 1184 - DNA, 3000 bp, Unknown
  misc_feature (1)..( 3000): cDNA_ID_2131449_gDNA_ID_1620368_Annot_ID_154909 3000 nt of promoter + ATG
taaaatctataagaatttgaaaaaagaaaaattcctcggcaactaatttttgttttttgttaaactaatatatatcttgttaggttttagctttatacataatctcaaagaatctaaattttcaaccgtcaaataaaataaaatctttcaatttaacaaagaatcatatattagatattgttagcaagatataattgagatttctgtttaaataggttcagtgtgcaactttgttcattgagtagaagaaaatggcaaatttcgtaatgttcttaaattttcttctttctttaactgtcttccacacttttcagtcagttcagtctcatttttctctctataatgataacaacattttcaatgttcttaattatggagcaattggagatggattttctgacgattcaaaggtttgttttcattttggttatatattctagttacatgtattgataattcaaagtatttatagaaattattaattcatatttctttcttaatcacggtttcaggctttcaaagatgcatgggaagacacatgcaattacattggatctgaatcaattatggaaattcctgaaggaaacacatttcttctgcaacctattgagtttcatggcccttgtaaatccaagaaaatcattttatcggtatgcataatcatatatatatatatatatatataaatattcaatatttattttatttactaacaagattaaggtcttgataatatttacaagtttttaaaggggattttggtttttattattttgaaaatctattttttttactatacaagatttttgaaaatatatgcaatactaatacatttcatatttttgtttgtagatcagtggaaacttaattgctcccgaatctccatatgaatggaaatgcaacaaagatgattgtcatcagtggatcgaattcgcacatataaatggactttatatcgatggtcatggcttgatggtcaaggaacaaagtggtggtctctagattgcacccaatatcaaaaagtatgcccttacccttttttatattttttccaatgttgatcagtagcaccatttattttattttctattcatctaaacccatttaactttttttttctttataggcatgtctcaagagaccaagggtatgtaaaaaatcactgaacaattaagtcaatcatctctcatatttaaggttatataagtcgttgcacaaattttttttagggtgtggttatatcacattcgagtaatgtgcatataagcaacattatggtgaaggacagtccaaattttcaaatgtcgttggaagattcgaaatgggttattgttaagcaactcaccataaccgctgatggtgatagccctaacactgatggcattcacattcaacgttctcagaatgttatcgtatacgatagtaacattcgtacaggtgattcatcattgatctttatactgtttttttttacaacaagatcgaataagatgtttgtctctcctagttgggttagagttaactgttgataattttaggtgatgattgtatatctattggtgatggttcgaaatacattaatatatcacggatctcatgtggtccagggcatggaataaggtacttctcttccattggtctggttacctatttcaactttaactatggtcaaattagtataagtgatgtgatcacgttatttttcctaaacaagtatcggaagcttaggtcgatatggaaccaaggaaacggtcgaaaatgttgttgttcgagattgtacttttagagaaacaactaatggggttagaatcaagacatggcaggtaaaactgatttgtttgtttttgtactccctaatttatatattgttgttaaagtaatgacaatatcattttccatatgtttgtattatttagggaggaagagggcatgtgcgaaatgttttatttgaacgtataaaactacatggagcaacccgacctatcatcatcgaccaattttattgccctcattcacaatgcaaaaaccatgtacgtaaatttttcttctccttctaatgatttatgagtacctagtccttaatatctatctactcaagtgttttaaaatagtactttaccaaaagtattaggttggttgtcatttttcgaaactatttcataaaattaatccacattatttcgtgagttatgtataataaattgatgtttaattcatatatatgtacagacgaaagctgtggagatcaagaatgtaatgttcaaccacatacatggaacatcaatcaagaaaccctttgtgcaactcctatgcagcaaatcagtcccatgtagagatatattcatgaacgatattaacattcacgacgaaaacgaagaggaagaaaagaaatatcataaatcattgtctcgccacgatgatcatccttctgctgaatgcatcaatgttaaaggtgaatctaatggtgtaatgaagccaaaactagcttgcttggaatccaaaagacattgatttgtctaaaacaatttgttagtttatttattcttttcttgttttgattagaactatactataatgcttgtgttttctccttttgatttattttgagaactaaaatagtaaattaaaatttgtgttttggtgaaaaaaattcaatttgtataactaaaaaaattaataaactaacttatcatcaaaaaaaaaagaaaatccggttcgattaaattactcaacattaacattgatattgtgagcacatgaccacaaactcaatcgataactaaattgagcaacaatttaaccactaaaatttttgttgctaaaatagttatgaagataatgaatttatcagcaaataaatccggtttggttaaaccactcaacaataacattggttattgaaatccaactgatacggtgtcgtattaccgcagagatgaattttaacttcttcgtgttgttgagctccaatctcactattacgcaaaaaaaaaccaaatg

SEQ ID NO: 1185 - DNA, 2639 bp, Unknown
  misc_feature (1)..( 2639): cDNA_ID_1413191_gDNA_ID_1620368_Annot_ID_154898 3000 nt of promoter + ATG
gatcttgttcgtgttgggccaactgatgtagctgttaagtttttgttccctgtgtttgttgaattctgtattgaagagtttcctgatgagatcaaacgttttaagagtattgttgatactgcagacctcacgaaacccgcgacttggtttcctttcgctcgtgctatgaagcgtaaaatcgtttaccattgtggaccgactaacagtggcaaaacgtacaatgctttgcagcggtttatggaagctaagaatggattgtattgcagccctcttaggttattagccatggaagtttttgataaagtaaatgctttagggatttactgtagtctcttgactggacaagagaagaaatatgttccgttcgccaaccatgtatcttgtacggttgaaatggtgtctacagatgagttatatgaagtggctgtgctcgatgaaatacaaatgatggcagatcctagtagaggtcacgcttggacaaaagctttgcttggattaaaagctgatgagattcatttgtgtggagatccgagtgttttggatattgtgcgtaagatgtgtgctgatacaggggacgagttagtggaagagcattatgaaaggttcaaaccgttagtcgtagaagcgaagaccttattaggagagcttaaaaatgttaagtctggggattgtgttgttgcgttctctagaagagagatatttgaagttaaaatggctatcgagaaacatacaaatcatcgttgttgtgttatttacggtgcattgcctcctgagacaaggagacagcaagctaagctgtttaatgatcaagaaaacgagtatgatgttttggttgcaagtgatgccgttggaatgggattgaatcttaacataagacgggttgtgttttacagtttgaacaagtacaacggcgataagatcgttccagttgcagcgtcacaggtaaaacagattgccgggagagctggaaggagaggaagccgttacccagatggacttacaacgacattgcacttagaagatctaaactatctaatcgagtgtttgcaacaaccgtttgatgaagtaacaaaagtagggcttttccctttcttcgaacagattgagcttttcgctgcacaagttcccgacatggccttttcaaatctcttagagcattttggaaaacactgcagactcgacggttcttacttcttgtgccgtcatgatcatgtgaagaaagtagcaaacatgttggagaaagtagagggactgtctctagaagaccggtttaacttctgttttgcaccggttaatatcaggaatccgagagcgatgcacaacctatatcgatttgcttcaagttatagccaaaatatgccggttaatgtagcaatggggataccaaagagttctgctaagagcgatgcccagctattggatttggaaagtagacaccagattttgtctatgtatctttggttatctaaccaatttgaagagaacttcccatttgtggagaaggttgaagcaatggcgacaaacattgcagagttgttaggtgaatcgttgagtaaagcttcttggaagatggagtcaaaagaagagaaagtgaaaggtcaaatgaaggaagatagaggatatgaaagaccagcttcgttaataaagttagttaagaagtaagtatctgcaagattttgtgtgtgttttgagaatgtttttggtaattgtggattttgctgagagatttatgtgtcttgtttcaggcggaaagacgagaaattggtgtgaaggataatagtcataataatgtagcttcatagtgatcatttgcagagagacaagtagtggtttaattcgttattattgttaagcaaaagtttttaatggattctttaattttgattcgactgaagattttttgttgtcggaagatataaagagtcatcaaagagctctctgtgacccttatatgtaaattgcgtattaaattaatagattgtatacaagaaaattaagaagtattggcgtagtatacataaaaatataggaaaaaaatgtcagaaaaatcccaaactttcaaatttgggatgattaaatcataaactacgagaaagataaataaattataaagtttttttgttagtctattaaacattaacaaaaaagtgtttagtaggctaattgaaaaagtgtttagtaggctaacaaaaaaactgttacggtgttgaactctcgttagccgtcgatatcgttaaaaaataatttgttttacttttttgttgacttttttatcgacggaaaaaactgttctgttatctaaaagggccacagaaacaaaaaacttaatttagagatttaaaatattaataaaattagtttggaagtttatagtactactgaaaatatgtcaaagtttaccgtccggtaccacttagaaggttaaaaacgttattttcccattttcaaaataattcagattcattgagcctaacaaattatagaggtcaatgaaaaaagcccaatgggccaacccaaccaaaagaaatcatttgaggccttaagaccctctaggtttttcatagtcgtgtaatataaaaagcacttcgtcttcatcgtcgcgatcaactctgtcttagttttgagcagcagcagctatg

SEQ ID NO: 1186 - DNA, 1581 bp, Unknown
  misc_feature (1)..( 1581): cDNA_ID_2132128_gDNA_ID_1620369_Annot_ID_154931 3000 nt of promoter + ATG
aagcttaagaagaaacacgcggatttacgggagcagaagctagagcaggaaaaatcaggtactgagcttcctgatgatgacagtaagaaggaaacagataacaacagactaaatgatgatgacagtaaggaggaaacagataataacagacaaaaggatgatcgatctgttacgtacgaagagctaagggaacgcctccaccgcaaaattgatgagctcaaaggtggtcgtggaggttcagatagaccaagaagcaatgaaagaaggaagaagaatctgccaaataagagaaagagggatacagtttctgaggagaagactgtggaggagattaagtcagcagataaaggtaagggtaagttggatgtggaggaggctgctaaggaccttacatttggttatgtcaagattgatgacgatgaagaacacggaaaagagaaaaagaaacgaaggctttcaaaggcaagagaacttgaaagggctatgaagttagaggctgcaaagaaggatccagaaaaaggtgatgtaattgcaaagaagcactcatggaaggcagctacaagcagagcagctggtatcaaggttcatgatgacccaaagctattgaagcaaagcatccacaaagacaaaaagaggcaagagaagaacgcagagaagtggaaagagagaattgaagggcaacaaaagttcaaggtggagaagcagcaaaagagatcagggaatattgccgataggattgaacagaataagatgcgcaaaatcgccaagagagagaaaaagctcctgcgtcctggctttgaaggccgcaaagaagggtttatcaatgaaggtggaaactagaattcaagtcttccacacgccttttgtgttccaacatttcaacgatgtgatcctcacaaaggctgtgaagagggtttttgcacatctgaaatcgaaaaacatattttgggaattttcatctagtcaagtccctagcaatatttgttatcttcttgttcgttttactttgcagtttgtagacttttcagatgttccatttgctactcaatgtgttgttccttacagtgaatgctcttatcaggcaggttttagataaacttgtcacagaaattagcatatattgaatgcgagattacaaatactaggtaattcaagctagataatcaatgcaagttgtgttcatttagatttactttgatctgaagtcatatgtgagaaatcaaactaatccgagtagatttgaattattaacttttgttggatccgatttggcctggttcatactacagaaaatatctttcagaaaagttctagatctaaacaaacgtgtctgatttagaacagtaagctttactatgctaaacaaaaagcttggataaagccgaaaagagagtcaaagtaggtcggtgaaagagtctcgagacacgtggcacaagaaccagcttggggaatctcgaaaactctcttactcatcgccattcccacacgtatgatgaatgacgtgtgccaatggatcacattacccaaaccttatataaacccaccgagagacccaacaaaactctaccagacaaaacaatg

SEQ ID NO: 1187 - DNA, 3000 bp, Unknown
  misc_feature (1)..( 3000): cDNA_ID_3061048_gDNA_ID_1620369_Annot_ID_154953 3000 nt of promoter + ATG
tgatattatggaacgaatggagattctggattttcgaaatcttgaggtacttttcttcaatcaaggatttgttttaagatagatgttgttgaatctatagcttggtgtggttatgttgtctaaacaacttaaaagtttagtttttttacttaaactgaatcgttttgcgtatgtagattcttattctagatgaggcagataggcttttggagatggggttccaaaggcaggtgaattacattatctcacgcttgccaaagcagaggaggactggcctcttttcagctacacaaacagagggcgttgaagagctcgccaaggctgggcttaggaaccctgtgagagttgaagttcgagctaagtcgaagtcggaatcatcccagcaattgacaaactcgaaaaccccttctggtcttcatcttgaggtagcataagttcaatatataattatgtaataatatgtttcagagtagttagttttcctgttgtatccttcgttatcatttagcattactgtgacctgatttacgaaggatttccttctaatttgtaagtatccagtagttatacgattctcttcgtagctctattgtattcccttctcttggtagcaagtttgttgtattgaaaatacctattgatcatatgtgttgcatatgtatatacttctttttagtagaaaccgatgttctatctttacatgtcctaccgatgcgtttcttagcggtttatttctccttgtctctacagtatatggaatgcgaagcagataaaaaatcatcacaactagttgatctcctcatcaagaacagtgataaaaagcttatagtgtaagtttaaatattccacacagacttatataaaatgaagcatccttataaatagtctaagtaacgctgcagattcttcatgacctgtgcttctgttgactactggggactcgtactttcaaaaattcctgccctgaagtccatatctttaattcctatccatggggatatgaagcaggtaaattactatgatagattttaattttccttatcacctcattacctattgctatttaaaggttttgatgaaatatacttaacacatcagaatgcaagagacaaggcattagcttcgtttactaaagcatcaagtggtgcccttctgtgcacagacgttgctgcacgtggacttgatattccaggcattgattatgttgttcaggtagattccaataatgttttgtttacattattatgacatctttgttgcaatatttaagattcagaggttcgaacatgttcatgcagtatgatcccccacaagacccaaatatgttcaaccacagggccggcagaactgcaagattaggaagacaagggagggccattgtgtttttactgcccaaggtttagctttgaccactttatgttctcttgtgcaccccatagttacatcagaaagcatgaaaagctgaaaagttcacttgcatatatgtgtaggaagaagcctatgtagagtttatgcgcataagaagagtccctttggaagagagaaaatgctctgaggacgcatccgatgtcatcccgattgtaagaaaacctccatatctctctctctctgttgcacacaagaagggtcgctctgtctatctgtgtgttaatcacattgtttattactacaatgtgttcagatacgttcagctgccatgaaggaccgagcagtgatggagaagggattaaaggcatttgtttcctttgtccgtgcttataaggagcatcactgctctttcattttcaggttcattcatgaggctcagtcatttttctgtttctcaaaattctttatcgctctatcagttttgtaattgaaaagtttttttttttgttttgggtcttaacttacagatggaaagaccttgagattggaaagttagccatgggatatggcctcttgtatcttccttcaatgtctgaagttaaacaacacagactttccagtgagggtttcacaccagttgaaggtgtcaagtttgaagaaataaaattcaagtaggtttttctaccataatccctaaacatttatgatatatatccgccttctcccattcccttagtttccgagacactaaaaatctgaaacttgatacattcaactcgtctacacgtacaatgaccatttttagatttagaggaaacaagcttttgtagtgtgaagtctttgtacatccgtgtcttcaggaatcatatgctttctgagttgacaagttggcatttctctaaacctgaatgttttgaatcaacgcagggacaaatatcgggagaaacaaagacagcaaaacttacaagtaaggaaagagaaacggcaagaagagaaaaaagagaaaggcaagagaaaaagggttgatgcttctgctagtaatgatcctaagaaagcgtcgagaaagttaacggggaaacaaagacaaactattcaaactgctgaagatgaagaagtgatggatcgagattataagttgatgataaaagtaaagaaagggttaattaaagaagatgaatatgaaagacttacaggagatgatgatttattctgatgagaagaaacaaaacctgcatgctgagattggactaagcttagtgtctttctactctcatatcatatgtgattctgttaatttttttttttttttttgggtgagaattaatatcggatcatgttatgtcctttttcgttctacgagtctcacttttatatatgtttcctaataaatttagcaaataaattgtgaatatatctatagagcaaattcgatcttcataggagagtgtgcacgcttgcacatgctagtaaatgccctccataataataaattaacgactatcaccatcactaaggtatttcatgacacaacaaaaataaaaacaaaaatctctctgtatcatcgtcttcttcgtcttttgccgttgacttgtttgaattttcgcaaatccgtctctatccaacgaagaagtc

SEQ ID NO: 1188 - DNA, 3000 bp, Unknown
  misc_feature (1)..( 3000): cDNA_ID_3061056_gDNA_ID_1620369_Annot_ID_154940 3000 nt of promoter + ATG
accaccgacttttctgttttttcttcccaaaattacgtaatcatatttttcccaaagttacgtaatcatataaatgactgttaacaaataaacaagtcaactattaaactaatcattcaaattatttttggttttgtttacaggcgcacacacgatcggacaatcccgttgcacgaacttccgagcgagaatctacaacgagacaaacatcaatgccgccttcgccacgacacgtcaacgaacttgccctagagcctccggttccggcgacggaaacctagctccactagacgtcaccacggcagcttctttcgacaacaactacttcaagaatctcatgactcagagagggctcctccattccgaccaagtgctcttcaacggcggctctactgactccatcgtccgtggatacagcaacaatccgtcgagctttaactctgacttcacggcggcgatgataaaaatgggtgatatcagcccgttgactggtagtagcggtgaaatccgcaaggtttgcgggaggaccaactgattcaagtctactccacgtgtctttttcctattggatttaccttttattatttgagttggtgagtataataaagattgatcttctccaaaaaaattcgaaggtccctttcaatgttttttttttgtttgctttgctttgtgttgaagtgtgtatttccgcattaaaaatctaatgaaaattattccattttgaagttttatattcgcatattttagaagtgattacgtgtctaagttttattggttataataaataattaattctttgaagcgggagagatttcctctgtttttaattacgcgccaattatgtcccgcgtattatctgttaagcgcacgttagcagaaaatccattatcgttaaaatgcgcaattgacacgtaagcgaaccgatgcctgagctctcgtgcacacaacatagtaaagagcgaaaaaggttaaaacttttgttcactgtcagaaatagaaaaaatcgtcgatgcgcattaatggcaattcggccgagaactcgtaaaagagttcaagctgttcgtcgtgctgccgatggtagcgcttttaaaaaatggtattgctactttgttcaaagcttttggattcgtcgatctagatttctttagggtttttatctagatttgtgattactctgttttgggtttttattccagtgaagaatgtggtgttatgatagcgattgctctgtatgatatgcatgagtgcggtgagaaaagaagggaagtgaaaaggttcaagtacattgcgagtggcaatatcgataatatctcgaaaccaattgggagctttgaagatgaacccagatcaccatttgtcttcttcttgtacagtaaccaaagacttttactctgtttcttattacaattgtgttgaatttcttgagttaactagatggagataaatagtggactttgatccttaggtcaaaaaaggggactggtgatgttaatttataaggtcaatgtctttccttttacgttaaatgttggaccttttgttggttcttggtgaaataatgcaaaacaattgtaggaaaatgtcagtgagtgatttaaccatccagtaactatttttctttctctagagaggagtttagggaaaattacaatggagacttagtggatgctagcagaatatgtttcaatgtatggaagaacatgtcagcagaggtaacatcactttgttcttaaaatactcaaaaagcctctggcgtattttctaagctggatttatgcataattgttgcttctttccaggaccaaaaaccattcaacgcccgtgctatggaggttgattcggcacacagtagaaagttaaacgaagaagctaaaaccatttataaggtagactatatccctcgatcataaattgatacattggaagattctatggaggtttactcaatagattcgttttccttcatatcttcatttaattgctaggcatacttgagatagctgtagatttaaactaattaggcttaaggttgttgaacactgtgatgtaccattttgcaggcagatgaagaggcagattcaaaaactgttgggagatatgacaaggtcagagtcattgttttttttttaactttacaaaaccaagaagcctagcctgtgtttgcatattcaattgtttcaattcatttttgactactttgcagttctatgagagctacgttcaaattgaagaagaggaagactatgattcatctgatcatttcggacacgagttttggtaagaatatgaacaatacaacactaccatacccattgttcttggctcttgttttctcacctttatgttcattgaaacagggaagacgatactatgttggactactgagaatcctgatttagtggagaaggttttggcttttggtggtgtacatgttttagagaatttgttgggggatttatgtaaatatagaaacagactagagaggctgctgatcttatttccttcctctgtgactattagaggtgttctcgtcctttttttggtgacacctttttttttcaaaaaaaaatgatggtgaaaactgaatctaagtagtaatttttaactcttcagtaactatcttcctatatctattctctagagtgaaaacatttatattgtcttcgacattatgtggagtaattgttccttcacaaattttgtgttttgaagtaaaagttactagcttctgatcccaagcctgtatatactactacagtactactatactactatgggtgctgttcattaattaagttatagaaacagaattaccattatgggctttttgagcattgggcccatgctttggctgtaatgggtttcaaaccacgcgccaaaagtgcgtgtctactcttagttcttacacgataataaatctttattattattattataaatataaagtttggatatttattgaaccgagtggtttctttcgttgactcgcccaccatg

SEQ ID NO: 1189 - DNA, 3000 bp, Unknown
  misc_feature (1)..( 3000): cDNA_ID_2132171_gDNA_ID_1620369_Annot_ID_154944 3000 nt of promoter + ATG
tctctctcatctgttacatatcacaatcttttgctttaaattgagatccttcttcaaagccgtatctctttctctagtgtaattctcctctgaaattcagccttagttcgtctctttcgttctgggtttctctgtaattgtagcccaattccaatcctgggcatgtatttcaaagtgtttccatcttcttttgtcaaagttgaagactttgctcgttttgaatccgtccgctagtagaatcttcttctttgaatcgattttgatatctctgctttatgggtttccacacttttgccagcaatgtctaagcttccaagaacatgcctttgactagattttcccggtaaagctttttgcttttacttcttttttcctggcacgagaaattaatgggttcagttgatgaggttgagatatctaagactagggtttcatgtcctcctgctctctcaacatctcataagattctcatcagtgaagagaaacctaggagatggtccgagagttcgttgcctgatgtctctaataggattaagcttttgaaatttggttccccttctgctagactcaagagaatggctgaggaaagagatgaagtttcacgctctgtcaacagctcaagctctagcagccacgatgtggtgtcttcccggaaaatcgagtgggcttgtttgatgaaaatgggtaagcaatggctacagaacccgttgaacatggttatgtttttgtggatctttgtggttgctgtctccggtgcgattctattcatggttatgactggtatgttgaaccatgctttgcccaagaaatcacagagagatgtctggtttgaagttaacaaccaaatcctcaacgcattgtttactctgatgtgtctgtatcaacacccgaaacggttttaccaccttgtgcttctctgtagatggaagcaagacgatgttacaacgcttaggaagatattctgcaagaacgggacttacaagccaaacgaatggatacacatgatggttgttgttcttttgcttcacttgaactgttttgctcagtatgcgctttgcggtcttaacttaggctatagaagatccgagagacctgccattggtgtagctatatgtatatcttttgcaatagcagctcctacggctgcgggtttgtacactattcttagtccacttgggaaagattatgatcctcaaggagatgaggagaatcaagtgcaggctgtgggagaaggaccggttagtaatcgcaagttatctcttgaaaggagatattcatttgcttctaatgatgtgagtaatcctgaatggagagagggagttcttgacatatgggaagatatttcattggcttatctctctctgttctgcactttttgtttgtttggttggaacatggagaggattgggtttgggaatatgtatgtgcacattgcgacttttgttctcttctgtttagctcctttctttatattcaacttggctgctataaacattgataacgagatggtaagggatgcacttggatatactgggattgtgctttgcttgtttggtttgctctatggtggtttttggagaatacagatgaggaaaagattcaagttgccgggctataacatctgttgcgggagacccgcgattgctgattgtacactctggttgttctgttgttggtgctctttagctcaagaagtccggaccgcgaattcttatgaaatagtggaggataaattttgcaaaagaagagaagaaaatagtaagattgatgatgaggttgtcgtatctgcattgcctcgtgaagacggtgtgtttgatccgagttgcttgcctaagaagatgaccacgacgatgatagctagctctactcttagcccgagcagacagaaagatgaaacttgcttgggagagaaaggtgatgaagctctaagtccaccttctcctccattcatacacagagaagctagttagaacttagaactaacagattttaatgaaagtttgttaatgtaaaaccagatatactatatctaattgaaagtaaagtttaaattcgttttggggtttatggaatttacgagttataaacaatgtaaaacaggtttagttttctttgaattttcacgtaggaatacaagtgttgtttgaagtgtttcagttagagaattatgtttcttctcatcatctcatgtgagcttaaccacattacgttgatttggaccttaaagtgaattaaaaaaagaacaacttagcattagttgcttatgcgatcaatggtctcatcacgaccctgatgagaatcgtgtctaccatccacgtaaaatcaacagctgataaagtattaaaactttggtcaagcgaacatgtagaaacgattttcttgttcatatttgatgcatgtgtagcaactggagttttagccaatgttttgtttgtgtagcaattgcagttttcttataattcttctaatttctgcaattcactgaatttttcttacaatacaattttttgccttgatatacatacttcataatacatcaacaaaacaaagaaatgtggcagcaattttgttggtgttttatgcaatatgcatctcaatggcaattaaattccaacaaacaaagaaaactgataattatttgctttttatttaaattttgtagtgtaaagaaaatgattgaacatgaatttttcaattccaaatttcttcaattgttgttgtcaattgtcatacctatgaatatatgtatgtccatgataattcattagccaatatatccatttgagagatgttcattagctactatttttcctagttgataaggtcttaattaattatttatttaaattgtaaatggtctttattttgtgctgctatttctactaaaaattttattaaagaagaagttgacaaaaaaataaaagaaaaataaaaaataattgatcgcactgtcaaaccaaaaaaaattgaaaaccctaaattggttgaatgggaaaatcg

SEQ ID NO: 1190 - DNA, 3000 bp, Unknown
  misc_feature (1)..( 3000): cDNA_ID_2132179_gDNA_ID_1620369_Annot_ID_154947 3000 nt of promoter + ATG
tgagaccttgtggtgaatcttctccggaagatccttccaaagacccgtcatgatcttctgctgaaacggcgataacgcgtaaaccaccgccttcaatttcaccggctgctttcccattttcgacgaccaaatctccgatttcgataaatgcaactaggagacttttcaagccggctaatatgcatctctccgtcacaaaacgctgccgtttaagtgtaaaggcttttaatttcaatccacttaagcccaatggttagaatatgggccttttctttatgaatttgctaaaatccacgtggacggtagagatgctacgatgcagagagcggtctatggtgagggttattacacgagatcatgacgttaacacgggaaacaggttgcttcaaaagaaatcaattcattcgtacgggcctttaatccacgcgccttcttcgcatccccacgcgcagtcgtgtgtgatgatggctaatcctccaacgttaccgatctcagaccattccggtggtggttcccaatctcagcaacccgtatcaacaccggcgtttcgcacgttcctctctcgcctctcgtcgtcaatccgccaaagcctatcgcagcggcgtccatggttagaactcgtagatcgaagcgcaatttcacgtccagagtctctcaccgatgcgtattctcggatccggaggaatctcccttacttcaaggtaaactacgtgacgatcgtctccttggtgctcgcgctctcgctcctctcccatcctttctctcttctcgttctcctatgcctcttctgcgcttggatcttcctctaccttttccgtccgtcagatcaacctctggtcgtcctcggccgtacgttttcagatcgtgagacgcttggtgttttggtaattttgacaatcgtcgtcgtctttttaaccagcgttgggtctttattgacctctgctttgatgattggtttcggaatcgtatgcttacacggcgcgtttagagtcccggaggatcttttcttggatgatcaagaacctgctaacaccggcttattgtctttccttagcggagccgccacttccgccgcagttgccgccgcatcaactcctgcgtcaggtcgtgtttgaaggactctcttctctgtagacaacaaactcaattactatgattcttttattgtatttctgaatgcgactatgtaaggggaaatgtagaattgatcttcttggttttaagctgagaaattcttatgattcaaacattaaatggattcaacaatatctcgcattactcttccttagctctttttgtgacaaagattatggaatggttgattactattaagctttgagactaattgtgtttagtgtgtttagatgttgggaactaaaagtgtccgacgtaaaatggcagtgtcatcattccggctgttttaacgaatctcgtgtaaatacttttgtttttggttatggaaaatgacatgtgggataatcatcgagacaaaggagtaacgtaacaaagaagtttatcgtgaatgtttgttaaaatgcattatgaaagatttgaatattacttcaagagaaaaagtctatttcgttattggcagttagtttattgtttgaacgttacactctagtacagtgcataatatgctatgtttgttaagaaaaaaacaaaaacaataaaatgaaatcatgagattgttaaaccaatatgacccaacgtcccaattcatccgtgttctgactttaggttttctgcatctagatgttgtttgtattccaaattcatctttagagtttgagtctttgagatatgaatcttgatttacatttatatatattttttaaaatgaatggatttagacctacatatattattatgcaatagtcaattttcttataaataattaatattgttaagttattgagaaattcgtctaatacgaatagaaaattatttacccattttttagagtttggataaccaatagaagatacaacaaaatcattaatctggttacatataattaaataatatacatgtgaccttgagtttttgtttacttttgtttgttaaaagagtggccttggtattaaattgccaaactattcttactgatgatgattaatgatcatttgtgtatttggtaagacaggaaaaacttgggatttaaggaagaagcttgagacacaagcactagaacgtctagacgtgatatgaaatgacttgagttcaattcaactaaactttgttgaaattatgctaagtgttcggtgcaacaacttaattacctcaactaagtctttgctccctttcaatgtctcaacttcttctcaatttcggatggcgccaaaagaactagtaaactatttttcaagtttataacttatggcgtggaatataaaaaaacatgattacgcaatatagaaagtattcataaaactaataatgttttgatgggttaatatttaaaaaaatatcaagataactaaaacaacctttaaagggatactaaataatatcatttttactaacatccagatatttatttggcactcgaatcatttttaagaggtgtttaatctaatttctaaaccaacattatattttgaaaatggtatcatcatgatcctatgtccattaacatattttaacatatattttctgccaacatttttgaggttgatcaactcttaaaatagaagaaaactaaaccatggttttccatttgaataagtgtgaaaggaagcaagaaaacatagccaacgaactgataaagacacataaatatgttggtgaccggtaatttaatttttttcttttgaataatcagcacctaattcttccaacccctaaataatttagtaaaaaaattaaattcaatttactttaactataaaagggatatttccctcttcataattctctcaaacccttctctcatatatctcttaatctcataaacgttaatctcaaatttttcgtaatctcaaagcttaaacacactta

SEQ ID NO: 1191 - DNA, 3000 bp, Unknown
  misc_feature (1)..( 3000): cDNA_ID_1396308_gDNA_ID_1620369_Annot_ID_154935 3000 nt of promoter + ATG
atgtactattgtagacatcatgaccacatgttttataagagctagatcactagtggccatgaaaagacgaatctttcgtgttataagaaagaaaaaaactctacgtatgaacatgttctataagccgattataaaaagatatatgtccatatataataatgcataccgtcacttgtgctttgatctcttcgtccgacagagtaggcttcccgtcagtgtctttagctattataaacatgtcaagaaaatcttgaggttctttcatcttcccatttcgccattgcatgagtctttcatcaacaaaagggtcgttatacttacttacatttctcattgcgttactcacaaccttctcatggccttccaagtccaagaaccttagccacgggacataatctgacaatgcaaaggcgtaaagatgggttaaaaccgtaaacaaagattccacatgttcaatctcttccaaccctggtcccgatccatcttcacttcctttaccaaaatgccttataccaaacatcatcttccgagctacatttccactgtattgccgtaccgcaagccttaaatcaataaccacaaaagcattaccacggtttttgacactacggttattgatgtaccggactaagttatcagcctcttcggttctcttttgtagcatcatttggaagctcttcttgctcgtcacgtgagatgccaccactctcctcatcttcttccactgctctccttgtggctccaccgcaacggtcaagtacccgcggctgcagtactccgtgcccatcgttagcggtctagtggcgaaaacggagtcttgcttcttcagaatctctcttgcaattctcggggatgtcacggggatcacgtgagtattcgcaagacggatacatgcaatatcggtgttgagttctttcatgagagaatgtatccaccggaacaccggtttgttcctccctagtatttccggtaggtttccgattaaaggccaagatttcggcccgggagggagagagaggtttctcgtagggctaattaacatggttttcttcttctccttacgcttcatagttaatgcaagaagaagcaaacctataataaacgcgagcattggggtggagtcaagcatttttttttttaaatctcaatttggagaaattatttgagttcgaaaaggttttttcttatctatgatgaggaataagctatttatagccatgaaacaaatgcttttgtttaagtgtaatctatggaaaataaatgtgctttaaatgttgaagaaaacaatgttaaatgaatccacgatttttcaacagctcatatgtaagacatgtttttttctttgattattccttatcccttataaatcttgtggatgttaaattggtaatgcatcattatgaaatccttgtcccttttaggtagcgccatcattagaaaaaccacgatttttcaacagctcatatgtctaatgtattacatgttgtgttttaagtacatttctatttaattaccaactttttacttttccaaattcgtctaaatctaatctctaaggataaatttgcttacgattccttaatccttatccctttaaaatcttgttgatgttaaattgttaatgctgtttatgaaatctttatccccttttaggtagcgccacgttaaaaacaatatggacatggagatttgggcttataaaaactgtaaatatttggcccacttaaaaattgattcagcttctgtaaatttaatcctagcagcttccattcggctcgacatgcgtagcaaaaggaatacccacgactatccatcaaccatgaaattaattaggaggcgaattaaaacataatcaaattacataaggactaattaagaaaagctagagattgtgattagagaatagagattataccatgacttgctgaagccaatttttggcactttgcacacattacccaatctctttcagttgtctcttcgatcctttgttcccacttggctcttagtttatgtgtcgaaagatgggcatagctttcaatagtcagtttcgatttgcagcagtaacacttacttaccagttcaaaaatgtgataatgatcgcaatagattgagatatgacttatgagtgatccccaaactcacggcttcgattagtcctcgcttcgatgccataagctgagcctctaaacccgtaatagcggagtcatgaattgatcctttcatgatttgggaggtcgagatagaagagaagacgaaaaagggtttttatacgttactgctttaaagacactctttatttctcttttttttttttttttttttttttgggtctttgtcatcatcagtttactttacgttactgatttcaagagccgttgtggagaaatgtggctgcttctaattttgtatctaatttatgtacgctttgtttcacatttgacatctgatctctttttactgtatcatagcaattctttcttctatctcttttaattattatacttctataccttcatttgttaggtagaatgagtggttgtggactgagtgcttgatccaaacacgtggcttcctggtgggtcgctaacaaacaattgagatcacaagctttggtagcaaaaaaattgaattcataaaaagaatacgtcgtcttttagatcacaagctttgaacgttagcaaaattatgttacctaccaccagtccctggcttattatatagagagagatattcacatttacaatttcgatattgtttctctaagatcgtaaaatagtacaccaagccatttataaatttcttcactctcagattcaaaataatataaattagaaagtaagtcttacactctttgcattcttttttattacaagtttatccactaaagtaagattttcagttctaacaagtttcaattattctcattgtctttttttcaatgctttgtttttttcctaagatttgtgtgttcttgtttatcaaacagtgggaacagag

SEQ ID NO: 1192 - DNA, 3000 bp, Unknown
  misc_feature (1)..( 3000): cDNA_ID_2132221_gDNA_ID_1620370_Annot_ID_154963 3000 nt of promoter + ATG
atatataaatttgtttgcaatctagttattcttttataattttaatatttttatttaatagaagaaaatatattaagatgatttacctccacgtctaggcgacccttatcaacataattttggtcgattattatcggatttttggtttctctaaatgtaagactcttaaaaagtatattttttgcgtatccctttccattctaaacaaaaataaataaaaataaatatcacttaaataaactatatcaatattgtcacaatagatccagctttagtattgaaaaactatttaaattttttattaccggccatgtcttaattctagctccattatccgtcctaatgaaagtgcaattagttacttggacattctcaactatagattcttctccatctcttcctacacttcccacactgtattttaattttatagataaagaagaaaatgtaatatatatatatatatagaatatataaaattagtatatgtacaatgctattgatgaatcacacacatatataccttattccatgaccaggtccacaattcatccttgcgatattgatattcatacttccgctgttaatagctacacaatcatctcctggaaagttttataagaaattttaaaattaaataatcttaaaataccatttgagattactttttaattagtgagtgtgcaagagagatatctagctatatataccagttccaataactgtgtcgtatatatcgacatcacttgattctgagatattaattccatcagtgttaggactatcgtggggtgctacgagttttatcttcgttattttaactcttttgcattcgctaatcgatatatggttttttggactgttgaatgaggttattccagttatcatgagatcgttgcatctttgaaaatgcaattgctgtaagaaaaattgaaagaaaaaaagaattcatcatgaactttccaaaatattgacgacgatcaatgtatataaataaataaaatattttcattttagaattcagaatgaattttagtgagaaaaagataaactcacggtaggccgtttagaagcaggcagtccttgctggatatattgaatatgaaaaaaagaggaaatattaaattaacacttttgtttatatataattaaaaatcatatcttttattgtgtatataaatttctttcaagattgccaaaaaataaaattgtttcaccttccaaaaagacgagccacgtccatgaattgttcccgaaccattgactgttaaaccgattatttccttaaaactaacccatctaaataacttatagtccgaccaagctgctttatttataggtgcaacaatctttccgtcaaactgcataaatgaatacatatacacctttattaatcagataatttgcacataaaattgtaaaaagatttataaaaatatcgataattaccttaacttgtacggaaggagatttacaagggccttggaaagtaagaggttgtagtaaaaatgttttgtttgatggaataatgaatgtttttgaattcccaccactaccacacatagcgctccatgctttcacaaaagcctatttattttatcaaaaaatcaaatgtattagaattcttaataactcaaattttgtgacaaaacgtatgactacgttgtaggaaaatgaaaaacctaataatagttatgtatactcaaaggctgtatgatattatattggtttgaatttttttttgaaaacttacaaaattcagatattttcataatataaaacaagataaaattttgcaatataatacctttgaatcatcggtaataccatttccatcggcaccaaattcaagcacatcatagatttggccgtttacaagaatagaatgcagtaaagtcaacaagaacacaccacgtagtatgatttcctacaacatacaaaatcaatgttagaaagaaagaaaacatactaacttttataaaaaactttactaacttcttatcattgtgtgatgatgatcagatgtaactcttaccattgtgtgatgatgatcagatgtaatgtagtgtatatgtatgtgatgttgatcacttaaatatacacatacaaaatcatgggtatatcttattaaaacatgttcatggatatagttttaaactttacatattttatgcctaaaatcattagttattatggatattatttcgcatataagtgatataatctctcttttatataagatttagaaataaataaaatagaatttgaagaaatagtaaacaaatacaagttaaaatagaaatgaaaatacttgaatataagggggtactaagtaaaaaacattttggaaaactcaaaaatagaattaaatttggatattgtgatctcattgcattattaacttatatttaacaaatacgagtaatattctgtgtaactacacagccattgacattgaaaactaaaatgcttttctaattatttggtagtgtgatttgcaatatatatagacagtaacttgaactaaaatctgatatgatgaacttattaatataatgtattaatcggtttgatgtacgataaaatgttttaaattatccactagtagggttgcatacatggtacattcaatataaccctttcaacgacaagaacaagcactaggtttctgattttaagctctaaactatgtgatttaatttatttgtttgaaaaaaataaagtgtgctagaatatgggatcatgatcatttccattctgaaaattaacgatgtacatttttttttaaaagatagtgtatattaattagtttgttatagttttgaccaaaaaattaaaataaaattatcagttagttaaatttaaaatccaatctgaaaaagatatatatgtaacaaaatttgtttttttaaaaaacactctctgcgtctggaaaaaaaaaaaaagattaaaaaccaataaagaaagtttcggaactaattagggcttccttttgcttac

SEQ ID NO: 1193 - DNA, 3000 bp, Unknown
  misc_feature (1)..( 3000): cDNA_ID_3061081_gDNA_ID_1620370_Annot_ID_154973 3000 nt of promoter + ATG
ttcattggccttcgcccgtttcttgctgctcatgggatttctcatctcacaagcccgcctcatacaccagaacataatgggttagctgaacgaaaacatcgtcatatcgtagaaaccggtcttgcgcttctcactcatgcgtcattacccaagacattttggacgtatgcttttgcaactgcggtgtatctaatcaataggatgccaacggaggtcttacaaggcacgtctccttatgtcaaactctttcaaatgagtcctaattatcttaagctccgagtatttggctgcttgtgctacccatggctacgtccgtacaacactaataagcttgaagcacggtcaacgatgtgtgtgtttcttggatattcgcttacacaaagcgcatatttgtgtctcgacatagccaccaaccgcatctacacttctcggcatgtccagtttgttgaatcaagttttccgtttgcttctcctcgaacatcggaaaccgactctacacagacaatgtctcaaccgaccaccaccaatgttatcccgcttctacaacgaccgcctcatatagctcctcctactgccttgcccttgtgtccgatctttcactctccgccgcactcaccgtcgtctcctgcctctccaccttcagagcatgtgccattgaccgccgcttcatcatcgtcaaacgccattaacgacgacaatatttcctccacaggccaagtaagtgtttctggcccaacttcacaaagcccacatactacacctacaaaccaaaacacaagcccactaagcaaaagcccaaatccaaccaatacaaatcaatcccaaaattccacgcctcctacttcgccaactacgtccgttcaccaacactcacctactccgtcaccactaccacaaaatccaccgcttccaccacctccacaaaacgaccaccctatgcgtactcgagccaaaaatcaaatcacaaaacctaaaaccaaatttaacctcaccacatctctcacgtcttctaaaccgacaataccgacgacagtagcacaagctctcaaagatccaaattggagaaatgcaatgtcagaggagatcaatgctcaaatgaaaaaccacacatgggatttggtgtcaccggaggaagctaaacatgttatttcttgtaagtggattttcacgcttaaatataacgttgatggctctattgcaaggtataaggcgcgacttgtagctcgaggcttcaaccaacagtatggcattgactattcggagacgtttagtccggtgataaagtcaaccactattcgtactgttctagaggtggcggttaagcgaaattggagtattcatcaagtcgatatcaacaatgcatttcttcaaggaactctaaacgaagaggtgtatgtttcgcagcccccgggatttatagatcgtgatcggccaagtcatgtttgccgcctcaataaagctttatacggcctcaaacaagctcctcgggcttggtatcaagaactacgacgatttctcctacaagctggttttgtcaattctctagccgatgcctctctatttatctataatcggcataataccttcatgtatgttcttgtatatgtcgatgacataatcattgcaggagaaaacgctcttgtacaagccttcaatgcctcacttgccagtcggttttctctaaaggatctagggcctctcagttatttcttggggatcgaggccactagaacttcacgcggcttacacctaatgcagcgaaaatatataaccgacttactaaagaagcacaatatgcttgatacaaagcccgtgtccacaccgatgtcaccgacgccaaagctctctcttctctccggaacggctcttgatgatgcaacggagtatcgcaccgtccttggcagcctccaataccttgcgtttacacgcccagatatagcttttgcggtaaatcgcctttctcagttcatgcatcgtccaaccaatgaacattggcaagctgcaaaacggattcttcggtatctcgcgggaacaaaatcgcatgggatcttcctccgctccgatacgcctctaacaatacatgccttctcggatgcagattggggatgtgatctggatgcatatctctcaaccaatgcctacatcgtttattttggtggcagtccggtatcatggtcctcaaagaaacaacgaagtgtcgctcgctcatctacggaggcagaatatcgagctgttgcaaacaccgcctcggaactacgttggctctgctctcttcttttggaaatgggcatatcacaaaccacagtcccggtcatttactgcgacaacattggcgccacatatctatgcgcgaacccggtgtttcattctcgtatgaaacatgtggctcttgattatcactttgtcagaggttacattcaatccggagcattgcgagtttctcatgtttcgactaaggatcagctagctgacgccttaaccaaacccttaccacgtccacgttttacggagctcaatagcaagattggagttcaagaattacctccatcttgagggggtgtataaggagttgtatatattaaggatataattgtcattagtagttgtgtataccctagactaagtactatatatgttgtaacacattcatcataataagacaattcactctcttatcacagattttacaagatgaaccccaaaatcagaaaacccaataattcatcttcgaagaaggtcacagtttccgttctctctgttttcttagtgttcgtcttcgttaatactttcttctacccaagtttttactctgactctggctcaattcgacgcaatctcgttgattctcgagaaagtttccattttccgggaaattttcgtaaaacgaaggtttacatgtacgaattgccgacgaattttacttacggagttatcgagcaacacggcggagaaaaatctgatgacgtcaccgggttgaaatatccgggtcatcagcatatg

SEQ ID NO: 1194 - DNA, 3000 bp, Unknown
  misc_feature (1)..( 3000): cDNA_ID_2132260_gDNA_ID_1620370_Annot_ID_154978 3000 nt of promoter + ATG
gctacagaacaagaagtttcttccatatatttcggttttcttagtttgttgtgatgtagatatgatctccgtagatattctaagatagtgtttgtaatctatttaaacgcttgtaatttcagttctgaacatatcgaaaatacatttctcttccattatgatctctgaatctatagacagtagccctaggaatcgattttgatgttgttgttgttgttcatgctctagggatggatcgcgattatatcagcgaattgccggattctttactaactcagatactcttagagcttcgaaccaaagattctgttaagacaagcgtgttatcgaagagatggagaaatctttggttaaacgttcctggactcgaattattcacccttcaattcacatatcctgatcgcgaagaaatctttgtaaggtttatggacagatttatggagtttaagtgcaggtcacgcctgaaaaagttcatgataacgtatgtcgattgtaaaggttatcgagatcgattaatggagttgatcggtacactggttgatcatggacttcagcatttgtatgtttttatgcatacttttgacagagttgatttcaaacgtcaaaacatttacaagagcaagacattggtctctttgaagcttcataacgtagagttaaagaattcagactttgttgtttctctaccttgtctcaagatcttgaaactggagaatatttgtcacggtgaggatggtcctttggttgtggagaagctcatctcaggatgttctgttcttgaagatcttgagctgattaggccttttgatattaggacacataaagttcttctgcttctgcgtgtgagctctcagactctgaaaagctttaccttacattttgcgatctataaggatcgtacagatttttcagttgagattgatgctccaagactcaagtatatgactgttgaacagagtcaatctgatagcattgtggtaaagaacctgagttccttgttcagcatcgacattggtactaaatttaatcctttgagacatgaggatctaaggatgcgtaatgttttctacgattttttaaccgggatatctagtgtaaaacatatgatcatctgtttgtggagtctccaggtatgtgtttatataacaatttaatgtattaattctcaatgaaacatatctgatttgcatttattcttcttgcagaggttttctccttattcaaaacccggactgattcccaaattccagaacttgtatcatttaaaagcacagatgtggagctcatcaacacacttattggaagcgtttcttgagagctgcccaaatctgaaaaacctcatcttggtaagaagaatctgtgattttggcaaaagaacattgttgaaacatatcgtaaaaactcagcttgttcatttcgcaggaatataatgttgaattggatcgagagcaagtggactttaccaacgtgcctcaatgtttaatatcgacgctggagtatgttgagattaaagaaccgaatgagaaaagtacgattaaactagtgaactactttcttgagaattcagcagtcctcaagaaacttactctacgtttctcatattcatcttctatctacctaaagagctacaagaagcttcttacatcaacaaagctttctcccacatgtcaagttatctttggttgttgaacattgtttcagtgacgttattcctgtagtttggctttttgttgctttgatttcaatttcaggacagagtttcagtttaattatagttttctcttttttttttaataaaaatttttattttcaacataataattgtagtttatatacattttaattaataattgcatttctctggttgtataaaattctaattgggttttggattcataatttatttgctattaaaagcttacgttactgttggtttaatgagttcttcagaatcctaccttgatcgttacgtttctgtgtaatttttggcagaaatttattaaaagctttccttactattcgtttggtgagttctacagatatgctattaagaacttcactgaaagatttcttgagtttaacagttcaagatgaagaatgatcatcacagccgttgatagcgggattcaacatctagatgttgagacacaaaatcctagtcctaggtatgttatagatggaatacctatgaacatttctaagagcaggacattggtgtctttaaagcttctataagaagggatgtagaatccggagttttgtgtttctctaccttgtctcaagatgaagcatcttgaaaatataattttatacggaaaccatggtcttgtgaagaatctcatctcagggtgtcctgttcttgaagttatcatttctaaacatgtatctgatgtcagtgagagcatgaacattatcattatggtttacgatgttaaaaatcttatggtgttaattataatgtcttgtacagagttggattgtctcatatgcttgaaaagtcgtattgatctctgtttcttggagtagtttaatcatctttgcattcaaagtggtttcgaaaagtcccatggtcaattgtttaatatgttggtatggttgacttcaaggttctctgttcgaaacatttgtccaaagaaacaacattttgttttttagaaataacatttgtcaaaagacttttcttctaatccaagaagcttctttggctcgccaatattgactcaaatattttcacctttatcaattacgtaccatctaagaaagcagttgaagactcgctcgctacatcatcctggtcaatttctgatcgaaatcgtatcttgcattcatttttgtgttaggtgcatatttactttattcattcttgatcacttaagtttttgtgtgtgtttctggttaggttgtaccctgcagatttaattgggtaatctatagtttcacaatgatgttttaatattataagctttgtgttttttttttactctccagtgtacatcaaca

SEQ ID NO: 1195 - DNA, 3000 bp, Unknown
  misc_feature (1)..( 3000): cDNA_ID_3061070_gDNA_ID_1620370_Annot_ID_154982 3000 nt of promoter + ATG
tatatatccctcaatgtcttaaacatttgaacagggattcaaaaattgatcccttttctctccaggcagtgaaccagttatatgaagcagtagatagatgtgaggaagtactcggaaaacaacgatacatctgcggaaacactttcactgaagcagatatccgattattcgtcactctcataagatttgatgaggtatatgagtcaacttgtcttctttgtttccaaatagaaaatccatcaggttcttgacatcatctttttctgcgttccaggtttatgcagttcacttcaaatgcaacaagagactcttacgggagtacccgaatatcttcaactacataaaagacatttaccaaatacacggcatgagtagcaccgtaaacatggaacacattaagcaacattactacggaagccaccctacgataaacccattcgggatcatccctcacggccccaatatcgactactcttcgcctcatgatcgcgacagattctcctcgtgaaagaaacaaacatcaaatgtcaatacttgtgtgtgtgtgtgaaaacgtttcaagtcatgttatgttctacattttgagaagtgaatgtatgtttggagattaacctagtttttgaaacactttgacacagatcattctcttttatttaagcttgttgatatgcttattgtgttgaaagatgataaagagagagagggagagagagtgtgagcatgaaagcttttaaatgacgtttgagtatgatcacaccattttgcaaataagattaataaaaccatttctttttgtatgatcacaccattaataaaaccatttctttctaatgtttttttttttaatctatttcttggttttctactatagataaaacggcttctttataaagtaaatttacaatgatttgcctttttcgtccaaaaaaaaagagggatacatttaaaatggtttatgtttgtctatgtattttagttgattttttattcggtaaaagaaaaataatttacaattatatatggattttatctattattaagaaaaatcgttaaaataataatttttactcgtgtgcattttaaattttatcaatattctcaaaattccctaaaagtatatttttgacctatatatgtagacatcattgaacaattatgtattgtacattcaaaagattgtgcaggaatatacactgtaataagatccttattcggctctatatattttaaaaagttatttatcccttattttttcacaattatttatatattacttaaactatgtaaatatctaatgaactaaataatagggaatcttgcaaaatctgtcatatttcactctatttctttcaatttctgtcatattctaaaacttttttcaaaatctgctacattttggtccacgtggaattcagtggacgaaattacccttaaggtgggtcagcgctctgacgaagatggtgacataacaacttttggccgatgtgatgatataagacgaaaaatcatggtggaagcataaaggattaggggacagaatagtggagaacagctggcttctactgttgttattgggtatttaaaaatgacttgtttaaacaaattggttatccaaaattctgcgggggacaacgtaatatataatacattaggagacatgattacctgatatcgggggacaacgtaatatataatgcattaggagacatgattacctgttagcagagaacaattggagcaagacttttgttttagtctccagatcttgtccccgaatagaaattctctgttgcatctacgttttgtcctcgatttcatcatcttgctctattattatgaatcatacatcttatatgcaattgttctcatttaagaattttgaattttatttagattttcgccatctattttggtccacagattagttgagcgttattgttttcacagagatgctgaaaccatctatttttcgccatcttatatgataattttgaaagatgataaaatcggggacaagatctagatacaacagataatttatgatgaataaaattgggaaacaaatttaattgaaagttatatatagagaatatgtgcaggttgtcaggggaagtgatagaaagacaaaagcttttcgttttgtctttggaaaaataatggtgtatggtcaaaatgcacggatttcgaggaaatagagataaaatatagaagaaatggtgaggataaaattgacatttcccatctaaatgtggcatgagttgtaagacctagaaaaataatgacacattatataaggattttaaaaaatatggcataggatataatttttcctaaataatataccaacaaacaataatgttattaaaactaaataaaaagtaaaaatacatttggcaaacaaaagcgtgtcgctgtttcctccgattatggttttgagaaaaaaagaaagaaaaaacaaagtcttcgtcgtccactctcaagctcaacaaagttcttgggtcctcctctctattattaccacttcttcaccaatccttttcgaagagttttgtattcacgacatgagaaagatcccaacactactgatcggttagtacttctttcttctctgtctaataagcccccaaatttcccaagatttttcttttgattttgattagtaactccattgtttcactcaatttctttagctcttttcatgtttccttttctgggtttatcacaattttcaatcttgctcattattttccaataaagctctaacctttaagatacataagctaatttgtgttcttgagactttggtattagtccctctggtttgatgattattttcttaatgttgcttgcttcagtctgtttatatttagattaagtttatttgatgagctctcttcttgtttatgtactttcaaattttagtctttttaaaactaatgtacatgattcagttttagtataggttggtgattgtgtatcttcattagtagaaggttaaag

SEQ ID NO: 1196 - DNA, 3000 bp, Unknown
  misc_feature (1)..( 3000): cDNA_ID_2132264_gDNA_ID_1620370_Annot_ID_154979 3000 nt of promoter + ATG
cactgaaagatttcttgagtttaacagttcaagatgaagaatgatcatcacagccgttgatagcgggattcaacatctagatgttgagacacaaaatcctagtcctaggtatgttatagatggaatacctatgaacatttctaagagcaggacattggtgtctttaaagcttctataagaagggatgtagaatccggagttttgtgtttctctaccttgtctcaagatgaagcatcttgaaaatataattttatacggaaaccatggtcttgtgaagaatctcatctcagggtgtcctgttcttgaagttatcatttctaaacatgtatctgatgtcagtgagagcatgaacattatcattatggtttacgatgttaaaaatcttatggtgttaattataatgtcttgtacagagttggattgtctcatatgcttgaaaagtcgtattgatctctgtttcttggagtagtttaatcatctttgcattcaaagtggtttcgaaaagtcccatggtcaattgtttaatatgttggtatggttgacttcaaggttctctgttcgaaacatttgtccaaagaaacaacattttgttttttagaaataacatttgtcaaaagacttttcttctaatccaagaagcttctttggctcgccaatattgactcaaatattttcacctttatcaattacgtaccatctaagaaagcagttgaagactcgctcgctacatcatcctggtcaatttctgatcgaaatcgtatcttgcattcatttttgtgttaggtgcatatttactttattcattcttgatcacttaagtttttgtgtgtgtttctggttaggttgtaccctgcagatttaattgggtaatctatagtttcacaatgatgttttaatattataagctttgtgttttttttttactctccagtgtacatcaacaatggctacaccaatggaaaacgaaaatccgaattttgctagaaccgcaacatcgttccgaaactttgtttcaaaagatcctgactctcagtttccagcagaatcaggaagataccatctttatatctcttatgcttgtccatgggcttctagatgtcttgcaatcttgaaactcaaaggacttgacaaagctataagcttttcggttagtaaagacgacacatttagtttcgatttttacagaacataatctgatcagtttgttcattagtctgttcaaccactttggagaaataccaaagaaaacgacgagcatatgggatgggtttttccagattcagatacagaggttcttggagctgaacgtgatcatatcaatggtgcgaaaagcgtaagagaactttatgatatcgctagctccaactacacgggcaaatatacggttcctgtaagttcttttaatcatggtgtggtctaatcttaagtcttattttgttacgtcactaaacattttcggatatttagagatattgttggtttctttgtttttggtaggttctttgggataagaagcttaagactatagttaacaatgagagctctgagatactccgaatgttcaacaccgagttcaatcatgttgcagaaaacccttctctcgatctttatccacccaacctccgagccataatcgatgagactaacgaatggattcacgatgggataaacaacggtgtttataaatgtgggtttgctacaaatcaagaaacttatgatgtggtaacgtaactttgcgattttcttatcaatattgtaattaaaatttgattccaacattttaattatttgtctctctttgcaggaagtgaaacgattgtatgaagcattggaccgatgcgaagacatactcagaaaacaacggtttctttgtggaaacactctgactgaatcagatatccgattattcgtcactgtcataagatttgacgaggtgattttacctcgaattgttctgttttcggattttcatatatacgttttgttcaatttaccatatatcttttgagaattttgctttgcaggcttacgcggtgatcttcaaatgcgataaaagactcgtaagagagtattatcatctctttaactacacgaaagatatctaccagatcgcgggaatgagcagtacagtaaagatggatcatatcaagcaaaactactatggaagctttccttctataaaccctcttgagatcatcgctcatggaccaaacattgattactctttgcctcatgatcgacacagattctctttagaaagtgactataccagacttgagttatttgagagtgcaagttttgtttgtgaattgaaattaattgaaatttttgattctctttaaaaagtgactattaattaaaatttttggtagttttttttaagtgaaacactaatgcttattttgttttccttttttacattcttaataataagttttgtttcgtccaacaaaaaaaaaaaaaaccatttacaaaataaagttacagaaaacacaaacgcttcgtcggagctcagcttcccgcttcagaatcggagttgaaatcgaaaattttgaaagtttttagaatctcacttccataacgcttctgaaaaaaacactttgaaaacttattggaagctgtagatttcattttggaagtttacgcttccatttaaattttgattattcacaaataaataagaatcacataattatttttgatagtttttgttttacaaaaaaaaatatgattttgcaatttagaatattttgcatactagcctttctattaaaggaaatcgctaaccgaaatcgaaagtcaggaaaaataaaaactaataaaccaaaactctctaccggagaaagagggtttgaaactttctatttgtcgtcgtgaggctgtcgaataataaagttgactttatgcaaatttgaactaatgactttgggagcgaagactttttacaaaagaatgtaaagagcgattaaaagcttaagatccacgaaaaatccacttccc

SEQ ID NO: 1197 - DNA, 3000 bp, Unknown
  misc_feature (1)..( 3000): cDNA_ID_3061077_gDNA_ID_1620370_Annot_ID_154975 3000 nt of promoter + ATG
gccagagtaaatgagtttatcctggcgtttccagagtttgtattctggattgggagaggtaacaccatggacagtgactgtggtgtgaggttcttcgatcgaaccatcaacgtaaccggcgaggtcatacccatccaatagcgcatgaacttgacgacgccacatgagaaagtttgttgatgtcagctttgtgacattggacatgttcacattgaggagagaggtagaatcagcaacaacaacggtttctgaggaggaagacatagccggaaatgatgaagcttgaagagcaagcttgtagagaaagaaggggagcgagaagaagaagaaaggtcgaagagagaggcggctcttttgttttaaaaaaaaaaaaaaaattaggtcttttagaatcactgctctgataccatgtgataagagagtgaattgtcttattatgatgaatgtgttacaacatatatagtacttagtctagggtatacacaactactaatgacaattatatccttaatatatacaactccttataaaatctactaaaagattccttttttgtttcttcttcttcaccaattcttcagttgaagaaagagcttaaagatgtacagtatcagaggaagaagaagagattgagtttcgtgaaagttgtattttcgagtaaaagatattatcgggaatatagaaaagttcatcttcacgagacatcgcgtgttgtgttgtttgtggaaattgacgtttgaagttcaaattaaaattaatcacattaaattagtccaaacatatatctcttgttctgtaataaattctcgttgacgaacgattatagtatgctttaaaacaagttaatgtgtgtttactactttcattttctttttcgttaactgacttttattaatgaaatgttacaagtctaacaaaacagcccaattacaaccaaaaaaaacttaatacaaaaaatcccaaaaaatgtccacaaagatggaaattaagtttttgttagggaaaattaagtccaactattttatacatttacaaattttaagctaaaaattggggaaaatatgcccaaattttcaaaaaagtttcaatttattccaccaaaccttaaaaataatttattaccttagaaattaaaaatattttattgccctaaatccccaaatatattgggcccgatagcagaaatccccttattattaaaagtgaagtacaaattgaaattttgtctaatttgacctcaattttgatttcaattttatattttgttctttgctattcaaaatcattaagggtaatttggtcttaacaatctcttagactttatatgatccgattcaatgtaaaccattcaataaaattaatttccttcaatctaagttattatttgatttaattcaaaaaaaaatcccaattattttttagttatgtttaattcaaaaaattgtatttataagtttaggatatcaaatttattcaaatatttagtataagaaccaaataaaccgattgcccgcggtaaaccgcggcttaagtcctagtgtattttataacaaaggtaccaaactagtaattttatctcatatatagttattaatttacgattctaatgagttatattcagatttattattttcttattttgttatttatcaaattttgttaattttatactaatccgacttaaaaccaaaattttattattatttttattgtgtttattaacttttttctaacatctcaaaactttcattaaactgtacacagataaatacaaagtatatatatttttttggacaaaaaatacaaagtatatatatgcccaaagtggtaggagaagctttgatgaagaatgaaactcctacacccgtgttggatcttttctgaaaacagaaacatatatttgtttgggaaccaattggtttactttagagaagagagtgcggtaaacttcagtatccaataccgaatgacatagaggagtgtgccaatcatgttaaaaactaatttttgtgagaaatagtgtttaataccttaatcattattttatttttaacatcagattattaactcgtaaagagatgttacaaatatcgtttcaaccatataggtggtacagagaaagtttaacacaaagagttaatagattgagccttcttggataaggtatcagcagcggcatttctttcccggttaacatgtgccaatgaagagaacgggagcttcgcaatccagtggcgaatatcgtagagaagggcttttatcttatgatgatcacctctaatattaatcaaatttactaactccccattatcattttcaaaccacacataccgtaatccttgagtccaagtcacttgaagggcatggagaaatccgagagcctccgcttggagaggggagcttgattgttgaagatttgcacatcctgatctgagaaactggccattacttgagtatttgtgaagggtcttccttgagtataaccgctatcaaagttgcattttatctatccaaaaggcggcagaagccattgtctacatcggcctcctgattgggtacgtggcgaatgtagactctccgtgtttttggtttagagactgtgttgctttcaccattgactcccttccttacttcacagttgggactgcgataaccttttcaaacccaaaaaagtaaaaggaattcatagagatttttctatagttttatggacatatttattgtttaaggtttatttttattttttggcccaaacccaaaaaggtaaaagaaagaaaccctcgtaggatgtcacgaacccgatctatttaatgatcatctctctaaataacacttggcgtcgttggcgatatcttcggcgacaatctgcagtcaaaacaatcgacggagacggttagttcatcatttatccttggattacttaggaagttttgatcgactttgaaacatagaaattaggaatcgatgttgttgttgacttgtgttgttcatgatctaggg

SEQ ID NO: 1198 - DNA, 3000 bp, Unknown
  misc_feature (1)..( 3000): cDNA_ID_2132238_gDNA_ID_1620370_Annot_ID_154972 3000 nt of promoter + ATG
gtcccaaatttttcggtatatgtgattaaaagggtttaaaagtcttaggtaaagaaacattaaaagccaattcggttttattgtttgtgttatgttactagagtaccttacactatttcgtgtctttgatcttaattttaaatcgcatggatgatccctagctagaataattgtatcataagcaaaatgatcaagagtggggctcacttgtctaatgcgttttttgcagcatctctaaccctactctattttttctctaaaactctattttagaatacattggcttcaacttctctctatatgttactctaaaatatagtaaatggtaggattgttctagatatatagtaactctattttatttacactgcctctattttagagtgatacattggaaagaaatcatgctctattttagaattacattgagatggtctcaatgattttttttatatcttatgaatgccattatgacttgtgatctgtgtgtggatataagtaaagtctaactatacaggtggggtattaattgatttcttgatgatttttatagttgatatatatgtgattatttttgtctaactagcagctagctatgagaacattaaattaatttattgtcttataaccgagaagagtactatatacttctgttggcccggtctcgttggtttctctgatgcatattgcgtaacgggttttggtgttttcgtggagagttaaaagcggttaagaaagagcttcacatacatgatcagtgattagcaagttttgttgcctcgcaattggttatatgagacattttaagaatgctaagtggttatttgattttcttgttttagttgtatgatattttattgtattgacatggattactactgtgtctctttgtctagtttttgttttgttttttgattgtgtaaccaactacccagttttgcagttaagattatatggattaatttaaggctcactcaaatccggtcaactattctaatcttctttgtagatcaatgattaataatggaatcaattatgattaagtaaaacacaatgaaaccattgaatcaaacgttcttacagaaaaaaatacttcttgtttttcctcagcaaatagtttcctcaaaaaccattaccttccatgggcgcctccttctccctctttaccgacgttggaccgatcccgcctcagtatcaagtgttcatcaacttccgaggcgaaaaacttcgtgatgggttcctagggtttcttgtggatgctcttttaaaagagaatgtcaacgtttttatagatgatcatgagcttagaggcagagatcttgatcatctcttcagtaggatcgaggaatcgagagtcgcattgacaatcttctccaagaacttcaccaactcaagatggtgcttagatgagcttgctaagatcaaagaatgtgtggatcaagaaagtcttacagtgattcctatcttctttaagatgaaaacagacgatgtgaagaaactgaaggggaattttggagacaacttccgggacctgaagttaacgcatcgcggcgagcctgaaacttatcggagatggaaagatgctatactgtatgtttctaagaaaactggcttgtcttcgtcacgatacaggtctggactttgtccctttgcttatgttctttgttggaaacttggaatactctgtttcttgactctgttcttggttagttcaggacataagcttgttcactgacagatcttttgaactctgttatgacagtcgccagaatgatttggtcaacacaatcgtcgaggaggttaagaaagttctaaacgatatcgccgagatcgaacgacaaattgctgaagagaagcgcaaccatttggcggcaagaacagatgaattgattagacttgttgtccggttcctaagtctgtttcttctttttacaatagtttttggtccttatgttttaggccttctcacttttttctcttttcttgtgggtcgtttgataatcaatcgagctgtggaaagtgagtggtgaatggtaacgtttgcgtttctatgagaatacgtaaacgcaaagaatctgagactgagagtttcattttggttacacattgttgcattcgatatttttttctatgaaataatttgatttcgattagtttgaccttgcatcaattattgataaaagtgattacgattaataacactatctcctttataacctaccacctaagacttttggtcaactactagatcaatgagacttccacatgttttatttggttatgatcttgaaatagaagaaaaaatacaaatctaaagataaatgtttctttcaaagtaaccacttttcactcttttgctttatttttcttgtgcaaaaagttcccaaagtctccgcttctctattccaaacagttaaaacccaaagaaacacatagtctcttcgcttgaccaaagctcaaaaaaaggtcagaataattcatatgaagttgttgagtgtccctaaaaacacgagatgtctaatgaagtcatcaagcagctcggtagtcgtggtcgtgcttgaccaaagctcaataatggatccagcacgaccacgactaccgagctgcttgatgacttcattagacatctcgtgtttttagggacactcaacaatttcttatgaattattatgacctttttttgaaaaaaaagtagttaaatctaaatatctaatacaagaatagtttaaggatagtttacatttgttcattgaatatagatgaacaaatatctaaatatttgtcctatatttccaatttttccataaaaaataataaagaagacagttgccaagagttgacttttgaaatgaatttttcctaaaaaagaaataaatgctttgacttttgaaatgaattggtccaaaacaagaaatgaatcttttacttttccagcttcttcttctccatatattcatgaagaaaaattaaagcaagaaagtctcaactctcaaccctccc

SEQ ID NO: 1199 - DNA, 3000 bp, Unknown
  misc_feature (1)..( 3000): cDNA_ID_1830914_gDNA_ID_1620370_Annot_ID_154967 3000 nt of promoter + ATG
ggtttgtagagagattggagaagaatgttaaagggggtgactttttttgaagatcggatggattttttttttctcagagatctcaacagggagagaaaaaagacaaggaagacggtcacttcatggttaaaaaagtttgttggaaaatgaactaaaaattctaaatttagcatcaaagacacgacgagaaagaaaagagacagggtcaaagattttgtttttttttttaaaaagaaatatagttcactaattaaatcatggttaattaccttcttatttgctaagaaaatttgagacagttaactaaaactcacttttcttcgtaagcattgtaggaattcggtactattcaaaaagagggaaaattccaaaacaaaaacacaattatttattaattagacgtttaatatgtaatactttatggttagaagaaaaatatgcatattaataaaaattgtgcaattttatcttcaaaaaactaattgatgttattttcatatcaataattttacaacaaaattttaattttaattttactcttactagttcaattaatcattaatatttaagtgatgcaacattaattttattttatttttaaatttactgtttattaatattttgtttctgtattcatcccaaaagattttgtttttctaaaatagattattttatttttaaaattcaagagaaaacaaattaaccatttttatgaatagataaattttgagaaatacaatgactttgggattgagattttgtcgaaaatacttttattggtgaagaatttaaattcaaatagagagtttctcacgacgaagaagaagttcatatcgatgttcgttgatatcatatccatcacaacgaaaaaaaatcgtgaacggctatcgaattcgatgttggaaaaagagggcaaaaggagattgtttaacggcgattcacatagcgattaatcgagaaaatctagaatcaaaaattgaatcctaagagaaaacgtctctttcattttctcctaattttttatgttgaattttaaaataaatgaatatataatagtaaatgaaattttaaaattaatgtacataaaattaatttctttatccaaaagtgtaaaattaatgccacgtcatcttaaaaactaataattaattgagatagtacgtgcataattatcatatttttttatgatatcgttattatgaaaataaccacatttaaatgtttaaatattaaactacacagtttattaatctttttcatccaaccaaaaactattagatattaaacgtccaaataaaaaatgagattttttcctttcaaaatatgtttacaaaattgggctttttttcttttgaattttgattttatacttctcaacctagcaaaaattcgatgtcggttataaaaataaatctctatcaaaaatttgttacgtagaggaatacgactaaaggaagagaagaaaatagggctatattaatttatatacccagaaaacataaaaataaaaaataaacttataattttttttataattagttctctttccacaacttctataagttggactaaaataccctttcgctcataataaactaattaacaacataagaaaattgttaccgacatcttttatatgattcagatgatattgtttatcaaatatataagtaagaatatattatgaattaactgataactgttatgttaacaagataacaaaatatatagcaataagtttataactatattgtgttaaaccatattgtatcgcgataagtttataaatatattatgttaaattatcttgtaccaataattttttgttgttcattatgttttgttatttgttaattattttaatatgatgtaattatattgatttgatatgatatacatattattttgatataaaatttaatacttatccattaaaataacgtgtgcataatcaaaatccggattattatgattaaatcctcttattattaaaagagaagtacaaattgaatttttgtctaatttgacctcaattttgatttcaattttggattttcttctttgctattcaaaatcattaagggtaatttggtcttaacaatctattaaactttatatgatccgattcaatctaaaccgttcaataaaattaattcccttcaatctaaaccgttcaacaaaaataagtaaataacaaaaaaaaatcccaattattatttagttatgtttgttttaaaaatttttatttataagtttaagatatcaaatttattcaaatatttagtataaaaaccaaataaaccgattgtccgcggtaaaccgcgggttaaatcctagtagatagttaaaatgtatagcaaaatagaatgcgtaagattaaaattttagtttttagaaatttactaaacaaaatacagaaaaggtgtgttgacaactatttaaaatttaaatataatcaataagatatagttaaagttattaagtgtatagcaaaataaaaattgtaagaataaaattggatttaaaatttttttagtaaattaaatattttaaaaatagggattatcatttactgtttagaattcaaatatcatcgataaaaatttatactattgttttataaatccgcttatctagacgggcctaacctagtaaatatataatacacatcttatcattcggtcaaaatattatgaaaacatcattaaaatttgatgattacattccataagtaatttgttaaagcattatgcattttcctgttctatggacattaatttgaaccatacgactccatctaattcacttgttctcggcagctagcattcgaatcctgacttttcaaatacaaattatcggtcaagatgggtgtgcgttacgttcatttacaaatcactaaaaatgagtggtgaataatcatttggacaatacggatacattcatcgaagttgactccattatcctaccgtcgtctcctaacaatcgaagcacaactttgca

SEQ ID NO: 1200 - DNA, 3000 bp, Unknown
  misc_feature (1)..( 3000): cDNA_ID_2132235_gDNA_ID_1620370_Annot_ID_154971 3000 nt of promoter + ATG
gtttcaatgtcttgaggacaaatgagtttgagttttgtgatattagcccatgacaaatcttgaattttgaatgatattgggctggtttgaatttggtccattagttttcatcaaaacacaagaggggtaaaacggtctttgactatttgctgtattagaggagggctgtattagagaggacagaagaaactaccctatcagcctattttttaaaaaactgtctagttctcaaattatttctctaaaaactgcctagttctcaacttatctcattatacttctaatctagaagggcatatttttagtcataactcatttttcactttttgttgtttacttacacatattaatgcattttaactttatttgtctttgcccatcaataattcaaagattattattctatggtttttattgtccatgcacttgtttttaactatttttagtcagttttaatcatttctttatacatttttagactttgaatttcagtcacaatagtttatatatgatctgatttgtgttgttaaaaatttatttataaattattccggtaaagttttcttacttaaatattgaactacattttgtgtgatatatagttgttaaaaaatcatttttatacattaaattatatttttattttgcctatggcatcaaaaacctttggcacggctctgtgtacgccgaatgatgaatgtgtaagtgacgaggaagaagatgaaggcactgggcttactaatgggctgcgtccgagacagtcctcacgtgtaaggaagcccaataagaagtatttggattaagagagacttcgtctccacattttcaagttctgcaaataagtgtggaagtggtctccctaattgttaggaaccattatcacctctttcccattatttcccaaattgtaggactggtgttcactccattgcattgttgttttgttcttctatttaagaaatgaaaaagccaaaaagaggcaatatcgattgcccaaaaatctgagtctcattgttctttctttcaagctttcttttaccttcggtactaaaattgtgatacgacgaggtcatatctatcaccgaaccaggtaactattaagtggataacgtctctgttgaagcgaatggccatgaaacctttcggtaaaaagtcctggtttaagataatacagattatagttctatcataattttgtcagtttgcactgtaaccatttgctttaaaaatgtgaagatttaaaactggtttgtcttgccttattgattaaaaagcaaaaatcattaataagatcctctctgattcattttatttcttctacattgggatcttcatacgaattgggcattggcaagacacggccgagctgcagaatatctatagccaccggcaatggattgactagtgtcccttaagttccgtgaagttaattaagaaaatagccggctttacccgggacacatatgcatactactcaactatttttttaaaacaaatattttaacaaagatttaatgcgttctaaatcccagggcatttttgtgtgttaacgtcttccgcaaggtacctccgaccagtgaccaaccaccgttctatcgccaactttagatttcgaggggtcaatgtctgtatagatggcttcaagcggaacaggggaaacttacaagttacaacacctcttgaaaaaatttatgtactcgaaatttcgggtttgatcttctccaagaggttcccaaagtcaaatagtgcttggaggaactagtgaagattgactgcaaacataaccgcccacacctcagaaagtcagagataatatttcgtgatacttcatgaatgatggaaacttggggtttaattaggtcccaaatttttcggtatatgtgattaaaagggtttaaaagtcttaggtaaagaaacattaaaagccaattcggttttattgtttgtgttatgttactagagtaccttacactatttcgtgtctttgatcttaattttaaatcgcatggatgatccctagctagaataattgtatcataagcaaaatgatcaagagtggggctcacttgtctaatgcgttttttgcagcatctctaaccctactctattttttctctaaaactctattttagaatacattggcttcaacttctctctatatgttactctaaaatatagtaaatggtaggattgttctagatatatagtaactctattttatttacactgcctctattttagagtgatacattggaaagaaatcatgctctattttagaattacattgagatggtctcaatgattttttttatatcttatgaatgccattatgacttgtgatctgtgtgtggatataagtaaagtctaactatacaggtggggtattaattgatttcttgatgatttttatagttgatatatatgtgattatttttgtctaactagcagctagctatgagaacattaaattaatttattgtcttataaccgagaagagtactatatacttctgttggcccggtctcgttggtttctctgatgcatattgcgtaacgggttttggtgttttcgtggagagttaaaagcggttaagaaagagcttcacatacatgatcagtgattagcaagttttgttgcctcgcaattggttatatgagacattttaagaatgctaagtggttatttgattttcttgttttagttgtatgatattttattgtattgacatggattactactgtgtctctttgtctagtttttgttttgttttttgattgtgtaaccaactacccagttttgcagttaagattatatggattaatttaaggctcactcaaatccggtcaactattctaatcttctttgtagatcaatgattaataatggaatcaattatgattaagtaaaacacaatgaaaccattgaatcaaacgttcttacagaaaaaaatacttcttgtttttcctcagcaaatagtttcctcaaaaaccattaccttcc

SEQ ID NO: 1201 - DNA, 3000 bp, Unknown
  misc_feature (1)..( 3000): cDNA_ID_2132313_gDNA_ID_1620371_Annot_ID_154986 3000 nt of promoter + ATG
cattgaaacacttaattaaaggaatacactactatgaaatatttatgtaacaaaataaaacctggattatgtaccaagtttctatattataatatatcaacttttcccatatagattttagtcttacattttactaattatgtcttttagagttattttactttattttttatttttggggtgaagaactgcaagaaaagtctttcacagttggaaaagctcctcgttaactttataatataaggtttggataaaacaatctgtaagaaataactttcacactttcatagttgaaaagatacctagttaaattctgatatattttgttggatataaaaaacttcaaaattgatgtacatattcaaagtatcatcttgatggaagcatgagttgtagaaagcttgcgtgtcttgttgaaagaagataaacacaaattgaatcacggtttcttgttttcttgatgttgcaattacttgtaatagttcaaaagtgggatattcaccaagtagttattgctttccacgtgaattacttttcctatattgatcttttttatattattattcctatattgatttattcttgcatttttgtaagagaaaataatcctaaacaggcaaatttaaatagctaaaatgatcaacttaaacaatttcttattgtttaagtattcgaagtctacttttcatacgatagaagtgtctactttagttatagattagttactgatctacctgtctatgctatgaatttgctattgagcaagtctaccaattattatgtaaaccaaccatttcgtacgtcaaattttgtagttattaaaatcttgttttctttttcagtaataatggatgaaatattttctgtaattcatgaaaacttctaaatattttaattattttcacaattaaatagttagtgaaataatttaatgaatggacaaagtttatcagaggttatgaatattaaagctgtatactcgtgctactaacaaaaattctatactgtagaaggatatagaagatccacaagttaatatgaagatgttgtatatttattatattgatatgtacagatttagttctatcttagattaggaaaccattttattatgtaaacatatgtaacccaaagcttatcattataagagtcaataacatattcttccaatctctatctctcatcaagctgtacatggtataagaaccacaatgatctaacgatcggatccattcctcgatctaagccaagagctctttatttttatttttttttgtgtttaagtcaagtgcttccaagttccaacattcaaattcttcatgaacctctgaatctaagcaaaaaaaatgcttagtgcttgatttgaaaaatttgcaaatttgcaaaatatgtgttttaaaagttgctctaaaaatggtctcagtcgtaaggttgcatgttttttttcctcactttccaaagattgaaagataaagtaggtgaaaaattgtacgacgtgttgtctaagagcagcaaaaactactcaatcggataaaattacaagaataatcgagacatgtaattgtaatctagtggtttgtgtgtgttttgtttaaaccattcaagttcaaatattgataaacaaaattttatatgttgttaaagtattatagacaaaattacaaggataaaatactagtcaacgtaacttaatatcaagtcttttttaaataatttttcaaatcaagtctttatgatgtcgcttttcatggatacctaatcatgtctttattttaatgttgctagttgctacaaaagataaaactactcaaattaaaaaacgtttagtgtaaacaagccataaaacagaaaaactaactttcgtataaatgcatcaatttactactaaaactacagtttttttgtttttgaacaaagactaaaactccatctaaaaatcataaaatataactattgatgaaggggaaagtaaaaagaaaaaacacacttttacttgtcaaaaagaaaaaaaaactttcatcatgaaataataactggaatctatttggggtacacaaacacacttcaatccttcaaaacaaacccaaagtcatatcccaagtgactcatcatgcgagaaatatgatatagacagtcttattattactttcccccgaaatcatagtatcaatttgattgagagttttataaagcatgtcttgttgaaaaaaagatacacacaaagtgaaatggttgatctctacaaggccacatacatgctagaaatttggtcactacttttgtctttctggcagtggttagagactgggatatttaccaactaaatgatgtcttttgcttaatttgatattttagttttaacgtacttttcctgatttgaattagtcattacgttttataagagataagtattattccaaaaagaccactgaattttgaaaataaccaagatcaatgcacctaatgaatttcctacccaaacaaccagttttgaaatattctcactataccattgaatttaaaatacaagcaggattttgaaaatttacatagaagacttgttcgtgtttgttgtaaatttgcttatcaagacagattaagcaagtctctggttaattgacgtaggaatagataacttacataagttatatcagttttttttttttggtcgtcaagttatagcagatttgcaaagtatatatgttgtaaatatataatctaagatatattgggctatgaggcctctcccgagcccacttagattgtatagctacactaggttaaatcatgttgttgtatataaggcattgcctctcttacgtatcaacatgaaacgtctttttacatcttcatctcctttttgacatggtatcagagcaaaacctaaactactaaagggtttttgtttcttgattctgtgatctgtcaattccgctgcaagttatagttgtttctaaaattcgtttgtttccacttctttgacaaacttttctcacgatg

SEQ ID NO: 1202 - DNA, 3000 bp, Unknown
  misc_feature (1)..( 3000): cDNA_ID_3061117_gDNA_ID_1620371_Annot_ID_155003 3000 nt of promoter + ATG
aggtttgtgccgtttgcaaaccgatggccatttctttgcacattgacatttccagtagaaatcgtctcttgcgatatctctccattgtttgcaaacacccatacatgacgcgagatcttcgccttctagcaatggaaacacattcttcaatacttcttcactaaacattcttcaacaactactgaaatcaaaattgagatcacaaatgcttcaatttcaataaccgatcaattacgataaccggaacatcgaaaaataacaaatcaaaactgaaatcgatcaaattctattgaattcgagacgattaagataattctacagggaaaattcgaaagatcgaaagaggaaacgatcatcgtcgtcaaaactaatcagaacgatgaagattatgtagatcgacgatatgggaaatgaactaacctttgaaacatgatctggagttgaaatctggatcggattaagtatgattttacgaggaaattgaagaaagtttcatttgatcgattaggattttggtaggctgtaaaaaaagaaacattatgaaaactaaaaagatttaatctgataaatgaaataagaaattaaattggtaatgtaaaaaggccttagcccatatagaagcccaattaaatatttagtcgagtaacacgaaaataatttagacactaaaaaacaaaatggagacctcaacggcccggcccaaagcccattagactatgagccttctctcatcaatttaagaagcttaatgctagttgactttgctaaaatatatagatttgcttcataaaaagtggatgaattttcttataagaagccattatcaaaaagaaacaaaaattatattcgaatcttagtttcttgaggtaaataagaaaagaaatttttttgatgttaatgaaatatttcaaaacatctttagggatgaacccaagaattgttcgcaaaattaaccctaatcttccacaaaacttattttaatattacacacttttaatttaagaatgacgttatcacttaactcaaatatgttattgattatgccgtatttttttgtttggagtatgacaatttgtgaggacatatatattgagttgaataaaacgaaatgataaacgtgaaagaggacaaataagtgacgagcatgggagacaagagcaaagaggtcagattgtgggatcagtagtcacactcttcactgacttgtgttttagtatcaggataccttatttccccacacacaaaaaaactctatacttcttttttccttctctttgtgttttttctttttataagaaaacatagggaataaagcgaaaggaacaagaaaactacatcacatggaaagtagatattttcagggaaaaaaaagtggatgatttgacgtgaattttgagtcttttcttcatacgatacttcttaatatatagaaaagaaaatgatttttatagataggcaacacttacatacgatacttcttaatatatagaaaagaaaatgatttttatagataggcaacacttacatgtaattaaactatatggggtttatgttttattaaattgtaatttgaaaatctgatcattaatgactggtctatagtggtagggtgtagggtgtagtgtagtaccagtagttagctcaacttttaggggaaaaagattgcactcttctgattttgtgtatttgagtttgattcctactgtatgatggttccttgttccggttataaaaacaatttggtatttgaatactcgatactaattaaacaaaaatatctgcagtccaaaaatgagattttttattcactaagaattatggtgattgttagtttaaatgtcatttattaaaactagaatttgttcacacaataatttacgtaattatgtgtgatttttttttttttttttttttgagtaagagtatgttggttggaaaaataaaaaagataaaagaaatatttattatttttaagtaatacaagatgcaataatttgtttaaagtgttgttttttatttacttaaaaactattgtggctcatcagcccaaaaaaatgtgcaaaaaagtaatacaaaattaaagaacgtaagaatgtagaaaacaatattaaatataatagactacactgaatttctctttgaaatagtcgcatgcccctcaatttaatctatgttaaagcttcaagttaaaactttgtttgcttggattcatggtcgattattctgatatctaaagctagaagatacttgaaaaaaaaaaaatcgaatgtatactgaaatcgaataggttgtggtcttttcttattgactttgttaattactgaaatgtaatttggtttattagttgatgttatcaggttttactaataatatagatatttatggataggataatgatagttctaattataagacaatctatcattactaaacaaactcatgtatgtacctcattcataacatctatgtggtcgactacaaaaaaatgaaaatgtgccttaaacattctaattaattaatttggattttttggatttttttcaaatacatggaaacatatataacaaaaccaatcagtttgaccttaaagtagataagttttgttaatttaatatcctctgttctttttatttgatgttttaggaaacatgtttgtttgaacatagaaaaatttccaggttcacaccgcagtccaggaaataaaaacaaagagctgagatttggagaagtttcaatcctatcgaatgcttactctgttttaagtgagaaaggagactatgacgatgttatttcaacgacagatacgagagatgttggtgtaatctcatcaaaagaagtttcaatagggacacagccggccacatcagagatgttgttgcgcgagtctttgccccgtgtatctaaaacagctcacaaagtgatatcagttccttctactcaatcaactaggattcctcctaaagatcagagtaaaagaaacaaatccaaaaatcgttaatg

SEQ ID NO: 1203 - DNA, 3000 bp, Unknown
  misc_feature (1)..( 3000): cDNA_ID_2132362_gDNA_ID_1620371_Annot_ID_155006 3000 nt of promoter + ATG
aatgataatgttaatgatcaggatgcatattgactaaataaacttgaatacaattactaatatagtatgtttctacgttatatatatgcccacccatatggctcccatcaaaattcatcattaatcaaagcttagtaataaaatatcatttaagagggataataatcatgaaactcttagaaaaaatgatatatgtagagtttttgatgataataatggtgatatgggtcgtgcccatgagttacggtcatggagcgatgattggtaatgcagtcgaagcacctgatgtagcggaagcaccagggattaatgacccaagcaaggcactcgacactaattggtatgacgcacgagccacgttctacggtgacatccatggtggcgacactcaacgtaagatcaaataataatgtttttttttaacctcaatacgattttgttttttgttaaaattatatgatttttggttacaacgaatctaattattgaatgcaaattttcattatcaaaaaatctctatatgataacatgtatatataaaaccaacacacatgtaagaaaaaaattcaaagccaaaattagtttttgtgattaacacatacataatcactttttatcattatatattcattagagggagcttgtggatacggtaatctattcagacaaggctatggtctagccaccgcagcgttaagtacggcactcttcaacgacgggtacacatgtggggcttgttatgaaatcatgtgcacgcgtgatccacaatggtgtttacccggatccgtcaagatcacagcaacaaacttctgtcccgcaaattacagcaaaaccacagacctttggtgcaacccaccacagaaacactttgatctctccttagcaatgtttctcaagattgccaagtacaaagccggggttgtcccagttagatacagacgtattccttgtagcaaaactggtggtgtcaagtttgaaaccaaaggaaacccttatttcttaatggtcttgatatacaacgtaggaggagctggagatattaagtacgtgcaagttaaaggaaacaagaccgggtggataacaatgaaaaagaactgggggcagaattggaccactattacagtattgaccggccaaggtttatcgttcagggttacaacgagtgatgggattacaaaagatttttggaatgtgatgccaaaaaattgggggtttggacagacttttgatggtaggattaacttttaggagaatgatttgagttttattatatgtgtcttacacataagttatgtaatacgtacttgcaataattaaaaataaagaagatactatttatccataaaaaattaggatgtatccacaatctatatttatactattatctttcacttctacatgtaacctcttttaaaaatcgtatgttgtttgtggtttggaggcataggaaaattggtcgcctccaaggggaaccggctgacttttgatggaaagatcaacttttaggagaactatttgagtttttttactttttaggataagaaggaatacaattaaaatgaattaacagatgtattgggttcaataactaaaaataaatgagatatgctttattatgtgtagttgatggagtgaagttttttacttctatgtttccatctttttatttttttgccatggaatcaatttacagatttgttttgtgaacctaattgtttaaaataaaacatttttagatttttttctatgtataacatgatttaaaattttgaaatctcatacaaattatttaaaatagtgaataatatttggctaaaacacaaatataaaataaaactaaatagtatagaacgaacattagactaacaaaggatcgagttaaaccgatccgatcccaaaaaaaactataccctatgcgatataacattggcaacccaagcaagcaaggtaaatcatagtagtgatgttgacggtaaaggtggtggtggtggtgacggtaatgatggtggtgatgatgacaatggtagtgatggcactaacggtgaagttgacggtagtggttgcggcgatacagttgtggcagtgataaatgatgatggtgagttgatggtagatgtgatggtgtaaaaatatatgggatagttataataagagttggagttgcagaaaaacaaaattaagaattggaagaggaagagcgtgtgttatgtgtattgccttgtacgtagtttttgaggtgttagtttccaaattattaaatttatttagattatagttgcaaatttccctaatcttaattcgagtttatacttgtaatgtgtaatggatttctaatagagttcctttcttttgtacttagtccattggacttttaaagaaatgaaatggcctacaagaaaagaaaagaacattgctaacatttataattggatatgtcattaaattagaagtcaaaaggattaaaggaacatgagacttctttactcattctacatttcataccttgttttacaacttattatcatcataccatgaattcaaaatatatacaggtgatggcaatatcatcacttcttaggattgcagattttgactacataaaattcaatacaattactaatttatcatgttcactaagtaaatatatgcacatttggaatgatttaaaaaaatattacaaataaccagtaaaaagaaatgggactatcacttcacatttcatgacttttaactacctataaacatcttaccattttatccaaaatacaaagatggctatgttatcaattcagattgactacaaaaaatttcaatacatttggaaagattttaaaagatatgactatagtcaaatatatgtctacttatatatacccactcatgttgttcatttattcccatcaatcaaagctaaaagtaaaacaaaatcatcaaagagggataataatcatgaaattgctagaaaaaatgacatatgtagaatgttttatgataataatg

SEQ ID NO: 1204 - DNA, 3000 bp, Unknown
  misc_feature (1)..( 3000): cDNA_ID_3061089_gDNA_ID_1620371_Annot_ID_154997 3000 nt of promoter + ATG
aagttttaacttctaaattggttcttaactttatcactttctctcctttgatgttattgtttaaatcctcttcaccttcacgctttctaaaccatattaacatataatcacgttagattatctagcattgaaatttagcaaattttgttttctattttcttatttccatatgttacttttgaaaaattaacaaactttttttcttttttctttttattcataaatataataaaaataataaaaaaatatagaaattaaaaagttaattaaagtcatggctaaaaaatgtaaaccaatgagatggttaatcctgattggtcgtttaaaaacttatgtggacgcttttagaagcgaatagcctcaacttttatatagtatagataaataccttgcttatattcctatattcttgaacatattaagagtttataataccttgcttttaatcttgtgagctgattaatttatgtgatgattttaactatagtatatttgatagtatgatattgaaaaattaaatccgccatcatagtcgttcaatgttcgagcagaaggctgacctattgacaaaggctctcgggcgaatcaagtttaaagaaatgagggagctcattggtgtgaaggacatgggacaaggtgacttcaagtttaggagggagaatgttggattaagcttgaagaaagctgatgaagaaagtaatattaaaccgagttatggtttagttcctaaccgagttatggtttagaaagtgatcatctcaaatctctttaggagttatctaaatctatgttttcctattaggattaggactaatgctttcatataaatagatgtgtcgagttctaatatcaatgtgagagttgtattaagagattgagagagaaagcttaagttttgtgtaagtttcttaagctataaagtgagttatacttttatattcttgagttcttaaacaacaaccaaacctagattctataaactgagagtaatcaggcgttgaaaaaataaagactactggaataagagcaaagatattcaaacatcaatgtgtggtttaagtttgaaaactaccctctttcttttcatagtaaattgaaatttctaaccaaaacgaaaaaaaacacacacacaaaaaaaaaatcagagccaagagactaccaataatcaatatccaacacatttcacatcaactcgttcattcaatcttttgataaaatccctcccatgttacccaaaacacaattcaaaagatataaatcaccaaaaaaatatcgatattgattcgtagaacaacaaaataactatacacgtatagcatcaacatcaagtgaaaaatctagcatggtaagaaattcgactcatacaaagaaccaaagcaatataaaacaaaccataatatcagaactatatatttaataaaaagtccttttgatatggtgtgaccgagacttgtatttatagctaaatgtttaggacaaaccatcggaagttttactttttaattttttttatacaaatatttgtatataaaaaacaatttaacatatatttgtatacttggacgatttaacatttcattgtattaggaatataatagttactcctcaaaaccatattaacatgtaatcacgtgaaataatctagcaattaaatttagcaaattttcttttcaactttcttatttccatatgtaacttttgaaaagttaacaatttttttttgttttttctttttaatcataaatatagtaaaaataatagaaaataatatagaatttaaaaagttaattaaagtgatggctaaaaaatgtaaaccaatgagatggttaatcctgattggtcgtttaaagctcacgtggacgcctttataagcaaatagcctcaacttttatatactatagattgcataattcttcttgtgataatattattgatcttttctacaataatacaatttgttgtcttgtcttcattgtttagtccacataacaaattagggccgagcattgggatatgcgagttgggtttgggtaaaagccgattaggtacggattctttgggtagaagagtttagaactcaatatattaaataaaaaatatatgttcggttttggttcgggtcctttcaggtttaggtcgctttgtatatagatttcagaacaacttaataaattatcggataaatacccatattttcgggtaaatactcgcatttcagagtaaaagtttgggtattcaagtaaaatattaagatatttttgggttcagattttcgagtataggagtttaggatccaataaaataaatctaaatttttattgtgtttagaatctaattttttgggttggttcggttcagatattctgatccaatttttttccccagccctagaacaaatcataagtgcataacgataatgagcagtaaggtacttagtagtttgcatatatggacgaaagatattatttgtatcaagtgtggtacaactatgggcccacgaatattcagtatccagttttgtacaagcccatgtgatccttgcaggccaattgacaattttaaatatatttatagcaacaatacaaatatatatttttcagtcaaatttgaaaattgcaaccgaaactagagagcagagtagagatcaacaactggatcaaaattttgaatttttataaaatctatagaattaagaatatataatatgttaaaactgaatttactccaaacctatattgtacaaagctgattagaattagtaatcattttagttccacatttctagcttttacgaggctattcggggcaactataactggccctatttggctcatcagtggcccattaaagatatatatgagttacattcataattttaaggaaaagaaatagttggtgtatgctcctcgtaatatcatcttatctataacaactacaagaagcttacattgctgctactaaaatacaaaattgttggaagtcatttttcaagatatcaaa

SEQ ID NO: 1205 - DNA, 3000 bp, Unknown
  misc_feature (1)..( 3000): cDNA_ID_2132303_gDNA_ID_1620371_Annot_ID_154987 3000 nt of promoter + ATG
gatttaccaactatattcccttaatttgatattttagtgttagcattagttttactcaatgttcaaaaaagtttataggtgctaagcaagcggtgatccaatgcctagtacctaaaacgcttaatcgggatttatacaatttttaggcggttaaagcgtttataacataaatactataaatataatattacatataataaacatataaaaatatctattagaaaaataaataaatatgttaatacataaacaaaacatttatttgatttatatcataccttatatgaacatttataactatatgtatagaaacaaaacttagttgaaaattgataaaatacactaaaaacaaaatctatatgattttaggtggtcaaagtgcatggttgtctagacgttttccgagaacctagcgcctaatggaggtttacgcgaccgcctaaatcggtttttaaagcacttcttttactacattgaattactctctttttctaataaacaacattgaattagtctttgcatactatatgctaaaactattccaaaagtaaataatcaacacaatgcacgtaaactttttaatattattctagcagtagcagtccatctaaaataaaagcagacgtttacatagaagatttgttcgtgttagttgtaaatatgcttgtcaatgcagattaagcaagtcttccggtaaacgtaaacttgacgtagtcatagataacttatataaagtatgctctagttttacctacgtcaaagcaaatttgcaaaaaattgtaattctatctatgatatatctagaagacaaagatataaatatgtcataaatctgctcatttcaacagtcttgcatggtctataacgtgggcagttgagttgtctaaatctgctaaaatatatttgtttggcttcttgtatataatttttgtatggcggttttgtagttactgacaagttgactaatgataatttatttgttttcaaaacaaaatgttattagacaaaacaagtgtttttaaaagcagtctatacactatacagttgcctaggtcccgattagacgtttagacgatgcatagatgaccgctttaatcgtctaaaattacataaattttgttttagacgatgcatagattggactacgttagtaatatacaactacaaataatttatttaagacctaaaataattgaaagaaaaaaccaaaaatgaggtaccacttgtaggagtatgtaatcttaactagtatgaacaatgagaagtcagacactcagaccttaaataattgaaagacaaagccaataatgaggtatcacttgtgggagtatgtcatctttactagtatgaacaatgagatatatatataatcgcagaaaaacatattggtgttattttcgttagcgactgctccgatctactaagatggtgtatgtgaatgtcggattcgcacactcaagtatttatttattttgtgagaaagattatttttgaagacaaaaattaaatgtaaaagctagagattaacactcaaatgactatagtatgatttagaaaaattgtgtgtgtgttagatagtcccaaacctctactacttatactaaaacatcgtatttacatgggagaccatagtttctccaagatgtataaatttggagaactcaccaatttcgaatatactgcttcgccctatattagctactataacaataacattgataacaaaattgctccgactgacgctggaaccaaagaagtcaatataaccatggtggaaaccggaccaaaaaccggtaatcgagatggcttaaccaatgttcctaaaccggatccacgacaacagattcctatttctccaaccaagtcttgtcactccgaaacaagtaataacagtacaacttctttcgcatttcccacgtaagtcgttctctaatcttccatgccaatttgctcggttaaaaccagactggttggactgaaaaatcggttttaattaattgagttgtgcttatgaggtctattggtttatttttaaaatcctttgtagattaggagagtaccaacaagagcgaaagacatcactaaacacgaagagtgaaagtggaaaaagagaactatcaagacttgactcgaagaccggattgtacccggatgattcgaaacagggcggtgctggtgctggtgctggtgctggtggttggctttcttgttgtctctgtttttcggtgaaaaattgaggttattactctttgtcatgtcaattatttaggtcatagctgtccaagagacgcgagacattagacaaggtaattaccgattgtatcctatatattcctatgtaacgaaattcagatactacgtaatcttaatgtgtcgatggaatgaaaaaataaagtattctgtaaatattttctatatattatttagcatatatacgctttataaattataaatttggtccctcccaaatacatgaaaacaatgtagtgataaaaaaaaaacaaattctgtatatatgctatttttataacataacaagcatttttcttagtcggttaaaatttcaagtgtttaatacttttatataattatgaacgtaagttataatttatgttttttttggtcagtccattattgattattccattcacactatatgcaacctatattcttcctatgaaacttttgatcgtgtgttaaataataatacaaattttatttcatctaataggtgggtggggactctctaattacgttctttgacatctactcatcaacatttggctaatctttctaaaggaattccatctaccggtcatttttgtttaaatgctctcttgtaactaaaagtccgtaccaaacttgtgtaatttcattaaacattaattatttagtccattccatgtcaaatatgacttatatgctcttgtcctataaattttaaagcaatgaggattcaccaagtatacatgcataacaaattaagagcgagcaataatg

SEQ ID NO: 1206 - DNA, 3000 bp, Unknown
  misc_feature (1)..( 3000): cDNA_ID_2132317_gDNA_ID_1620371_Annot_ID_154992 3000 nt of promoter + ATG
cattttgacaccttatccaaatgtgtacatattttggtagtttattttcagttatattttgaaaatatttttaatattgctatattaacaacaacgtctttgataatataaataagtaagagaaaatgacacatcatatttgcaatatgtttcatacctaaatttaatccgatatatattttctttcttattaaaataaaatgttaaataacgtaaatgatactaaaaatttatataaaaatatttatgtgaaagaaacaaaaacaaattataatagtacttttgcattactaaacagaaatatatattaaaaattaataacaacaaacctcatttaaatgattactaaaccaaaaaataaatttaaaaaatcgataacaacaaacccccgcgtaataggggttaataaactagtatgaaccaataaaacttcaccaatgagaagcatattaaagtctcatcatgtgatttcccaaaaatgtataactctcgaacatgaaactacaaaaaaatagatattaactgaaacccttttaaaatgaattctatgtggtttttttctttcgagaaaaacttaatctgtcattttatatgtccatatataatataccaattcatacataaaaacaaaaatagttaaacaaaatatagatacttttttttatcaagcaagatgttctaaacttaaatatgtagtttttctaggtttagaaccaaccgttaatagtagttatttgttaaaaccgttaatatataatacttgaccttgaccatacgtaaatcatttcccccaaagatttcaaactagaactagaagtacaaggttcaacttccaaaaggaacgaccaacgtaaaataagttcaagatttgtatgtaactagttgaaaaaataagaacaactaaatatagaaatagaagatttaagagagttaatgatgagattaaaatcgcagaaacactttctgatgcattattataataacagctccgagttaggctcccagccattgaatttttcaaaatttcttacaaaccctttttttttgttataacttataacagaagtctaaattgtttttcctaattcataaaaatctctaatggagttaagttagtttttattaatatatctaaaaagtagtcattattaatgaccacaaggatttggttataacttataccagaaatccacaaagtttttcggttttaaaaattataactaactctctaatggagattagttagtttaattacgtttgttatcaaacgaaaaataatcattattaatgaggacacagctttgatcaattttcctcacatcattttttaaaagaagaaattgttcttttcaaccttttggctcttgaagaactctcagcttgaacttgatcaaaggtgatgagagctcttctattggttacaaatgttccatttgttgaagaaatctgattacataaattgattgatatctcatatttttttctggagacaggtacacaaatggaccaggaaactaaaccaggctatgaaccggatcggattccacattcggtttttgcaacctcggtaactccaaaacaagaatggagtatccaatcgaacgagtctttgttcagtattcacatgggagaccatagtttctccaagatgtataaatctggagaactcaccaatttcgaatatactgcttcgccctatattagctactataacaataacattgataacaaaattgctccgactgacgctggaaccaaagaagtcaatataaccatggtggaaaccggaccaaaaaccggtaatcgagatggcttaaccaatgttcctaaaccggatccacgacaacagattcctatttctccaaccaagtcttgtcactccgaaacaagtaataacagtacaacttctttcgcatttcccacgtaagtcgttctctaatcttccatgccaatttgctcggttaaaaccagactggttggactgaaaaatcggttttaattaattgagttgtgcttatgaggtctattggtttatttttaaaatcctttgtagattaggagagtaccaacaagagcgaaagacatcactaaacacgaagagtgaaagtggaaaaagagaactatcaagacttgactcgaagaccggattgtacccggatgattcgaaacagggcggtgctggtgctggtgctggtggttggctttcttgttgtctctgtttttcggtgaaaaattgaggttattactctttgtcatgtcaattatttaggtcatagctgtccaagagacgcgagacattagacaaggtaattaccgattgtatcctatatattcctatgtaacgaaattcagatactacgtaatcttaatgtgtcgatggaatgaaaaaataaagtattctgtaaatattttctatatattatttagcatatatacgctttataaattataaatttggtccctcccaaatacatgaaaacaatgtagtgataaaaaaaaaacaaattctgtatatatgctatttttataacataacaagcatttttcttagtcggttaaaatttcaagtgtttaatacttttatataattatgaacgtaagttataatctatgttttttttggtcagtccattattgattattccattcacactatatgcaacctatattcttcctatgaaacttttgatcgtgtgttaaataataatacaaatttgatttcatctaataggtgggtggggactctctaattacgttctttgacatctactcatcaacatttggctaatctttctaaaggaattccatctaccggtcatttttgtttaaatgctctcttgtaactaaaagtccgtaccaaacttgtgtaatttcattaaacattaattatttagtccattccatgtcaaatatgacttctatgctcttgtcctataaattttaaagcaatgaggattcaccaagtatacatgcataacaaattaagagcgagcaataatg

SEQ ID NO: 1207 - DNA, 3000 bp, Unknown
  misc_feature (1)..( 3000): cDNA_ID_2132313_gDNA_ID_1620371_Annot_ID_154991 3000 nt of promoter + ATG
cattgaaacacttaattaaaggaatacactactatgaaatatttatgtaacaaaataaaacctggattatgtaccaagtttctatattataatatatcaacttttcccatatagattttagtcttacattttactaattatgtcttttagagttattttactttattttttatttttggggtgaagaactgcaagaaaagtctttcacagttggaaaagctcctcgttaactttataatataaggtttggataaaacaatctgtaagaaataactttcacactttcatagttgaaaagatacctagttaaattctgatatattttgttggatataaaaaacttcaaaattgatgtacatattcaaagtatcatcttgatggaagcatgagttgtagaaagcttgcgtgtcttgttgaaagaagataaacacaaattgaatcacggtttcttgttttcttgatgttgcaattacttgtaatagttcaaaagtgggatattcaccaagtagttattgctttccacgtgaattacttttcctatattgatcttttttatattattattcctatattgatttattcttgcatttttgtaagagaaaataatcctaaacaggcaaatttaaatagctaaaatgatcaacttaaacaatttcttattgtttaagtattcgaagtctacttttcatacgatagaagtgtctactttagttatagattagttactgatctacctgtctatgctatgaatttgctattgagcaagtctaccaattattatgtaaaccaaccatttcgtacgtcaaattttgtagttattaaaatcttgttttctttttcagtaataatggatgaaatattttctgtaattcatgaaaacttctaaatattttaattattttcacaattaaatagttagtgaaataatttaatgaatggacaaagtttatcagaggttatgaatattaaagctgtatactcgtgctactaacaaaaattctatactgtagaaggatatagaagatccacaagttaatatgaagatgttgtatatttattatattgatatgtacagatttagttctatcttagattaggaaaccattttattatgtaaacatatgtaacccaaagcttatcattataagagtcaataacatattcttccaatctctatctctcatcaagctgtacatggtataagaaccacaatgatctaacgatcggatccattcctcgatctaagccaagagctctttatttttatttttttttgtgtttaagtcaagtgcttccaagttccaacattcaaattcttcatgaacctctgaatctaagcaaaaaaaatgcttagtgcttgatttgaaaaatttgcaaatttgcaaaatatgtgttttaaaagttgctctaaaaatggtctcagtcgtaaggttgcatgttttttttcctcactttccaaagattgaaagataaagtaggtgaaaaattgtacgacgtgttgtctaagagcagcaaaaactactcaatcggataaaattacaagaataatcgagacatgtaattgtaatctagtggtttgtgtgtgttttgtttaaaccattcaagttcaaatattgataaacaaaattttatatgttgttaaagtattatagacaaaattacaaggataaaatactagtcaacgtaacttaatatcaagtcttttttaaataatttttcaaatcaagtctttatgatgtcgcttttcatggatacctaatcatgtctttattttaatgttgctagttgctacaaaagataaaactactcaaattaaaaaacgtttagtgtaaacaagccataaaacagaaaaactaactttcgtataaatgcatcaatttactactaaaactacagtttttttgtttttgaacaaagactaaaactccatctaaaaatcataaaatataactattgatgaaggggaaagtaaaaagaaaaaacacacttttacttgtcaaaaagaaaaaaaaactttcatcatgaaataataactggaatctatttggggtacacaaacacacttcaatccttcaaaacaaacccaaagtcatatcccaagtgactcatcatgcgagaaatatgatatagacagtcttattattactttcccccgaaatcatagtatcaatttgattgagagttttataaagcatgtcttgttgaaaaaaagatacacacaaagtgaaatggttgatctctacaaggccacatacatgctagaaatttggtcactacttttgtctttctggcagtggttagagactgggatatttaccaactaaatgatgtcttttgcttaatttgatattttagttttaacgtacttttcctgatttgaattagtcattacgttttataagagataagtattattccaaaaagaccactgaattttgaaaataaccaagatcaatgcacctaatgaatttcctacccaaacaaccagttttgaaatattctcactataccattgaatttaaaatacaagcaggattttgaaaatttacatagaagacttgttcgtgtttgttgtaaatttgcttatcaagacagattaagcaagtctctggttaattgacgtaggaatagataacttacataagttatatcagttttttttttttggtcgtcaagttatagcagatttgcaaagtatatatgttgtaaatatataatctaagatatattgggctatgaggcctctcccgagcccacttagattgtatagctacactaggttaaatcatgttgttgtatataaggcattgcctctcttacgtatcaacatgaaacgtctttttacatcttcatctcctttttgacatggtatcagagcaaaacctaaactactaaagggtttttgtttcttgattctgtgatctgtcaattctgctgcaagttatagttgtttctaaaattcgtttgtttccacttctttgacaaacttttctcacgatg

SEQ ID NO: 1208 - DNA, 3000 bp, Unknown
  misc_feature (1)..( 3000): cDNA_ID_2131758_gDNA_ID_1620372_Annot_ID_155022 3000 nt of promoter + ATG
tgacaaaaaaaaaaaaaataaaaaaaaaataaaaaaaaaaaaaaaaataagcataggatataacatcaataaaggggcagaaatcaaaagacaacaatttttttttttttaaagagtcaaaaaaccagtacacataattggacatttatgacaaaattgttttgggacatttataactactaatagtttttgctaaggtattcgtattatgaggttaaactaaaataaagatgatgttactgattttttttttttaattaatcctaactttgattttaagataagttaaaaaatatgctatatatccgaatatgagaaaaatccaagagaataattagtttactatgctgctggcaatttttttttagtttactatgttgctagtgcttgctaccacacttgtacgtgttcaaggcgtcgtggatatattatacaccatgaaatctaaggttaggtgttttttgctaaatcgttacgtcattgtttcttaaaaataagaattaaaggttaagttacgtctgtttattttgtgtgtgtttgtttataatttgtttatataaaagaaattggaaagataaatgagcaaggtgatttcgatcattagtttcagtccatgtctttgtctctatggtcggccatcggccttagaggcgtgaaagtcttaaacaataatagaacttcattcggaaaaaagaaaaaataacccttaatatttaaatgtaatttagatcatacagtataaataacttcttataccaaactaaaatgaagatggtagctgattaacgaatttacatgcggaagacttaaataatcgatagattagtttatgaaaagacttgcataatcgatagattagtttatgaaaagacttacataatcgatagattagtttatgaaaagacttgcataattggtagatgcaaagttataagaaaactgataaatctgaaacgaggcttgagttcatcaaaatttcctgtgacagcgattattttaatgttactaagacgattgggttgttgggattgttgtagataaaccaggcaataacataatctaccaataacaatgtattgtatttccttttagttgagaaattaaatatttgaccacattatctgaattttcttgtcgtcttaataactaattatcattattcatttttggcaggatctttttttctttgttaaagggtctacttttttttttgataaagcagtcttttatttttaaaacatgcatcacaaaatttaccttcatgaatcaattccctgtgagacaatgatatgatttaaagtttacatgtaaaatattctataccgtggaaaaacactcatttcattgttatataacgaaaaatatgaattatatggacgcaaaataactatttactagatatatcgatgttatagaaataatattatattaaaaaaaacgatatatacggtttagtgttagtgtaagtttatatttttggcacttgttgaaaacgttatgataacttgtttattatcaacctaacatgttttatacggctataccgcataaagtgtagaattaattttacctctttatatgacacaataatatttaacatgtaacaagagcaaggggttacttgtcaaatacgcctatgcactaaacaatgataaattggtcattctcctaatttaaaaagtcactttatcattcttctctaataccaaacctttctatataatcactcttaaaccggccgataacttgttttccaaataatctaaaacttatactaaccaaatttaactaaaatagtaataatttcttacaaatatcaaatcaaaaaatttcaaatccctgacttgtcaaatcaaccatgtttcggactgagaccaaagtctctgcaattcaatgacacatgtatattatatagtattgtttcattaatcacacatgtattttgaccgttaacatgccttgttctttacgtatgttgcactgcaacaacgctttgtcgttaatttacctaacttagtaaaaacaaaatacatgtcttagattatcagttattcaaacttgtcgttatgtaattgttattgaagtaaacagaaactctggtgcgatgcaggacgttactcaaactgagtcacttcgatcggatgtcttaattcaagcaggacaatctagctttgctactgaaatttgatgacacgatgatatatatctatttccaaccgatgaagcacactggagatccgtttggatttttattgtttttacttttttacactatcgtaatcattctttacatatttcctttttattttctccttagaagagaaattatttgtatacaaaacttagaaggctaaataagcatatttattcagtataatcactgtaaccacaccttattcaataaaattcttattttgaatctgtctatttatgtatatgatattgctatagtgatgacagatgagtaaacattaaacatacacgcaacatagctatcttgaaaactgtttgatgatttgagacaaagagaccaaaacaaatggaaccttcttcacatatctatcacacgtcctcatacaccacccatattctgccatgtgttctcactccatcaatattaattatttttagggttaatagagatggtttagtctcatgctttttgtttattactttttttctttggtcagagctttttgtttgttagtaaggactttaaagatagagagtaaaaattactcttttgttttgtcaacataataagcagtttttttctacttcattttgtctccgtatttcatcaagaaaagacacgtatttagatagatgatggaagggcggtaccaaatctccttgacttgactttgcatgtaccatatatatatttgtatatacataaatcataattcatgaagaaaccaaattttctctgtaatcaagttctcaaagcttattagcttctctctctagttctctcacatataacatttgaaaaagatg

SEQ ID NO: 1209 - DNA, 3000 bp, Unknown
  misc_feature (1)..( 3000): cDNA_ID_3061152_gDNA_ID_1620372_Annot_ID_155029 3000 nt of promoter + ATG
caccaagatcattttatattaattgcgcaatatttgcatacccttgagatcggcgagtattgacgtgaactaatcattgtatttttaattttgcttgataaaagatttacactctaatcattgttaattttgattgaaattaaattatgtattaacaatcaactatagtctacataacaatgtgtttgatagagtgataagactcgccagcggaatcaaagtttatactgattcatgaaaagttaaaacttttggataaccaatcatctacaagaatttttaaataaccaaataatcttagtctagtctagtgtagctctagttgtcatcatcctacacgtacgtggttttaggtcataaattgatttttaattgttaatcattgttaattttttctactagacgtatattttctttcttttggttatttactagattttgacttgaagttgaagctccctgattaaataataataataacgatcatattatctctacctaaaaacttctctaatttttgtagttggatctacttgacctcacatcaaaattagctacaaaactatgtcgcttgcaattaaaagaacacatagtgagaattgatcataatactttaaaagtactgtgactatttggtattgtcaatatagtgtccgaccttaattattaatattctaatttattttccaatcatgtctctagctacaacattcacagttccactatgcattttccatcttttatgtctaactaaattgtaagaaattatatagctacaaattaattagagtctactttcttcataaaggctaacatatatctgattttaaatgtcgagcacatcaaaacaaacaattcgtggcatgaacaaattaaaaggttgaccagttaatgtattagtattgttttgttgtcgattggtctcttaactttgttaagctccaaatggaaaaaaactgcgacaccttatttgttcagccgggttgtattgttgactcgctcttacgctttttagctaattaagtgctcttttatttgctagattagcggaagccacgtttactcttttcattttctatttccattactccccaataatttcatgataaaactcaaattaaaaaactcgtgtatccgtcacctattatctatagtattttttaaaaaatctatttacggttgaattgagtttttttttttggaaggtctctattcggtcgtcgaagtaaagaatgataaggcagttagcagttctatttcgaagaaagatcggatttgtggataagctatagttaatgagttatatatgataaatcgacttgttatggatttgtggatagctataccagccactaaaatataactgttaagtgacaattatatagcatgttaatctatatagaacatatgtaatagattcttgcaagaacaaagattttcaatttttaccaaactacaaggtcaacttctacataacatatcggataaacggataaaagtatatatccaaaccctactacaaaggaaggggtgagacttgagagtttgtggaaaagaattgaaaggggggtagttggaactgagacattaacgtgagcgccttgattgagagatattatcgtcattttcgatcaaccaaagccccttaacgaccagtcttccctcctccaacgtgtcacgttctataacaaatactttttgactttggccatttgtggatcttttttaatattgaggcaacgtctattcatgttcactaaattagtacatttgtttttattctcaaattttaaataaccttagagctagtttgaactttgttgacccaaataaaataaaagatataacgacctttaaaatataaaattaattaaagtaagtggagacacacatatttgattattttgagcaaaatcaggagtttagtgttagaaaatagttagattaacatgctatatagataaatgaaatgatataaaaactaaccaatgggatgatttactacctgaagattttatgacttgtataaagaaaaaacattaaagtgagtatttacttcctagttaataatttgaaattccaccttaatggtaattttctaaaaacacaggggcaaattatagaacgttaatgatgcatataataacaccttttatttttgtgaccaacgttattttcacaaatatataaaaaataattttgaaaatttgagtcattaatataattcagattcggacccattttttgtctgaacaaagagaaaaaaaaaaagacaaaaaatttgaatttttgttgttggtcgaagagaaagaagggaagaagaacagagaggattattcattactcttttatcttcttcttctttcccaaaaagttgcatcttttcgagaaaacaaatccgcattaatctcctcaggagaagaagaaaatcttagggttttaaaatttccccaggaaaaaatctgtttttttctttcttcctctcctgttttccctctgacaaactaacctgagaagcagagactctctgtctttgtctcttccattgacctcgtaagtttcgctctccctctttccttttcaattcattttctcttcttcgtttctgggtttgtgtaaagatcaggtttttgttgatttctcgtttaagtcagaatttttgtttgttctaaagtttcaatttttatttccttcttcaaatccattcatgagaaatgtatgaggagcctcgagattgttttacaaatgttgattcgctgaatttctgatttttagtttttttttttctttcccaagaagctctttctctggttccgaggaagtaatgcatggttaacgaggcgtgtgatttgagagattaggttttatggaagcttggattgcgtgaaatgcttctcaattaaagactcagcacaagagatttctgatttatttctggtgttgggtttttagaaagttttcaactttgattcagtttttgaggtctgtgattgaggaatg

SEQ ID NO: 1210 - DNA, 3000 bp, Unknown
  misc_feature (1)..( 3000): cDNA_ID_2131812_gDNA_ID_1620372_Annot_ID_155037 3000 nt of promoter + ATG
tatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataaagtctcatctcaaatgggaaagaacaaagtcatgggtgcctgaagatgatgataaacatcagctagaagaatattggggtcgtgattattatcaatgtatctttgttttttgttttttttcagttttctatgcattatttagtatttcgctttcagtttagaggtatcttatagctattgaagtttttgttctcatttttttcattcaattgtttttttttttctctttttgtttccttcttgtcttataaatgttctcttttcctatttgtcaatctttgattacttcatgaagccttttatttttcaatgcctaaatctcatgatttttgtaaagatttctgcaagtttctggtctaattatttgtaagcgaatttgatctttcataatttaaagagattctgagttttgcttgaaatcctttgttaacgagacattatatctattcaacttataatatattagtctttccgatcttattattagtgttgtaatctcccaaatttgtttaacacatgtcatcatctttcaggattttttaaccaaaaagataattatcttttttatatatatcaatgttaatgaatatcgtctagttattgaacctatatacataatatgtaatttaagaaaccatatttagaaaaatggaatataatctagagtcttgtataataaaaggttgtcctactcacaacttacagtttccagtttgtgataagagaaggttttgtttaaaaaaaaagaagagaaggttaacatacttagaaaaattgggtaacaaaagatttgcaaaactggaattttaaatatttcggaaagtatctgagtgatgcagaattgaaaatttcgggttctctatccttgcaacgactatcgtctgtatctagaaatgaatggatttcacttcatggcctagggttacatttcccagcgttattttgatttgggtttgtgagatgtctcatataaaatatgatggaacattaattattaaaaaattgttttgtgcaaataaaactttaaagtcgtttttacaatggataaatacctagctagtaaaccgtattatgtgtggtgaactggtgataagtcattcgttatggataaataatgtatgttgaaaatatatttgtccaatagtttcatagactaattaaagaaaaatgtggcgttatagacttatagtcaactattcatgttatatcatctaaatatatatgactgaaaatgcatttttaagaatatcaaaactggtattctgtaaagttcatgcaccatcagtatttaaaattgtattcattttgggtatttcctagtaattagtaagtatatcgaaagtaaataaaaaggaaaataaacaaaagaaaacatagaaagtaagaaactgaaaacaacataattaaggaaacaaaacacaatttctatctatcattaagtcaggataagaaaaaacaagaataagtagtaaagctgactaagacatagctggagtttgtatgtacaatgactcaaaatttaacattctatatacaatggtgtgtttccctttctttgtatttgcaattatcatatatatatatattagagaaaataagtgaaaaataacatcattccatataatagaaaatataatcttgtattacttagcttattaatacatttttttacatatcaattaatattttttacatattaattgctatatgaaataacatgaagttaccagtttgcaacggtcgatataacgaactgaagcgtaacatttttaaaaaaattgaaatgagttagtgttttttttaatttacttttacacataatgacgtatactataacaattatagatatattttagctaagtagataaattttagattatacaaagccagttggtatgcacacaaaattattattttggaagacaaaatgtataagatcaccatggttagaaaaacaaccatattttctatctttcattggagttatatataacacatcatgtaaacaaaatctagtcaaatttgaaatatattaattaaattggtgtatttttaacatatgaagtatcattttagaaaacagaaagaacaaagtcaagataactagagacacacgtacttgaaatcatgagtaaataaatattagattatacaaagccagttggtacataatgcacaccaaattttaatttggaagacaatgtataaatcaacatggttagaaaaacaaccataacttttaaaactatggataattattcatagtagttatataacacataacttcatataaacaaaatctagtcaaatttgaaatatattaattaaattggtgtatatttaagaaagaaaaaaaaaagtcaagattgttaagaggcacaactatttcttttaaacaaaaaacaatgaattcaaagtagatttactgttacaattaatgctatttgctcttggagattttataccttagcgagtgcaacacagtaattaaatctctcaatatataccatacgtctccggagagaagaaatcactcacttctaattctcatcaaagttttacaaaaaaa

SEQ ID NO: 1211 - DNA, 3000 bp, Unknown
  misc_feature (1)..( 3000): cDNA_ID_2131826_gDNA_ID_1620372_Annot_ID_155040 3000 nt of promoter + ATG
ctcttggtccatccaagtccacaggaggcagcaacaatagcactaataacaacactaactcatcgttccatgggaatctaatgactcccgtgggtccttgtgtgcctagatacagtttggttgctggaaaccaggttgattcaagcaatatacatgttcctgcttatccaaccaccgatctttgttatgatttttttgctttacaagagcatggttcgggctctagtcactcaaaaagtctcatctcaaaggggaaaaacaaagtcatggtgcctgaagatgatgaggatatcgggatgataaggtggttgcccaagaaaaaaagatcaagaggagagtagtaatttatctatgtccctttgtgtttttcagttttctgttttctattgaggcctatgttcacctcttctttttttcatgcaattgtttttctctttttgtttctttgttgtctttttgatgattttgatgtttcgattaattcatcaaatccctttttcaattcctacatttcatgattgttcttaaatttttgagattttcagaagtcattttcgtaagcgaacttaattttttcaaaggttagagagaatctgcaatttgcttaaaaacattagttaaagagacattatctcttcattgacaatttgttagccttggaaaattgaaaaaaaaaaataagaggcagaaagaaggtctatctgatcttctattgttgtaattgtaacctcacaaaaaaaaaaaaaaaaaaaaaaaaaaaaaaaaaaaaaagaggcagtggtttccttttgacgattagggtttcgctggttccagtttgcccggttttcttccttgacccagatccgatttactagattgtattacaaatgtaatcatctttcaggatatttgtaacaaaaagatacaactgttatccaataaaactgttattttttttatgtattaatataatcttgtaatcctagtaagaatttataaaacttaaaaacctgtaaggctgtaactgatgtttgcatctccattctccaaagatcttttctattgaacaaaaatcaaaactatttttgtttctcttgttcaagagaaatctccttttaaagataatttcctgaagacatttattccatagtatgaagatcgaggtctagaagttgatagtattgaaaattgtctattggatcaactggattgttttctcaaacaaatgaaagtcaatattgaaaaacacaagtgctttttcttccaagcaggagattgataattttgcatttggagcttgtgcagatcatttatatattaatttaagttcgtgaagatttaggtttatggttgtagatacctcacacaaagcttacatagtagttacataggaataataccgaacatcgtcgcttcatttgagatgttgggttgatagacccaacaataaaatcatcctaaaagaagtaagctacgtacttattatttataaaggcttgtcctcctcccttccttaaagccaaagccaactctttaagtctcgctctcactgcttctggcgaaagctcaagttgaggatgacctctcagaaaatcatcgcttccatttccatattcctcagattcaatcttcttaaagcacatatacaatagcaaaacggaatctagaattttatattataaaaatgttgccacgatttttaccaatatcttattcaatgtcgaccaaattaactattgaaaccctaatatcactgcttttatggaagtttgtttttcttgttcaatcatcgtggtctagaagttgatagcattgagagttgctatatgatgaaactttatagtttttgctagacaatgagagtcaatattgaatacatgaggaatatgaatacttctcaacttgcaaatttgtatttttacttcgcaaattaacaatcttttatgaaattttaaacaagttttttgaaaacatcaacatagatggaaaatctgactaggaatttcacagaaatatgtaaaatcgatttctaagttcttgttgttagttttagatgttatatattaatgttcaggagataacgtcatcaagcggggatagctcagttgggagagcgtcagactgaagatctgaaggtcgcgtgttcgatccacgctcaccgcatttttctttttgtttttgaaattttatttctcgttgcaaaaccaaacgacgccgtataaatataaaagaacaaattgacttggagcgacgttgcttcgttagaacgttaggtcgcacgtgtaattgacttctctaagaatcaaattcattgggtttcagaaaaaaaaagttataaactttccatagagaataatacaaggtcgaaaaatgacaaattcttaattctttacatgaaatttaatatttctgaaattataatacttggttcacgtataaaatcatccatagataagtaataacaccgtccatgcatgaaccaatattataagattctaacaggtaacagattacatataacacatgctcaacaaaatggcatagtcatatttatgaggaccgagaaatgtggatcactctgctttctttgtaacaatttagaacttcgttcatacatgatacatatcgaaatctacaatgtctataattttttttttcttgacatatatatgtatttaccgttgtataaaacattaaatatctggatttatgatacagtttgttgtcattacaaaattaatcttaaaacgataccttaaactggagaaatagtcatactttaattttactttgaaacgaagtcaacgaaggttaagtaaaattgttaatggtgtcaccgcgaagttcgtccaaaggcacacagtctccaacatgtatctcaataattaattaacataatagcccctttattaagcaaggatttgacttttcaccactataaattcacaatcaacaattctcattatcatcaaaacaaaccaactttccttctctaatcaaaacaagaaagacacaaag

SEQ ID NO: 1212 - DNA, 3000 bp, Unknown
  misc_feature (1)..( 3000): cDNA_ID_3061146_gDNA_ID_1620372_Annot_ID_155031 3000 nt of promoter + ATG
gataatatgatcgttattattattatttaatcagggagcttcaacttcaagtcaaaatctagtaaataaccaaaagaaagaaaatatacgtctagtagaaaaaattaacaatgattaacaattaaaaatcaatttatgacctaaaaccacgtacgtgtaggatgatgacaactagagctacactagactagactaagattatttggttatttaaaaattcttgtagatgattggttatccaaaagttttaacttttcatgaatcagtataaactttgattccgctggcgagtcttatcactctatcaaacacattgttatgtagactatagttgattgttaatacataatttaatttcaatcaaaattaacaatgattagagtgtaaatcttttatcaagcaaaattaaaaatacaatgattagttcacgtcaatactcgccgatctcaagggtatgcaaatattgcgcaattaatataaaatgatcttggtgcgggtaataattctacacacacacacccgtaagtattttcataagatcatttcataaacacaatattgaatttttttaaaacatgtctacattcaatgtttacttttgatttggagtattattttcgttaagttaaagtagactacttttgatgtttgcggtccaattcattaaaaaagacaatgatgagatgtgtttgcttaaggtacgtgattatgaatgtacataataatgctcgtgatttttaatgtggcatgtacaaatttgcatcttcttattatcagccttcttacgtccaaacacattaaagatcactatattatgcttgtgttgtaatacattcaatagttgtctatttataacatcagcggctgtaaattgtaatcggcaattgagttactaccacttcgctaaagttattgttctgatcataacaatattttcatttttaatttcgattggtaattttttttttttttttttaacctgagtgaccaaaactcagattaaccttccaaacttcgttaaaaaaaaaaaaaaaaaaacttccaaaattcatagaaatttggatttttatttgaaaacattgactactagtctaaaatgtttgaattagcagtacaaaatgctctaaatttatttaaaaaggacattcaactttttttttttaaatcactggaccactactgattaatttccatcgctatatagatgccttttttattattactaagaaattttttaaactagaacattttcttaccaactaccgatgacaacaaatagatatgcatctttttataagcgcatttcgatatttatgcaaggcaagttaaactttaaaaaaaaatattttaacagaaaagtcaaactcctaatctttttttctactccttaacccctttaaaatttatatacccctacttaattaaatggccatatacaatacaaaatattacaccaaatcaaacttttttatatattcaaatttcaataatgtaagatttctctagttctaactatagacaattatatactttttgtttattttccttaaaaatgtagacatgcaatgcgaggagttaaatgctttgcatcattgagcatgatggaaagggtaatatcttaatttattaaaatttctgacatatccacaagggaatgtccccatttacactcatgtctcttcatgtctatcccaattcgtttgtcctaaagtctctgacattcttcttcttttaccttttctcttaaaaaaacatgcttctgtcttttttcttgttttgtggttgtagtggcgcttgtattcgaagtacgagagaaaacgtaattcgccagttcgcctaattatcaaatttatcagtttgggtttaaactttgaattgttctggacttgttgtaaccgcatatgtgatatatgtgcatagaggacacatcaacaggacttgaatcaacgtcttaaagattgatctactacgctaattaacagagaaaacgacgaaaaatgtttgaaattttagttttatcacacagttaaagttatcagtaatattcccaagcagaccaatcatttcaaagagtgaatggttccaaaataaaatcatattctaactggaattatggattaagttatatatacgcatcatcatatgctcattaaaattttggtaaagctattatcgcatgcgagttcaagattttagcgatagttacgttgctagctcaataaaaagaaattcgttggatctttatatcaaataaatcacgattattgaactttatgaattgaagcaacgtctgaataaggaagaaacatgtaattgtagtctataccgttccatttaaataatttaaatgttggataagatactttctttaaatccatatgcatatcttaaaattgtccccacgaaccggtgtcgaccacaacttttgattttaatacgtgtgagtgaatgttggctagaaagtataaaacctaaaagtgggccaaagtatcttttacaaaattgggtttgttgaaaagtttggtaaaatcaagctaaatataagatgacaactgagtttatgcttttaaaatttcacactactcattagcccactcaacattactcattgtgcgatgtgatattaattacaatcagtagtcaaatttaaccccccaaaaaaatatcaacgcattttctaatttcttcttatttttggtagtttaatgggcttgtaaacataagcttagtaccatgtaaacaaccacaattatgctaaagattgttgctgatcgattagccctactattctaaatctttgtatatacacaatttgttggttatcagattggatccatagtgactttgtacactccaatcattaatataagttaatgggcctttataggctttaaaaaatcagcccattagtatatatcattaaataataatggaaaattagaaaagactgtgaagcgagaggaccgttaagacgacggacgcttatctggaaggagagtc

SEQ ID NO: 1213 - DNA, 3000 bp, Unknown
  misc_feature (1)..( 3000): cDNA_ID_3409203_gDNA_ID_1620372_Annot_ID_155028 3000 nt of promoter + ATG
atgacaaagtcccaaacacttacaggttgcaaatccccaggacattttgatattttccaaggcttctaagaagggtcggagcgaaggtaagggcattggtgtactagtaatttatacaattttgtttggattagattgatgcacgtgcttttactctaacttgtaatagcttatctggcaaaaattacggttaagtagtgtatctgagatatagtaatgtagaacaatatgggcctatgataacctcctttgttgttttattgtcggtattataattctcgtcatatatatcatgactactaactttctgttgtgtggagcttgatattgatgtattgagtgttaattttctttctgttccacttttcttgttatagttcatgtttcttcgtgtgtaacctatagcatcaaaattttgcgaatcttatggattatctctagttagtatatattggaaatttgccattttgataatttttttgtctagtgaattgaatggcaatgatgcatgtcctgatggttgtccagtgatccagttatgatatatttcaatcttccatttcacagccaacatcgatgattctgagcggcttcgtccagaagaactgaaccagcagaatatagaagctttagtagctgaaagcaacctggtacatcctgcaaccttctttccttatgattgtgttattatcgtcaacccctgtagaactttgccacagaatgatatagacttgggtagttaccaaatgggcatgagtacactatgggatgatcattctattttcttccgcagaaaatggagatccttccagttaacgatctggatgttgctcttcacaattttgtgaacaaggatgataaactagccttctactcatgcgttcagtacaatcttcaagagactcgtgtatgtactattttttacttcaccattcaatacaaagttctgcataggatattatttttatttcgtagcacgtccttgttattgcttttatgatttatctcttccctctttttgtacagggtaaacttgcaaaggattcagatgccaagaaatttgaggaagatgacttgattcttaaagtgggagagtgcttagaggcaagaagatatagattcagttagttctgccgcagattatgagaaccagcagaatattgatctcacttgcattattgttcgtgcaggaacgcttgaaagataggtccactcgacccactggttcctcacagtttttatccactggattgacttcagaggtttaaattctcttttttagattttccttgcctctgtccttccgttggtttctcacagtgctattttctacctgagattggtacagaatttgacaaaaggaagcagtggcatcgcgaatgcttcgttcagtgatgatgaagacacaactcagatgtctggtttagctcctcccactagaggacgaagaggttcatccactgctaatacaactcgtggtagagctaaagccccaaccagaggacgaggccgtggtaaggcctcaagtgcgatgaagcaaaccactcttgatagttctcttggtttccgccagtctcaaaggtaactttttgacagcacatttaaccagtttagggtaggattcacggacgtgcaaggaaatgattggcatcactagctagctaatgttatgtccctaatttgtctttcatagatctgcttcggctgctgcttcagctgccttcaaaagtgcttccaccattggagaagatgatgtagattctccttcaagcgaagaagtcgagcctgaagattttaacaaacctgacagcagttcggtatggactattccttacactgttattcatttgttcactaccataagaaagcccatgtaaaaacttgacaacatataacttttggcattcttatttctctatttgaagtaaattttgcgtttttacttttcctgattcttgtttgatatccactaaaggaggacgatgagagcactaaaggcaaaggacgtaaaagaccagctactactaagagaggcagaggtagaggttctgggacttcaaaacgtggtagaaaaaacgaaagctcttcttcacttaataggctactcagtagcaaagacgatgacgaggacgaagatgatgaagacagagaaaagaagcttaacaaatctcagcctcgggtttgttaatcacatctattttcccttctttcgctgcttattagcaggttttagtaagttgttgttaaccatttgagatcaaagctcacttaatagtacaatttgaatatgcaggttacaaggaactatggagctctaagaagataaatacatatcaaaccccaatctctgacatcacaacgaagcttcatttttctgttattttctagcgacctctcaagcggaacaacttctgaagaagagaaattagtactaacaagagttctgtgagatgatgtacagagaattttgtagtgtttttttttcttgctctttttaaggttacgttgttgatgaatgaggcaatatgattaacgtcagtaagaagtctaaaactgtagtaaccaacaagttacttagccaataatttaatccctaattttacatttgaaattcaaataatttgggacaatctaattaatattggaaattcgaataatttaactaatattacattttacatctaaatcatagtttataggaaaaaaaataaaacattataaaataaagagtaaaaaacttaaatgggcaaccagaaaagaaatatggataaaaaagagatggaattagagatacttcaaatccaaagctgtttcctgattggctaatcccaacatctcactctctatctatatcccatctctgattctcccacctctcttctcatccacaaaatactaacataaaagtcaaagtccctgagaccaatactttcaccaaacagcaaaacaagaagaacaacaacactaagcaaaaaagaaaagctcaagccgagagagaca

SEQ ID NO: 1214 - DNA, 3000 bp, Unknown
  misc_feature (1)..( 3000): cDNA_ID_2131772_gDNA_ID_1620372_Annot_ID_155025 3000 nt of promoter + ATG
gtggcaatcagttgcaacaagtactcgaagtgtatcactaaaatcctccctgtcaagttttacaatcatacactgacactcataagtttttcaaaaaacaaaatgaaaaaaaaaaattgttcatttcaataaagctttagacatctagttttcctatagtcagtatccattaatacacagctggcgcagcatatatatcagagttaaacatgtataaatatatccatgaaagagtgtaaagacaaatccaaaagctgacctagacatgatgccaagtgtttgcagctcagtaagtaaacctgaaaaagaccaaaacgaaaaatttacatgatctcatactaagaaaagtaatctcagataagaatcaagcacatatctttgattgaatccattcagcctttattactaaaacatactgaaaaaaagctaaaaccctaaagaatgtggatttgataaaccaaaatcgtcatttagttcctaaaaacaacagaaatcaggtctgaaattgattctatgaatagaaaacctaagtaacaaaatcaaaacccgaggatcaaaatcactcggatttgaaagcgaaaatgtacttcaaagttggctagaaaattagaaattaaacagtttcaatactataaaatgaagctccactaaaggatttctcctaaatccgaaagccactaaccaaatttaatcactaggactgtttcgagaaatttctttagttctcgcattttctcagctgtgtggaaaatagaaccctaacctggtattcaaacggattaaagtgaaccgacggagctccggtgaccggaaatagagagaatccgacggaggtaagcgagactatgattaggagagacaggcgcggggaatttcaaagcgagaggcgacagagagagagtgaatgaccaaaaatttagggagacgaaagttctaaaggaatatatatttacatgtatggtccctcttttagtttcgttttgtcttaatatacccaaactttaaaatgttatacggtttgattattcatgaaaatcaaacggttcataattggtttggttctggttttttccaactcgaggccactataaatgcttcacccaatcttaaaaatgggcttaaggcctcggcccattttattttattttgcttttatatattattaatatcatgataaatagagggaaaataactaaaataattcaggaaatatgccaaagagaataacagcgaatatgtatagagaaacggtctaaaaacaatttgatataataataatgaaagagagataaaagagtgagaagatggaatatgaggtggggagaggttagagagagtgatggttagaattgccatatgtaagagatgtacttattctaagaaatgacaaattactatgttggagtttagtgaacaaagaagctcaaaatacttttattacataacaacccaacaaaaatgaacatttcatgtgactcatgccaaacacatatcttctatcttccacttttttctattatataattcgtttttatatgctgaattaataaactccatgtgcttaagaatatatgaaataagtatactgtttactgaagtttttgtgtgtcgctaaaattcattacgtcactcacatatccaaattatcatgcatgaatccaaatcaagcatgcatacagattaaccctatttggtcttgttgtctacgagttggtaaaaaccagtcctaaatttatcgctttctcatttgattatattatatgagcacctatttcttctcgaaaaaattgcgtctatctaatgaatacaatgtctagtgttttgttttaacagtgttatgttcactgttgaaaccgttattctattcaagttaatgtatcggtaaaagtatatatacacatgtatatagtggtttattcttcaattaataaatattgcacatctcttagatacaattagcttatatggtacaatttcagttttctgttagtatttttgtttcagctgtttttttttttactaatttaacgggatcaataatgatgatatcatacattattgaatcgacaaggatcacattcaacatctagatgtttgtttgcttcttatattatatatatggtacaaaaagctctgaaaaaaaaaataagaagaaaaaagagttcaaaatccttaaggaaaaaaattccttcgatggcgaaagaaaataacaaaacgtattatcaagaaaaacaaaagtaccaaaacttgtttccttttttttcttaaaaaaagactctctctctatttatttgcttcgaacgtatctacgattctacgaatgagaccaaactattcaaactcattatgcttttacgtttgtcaaattacatgaacaccccttagcctcaagttttgactgggataccaaaaaaaaactaaacactgacttttaactttcattatttgtagaaatgattatagaagaaacaaaaggactcatttgtatttcaagaagttgtttttagtgtttaatcaaatactactggcattagtgttcattttgtttttagctaggtgttcttttttcccttgcaaactctatattaaagatagtgttttaggcatttcctaacatatagaaagactacaactgttctttgtctttacatttcttttgtattcataacttagaatgatccttcactttccatgtttggtacatgaatgttacatgtttgtgcttataattgctggtcgttgctactaatcaattactttcaatcgtataataattcttcttcaacatactaaactcctaattatatagtttcttattagtataacaaaaactcgcaagggtataatggtaatttgaatagcactatgtcatttcttttacatttttagaaaattcttcttcataattaagacaacgttcatctccaagatttctctccattgtcgaccttcacaaaataactatctctctctgtgttgcatgcgttagtactttcaatg

SEQ ID NO: 1215 - DNA, 3000 bp, Unknown
  misc_feature (1)..( 3000): cDNA_ID_2131778_gDNA_ID_1620372_Annot_ID_155027 3000 nt of promoter + ATG
gttctgtagtctaggaagaaattaagatagaagctcatacgaatgattacatctaatataaaagacacttcaaaacaattaaatcagttttctttaaaataggaatattaaaatattggttaattactaacctgaggtaatggtaatatgacgaagagatcgaagaagaacccattcttcttaacgtaaggtggagcaaccctcgtagagccacgtgtccctcctcctttgttggtatcgccgtcgctatctccgccgggataaggccaccggcgagcaatcttgaactgaatccaaatgttccaaaggtgcaaaagatcggtcatggagcgtaaggcagtgacggtaagagcaagccaaccgtcgacgaggagacacatacacgtgtcgctcactgatagggtatagagaaaaagtgggtctacgaatagacccgttgcgcatacaaggagaaagactttgttccattctcgaacccatttggatctcgggtcaagtattcgacccaacatcatccatttgttgttattacttgacccgtttcttcttcctccgcacgtgagccctatacgtgggtcttcttcttcctcttcttcctcctcttcttcgatttcttccatctcttcttcttcttcatcttcctcctccgtgttatcttcttctgagtaatatccaacgctgcttgagtcacgtgagaagcgtgatgcgcgtgtgaattcttgttctgtggccattgaaagtactaacgcatgcaacacagagagagatagttattttgtgaaggtcgacaatggagagaaatcttggagatgaacgttgtcttaattatgaagaagaattttctaaaaatgtaaaagaaatgacatagtgctattcaaattaccattatacccttgcgagtttttgttatactaataagaaactatataattaggagtttagtatgttgaagaagaattattatacgattgaaagtaattgattagtagcaacgaccagcaattataagcacaaacatgtaacattcatgtaccaaacatggaaagtgaaggatcattctaagttatgaatacaaaagaaatgtaaagacaaagaacagttgtagtctttctatatgttaggaaatgcctaaaacactatctttaatatagagtttgcaagggaaaaaagaacacctagctaaaaacaaaatgaacactaatgccagtagtatttgattaaacactaaaaacaacttcttgaaatacaaatgagtccttttgtttcttctataatcatttctacaaataatgaaagttaaaagtcagtgtttagtttttttttggtatcccagtcaaaacttgaggctaaggggtgttcatgtaatttgacaaacgtaaaagcataatgagtttgaatagtttggtctcattcgtagaatcgtagatacgttcgaagcaaataaatagagagagagtctttttttaagaaaaaaaaggaaacaagttttggtacttttgtttttcttgataatacgttttgttattttctttcgccatcgaaggaatttttttccttaaggattttgaactcttttttcttcttattttttttttcagagctttttgtaccatatatataatataagaagcaaacaaacatctagatgttgaatgtgatccttgtcgattcaataatgtatgatatcatcattattgatcccgttaaattagtaaaaaaaaaaacagctgaaacaaaaatactaacagaaaactgaaattgtaccatataagctaattgtatctaagagatgtgcaatatttattaattgaagaataaaccactatatacatgtgtatatatacttttaccgatacattaacttgaatagaataacggtttcaacagtgaacataacactgttaaaacaaaacactagacattgtattcattagatagacgcaattttttcgagaagaaataggtgctcatataatataatcaaatgagaaagcgataaatttaggactggtttttaccaactcgtagacaacaagaccaaatagggttaatctgtatgcatgcttgatttggattcatgcatgataatttggatatgtgagtgacgtaatgaattttagcgacacacaaaaacttcagtaaacagtatacttatttcatatattcttaagcacatggagtttattaattcagcatataaaaacgaattatataatagaaaaaagtggaagatagaagatatgtgtttggcatgagtcacatgaaatgttcatttttgttgggttgttatgtaataaaagtattttgagcttctttgttcactaaactccaacatagtaatttgtcatttcttagaataagtacatctcttacatatggcaattctaaccatcactctctctaacctctccccacctcatattccatcttctcactcttttatctctctttcattattattatatcaaattgtttttagaccgtttctctatacatattcgctgttattctctttggcatatttcctgaattattttagttattttccctctatttatcatgatattaataatatataaaagcaaaataaaataaaatgggccgaggccttaagcccatttttaagattgggtgaagcatttatagtggcctcgagttggaaaaaaccagaaccaaaccaattatgaaccgtttgattttcatgaataatcaaaccgtataacattttaaagtttgggtatattaagacaaaacgaaactaaaagagggaccatacatgtaaatatatattcctttagaactttcgtctccctaaatttttggtcattcactctctctctgtcgcctctcgctttgaaattccccgcgcctgtctctcctaatcatagtctcgcttacctccgtcggattctctctatttccggtcaccggagctccgtcggttcactttaatccgtttgaataccaggttagggttctattttccacacagctgagaaa

SEQ ID NO: 1216 - DNA, 3000 bp, Unknown
  misc_feature (1)..( 3000): cDNA_ID_3061227_gDNA_ID_1620373_Annot_ID_155047 3000 nt of promoter + ATG
tggttaacggtggcgtcgccgcactcaaggcagtaccaggagcaacagtcggtttgagggtcccatgaagcgaggtgataagggttgtttagagatttcttgatcttgaggagggtgtttttgtcattttggttacagagatctttagacaaacaggtcgtgaggaatgtgaacaagaacaagagacacaatgtcgctgtcttatccatggtgttggttttgaattttgatggaaagtgttagtgatacatatacatactatatagtgagtgatatagacttagagagacggattcgatttgatctctgtttccacatggaccgtaataatagtcaatacatatcatatagtcaagatgtcggcgttgaatatgtttgggtaatgcaattacgcgttgtatataattaggctataaccggtgcaagttatatctccttgaagcatttggaaatgtatactgaggcaatgtcttcaccatctaatacaacttctcaaaagttcatccaaatttaagtaacccaattgatctatccaacaaacataagatttgagagaaagtttagattttggttcatatttataagaaaatatcgaacaaagtttatggtcatcttcaaatcgatccgaccgttggaagagatttatcacaaacggctctattgagataagtgatttctgtttttctatgaacaaataaataaaataagttaccgaagaagagccaaagtgtgggcttaattcatctttcagatctcaatgaacgtgaatgaggcccaattagtttataatgggcactatgaaagccactagacaagtcttatgttcacaaatgatgatcaactgtatctgatccacaatgtaaaatgtctaatgttcacgccaagtctaaatgctttggtttcgttagacattaataaatcgtaattgtgaaccaaactaaaccgagaaaaatggatattatgtgacaagtctatcaagatgatgcataaaagaacataataatatagtcatcattactaagcatcactgaggcagcaaaagcggaccactaaagttggatcctttacaacttgataagttggttcataaaaattcaaattagccttcataaaagttttaaaaagaaaaagcattccagtttattcatagtttacatataacatagatgtaaaaaatgttagaaccatcttataacttttttgataaagaaacaatacaagaacttattccacacctttttattctttcttttgggaggttttgaatttcaggcaacttaaattcatctacgttggtaaaaacaattctttatcctcagaaatgtttattggaaattgtgtagaactcatctataacttgtctaaaatattaaacacatgattttgaagaagattgactacatcctcatgagagctcatttgctatggttgaaacctggacacattttaacaaatgcaagtggagtgaagaaccggttcttgtttgatactatacaaagggaaatgtcgatctaactgaagttagtttcatctctgctgttagggtcgatttagtctcggttcactgattctttttaccaaatagtttaataagctccagtgcgggcattagaaataaaaatggcgagataataaggtaatgatgttactcaatcaaataataataatcactccttagcctagcctgcccttttgctttttatgaaaaagtttcaaactccaaaaagctattttttagatgcttattccaatgaggcagaaagaaagaaacactaaagatatatatactcacaggggaaagttggtgttggaaatgtttctaattatcactttggcactaagtatattatctgtgagttcttgtaaatttatgtttacatgttttattttatatattgatgcgaaactatttttgtgaaaagttttgattaaagcatgagaaagtttcacttgatgttgggtttgagtgttttatccgggtttattcatccttgaaatcagtcatgcaatttggcaaatatgtggtgtaattttttacaagtgtgagagaatctactatttctacctttgtcactgctgaaaaatttcttaatgtacctaaaagtcttaagacaaacgaagaatctgctttcctatttaataaaacgaagataacaaaaaaaaagaatcagcttccctcttaaagaaggagaaaaacagagagaataagaagtaattttttagggttcttcctttttcattttgattcttctttttctttgagatagaattgtttctctttcgttctctctctgtgtatcaaacaaaaatttgattatggaataactcttaacttcttggtttcttaaattcttctttctttctttttttcatttctatggtacagcagcaaacagagaattttatggcagcttcttcaacatctttctcaaggtactgcttactaagttaaacgcatccttctttacatatatacatgttcttgaaatattgttggtccatataaaaatagctctctttttttgtaagttcgaatactatagatttatctctttcattgattttgtttgctatcttctttttctcttcatttactctctatttatcgttttcatattaatccttctcttacttttcatttgcaaaagataattcaagacattctgtgttttcctgcaaacacttgaatgagttcatggaacagaaccaagagacaaagcttatatttgcgtcgaccacttagtatatattgtttaaatcaggtaagaatcctttcaattatcttggttgagattgaaagtaaattactaaatactaattataaaggttttaaatcagttctgatgagatacattagtttctttacatccaagaaacaggttttgtctaatcattttttcctgcaattctcagattctgtttttttgtatgtcaggaacagaattgaaacgttttgaaagaaacaggagaatcttttggttcaagtaatctaaaaccatg

SEQ ID NO: 1217 - DNA, 3000 bp, Unknown
  misc_feature (1)..( 3000): cDNA_ID_3061209_gDNA_ID_1620373_Annot_ID_155054 3000 nt of promoter + ATG
agcctgctgcgatgtctgttgcaggttatttatgcccatcaactgtctctctgtcattggctccaactgattcgccagaagctgtttcaacacatttttccctatgaccattctttttatgttctatgtagaaacagatgcaatcggtgaagacaaagtgaaatttgacctcacctttagaagttcggatgaacgaaatccaccgagccacaagaaacatctctcagctggtgttttccacatgccagatagcaagtgaaagacatcattcttagctgcattgctctttatcctgaaaagctcctcatagtgagccatcacaccatcgactattattcgaagctcagaatcacctgcatgcgcattcagagcagacctcagctcgttcatttgcttgttcttttcttccaaccaccgtgaatgttcagcatcaaacgccaaagcacctgaattaaaaaatttatacatgatcaaaacaaacccatgagattcgtcatcttgtaaatctaaatctacaccagtgctaattagaataacagtttttgctatcagaaccatgtcagtctgccactgactctgataacccagtgtattgtaatgggatgagatatgatgtactaattgatcagtctacaccaagtcaacaggaagttgatatatgaacttaacttatacacaaattagaagccaaaaaataaacataattaaaactaatggagaataagcaaccaaccatttccaccagtagaatgggcctggtctcctgtgcctgaaatgaagacgccctagaaacaagaaatttaccgttaggtatacagaataacaaaataaaaatcaatagaaataagaaacaaatttgaacctgctgtcttgctctttgcagctcctgctcaagctgggttagtttcaagcggctgttctctagctgctgaacataagcctatggagggagcaattaaaaggaattaacgtagtaccaaatagctatgcttctagcgatgcaccaatttaaaaagaaaagaaaaagtaaaaaaagataaaaccaatggaaggtaatataccttcttcctcaatctgcttttccttgctgcctcacggttttgagcaagcctacgaagagtctatggatcaaaatataaggaaacaaaaagagattataaattggctgaataaaaacagtgatcttatctacagagatggacatgtcaccttttgatccatctttcccttcgatcggtcactcgaatcagaagcagcagtattcactagtgctccctccgactgcattaaaattaacaccagaatttttgtttggtccataaaaaatcacactattttgaagaatataagtgataaaatctagccagattatgagctaaccccaagatcaggatgatctgtgtcgtcatctgttgagacatcagttctcggactggtatcagccatattactttctcaccacttttctgtactaacacttgataacaaagacaatatccacttgtggcctctcttttagtaacaacttcttgaaatttctcttgtgtgcacagactgccaggattcggaaggaaattaagaaaaagaaaaaaagacagaaagaacaaaattaggtgatagaatataaaagaaagatcaacacctaccaatacgaatcaataggaaatgaatcaggaacaaatgttggtcacccggagcattggctgcgctgaatgagcacaaaaaaaaacagcattacataccatctcttttgctaacatagttttcaattatgtcctataaagtcaagaaaaaggttctctagtttgtttcagttaaacaagccagctaaagaatgctaaagagtcctttacttattcaaagtgtcctaagggaaattctgctgactaccataagtcacaaagtcaaatatataagaacaatctgtttgtagctaacagactgacaaaaatagcccatcaaaaacacaacctttaaagcaattcatcaaacccaatcagacatgtagcttgcacaatctacaaagtctgagaaactcattcagaccttaagcttagctcgcggatcaaagtcaaaatcagtgagacttaaggtgttggcacagtcgaaaatgcctgagtttgaaaaattaggtacagtcacactcacacacatcatttcaattcagtttgaatgacactaaagtagcttcagtagctgaatctcttagttttgcaactctagctagaacaaaaactattcagtattcacatccgagttgactcaattccttactcagtattcatatccgagtaaagtaaaaaaaaaaagctaaactctaaatctagaaccagtgagaattcggcatgaagctgcagctatgatttcaaaccaagaaactaccaccgaaacagaattcaagagattaacatttaattcgatgattttggtagctcaaaattaagaacaaaatcaccaattaaaaaaaaaaaaaagctgaactctttaagcttgagaaagtcaactaggtttaacttcaaaagcaaaaagacagagttaacaagtagcttcttaggactgtgaaggagaaaactcccagaaaaaaaacaaaggaagaaaaaccctagaaaaaaaggttggcttgatgaagaaactgacctggaaaaacgaaatcttgaaggtgcacaagtaaagggcttgattcgaaatcggattgaaacaaagaaacagagagagacacgatccgaaattccaatctccgagacgtcgttttgtctacaaatctaccagttccccatagaccctcgaccaaaatttaacgggaaatttcaaactaaaccctatactctttatttttaccattaaccaaccctactatcttataattgcaaaacccaccccgtattttcaacacctgaaattcaattcactctcactctcactctcactctcactctcactctctcactacttcactcattcagcagatcctcttcattctctattcttaactcattaatg

SEQ ID NO: 1218 - DNA, 3000 bp, Unknown
  misc_feature (1)..( 3000): cDNA_ID_2132042_gDNA_ID_1620373_Annot_ID_155057 3000 nt of promoter + ATG
aaattcagtttccctactgacaaaaacgtcatagatggtgatgagtcattagaactattgaaggtgatgagtccatttttaagcaaagtatgattaatgaaaaaagctctctttacctggttctatcctcaaggaactcatccgagttggagtctgacttctgttgtgagttctttgcaagccggtaaaaggtatcgcggaagcacttgcgggtatcatcagtcaactataagaagaagaatgtaaaagtctgttacaagacagatcaaatctcaaagaagattatataggctagatcaaatcaccacactcaccatttctgtagccctttgtagatcctgcaacacaacttcttcagcagatgcctcctccttgttctcctcacacagattcataggtgcatcctcctccttaaccaaaagaatgttccaagatcattaacatctttactattatctcacttggaacaacaatagtcaaacacataaccgagagatctcagaccaaaatccaaaaccagactaatcccaagagtctactgaattcaacaagatttgtcaatcacttagtttctcttttctactatttaacattgctagtatatcaaaagagtcgattcttaccataagtggcatatcttgacaagtttcccagttgtaatggaacaaagggacttccctgccatcagttgtgtcgagataggaggaactggagctgttgttattatccgactccttgaaagaaagaaaattctcattccctggaacatcctccaaaatggaacttcttcagtcaaaaccggaaacaaaaagagagagacacaaaaatataaacatcgaaaaactatatagatttttttttttttttatgtgatatataaacaatttcttacaagaacatgtcatccatgtgttggatttcatcaaaatcatgaagcgaacggtcaaaacaaccactagcctttaacttcttagtttcttcttctacttgttcactagttcccatatccatctccatctgactgtataatcctccactgaaaccattgtgaatcacatcataatcaaaacatttctcagcagcttctgaagagttcatgctccatccagtaccccacatatcaggagaagggtacgaatctgatgtctcttgatagttaggcacaacaagatcctctaaattcctcctcgaataacgatccatgaatgatactttaacctgctaacaagtcactcactatattcagcaaccaacaggagaaaaacatttgaattcttaagaataaaataatcaaaagaagtcacctttatgatcagatctaaatccaaatccaaaagattatgagtctatcttcttctatcttctgtagatttgtgagtgcgaaggaggaaagagagagaagacaaagaagcaagttgaagagaggaagtggagagcgcgtgagtttgaactttagttagtggcttagaattcacaaacgagatttgtggcttagattactcctccatctaaagcaactctttcattggtccacgtgttaaacatatctttttctgtgtgaggtcggcacttgaattaaaattaattaaatcttgcaagacacaactggccaacttgtacgtttttgtagttcttaaaagttgtctgtttacgggtagacgacaaaaggattttaagttacggatataccctccagatcaggcagtggttagcggctcaggtttggtgacgacacgtcacatgttcactcgatttggtgtagacacgtgtcctgtaggtatagggaggtgatgacacgtgacagactgttttgcggtggagtgggacccatggtctcatggggatgcagtggataatgttcctctcaggctctcactctcttaagcaaaacttttaaaactggaaattggtttaggtcctttataggaggtattttgaaaatccacccagctgccgacgatcttataggtaaagtggttaatccagttttgcttgttacttcgtaaggttaatatatgatatagtgggcctgacaaaaaatcatatgggcttgacaaaatctatgtttatatccagttcggtccaaaattcgaaaacataaacaatgtggaaagatgtgttggctaatctgataccatgtcaaaaaaacatagaagttcttgtgaggtttcttgtttattcatgtggaggcaattgcccttgtatacaaggcttgtgaaagaagtaaagaagataagtttaggaagaaggtggcccatgagggcccaatattcatatcattagtgaaaagcataggaatttcaacttgtaatattaaaatcagtgataattgaataacattaatctttttaagatttccaaattaattcaaatcttcattaagaaataagatttaggaatactaaaaagctaaataattatctaattacttaaaatcagtaatgaaaattaatattatactcccatagtatattttcttcactatgaatgaagttgagacttcaattttgacaaattcggtgttctggaataacaaaagaagtcaaagaaagaaaattagggagatagagtaaattaaagttgagacaaatcagcttcattttgtttttcccaaataataatatacagatagatctttcggccccggcgcattctctagatttgctcatcaccacctcgaaatttctgctcgaagttctccaaaacagttcattcatctacatttaccagatcatattcgtattcagtcgtctctaaattctcactaaatcaatccttcctttggataattccggtgtttgcgaggaatctgataaaatgattggttagttcagttaaactctacttctaaaactaaatctgcattcaaatgtagtctctagttctcgtacttgaagtagacttgattcgatttgatttactgattcgtggcttttgatttcacaggtcaattggaaatctgagaatccgtgtgactattattgcagctggatcgagatg

SEQ ID NO: 1219 - DNA, 3000 bp, Unknown
  misc_feature (1)..( 3000): cDNA_ID_2132070_gDNA_ID_1620373_Annot_ID_155064 3000 nt of promoter + ATG
gcgttggctgtccttctaacacggccttttcccctgctaagtctacatccttcaagaacgttagctgcagcgctcctcagtgtaagcaggtatataattttgtacttacacacctacagtactacatatctaataaatatgtttttggaatgttttttgattaatttattttatcctcacacttacactttcatagcttcataaatgaaccggtagtattaaaaaagaaaaaatagtttatgaatgtctcaccatactatattgtagtcaaattttaatattagtaacctgcatttgttttcatcataaagatgtgagcatgagaatgttaattgctgccccaaaatgaaaatatatttgacaaaatatcagatctagaaattttttagttgatatacaaaaaggacagtttctattttattacgtgaaaaatgtattttcacagagagtgggttccacgtggttataattgataattccacccacattcaaagaaaaaacggtcacgggattacagaaccactaaacacttgaccgacacagagacactgtactgcattaacaacaattcacgtgaacacttgcttcaggtaccaaaccccacgtgtggagcacgcgcgtgctctttcaacctcacctatggaagctcctccattgcggctaacctctctcaagacacgatacgtcttgccgccgatccgatcaaagcctttacattcggatgcgtcaacaaagtcgccggtggaggaaccatcccaccacctcaaggcttgttgggcttgggacgaggcccactttcactcatgtcacaggctcagtctatttacaagtccactttctcttactgtttgccaagtttcaggtctctgaccttctctggttctctcagactcggccctacctcccagccccagcgcgtgaagtacactcaacttctcagaaaccctagaaggtcttctctgtactacgtcaacctcgttgcgatccgcgttggtcggaaagtcgtcgatttaccgccggcagctattgcttttaatccttcaaccggcgctggaaccatcttcgactccggtaattactcttgtccggtttggttccggttaggttttagttttctgtttcaattggtattaatttcgtattggtttagactaaaaacataaatctttagttaattagtgtatttcgtattgttttacactaaaatatatacgtaacaaaatagaataatttagtgtattttattcgattcggttattttcagttataatataattttagattggtttggttatattaactaaaccatttgctgtgtaggaactgtgtacacgcggctggctaaaccggtttacgaggcagtgaggaacgagttcaggaagcgcgtgaagccaaccacagccgtggtgacgtcactcgggggtttcgacacgtgctactcagggcaagtcaaggtgccgacgataacattcatgttcaagggagtgaacatgacgatgccggctgataacctgatgttacacagtaccgccggaagcacgtcgtgcctcgccatggctgcagcgccggaaaacgtaaactctgtcgtcaatgtgatcgcaagcatgcagcagcagaaccaccgtgtcctcatcgacgtccccaatggacggctcggtttggcacgtgaacgatgctcttagaaagatgaatgagacaataagagcctactcatatttatgcagagacttgtttgtttgtgttatttgtgtgtttcatttttgtcttgtcttgcgtcgtttgcttcaccagtcttagagggcggaggtgtgtagcatttgtgctatctagtaatttatgtttttaattgttcttcaattatctagagtgttggatctaagctaatcaaataatgaaactatattatatttccttacggtatacaaatatacaattgaacatattaggtaattagaaatacataaaattgaatataatattagcacaatgatctaatcaaattttagtcgttgtcttaaattgtttatcgacaatcgatgttcatcaattggcccatcagaaatagcgcgactagtggatatttcagttcatagttttcaaaaagaatccactttaaagcttgtatagggtttgtctggcatggtaatatgtataagacaataattttcataattttatcaactagtagagaaagaaaattgattaaaaaaaagtatgattaaaagaaaaaatatagttttgagtttcaaacgagtaatgtagaaagtgaaaaccaaaagagaatgctacgccaattgcttaaaatcaaatcaaatttcataaaataaaattgataatgcgaaagagaacagagagacaacaatcacatcgatcatgtaaccacctaaacaagttccactctggttcactccattatgatggtacttgtatacaattcttttattccataccgggaaagtgtgatttgaaccccacacatgcttaaggtacaatacaatggatagtggctaagcactagcacacaaggtattttggggtcgttatgattaaactatggcaaaactgatataattcgttaatgtctttttacgggaaaatgaattgaataatggaatataaagtggacgaagcgggaaaaaaaaaagcgatatgcggaatatctctagaaacagaataaagcagaaaaaaatcaaggtgcactaatccatacaaaattttccaataattggattgaataaccgaattttaaattcgtcattgagaaaacagatcagaaagaaaaccgaattttattccggtttgatttgaaattgtttcaatttggtttggtataatttggagttaggaatttgtgggtttggcagttacacgcgtaggctagtggaaaagcccaccacacataacacacacacatcttcttcctctctttatcttcttcttctctgtttctctaagaagatagaacaatcccaagattctcctcttatttgatcaaccatg

SEQ ID NO: 1220 - DNA, 3000 bp, Unknown
  misc_feature (1)..( 3000): cDNA_ID_3061168_gDNA_ID_1620373_Annot_ID_155072 3000 nt of promoter + ATG
cataatggaacaatcataagaagaagctatatatggcgatgtgtatgcactgcagatggtttggagtcacaggctcatagcctcatatgtttacgttaatcatcatggaaagcgatttttgatccaaaaaaaaaggaaagcgataccaaggagcttgtggagtttatggtgatgctgcttttgcgctggttaagttgaaattcagaaagaaagataacccaaaatccaaattaatgattacttcaaacacttttgcatatggagaagaagagctgttcaacattaaacggtacaacgcagcattgaatttccgtgtcccaagcactgactgatgatcattctctaaagtctctataaatatgaccatgtgatcgtacgtggctcctcatgactgccccaacaagccaattactaaacttgtctttatattgcggttccaaaagatctgatgttgatgttctccaaaacagaaacacattttataagataaatgtaaattaaataaagcaattgggaaatatttatatagagtgatgatgaatacgtgaggactagtttatacaccacaacacaaaaacgcgttttgctcattctctctctctcgcacacacgtcaacaatcatatccatcgatgcatttgacttcctcgttcctccatttacatatgtagatccagttatgaaaggagtactagttccaatttcaatacatttatatttaatattttattcaatacaaaagtgttgaaagggattcggataaaccaagcatttttatgtgtatagaaaaataatacttgactttgcagtttccatttccaatcttcaaagtcatatcttaccaaactcacatctctagctaatatatcccctatattttgttacaaatatatatatatatatatatcttacacaaagacagtgcatgtgatatagaaatcaagatgggaagccaaggcatgagttcaccgagtcccttggtggtgaagaaatcgcaagtggttatagtgaaaccctcaaaggctacacctgatgtctctctttctctctccacactcgacaacgatccttatctcgaaaccctcgccaaaaccatctatgtctacgctccaccatccccaaacgaccacgtccacgatccagcttccctttttcagcaagctctctctgacgcccttgtctattactaccctctcgctggaaaacttcaccggggatcacacgaccatagactagaattgaggtgcagtcccgcggaaggagtcccctttgttagggcaaccgcagactgtactctctcttccctcaactatttgaaggacatggacactgacttataccaactcgtaccttgtgatgtagctgcgccctctggcgattacaaccctctggctttgcagatcactttgtttgcatgcggagggctcactcttgctacggccctctctcattccttgtgtgatggttttggagcgtctcagtttttcaaaaccttaactgagctcgccgcgggaaaaacacaacctagcatcatccccgtctgggacagacatcgtctcacttctaacaactttagcttaaacggtatatgttaactagtattatctaaatataatttcttttagatttagacgcattactaatcatcttgatagtttcagatcagttgacaaaaaatagattggtccatatcttttatatattgttgttttaactttattttatttataatgtgatgttactaattaacattgtatatatgtaagtagggcaatgttttatattgtagttttaaatttattttatgtatgatgtgatgttactaattaacattgtatatctatatgtaagtagaccaagtggaggagggacaagctcccaagctagttgattttggagaggcttgctcttctgcggcaacttctccctacacacccagcaacgacatggtatgtgagatcctcaacgtgacatccgaagatattactcagctcaaggagaaagttgcgggggtggtcacgactctagagattcttgcggcccacgtctggagagcaaggtgccgggccttgaagttaagtccagatgggacttctcttttcggaatggctgtgggtatacgccgcattgtggagccaccattaccggaagggtactacggaaacgcatttgtcaaagccaacgtagcaatgaaggctggagagttaagcaactcaccgttgtctcacgttgttcagctcattaaagaggcaaagaaagcggcacaggagaagaggtacgtgttggagcagttaagagagacagagaaaacgttgaagatgaatgtagcgtgtgaaggagggaaaggagcgttcatgttgcttactgattggaggcaacttggattgctagacgaaattgattttgggtatggaggatcagtgaatattataccattggtgcccaagtatctgccggatatttgtattttcttgccgaggaagcaaggtggtgttagagtgctagtcacgctgcccaaatctgtaatggtcaacttcaaggaacacataaatcccctaaatacatgaaattaataagcaggtgaatgtaattcacagtgtttctttaaaatatgaaaaggacctcatgcgattgtatatttaaagcttttgtttgctgtttgtttaagtttttcacatttggaaagtaatattttacaaaccaataatgtaacgccacgtcagcaacaatattccttctaaagaccccacgccaatattccttagtggagtttttaaaatcactgtttcatctaaaaactgattttagctacaacaaaatataaggccgaaaaagaatgctttagttgggcctaaatatttcatgctgtaaaaatgggcctatctaaataagcccaataaatttatgcgagaacaacactagggttttagtttttcttttgatatataatgtaaagggcgccgttaatcgcagcctcagtggaaacagagcagctgcaaac

SEQ ID NO: 1221 - DNA, 3000 bp, Unknown
  misc_feature (1)..( 3000): cDNA_ID_3061192_gDNA_ID_1620373_Annot_ID_155065 3000 nt of promoter + ATG
gattacgaatgagcaggaagcttgatttatcaggcgtccaaaattaaaatagttatccgattttactcggattttttattttaaagaattgaaactttaaaatgtttcaaaaaattataaatattataactttatcaaaagttaaatattataattttaaatttttttataaagtttatctttaaaaaatgctttaaatatttataattttaaaacttataaagttttaaaaattataaattgaattttacaagaaatttaacattataaatatataaaaaatatattaatacgagacgatatattacagaaaaaatcttaaatataacaatcaaaattcaatgatgaattttgggtcgatattgtatttttttaagtttcaaattttataatattgaaatttataagaaaatgacaaaattatgtttaatttcacgggactgggttatatggtatgacgggtttgggtggataataattacgattttagaatgtcccacatcgcttaaaaaaattggacaatggtcaagagccatactataaaaaggaccaaaatgatttcgattacgaatgagcatgaaacttgatttatgaggtgtccaaaattaaaatggtttgtttactagggttatttattttaaaaaattgaaacttaaaaaagtttaaaaaattataaattaaattttacaagaaatttaaacaatataaaagatattaatacgggacgatatactgcgagagaaatcttagatataacactcaaaattcaatgatgaagtttgggtcaatattaatcttttttgaagtttctagttttataaatatttgaaatttataataaaatgacaaatttgtgtttaatttcacgggacggggttatatggtgtgacaggtttgagtggataataacatgggatagtatgctatggaaaaaaacatataataacaatcataatataattatataatcttaaacactaaacaaaattaacaatattaaaaaaaaaaaacttaaaactttaatttttttaaaacacattttgattcttttataagaaatttaaacattataaatatttaaacattatactacgggtgaaattttataattgactgtttgggttgataagaatttgcgatagaattgggagtgaaatcctagaatgacaattaaaatataattatacaattaaatactaccacgggtgaaatcctagaattgacgggcttgattcgatattaatatgggatggtgtactacggaatattttagaattgactggtttgggttgataataatttgcgatagaattatgagtgaaatcatagaatgacaattaaaatagaattatacaattaaatactaccacgggtgaaatcctagaattgacgggcttgattcgatattaatatgggatggtgtactacgaaatattttagaattgactggtttgggttgataataatttgcgatagaattagaagtgaaatcatagaatgacaattaaaatataattatacaattaaatactaccacgggtgaaatcatagaattgacgggtttgattcgatattaatatggaatggtgtactacgggtgaaatccgagaaacaacaatcaaaatacaattatacaatattaaacatttaacaaaataaacaaatacaacttaaaactttaaaatttgagttataaaatttcgtctagcggtgaattgtacatttaaatcaaacaatagcataaatttattaaatcattctaaaaaatattcaattattttttatttaataaaaatataggctcgcggtataccacgggttaatatatagttaaatgtacacttttaaaagaaaaattaatcacaaaatacattacccatgttctattttgttgttgtgattagaaaaaaagtttatttatatcatgtgggagacaagtatattttccttattgtatacgctgcccatcatactaataccccacaaaagtagtggaaatctgaagaaagtaactttgcactatcggaagagtaaagaaacagatgaataatttacattacttgccgacacatcttttacaaagataaatataagagtaataatggcatgcttacaaaatactagtaataactaaaccagcacccatgtttttaccggttcgcattattggagatgctgcaagaaacaataggaacacatctttctattttagatatgatggttaagaggtggtagtgattaagaaatcatctcggaaacattaaagacagtcactctttgtgaagggattgttggatatttgaaagaataacccactttttattattttaaatggagataatatattatcttcgaaaatatgtttgagaggtaaatgaaagaattaacataagaatggaaaagatttcgaatcaatatatatcttagattttcccctctaaagagacattagttatacacactttacacacacaaatcattctaaaatcacataagtcaaagtttagaaaggtatatcataaaaaaaactttagagctctgcaacttgtttgatctcatatacagtttaagtttgttgaaggtcgaactctcgaagggcgggatatacgatttaaacatgtggttgttgtatactggaaagcgtttttttaacggatcatacagttaattgtttagcataatgttttagatacatgctttaacaatttattgttcttatagacagtccaaggcaaacctttgtaatgaaaaaaattaacattacaaaagaaatgttaaagttagaaacgagagcagtttaaatttaagctaatctttattttaccgtggattcaaacttaaaacctaataagcggaaataattattgatttgtatcatatagttaattatacttttgattttatgtgcttggtcattatgtagctcagaccactatatatacccttctcatgccaacaccatttaataacccatccaacccaaaagcatacaatacaatg

SEQ ID NO: 1222 - DNA, 3000 bp, Unknown
  misc_feature (1)..( 3000): cDNA_ID_2132046_gDNA_ID_1620373_Annot_ID_155058 3000 nt of promoter + ATG
cgtagttagctctggctactggatggtataagcaatgataattttacaagtactcctttagtttctcgaactaaaatgccctgtccataaataataaattaccaagtctacaaatgcacgtatgatctgaataattttatgaggttattcaatggaatgacagtaacaatagtattcctttatcaaatttacttcttaaagatatgcattttccaaaaatattaccagtcgcaaaggagggcagtcttggcacaagatcagcagcatcatttgcagtccgcctagagatcctgaaattaccaacttcatcaagatcatcatcgtcttcaaaatcatcaatgtcatcaacagtcagctcttgagcttttggtgaatcaaaagattctgatcgcatcaatggtggcgcagatggtgactcacaccactcgggatttgtaaccatgggagaagatgaggaaattaatacaggaataggcggtggggccctttttggaggtgagccagaagattcaggaattgtagccaaaaagaattcatcagcagtacccacgctgttctgaaatatacataagactcaagcatttagaaaatgacttatataagtcgatggagaaggagtccgttatatgttaatagcaaaaggttttccagaaatgaacaggcattatcctagaaactgttgcaagcaactcctagtaatgcttaacaaaagttagaagtatcaattaagaaagcaatatgttacatgtacacaccatataaggcaatccaatgtgatcatgatagtcccgaatcgcttcagcgagttcgagcattccacctaaattgaaacaatacacactattaatctgaaagaaaaaaaacagaacgatcacgaaaacaaaagaagaaagaagctagtagtacctttcttagcacagttaatgacataatcaacactaacttgatctaaatcaacatcgtcaagagtcacagcaccaggaggcattataactttcttgattaagctaccagccaacataaaatccaatagcttccgcctatcccggcgatatctctgaagaatctcgacagcattttctctatacacgcaagaaaatacaacagcacatcgatcaaaatgcaatagcaataaaacgaagaagattgtacagtagcccaaaaacaaaatcaaaagaagaagaagaaagaaacatactcttccatctcgatccagctgcaataatagtcacacggattctcagatttccaattgacctgtgaaatcaaaagccacgaatcagtaaatcaaatcgaatcaagtctacttcaagtacgagaactagagactacatttgaatgcagatttagttttagaagtagagtttaactgaactaaccaatcattttatcagattcctcgcaaacaccggaattatccaaaggaaggattgatttagtgagaatttagagacgactgaatacgaatatgatctggtaaatgtagatgaatgaactgttttggagaacttcgagcagaaatttcgaggtggtgatgagcaaatctagagaatgcgccggggccgaaagatctatctgtatattattatttgggaaaaacaaaatgaagctgatttgtctcaactttaatttactctatctccctaattttctttctttgacttcttttgttattccagaacaccgaatttgtcaaaattgaagtctcaacttcattcatagtgaagaaaatatactatgggagtataatattaattttcattactgattttaagtaattagataattatttagctttttagtattcctaaatcttatttcttaatgaagatttgaattaatttggaaatcttaaaaagattaatgttattcaattatcactgattttaatattacaagttgaaattcctatgcttttcactaatgatatgaatattgggccctcatgggccaccttcttcctaaacttatcttctttacttctttcacaagccttgtatacaagggcaattgcctccacatgaataaacaagaaacctcacaagaacttctatgtttttttgacatggtatcagattagccaacacatctttccacattgtttatgttttcgaattttggaccgaactggatataaacatagattttgtcaagcccatatgattttttgtcaggcccactatatcatatattaaccttacgaagtaacaagcaaaactggattaaccactttacctataagatcgtcggcagctgggtggattttcaaaatacctcctataaaggacctaaaccaatttccagttttaaaagttttgcttaagagagtgagagcctgagaggaacattatccactgcatccccatgagaccatgggtcccactccaccgcaaaacagtctgtcacgtgtcatcacctccctatacctacaggacacgtgtctacaccaaatcgagtgaacatgtgacgtgtcgtcaccaaacctgagccgctaaccactgcctgatctggagggtatatccgtaacttaaaatccttttgtcgtctacccgtaaacagacaacttttaagaactacaaaaacgtacaagttggccagttgtgtcttgcaagatttaattaattttaattcaagtgccgacctcacacagaaaaagatatgtttaacacgtggaccaatgaaagagttgctttagatggaggagtaatctaagccacaaatctcgtttgtgaattctaagccactaactaaagttcaaactcacgcgctctccacttcctctcttcaacttgcttctttgtcttctctctctttcctccttcgcactcacaaatctacagaagatagaagaagatagactcataatcttttggatttggatttagatctgatcataaaggtgacttcttttgattattttattcttaagaattcaaatgtttttctcctgttggttgctgaatatagtgagtgacttgttagcaggttaaagtatcattc

SEQ ID NO: 1223 - DNA, 3000 bp, Unknown
  misc_feature (1)..( 3000): cDNA_ID_3061205_gDNA_ID_1620373_Annot_ID_155055 3000 nt of promoter + ATG
taggttctgtaagccttgagggatcaaaccagtaagactattatcagatagatcaagataggtcagaacatgtaaatcagcaagtgatggcgggatttctccggtgaatgcattgcctgctagagacaaagagacaagcttcttgcagtttttcagttctgggatctttcctaagagcctattgtgagagatgtttacaatactaaggacaggtgagtcgcaaaaattcggcggtaactctccactaaaccggttttgtgaagcagaaaacttatacaagctcttaaccaatccaagaccatgtgggatttcaccagaaaaggaattgttgactatctcaacttgctccaatgcagaagccaaagacacagactctggcacttgacctgtgaaccgattattatccgctctaataatcttaatcctgggtaatttccacaacacaactggaaactcaccagaaaatccattgttctgcacttgaagcctctccagactaaggcattcaccaatggagttaggcaatgacccttcaaagaaattcgagtggagagaaaggttaataagccttttaccactgcaaatgccactagggaaagagccagataacttattctgtgagacatcaagagacactaagttcttgagagaagggcctaatgatcgaggaatctcaccactcaggttgttcaaactcagatccaaggttctcaaacttgtcaaaccaacaaacgaagtaggaatctctccatggaaccctgacctatgcaacagaagctgttcaagcttgtctagcttcccaagaaaagaaggaatctcactaaccaaatagctgttttcagacaaatcaagaacaacaagctcacttagcttcccaatagcaggagggacgataccagtgagcaaattacttcccaagttgagaacttggagattaaacaataaccctaaatcttctggaatcataccttcgacatggttactgctaaagtcaataactttcaaggaactaaactcagaaatctgatcagggattgtgccccagatgagattagagctgagattaagagtctctaaagtaacacaacgagacaactgaagtgggataggctgattgaagaagttcaaggagaggtcaaggtgagtgaggtaagggaggtcacaaatggagtcagagatttcaccagaaagattcaaactttgaaggttaatggaagagacgtaaagagtaggagctctagtacatgtgataccagtccagttacaatggtgcgaagaagaagtgttaaaccaacctgaaagagagccttttggatcatcaaaggaggctttgaatctgagaaggttaccaagttcctcgttctctgtgaaagagaaggtcttggtgaagaagaagaagaatgtcaaggctagtgagattgaaaactggtgcttgaatctggtagccattaatgagttaagaatagagaatgaagaggatctgctgaatgagtgaagtagtgagagagtgagagtgagagtgagagtgagagtgagagtgaattgaatttcaggtgttgaaaatacggggtgggttttgcaattataagatagtagggttggttaatggtaaaaataaagagtatagggtttagtttgaaatttcccgttaaattttggtcgagggtctatggggaactggtagatttgtagacaaaacgacgtctcggagattggaatttcggatcgtgtctctctctgtttctttgtttcaatccgatttcgaatcaagccctttacttgtgcaccttcaagatttcgtttttccaggtcagtttcttcatcaagccaacctttttttctagggtttttcttcctttgttttttttctgggagttttctccttcacagtcctaagaagctacttgttaactctgtctttttgcttttgaagttaaacctagttgactttctcaagcttaaagagttcagcttttttttttttttaattggtgattttgttcttaattttgagctaccaaaatcatcgaattaaatgttaatctcttgaattctgtttcggtggtagtttcttggtttgaaatcatagctgcagcttcatgccgaattctcactggttctagatttagagtttagctttttttttttactttactcggatatgaatactgagtaaggaattgagtcaactcggatgtgaatactgaatagtttttgttctagctagagttgcaaaactaagagattcagctactgaagctactttagtgtcattcaaactgaattgaaatgatgtgtgtgagtgtgactgtacctaatttttcaaactcaggcattttcgactgtgccaacaccttaagtctcactgattttgactttgatccgcgagctaagcttaaggtctgaatgagtttctcagactttgtagattgtgcaagctacatgtctgattgggtttgatgaattgctttaaaggttgtgtttttgatgggctatttttgtcagtctgttagctacaaacagattgttcttatatatttgactttgtgacttatggtagtcagcagaatttcccttaggacactttgaataagtaaaggactctttagcattctttagctggcttgtttaactgaaacaaactagagaacctttttcttgactttataggacataattgaaaactatgttagcaaaagagatggtatgtaatgctgtttttttttgtgctcattcagcgcagccaatgctccgggtgaccaacatttgttcctgattcatttcctattgattcgtattggtaggtgttgatctttcttttatattctatcacctaattttgttctttctgtctttttttctttttcttaatttccttccgaatcctggcagtctgtgcacacaagagaaatttcaagaagttgttactaaaagagaggccacaagtggatattgtctttgttatcaagtgttagtacagaaaagtggtgagaaagtaat

SEQ ID NO: 1224 - DNA, 3000 bp, Unknown
  misc_feature (1)..( 3000): cDNA_ID_2104994_gDNA_ID_1620373_Annot_ID_155052 3000 nt of promoter + ATG
ggtagtcaacgttttgcattgtgggacggttcaggaagttgagttcattggatttgagaatctcattcgccatctcggctgatgagacaataagattaggaatagagccaatgaagagatacatcaaaggtccgtagcggattgagagcttgtgaagtgcttggtgagctatgggaccaaggaggtgaatgtgaccgatgatcggtaaagctgttgggcttggtgggagtggaagtctgtcacgtaatctgttagtaatagcttggatcaagactgtgattccaagacatacaaggatgattacggagaagtattgtaaatccaccattttcgtttgtgttttgtttttaggagagatattatcatgttttgattttataggataggtttatagtcatgactcctaatggtatcaaatgtcaatcccaacttcaagattctttcttttctcatgttgtctttgttctgtttttgtctcttttgtgaaggtataatctctgtttctgatcctgtttcatgtttatttatggcttgtctgtttataaacaaataaaaatttaagaatttacttgactgttgttaagctttcattatcagttgacaaaagaaaaatgttttcattgtctaggcttacacgtcattttcaggtgtagttagattagtaatcaaggttggtaacaacagactgtaagatttagagcttatggaaataactgaaacattttttttccatcaatagtggtaactggtaagcttatgaaaacagaacataaaacagagcataaaacagagcacagtacatatgattccaaattcctaatgatgtttatctgcagaaattcacttagtttggtatccaaatggatcaaaacataattcaggagaacacataagtgagcttcctccagcagtccctgaagccgaaaagccggtaggtaacttgatcttgattttgtcttcatctcccttcaccgtccaattaaaacactgcacgagtgacccaattgtgagactcaacaccagagaagcgtgagaagctccaagacatcctcgtcttccgctcccaaacgcaagataattcacatcttggccttttaattccaacatatattgctggtagtaacccatctttctctctgtatcttgttccaccacaagaaacctctctggcataaacttgtcagggtctttgtatgtggtcggatcacgcattatcccgtaagcattgatgaagatctttgtcccggattttacatcgtacccgttgatcttcatgtctgtgttgctttctctgcgtagtaatggtcctactggatgaagtctcaatgtctccttgatagctgcttgtaggtaaggaagcttctgcaaatctgattctttgattaaccggttcgttgttcctacaaccgatttgatctcgtctctgatcttcgcgaagatatccggatggttgattagctcagtcattgtccattgtaaagctgcagaagtcgtgtctaagctcgccatgaacaactcctgcaaacgagagaccaaatattcttattaaggctaatttaacgaagctaaagaaaagtaatgcaaatagcttacaagaatgaagaacttgatctgattcatagtcaatctgagttcggcttttgggtcattatacgtgtccaacaagatatcgacgatatctttatctttctcttcttcctcattgctcttatcgttttcatattccttcagtatcttctcaaccaactcatcataccgccaaatagaggatctaagcttcttaccattcccaaacaaatccagatcccgcaatggtccaaatagctccatgaatccaaaccttgtggcgcaagccataatatcactcactatcttcctgatctctttgggaatattcgagttttggcggcaccttttccccataaccatctttgataagatctttgtggtcaaagcagtgaactccaaaccgagatcgcaagcctctccgtttcgcgacctctcaaccagcgtgctcagtaaagctaacgtttcctcttctcttatgtcgacaaatcgatcaagctgataacccgcgaatagcttagtcatgcatagcttcttcatgaacctccagtaagatccataaggtgcattaaagaactctgatcctttataaacattgaactgtctcggaccaaacacaaacttggaagcgaaatcagggtcgtgagtcttgaggattagcttagctgtgtcggaatctgagacaacgaggactcgtaatgatccgatgcgtatggtcatgagaggaccgtaagtatgagccaaggcttgaagagatcgtggtaggctagaccggaggagatgcatatgaccaagaacgggaagtcctcgaggacctggaggaagacctctgcggctagaggagctgaagagtctatggagaaggaagatggttacaagtgtgaagaagagatatgaacaagaagtataattcatatccaaattcaatgtaaacatatttgtttgtgctgattattgtgactgggatcaaacaagtataagacgatgttagtatataacaaaagctttatgtttgtttgaaaatactataaaaacttgtcttgttgccatgaaggatctaaaaatacatgattctttgatgatagtgaccttgacttaaaattgttaaattatgcattatgttcaattatgtgttagaatttattgaaaatcatataataaaacattacatttttcatcaaaaagataataactaggcctcataataatatgttattaatataatattattttattttttataaatgtaaaaatcgaataaataaggattacaagcaaaaaagtctctgaaaggaatccataaacctacaatggcggggaacacggaaatattggcgcccagataatcttcttctgtgaagcattttaagtcgccgactccaatcaacagagcccagttattccatattatcgaattaattagggttcagagag

SEQ ID NO: 1225 - DNA, 3000 bp, Unknown
  misc_feature (1)..( 3000): cDNA_ID_3061220_gDNA_ID_1620373_Annot_ID_155049 3000 nt of promoter + ATG
attaccttattatctcgccatttttatttctaatgcccgcactggagcttattaaactatttggtaaaaagaatcagtgaaccgagactaaatcgaccctaacagcagagatgaaactaacttcagttagatcgacatttccctttgtatagtatcaaacaagaaccggttcttcactccacttgcatttgttaaaatgtgtccaggtttcaaccatagcaaatgagctctcatgaggatgtagtcaatcttcttcaaaatcatgtgtttaatattttagacaagttatagatgagttctacacaatttccaataaacatttctgaggataaagaattgtttttaccaacgtagatgaatttaagttgcctgaaattcaaaacctcccaaaagaaagaataaaaaggtgtggaataagttcttgtattgtttctttatcaaaaaagttataagatggttctaacattttttacatctatgttatatgtaaactatgaataaactggaatgctttttctttttaaaacttttatgaaggctaatttgaatttttatgaaccaacttatcaagttgtaaaggatccaactttagtggtccgcttttgctgcctcagtgatgcttagtaatgatgactatattattatgttcttttatgcatcatcttgatagacttgtcacataatatccatttttctcggtttagtttggttcacaattacgatttattaatgtctaacgaaaccaaagcatttagacttggcgtgaacattagacattttacattgtggatcagatacagttgatcatcatttgtgaacataagacttgtctagtggctttcatagtgcccattataaactaattgggcctcattcacgttcattgagatctgaaagatgaattaagcccacactttggctcttcttcggtaacttattttatttatttgttcatagaaaaacagaaatcacttatctcaatagagccgtttgtgataaatctcttccaacggtcggatcgatttgaagatgaccataaactttgttcgatattttcttataaatatgaaccaaaatctaaactttctctcaaatcttatgtttgttggatagatcaattgggttacttaaatttggatgaacttttgagaagttgtattagatggtgaagacattgcctcagtatacatttccaaatgcttcaaggagatataacttgcaccggttatagcctaattatatacaacgcgtaattgcattacccaaacatattcaacgccgacatcttgactatatgatatgtattgactattattacggtccatgtggaaacagagatcaaatcgaatccgtctctctaagtctatatcactcactatatagtatgtatatgtatcactaacactttccatcaaaattcaaaaccaacaccatggataagacagcgacattgtgtctcttgttcttgttcacattcctcacgacctgtttgtctaaagatctctgtaaccaaaatgacaaaaacaccctcctcaagatcaagaaatctctaaacaacccttatcacctcgcttcatgggaccctcaaaccgactgttgctcctggtactgccttgagtgcggcgacgccaccgttaaccaccgtgttaccgccttaaccatattctccggccagatctccggtcagatcccggctgaagtcggtgacttgccgtatcttgagacccttgtcttccgcaaactctctaacctcaccggtacaatccaacccaccatcgccaaactcaagaacctccgaatgctcaggctcagctggacgaatctgacaggtccaattcctgactttataagtcagctcaagaatctcgagttcttagaactttccttcaatgatctctctggttccattccaagttctctctctacgttacctaaaatcttggctcttgaacttagcaggaacaaacttacaggtaaagaacgatcttttcctttattacatcattcagtgtcttgtctaaacaacgatctttatgttgtaggttccataccagagtcatttgggtcgtttccaggaacagtccctgaccttcgcctatcacataaccagctctccggtccaatacccaaatcattaggcaacatcgactttaaccggatcgatttatcccgcaacaagctccaaggtgatgcttcgatgttgtttggttccaacaaaacaacctggtctattgacttatcaagaaacatgttccagttcgatatctcaaaggttgatatccctaaaacacttggtatcttggacttgaaccacaatgggatcactgggaatattccggtgcagtggactgaagctcctcttcagttcttcaatgttagctacaacaaactgtgtggacacatcccaactggagggaaacttcagacatttgattcttattcctattttcacaacaagtgtttgtgtggtgctcctcttgaaatttgcaagtaaaccaagcttatctctaggattacgaaaaaatatatttgagtcaataatatagacaaatatgtaatgttattcggattgattaataaaacatgaaccaaacctctcatttgatgtattcatagcacattttcaaaatgttttatttgatggattaatcctaccttaatggaaaaacaggggaaatatggataacggaatctctgagtggtttggtatggtttctcgattcgatttgggtttatatccaaacttgaaaagtaaaaccagattggtttaaacaaaaaaaaaaagaagagaaaaaccctgatttccttattcttccaaattcccaaatttctcaaatcgtcacaaatataaattccaaaatttctgcaccgaaacttgtttaaaacgtggtctagtcagcaaaatcattactacatctgtatcgcaccatgcattcatagcctatatgtatatcaatcatagtttccataaaaactcaaaacacaaacaccaaaaacact

SEQ ID NO: 1226 - DNA, 3000 bp, Unknown
  misc_feature (1)..( 3000): cDNA_ID_3061216_gDNA_ID_1620373_Annot_ID_155051 3000 nt of promoter + ATG
ggagaagaagagaggaagatctcaggggagatgtggagaagagtggctattgctttgaaattagattgccgtagagtgtttgaggcgtttaaagagagagaaggcgaagaggaagaaaaagcaatgggtattgtgggttcggaatccggaggtgaacgtagagtggtggagatggccatgaaagctaaagcaatggagaggatgaagtagacgaagcaatctgatgaacaacaacccatcgcttcaaaagataaaccctaactgtttcttggagaagaagataggtcgtcaaagatatgttttcttggagaaaatttggattagcaaatagagtttttctatttcaccgtttgggttcagtctcgtcctgtaaataataggtcaacttcattttttttatggagagcatcaaaattttgagaagataattcctcaatttataaagcaataatcgaaatatttactgatttttgaaattgatgcaattttgaaattgatgcaattttgaaagaaaataaacattcttgttccatcacaaatactactagaagacaactctgctttaagacctctactttcctctagacttcttggatggttttcttttgctttcaatccttctctgggcagcttcaaattcttcttcagtgggctctgcttccgcatcaccaccatacctagagataagtgatgaaaacatcgagtccaccttccctttcctctcctcttgtcgtttcgcaatcatcaagcaaagatctgtctctgaatcctttgctgctgacctacaagtatatacaaattgaagcaaggtggtcacaacaaggttaagtttgattggtggaaataattaagaaacgaaggcagagattttacttcttcttcttcctcttcctcaatggactggtgggcggtttcgtttctgaaattttatttgcccatttctcatatgccttgcttgacttcacttctcctgaaaaggaaatcacacttgataatcagcaactctcccaagtttacatagatttcagatcaggatcaccaaactggaataaaaaaattagaatgcatatttaggtggaatatgaaccatcaaacacacagctaaagggatatggtacattttacactcatcctctaactggagaaggcacaatatcaaattctattgcgttatcaaaattcatagatgtacaaatagaaggcaagctcatcttataacgtcaaggattccatagatgagaagataatcttgtaagacgtatatactaaatacagaaagataaattacctgctgcaatggcctcatcaagcatgtctttgaaacggtgtgaatcaagcttggggtccgagcaaagcattgagcagaatagcctgggaagaaaatatatatataaatcaactcacaacctcaacaatatcgaaaagaaaggatgatgaattacctgttcattttacccttaaacttgttgaaaagctcaagcaagtctttcttctctgactcagatcccctgtagtttgcctcaaactcttcaatatcagcttcgttgacctatatataagcagcaacacaaaaaaaaaaagttagtgtaagcagcagaagcagatgtgtaaaaggtatcactagtgaaagtttctgctaccttcttatacatgtcccggaagaaatcccgcaaattctcaaacgcatctccaggaatatcctaacgagcatggaaaaacacctcaggtttaagaaaatctcataatactaatgaggaagttaagtgctttcttcactcgatcaaactgaacaaacacaacaaaaacagagactcacagcatcatcaattgagccagtttgatcatagactgcccttttctcttcatcaccaagaattgatatcactttttgcagctgctggaacttgtctttagcttcctgtaacaaaacaatagtagaatcttcatgtaaatgaatccaaaaaatatctcaagtaaaagagtgtgtatttaaccttatcatcctgatttttatcagggtgaagcttcaatgccaacttatggtatgcttttcttatttcctgtgaagtggctcttctttcaactccaagaacctttgagtaaagtgacagagagatattagttagtttctattgatttctgtctttttagctaatcgaatcatcctgataccaaaatcctaatcaaatataagatcactgatcaaaacctatgattagtgtttaatctacataaaaatttatatatcaaaacaccaaattttatgaaagtagacaaattccaaactattttctagaatcatgataaaccaaacccagaaaacaagcttaaattgaaatccctaataaaaccctaagtacgcgagagaaagagcagcgatcggaaagagaaatccgaaaatacctcgtaaagacttgtctcagaggatgggccagcattatccatctcaatctcatcttcttcggttgtcgaagccctagatttctttttcctacccatctctctgaaccctaattaattcgataatatggaataactgggctctgttgattggagtcggcgacttaaaatgcttcacagaagaagattatctgggcgccaatatttccgtgttccccgccattgtaggtttatggattcctttcagagacttttttgcttgtaatccttatttattcgatttttacatttataaaaaataaaataatattatattaataacatattattatgaggcctagttattatctttttgatgaaaaatgtaatgttttattatatgattttcaataaattctaacacataattgaacataatgcataatttaacaattttaagtcaaggtcactatcatcaaagaatcatgtatttttagatccttcatggcaacaagacaagtttttatagtattttcaaacaaacataaagcttttgttatatactaacatcgtcttatacttgtttgatcccagtcacaataatcagcacaaacaaatatg

SEQ ID NO: 1227 - DNA, 3000 bp, Unknown
  misc_feature (1)..( 3000): cDNA_ID_2045780_gDNA_ID_1620374_Annot_ID_155091 3000 nt of promoter + ATG
cttaatggaagatttactggaaaatgtctctatctgttatctagtattggacccgttaataatgtgcaacgtataatgtagggtactaaatcccaagaaaaatctagattttctagataacatatttaaccagaaaagaaaaaaaattgtagtggaatagaccagcatggttcaatctggtcgttactaaaactaccaatccaaaacctaccaactataatacaatatgactacaaatacggttttgaagattaattcgcggctaaccatcaaaaaataatgtttgacgatggctcatggttccactcgccaaccatatacagtttatattctcttttgagacctcaaaatcaagttactagaactcgatgatcttacatgaatataaaatgaaaatcagctccaatgtagtttgaagaaggtataaaacaggtttagaccaaccgattccaagacttatgatggcccacaacaacaaaaataactaacaaatttttagaccctacactactcttagcatgcatgtgacagcttaaacttaaatttaaacagttaacatgaacaaccccacttgcactaggaagacagcaaatagcaaacttaaagcagtttacgatttctggtcttttaaggcaaggtttagtaacccagtaattccttttgatttgaaatatatgaataaccgaaattaaaaaacaaaaaaaaaatcacaaaatactaaaatttgaaagccgaaataattcatttttcaatagttataatcatcttttaaaaagtaagttagatcataaaacctaatataaaacttttattggcaaaactaattaatcacgagaaaataatattaaagttagctcatgttatgtttatattaggaatctctcatttactttattttgttttgttttgtttctataatgatattaggattcaggaagacaataaacaaaatatcaacaaggaatcatgaaagatacattcgaacgggctcagatcgacgcagaaacaaaaagctttggaatgatttaataatacaaatttggcggaaaggtttgaagaatttatacttggcattctatactagcgaacgaaaacaaaagtttagtcaaatatttaggattaccaaaaaatcaatattcgtatacaaatgtgttttattataaaccatgatttttcataactttattcttagttgtttcaatttgttttctctcatttctcgttcctattgtagaaaaaattcctgattcttttttcttttcttttgttttcccatgtcaattataaccgcattagaaaaggttagcacatgttcatttgcacagaatgtagtcaatgtacaattcatctataatttatcacctttttgttaaaaatatttatagccatgttatatatattttatcatgttgtgttttaaactctagatttgttctttcacagtttatgggatttatcatttcatatatttcctcctatgagtaagatgtcatttttaaattcttaattaagaatttagaaatcaagtttattattttgttaaaatttataaattacgtatttttcctttattagtgagattaagatataaagagtctagcacactagagaaatgaaaacatacatatatctagaaagggtttataagaaattagtaaatggaatcagaacatgaaggagaagggaggggccaccataccgacgggaatgagaagtatgggacggacaagaaatcaagtgtacacacatgaaaaaacccaccacgtgaagatctcctattggtgtgtcttctcctaagtactaagtataaaccaaagtcaaaacacaacaaagacatattgcttgcgagccagcgagtgtgtccgagtgagaagagagtttgggacttcactgtttagagagcctcattcgctacctagattcggtttatccacgtggagagttcacgtagcttctataataataatacattatataagctgtttcggtaaaataatcttagagtttcacttcccatgcaaaaagattaaatggactactatattttctatatgagtgttttggaaataatcttccaagtttatggctatttagtaaaactcaatccaaaatgagaacaataacttttttttttttttttttgcaatgagtacaataaacttatgattggttttggggactagaaaataaaatagagacatatactttaagaatagttgatgagaaaataaaacttttttcgaagaaagaaaaaaaaatatactctggccccttacatattctgtcaaatgccattttattttctttattttgcttggtccatttctggattcctgaaatgaacacaccataattttcatgcccatttttgtcctcccattaacacttaccaaacaccaaacgtaccttccttcctttatatgtgtctctatgtctatatatcactcccaccttcaaatgctaggaaagtggacatcacaccatagtctgatagtcatgaatctcatcaagtagaaacctccaaagaaacagattgcgtttcctcttcttcttcctcctctttcgaatcttatattttcgtgtcaaaaaagaaacaaaatatgatgatatctaccgcaaaagctcaatgtttgccacttaaattctgtctcatctctcaagatttttgatcatctcacacttactccgttccgcattttacgccttttcttcaccattgttgcttctcgaatcgaaaccatattggttttgcagcattaatggtgcactgagtcttcttaaagccgttaacctttccctgccaaattctcaaccaaaaagaaaaaaagataacaaatgggtcacaacaagttgccataaaggtcccaacagaagaagaaaagagaagtttccccgtgttgctttgtcacaagcttcatcactatttataactaccttgccaagaagaaagcctaaaaaggtataacagtttctttgtctttagagatcatcaaaaagatg

SEQ ID NO: 1228 - DNA, 3000 bp, Unknown
  misc_feature (1)..( 3000): cDNA_ID_2045741_gDNA_ID_1620374_Annot_ID_155104 3000 nt of promoter + ATG
aacatctgtggaggggttgatcaagacaccagcatcgatactacatagcctcgcaagtgtatcagtcttcctgaaatgcctaaccatttttttgttagagagatttttgttgtttttgttgttatggttagtacttttactccgttttatagatggatcgggttaaatttgttcaatacataatgaaatgtctatctatgttggtaatttctttccactaaaatatttgaatttctttttacatgtatttattttcaactattaccattaatttctttattagaaaagtcatattcaacatgttttatcaaaactttctgtcaaaagatgatattagaactaaattcggacaatattttagataattcctcgtttgcgacgtaatacatgatgtcaaaactatgttacatttagtagtacttatcttgaattaaataaaattaagaaaaaaatatgaatggggtgttactatggcatatatctattacctctggatttcattctatatacaaaaatattattttaaaatgataatttacacgcgccaaatatgcgtaccagccacgaggcaaaaattactatataactttttttgaaaataaaaactaattttttgttttttcaaaataagatacaaattatacgtaattccttagtaaagcctgaaaaacatcaaactttattttggctaaaggacatcataaaacctactatgtaattgtcattaacgtttgtttaactaaccaaaataaattactgaatcttgaactataaattcgaatatagagaaaatatgaaattttgtaagtgttattagacatccaaattttaaaaccgcgtaaactacactacaatttaaaatcggagtatgtaacctacatagagcctaaccacctcctaagccgtatttaataacattgttatattatgtaaagatatgatatatatcgttaagtaatattatgtagtgaaaatccgtcacaaatcataataacttgtagtgatcaaacttcttgtatataatctactttgttctcgcgagcaccttaatcaatcatcccatttaaaaaatttctttttgctattaacatcttaaatgttaaatctatcattgagcaatgtaacagttctgtgtgaagaaacaaggaatcacttacttctacattgtctctttacaaaggaaatttggcacatgataatgcttcggtttgggcaatctccttatatctttgcagacttgtctattaccataggtaatcatataaaagttattatatatgaacaatgttcctatggtaatagaaattcacattttattaaaaaaactgatacgaataattcaaagaaataaaataacttttatatgattgtccataagatatagtcaaaacgcaaaagactttgctctaagaaatattaaaaagaaaaacaacaagacgaggattatttcttttcaataattaaaacattagtataaatacaatcacatgcttaatgtaataatgtgacagtttggccgagtggtctaaggcgccagatttaggctctggtccgaaagggcgtgggttcaaatcccacagctgtcaatttgtttttttctttgactcctttgttcatctttattttaaaatcaatataaacccttttcggacattctaaatattttgacccaacctaatgatattcattatttgtctaacgggtcaactttcaagtcttcaagtaaacatgatatggaattatatgggtcaactccaagtaagaacagtgcatgcatcttgaagacaaaattgatttttttttttgtttttaattaatggaaattttgaaatactaatgggtcaagatgaggttgtccaaatcaactgatatcatatatgaccagattcctcaatagtcattagtcaatacaaaatccataatcttttttaaaaatataatctttttattttaaatcgcctatttttttccattcatttgtccaatgtgaaaagccataaatcatatattaagaagttgtgaattgtgatcataggagtaatatttctatctgaacaaaaattgaattttgttttgctttttgttgaaagataaataaaatgtttggcagattgtttgtacagaacacaacttgttgataaaacaaattccatcaagacagctaatgagcttttgatagtcagagctttgaagacgtgttaatgaattaaactgattagacctaaaaccaaatatttagaaagaaaaaaatatgataattgttatgttatttaatcaatagtcaaatactatgttgagtaccaatcatttcagtttcaacgattgctactcttttgaccaataacaaaaaggtttttatttttcatttctcaaactccatttttgtttgtttttagcataaaaacagctagaatgtgagtttcatatgtattatatactataagaaatcatataaattaacgactagaacatattgttttcattctagtggtatatctgagtttgactagaacgtttggaggcagattaaagtgatttcgccttgtcaaaactactttgtatatgttatcaatcaatcgctcaaaactaaatcggaaaaaaactacataaataagatatggaaaatgatactaacacaaactagtaagtaagtagtcactacatattctggtcccatgaatatggcttacatagtacatacattgtgagattaaatgaatatgatatataatacaagcatataagcatgtgcatgactatgaagtgggaatacatttagtgcctttatatgcaacttgacagaattaccaattatgtgaatagtgaaacttatattgcgtcttggccttttcacatccgtgacatgatccctcaaatctatatcttcttgcggcatatgcttatatataaacatatgacttcgtctatagatttatatccagataattaattctctcataatatcttctccacaatttcaactcttctaaagtctaaacc

SEQ ID NO: 1229 - DNA, 3000 bp, Unknown
  misc_feature (1)..( 3000): cDNA_ID_2045715_gDNA_ID_1620374_Annot_ID_155111 3000 nt of promoter + ATG
gctaagtttgtccaaaagatcaagaatgaccaatattattatttagagtctttaagttcagcccaaacttaatatacactcaaatgtttcctttagctttgacatacccaatttttttgccagattcgatcgtgtatgcattagcttttttttgttgtggtttgagcaaagaataataagtacacagcttgatgagtttcatagcatgtcaactttgttggagaatactgcacttagataaacgttctttaacttcatcccaagctgcatattgtatatatcaaaaacaaggttaatgaatcacatcagatattcaaaagacaaagaaaaacatcaagattcaagggcataactaaacctggtaaatttctgaaatcaggttcaattccaccaccgttgatatccatatggttaggtgtgacatattttcctattgtcacaacaactcctgaaccatctcggagctcatacaccgattgaatcaaaccctgaaacccattaatcaaatgacatgaagatgatcaaaaacaattcaaaatcgatagattggttatgaaactagtaagcctttggaataacctttccataagttctttcgccaacaagaactgctttacagttatcatgaagtgcagaggccacctggagaaatatgacacaaatcatccgtttaacatccaaaaaaagaagagtttcccgtgggttaaatcttttgagattactcacaatttcactagcacttgctgttctgttatttaccattacctgcaacaataataaggattctaatcagtgcaagatgcaaaataacataatagtgtgaaagattaactggcttacatgattcatcacatacaataagtggggcagtgatcaaaggtttcttatctgaaacaacagttttttgagcctcggggtctctccccgctgtatatatcacctgttacacaattgcaacatgtaacataagtttaagccaatcgttatggaactcattcatgtaagttgaagcaagctattctgtttcatattcctgaacaacgattgacaatgttttaaaagttctaaatgaatgttgatttaccgtatctccttcatctaggaacagcttagcagtttctattccagcctgaaataaacataaccaagaaacgaagggctaagtgaaaaatcaagttcctgtaaattatttgtgagaagaaatggtcttaagttacaattgtagaatgaacctgcacaagtccaccaaggttatctctaagatccattacaaaataagacgcacccttgtctaggagtcgtttcattgctgcacatagtgaaaaggatgtgtactatttaaacacaagtagataaaaggatgggaccgaaagttgataactttgatgtaacaacatgaaaaggcttaccaatcaccaaatcttttctagccagcgcattgaactcttttagacgaatatacccgacagagactgttccattgtcaactttttccaaccggtaagaaactggggtctgtgcattaacttgtctctggattttcagagacttaacaggtccacacttcccatgcttcacctgcaatatgcttaaactacataaaaatcttgattccaaacttaaatcaagtactaatgaatttagtatgtatcttattattaagaataataaccttgagaactacaaaagttttactagggccttgtaacaaagacgatacttcaaaggatgatttcccactgacatccattccattgacagccagaatttcatctccctatcaaagagagagacattgcacacttttttaagtgagatcaacagcgaacgaaactacaagaaagaaactagaccggtttataacctgtttcacaccagcaatatcagcagcactgtccaatacaagaccaagaaccttcaactttacatttccaccaccatcagaaacttctctaaggttaattccaataccagtaatgtcatacttcgacatcctagaaaacttcaaacaagtgacacaaacaatgatatgagtaactgaaacaacttaagagtcctttctccatcaatcaaattcatagaatgtaaagaacaaaaacctcatctggtgataggaatcgagtgtattgatcacccaaactagccaacatgttcttaatcacttcatgagccttcgatctactcttaataggactagctaatatatcatccttctgtttctgcaaagtaacaaaaaaaaaattcaaccattacatatataaagcttcttcctttatctacccaacaagctaattcacacacctgccaagtttcaggagtccagctatggctacgagtatctagaaaggcaccattaacaatctcccaagcttcttcaacaatcccttcattagttactaactgaggctcaatgtcatcatcttgaatctcagtatcagcttcttcctcattaggacaatcttcaggagccgaatcgaagtgattcagagaagattcaaacgatgacgaaggaggattgacagagagataaggatcattagtagcagcaacggaggaaatcggcgacgagaaaacgagagtgagcgatagagctccggttagggttccgattaccgattttttaagaattttagttagacccgagtagtcaaattgagacggaggtggaagttcagggataaattgcggcgtcgacggtgatgacgtggcggataacggcgaggaaaatggaagcaaaagcctcatctttgtttaacggtcaagcttcaaaatatacgcttgtctgttatatggtgcaatgcaatagtatttacgcgtatttacatattagtcctcgtatttatgaaatctactaaattgtactagtttataaatttgtgatattaagcccaaaaattgaaagtgagagagggaaagagaaaaagagagcaatcgtactcaaaagccagaagcgagcgagagagaaagaaagatcatccttttcgtgttgaatcagaaatg

SEQ ID NO: 1230 - DNA, 3000 bp, Unknown
  misc_feature (1)..( 3000): cDNA_ID_2045731_gDNA_ID_1620374_Annot_ID_155107 3000 nt of promoter + ATG
ggatcactcttgttgatttaaccaccgcaacttctgtttagtaatacacattacaacatgattgaagatggcagtggaaaatccgcggttttggatatagttgaaccagtttaaaatttgttttttcttgggccttttcttatggcagaaattgtcaccttctctcccaagatgatgagaataaagaagttatatgattctttcatgtgtatcttattctgattgatactctggtttgaacaaaatctttcaaaagatgttaatgtaaatgttaagatttgatatttgttactctatttacttatattttttttttaatgaatttatctttcctccgttttaaaaatttattaaaaaatatatgtaagatgctttttattatttttactatgttgcacatatatacctatcaagaaacctgttcaactatggcgtaggtcaacaatctcattctcactttctcatatcttatagaatcataatcatttatgttagcatttaataggttttaatattttcaaataataaatattatgctttctcaatcatgacaactattcaaagtttcaaacaaagataatgagagaaaaatcctactcaacaacaaaaatcttgaagaagtttggtgtatccgtacatattccacgaaaattggtcgtaaatttcaactgcgaacatataatttttgtctctataaagattcatttttaatttcctttttatctcatatagacagagtggttgtcaggttgactgcatactgaggtaatttacagaaatgaaaatatactaaacctcttggatatgaagatgccagattatacacaacggttacagcaaattaagctgtgaacaagtgtatcaatatactatgggctgattttttttttatttttttttaagtttcaaaagccaaatcttttccaattaagctttaattatcttcctaataacagccccaaaaatgttcctaaatgtgttttaaagatgtttgcgtttttgttaagccaacaaaaatgtgaccttattatttttgaaatgtgttttttagaattgactaattttgttcggtgcattgcccaattaaatttgcattgtattcaaaacaactagctagtagttattgaagttttggtcctttgagcatcatggctgagttgctttaatttctttgggccatcgagaatcttgaatcgtagttttgtcttgaaaacgtttttcatcattattcgcatttttcggaaacattagaattgcaatttaaatctttatatcatttgtttttttgataaagggacaagggttagcaaactttttaatcaagtattcctatcagctgcatgcataatgctttttttcagatcgcatgaagctgagattcgtaatttgaacaaaaaaatccagacacatgaacagtttataagtatacattattatataggtataaatctataaaaggaaaataggtatttgactgtacctatgtaaagtcaatttctgttcacttctcattgtcattttcggttaggaatcatgtctctctctctctgtttttttctttttcatttcctatatattttcgatcatgtttcacatttttatcccaaaataaaataatttgttttgttgacaaaaaaaaaatgtattaaatattaaagcattgatatttgaccgtagttcatatatttagttatttctattactctaacgttcctttaatgtttggggaaagttctaatgtgaaaactgaaaagagattctgcagcgtgaatcgtgatgacgttggtaaatcgtcagtatttcgatcatatttctcttttcaacagataaaatctaaacctatacataatgcaaaatgattcatataatctttctttaacgtccttgctattagccaagcttattacaatatgaatcactttaataaaggatttaagcacctgataagaaatttcattttgtatattgttttttataaaaattaagattttcatgtaaattggttgtaactaaggtcgaaattacacgggaatataatgtaatgtataacattgtcgcatttgcaccttgactttggtggaatattaaattgatagactaacgtctgatatttattagggtttgagaacacaaatccagtagtccaccacgtgccaggtaatgtgtcggttacggtcaaatgccggtgccaataattacacgtgtcatcctaataaccccacaattctctttgactttttgacttggctcttccttcttcacataaagatgaccggagactgactatttccggttaccggttaactattagtcagcatcatcgccttcttctacaacaaagcttgttcccaccttattccacaatctaaaaaatggtaaataactaaacatttacttttaagacccaaacatctttaaaaaggtaaaaaaataaccatcttttcaggttttacttggtcagagtcagacttaaaagaagtttctttatgatgataaaatggcttttccttttatgttcatgttcacattaaacgtttaagaaacaaaatgacaagtatatgtttcctcactcgaggccacttttgtaactctcgatttgggaggtaaaacgcatcttgtcaactcaactttataaaagttatcattattttaaaaatacaataaaagtcattcaaaccccaaaactctttttgaatcattcacacttcaatactctttcattcaaccttagatttgtatatatctaagacaaaataaaatatgctaaaacgccatttactatatttatttagcaagacataaaataatatatattttcaaaaggcataaatacgagaagacccaaaagtcttaacaccaaatttagaccgactaaaaaattcattaacgtaaaaaagttcttgtttctttctttcttttcttcttcttcacgctcctctctttgtcattttctttttctttctttttggtttaagttttttctctttgttcttcgtcatg

SEQ ID NO: 1231 - DNA, 3000 bp, Unknown
  misc_feature (1)..( 3000): cDNA_ID_3061240_gDNA_ID_1620374_Annot_ID_155113 3000 nt of promoter + ATG
agctggactcctgaaacttggcaggtgtgtgaattagcttgttgggtagataaaggaagaagctttatatatgtaatggttgaattttttttttgttactttgcagaaacagaaggatgatatattagctagtcctattaagagtagatcgaaggctcatgaagtgattaagaacatgttggctagtttgggtgatcaatacactcgattcctatcaccagatgaggtttttgttctttacattctatgaatttgattgatggagaaaggactcttaagttgtttcagttactcatatcattgtttgtgtcacttgtttgaagttttctaggatgtcgaagtatgacattactggtattggaattaaccttagagaagtttctgatggtggtggaaatgtaaagttgaaggttcttggtcttgtattggacagtgctgctgatattgctggtgtgaaacaggttataaaccggtctagtttctttcttgtagtttcgttcgctgttgatctcacttaaaaaagtgtgcaatgtctctctctttgatagggagatgaaattctggctgtcaatggaatggatgtcagtgggaaatcatcctttgaagtatcgtctttgttacaaggccctagtaaaacttttgtagttctcaaggttattattcttaataataagatacatactaaattcattagtacttgatttaagtttggaatcaagatttttatgtagtttaagcatattgcaggtgaagcatgggaagtgtggacctgttaagtctctgaaaatccagagacaagttaatgcacagaccccagtttcttaccggttggaaaaagttgacaatggaacagtctctgtcgggtatattcgtctaaaagagttcaatgcgctggctagaaaagatttggtgattggtaagccttttcatgttgttacatcaaagttatcaactttcggtcccatccttttatctacttgtgtttaaatagtacacatccttttcactatgtgcagcaatgaaacgactcctagacaagggtgcgtcttattttgtaatggatcttagagataaccttggtggacttgtgcaggttcattctacaattgtaacttaagaccatttcttctcacaaataatttacaggaacttgatttttcacttagcccttcgtttcttggttatgtttatttcaggctggaatagaaactgctaagctgttcctagatgaaggagatacggtaaatcaacattcatttagaacttttaaaacattgtcaatcgttgttcaggaatatgaaacagaatagcttgcttcaacttacatgaatgagttccataacgattggcttaaacttatgttacatgttgcaattgtgtaacaggtgatatatacagcggggagagaccccgaggctcaaaaaactgttgtttcagataagaaacctttgatcactgccccacttattgtatgtgatgaatcatgtaagccagttaatctttcacactattatgttattttgcatcttgcactgattagaatccttattattgttgcaggtaatggtaaataacagaacagcaagtgctagtgaaattgtgagtaatctcaaaagatttaacccacgggaaactcttctttttttggatgttaaacggatgatttgtgtcatatttctccaggtggcctctgcacttcatgataactgtaaagcagttcttgttggcgaaagaacttatggaaaggttattccaaaggcttactagtttcataaccaatctatcgattttgaattgtttttgatcatcttcatgtcatttgattaatgggtttcagggtttgattcaatcggtgtatgagctccgagatggttcaggagttgttgtgacaataggaaaatatgtcacacctaaccatatggatatcaacggtggtggaattgaacctgatttcagaaatttaccaggtttagttatgcccttgaatcttgatgtttttctttgtcttttgaatatctgatgtgattcattaaccttgtttttgatatatacaatatgcagcttgggatgaagttaaagaacgtttatctaagtgcagtattctccaacaaagttgacatgctatgaaactcatcaagctgtgtacttattattctttgctcaaaccacaacaaaaaaaagctaatgcatacacgatcgaatctggcaaaaaaattgggtatgtcaaagctaaaggaaacatttgagtgtatattaagtttgggctgaacttaaagactctaaataataatattggtcattcttgatcttttggacaaacttagcttcatggccattcttgatcttctggacaacctccaacggatttttatttcatttttttctagtagataagccataagatttttagtggatcccaaaagggcggtgactcacccaaccctctgaagacgaactccacgacggccacacagattcataggaaccgttgttaaccactgaatcaacactgcgaaacccaccaaaacgccaccaacttccgccataacaaccacaacaagagaaacggttgagccctgtggaaccccgaagcactccacgaagtcctcaaccgcgaaccacgccttagagcctccacatgcttaccaccagagcagcgactacatcagtgacgaaaccacaccaccaaagacggaaaggcgcccctaccaactcctgaaacataaacaagaagcttcaacccgacaatgaagatcatggaagcataaaagtaaaaatagactgacaacggatggcgggttaaaatctagtaaaattttatgctcaaatctaataatccggataaatctatttaaattattttagagttggggttaaaaaaataaccataaatatcttaacaatttgtgaaaattcaccctttgtaaagtagcattcatagtttcatacgaaaacccaacacctggaaaaaaagaaaaaaaatctaagtcttgtctaccg

SEQ ID NO: 1232 - DNA, 3000 bp, Unknown
  misc_feature (1)..( 3000): cDNA_ID_2045750_gDNA_ID_1620374_Annot_ID_155101 3000 nt of promoter + ATG
aagatggtgaaaaattaaagcaaagacttttgacgtagaacaacaccaattcatgagtagacatttaacttaatgcgtttgtcacttacttggcacaatacattatacatctgtcgaaagggttttcactttattatcttctacctctaaaagaattatcgtcgtaaactctagcaaatactcttcttcatttcaacaatatttatgaaaataaattaatttctcatttctctttggcaaatagagccaaaattttggcattagatggagaaaatcaaattcagtcagttgaaatatttgtgacaaattactataatgttctagagcttcctaatcgggacattggtggtattactattaataaaaacaaaagataaaatcaaagacctatgtaaagagcaacatcaacacaaaatgacataacttatataagcttacgtaccaacataacttaaataagcttataagagcgtatatgcgtttgagtaacaacatatatacaatttcataaatgtcttaaaatgtgtaaactctttttctatttaataaaagcttaccacgtacgttcagttacaacaacgtattcaaatataattactaaatgtatcaaaaagttcatccattcacgctaaatgtatctgttaagttattataagtccgtccatccacacgtattttctgttgaagtgatttttctcttcaatatatgcattaaaaatcacatataatatatacatatatctactactttcaaaaagaaaatacttaaaacccccatcaatggtagtagataaaatgaaatatttttgttttattataataaattgtgtacaagttgaaaaattaagtatcgtgtgtgtgtgttattaacccacctgacacaccacatctataaatagagggagaactttgcagaaaaattaacaaaagaaagacctagacataaaagtttccactcttgtgtcttcttcattccaagaagaaatcaagaaatggatcatggagaaatgagcactaaggaaactaccactttgaagcttatacccgggtacgaaaatgtgatggagctcgagcaaagaagacaagagctgaaggtaagtctttatttgaattgattctatatttttatatacttttttttgtctacaagtattaagattatcgttaaaaattaggctgtcgagaagaggatggaaaatgttattggagaaaaagagattgacgatctaaacttgacagaattaattgagttcgagaagaagcttgaagatatccaaagtctacagttgaaggtaagtagtgctcattttatcactctttaaatttattgtttatgtttataaaaatctattttttaattgatttgtgtagaagttggaaaagattccttggaaagacatgatacagccagccaaagatcttgtagttctgaacgaatatgtcaagtttaagattggagaaatgcaggctaggatttccatgcctcaaaacgacgaatttgatattaaaatggaagtaggaaaaaaggaagatttgaaggtaaaatgttggttaatttttgttttttctttttatatgtctacacaacattaattataacttcttaaaaatatagggtttgaaaatgaggatgaaagtgttcattggagaaaaggagtctgaagacatacacttggaggaattgattgagttcagtaaaaagcttgaagctcttcacccaaaggttagtagtgtttaacattttttttcttattatatatgtttattttggtctgcaaattgttttctaagtttccctttttaatttcgtgaagagcgtgatgcatttggacgacatgacagaagaaattaaagatatattcattatgaaagaaattgtgaagaaaatgatcgcgaagagggatcctaactcgtctaaaacgatgatcatccagaattatttttaattagaaattagtaacatataaattcattatcatggatcatatatgatcactttgtcgcttgtttctcccattacatatttacagaataatttgggattattttaatatcaatggaaggaacttatgttgttattttatattttaatcggattttctcataattaaaagatatttttttctaatggctattgcataaatttcatactttggttttcaaagtttatgtgtacatcgactactatgttaaattttgttttatatcaacttattgtaaataagttataaaaacatatgagatgatcgcctaaaggttacaaattataaaacatggtgtgtctttaaatgcgtcaaacataggattatgcatttttacaaaaaaaaaatgtttgaaattttttgagtcgtcgttaaattgatccaatggatataaaaagaataacatacaaaagagtttggtaagaaaaaatttagttgcggttttcgtcaaaaagacatagaaaatgtaatatagcaaagacttttgccgaagaacaacaacaacatggtaatacattattactgtctttatgaatttcacatactgaacaaacatctatatatggaagaaagggttaacaagaacgaagaaaaagagcaaatagaaattagacatccaataatgaacttagtccatttatattcgtttattgtgataacgaaaatattttgtttttataaagttaaattcttaatacttcataatcatttagagccattagcgaaggttaagatttttgttgttgttgctgttgtgatcgaatcttggataacctctgtaactaatcaatgggggtccaataaactgtatcaaaaccggaataaaccgaacaaaatagatattttattgtagtaattaaatgaagttactgtacaggcttaaaccctaacggtctaaccaacgcaatatttaattttgttatactgactaaacctcgaagttagtgcctttatacgttcgtttactattccttaaagtgattcttctcattccctttctactcgttcatttcaatcc

SEQ ID NO: 1233 - DNA, 3000 bp, Unknown
  misc_feature (1)..( 3000): cDNA_ID_2045772_gDNA_ID_1620374_Annot_ID_155094 3000 nt of promoter + ATG
attgaagaattccctaacctcgagaatcttgttgagcttagcttatcaaaagaagagagtgatgggaaacaatgggatggagtgaaggtatgtaccttctaaacttaacgttttctccaacctctttaactaacacttttatatatataaattattgtcgattcgtacatgaaatgatgtatattcttctatatagtactagatccggccataacacgaaaataaaatcaatgttgtttacatttcacaaattatgtttgacacttagattaaatattatgttgttaacattaattttacaaaactctgttttcattcagccgcttacgcccttcttggagatgttgtctcccactttgaagagcttgaagctcgagaatattccaagtttggtggagcttccttcctcatttcagaatctcaatcaactgaaggagttgagcatcacatactgcagaaatctggagactcttcccacaggaatcaacctcaaatctctcaattacctttgtttcaaaggatgctcacagttgaggagctttcctgaaatctcaactaacatctcagttctcaatctagaagaaacagggattgaagaggttccttggcagatcgagaacttctttaacctcactaagctaactatgaggagttgcagcaagctaaaatgtttatccctaaacattcctaaaatgaaaactctgtgggacgttgacttttcagattgtgcggcgttgactgtagttaacttaagtggctatccaagtgacacactttccgaggaggaggatgatagtttggacccctttctcgatttcaggggctgcttcagcttggatccagaaactgtccttcaccaagagtcagttattttcaactccatggcatttccaggtgaacaagtgccatcatatttcacgtaccgtactactggaacctccaccattctccccaatatccctctacttccaacacaactctctcaaccattcttcagatttagggtttgtgcggtggcaaccgctttcaatatagtatccatccaggtaaatagtcggttcacaggcagatttgggaacagctttgatttctttggtgagggacatgaactcatggaaatacggaagggtgatatgttgatatttgactgtcgtatccctttcaacgaagataatgctcttctagctcgaggggactacgatcacgtggatatgaatattcatataagtggagattcagaatctacgttcgaattaaaaggatggggtatacgcctcttagaggactgttcatcagtggagaaccgacttgttaatccaacacatgcgtatacacctgttcaaggacttgttaatgagattgaacacaatgaagactctggagataacaatgtagagactaagagaagcgcgaagcgaatgcgggtaagcattaagaatgaacaaaacataatattggttatcaggatcaacagaacattttaattgcttatgtagatttgttttgtttttcagatcacgtaaagactcaagaaacctatgacttgcccctacctctatacctaggactgggaggaacacatgatgtcactttcaatctttgatcttgaatgttgcaatgaatagttttgccggttataatggtacaacaagatcaaaggaggacatgcagcgactgatctctagtatctccctagctagatagacgttttcaggtaacccaaaactcataaaccatgtttccaacagatgttgccaccgacaaaagagttgatttcaattggtgattatatacgatgcccttcagtctctattttggtcttatgtgcttataaattaagttgttgggtatttcaagttgtcaagtcagataatgtattcatggtcattaacttcctgaatattatctgattgttttaggttcaactcaagataaaattgtatgaaatcagattggtatatccgtatattttatatagggctttcactgattagtgaacatgtttttgaatcccatgaaagcaacaggaacaatggaagaagaggaaacaaagcaaagtacatgtatataggtgttattagatctataaatgtacattattatttttgaagaactatatacaaagtttcttacataatccattccacaaaaattcgaggaagtcaagtcaggttggtatatgcctctgtttcaggcccgtgaagccatttttcgttctattgtgtatagaagtagccatgcttagctagtggtgttttcttaatcttttgtaaaatcgattttaagtactttatccaatgatattttgaggacttttgcggaattaaatatcacatatccaggattttattgaatcagtctccacttgtaattttatactctagacttttttttttcttcattgagtagatgtcgttagaccaaaatttaattgataaattgtaaaaatattaaatccaacaagaaaatgacatataggtggaaaatgttttaagagatgtccttgtgtcacactcttgtcttctttcttttcataatggtgttttcgtcttctttcgttcaaattaaatatgagtcgagaacagaccacgaccataataatattaatttaagtccctttgaatatgcataaaattaccaaccataattgcaactcttgcttagggtttcaatttcacaataacgatgagaaaatgagttgacttcttctttttgagttgcttcttagttgttctaacttcacaaaataactatattatacaatttaaactatgattttcctttggaaaacactaaattacaaagctatatggatccaccaatgcctatctttgctctcgtagcagaaagactcgaaatggtaccaaaaagtctacgttagacactctacaagattgcgacgcgacgcctcactaattctcctctaatttccttcttacaatctcaatctccaaagtctttgttcttagttttctcctcctctcactctttctctctatg

SEQ ID NO: 1234 - DNA, 3000 bp, Unknown
  misc_feature (1)..( 3000): cDNA_ID_3061255_gDNA_ID_1620374_Annot_ID_155095 3000 nt of promoter + ATG
tctgaccaagaaacaggtaaaaagcacacaaaagcgtttccacatttttttatcaaatgctaaaatcaaaatttgaaggaaggtcaaaagtgctatttctcattaaaatcaaattctcattttcatcaggggaacgaagactagaagctggtgcaatggtcctcgctgataaaggtatcgtgtgcattgacgagtttgataagatgaatgatcaggaccgagttgctatacacgaagtgatggagcaacagactgtaacaattgcaaaagccggtatccatgcatcactgaatgctagatgcagtgtggttgcagctgcaaatcccatatacggaactgtaagttctcaccgaagttttcctaatctacttactctactgactagtatttttttgtcctaatacctactcttgctcctgcagtatgacagatcactgactccaacaaagaacattggacttccagattcgctgctttctcgttttgatctactgtttattgtgttggatcaaatggatgctggtatcgacagcatgatttcagaacatgtcttgcgcatgcatcgttacaagaacgatagaggtaggaaacaaatcatgcttctatgttttactaaacatttcacaacccatgtcttgaaacgcatctgacttttgagtgaaccataggtgaggcagggccagatgggagcttgccttacgcgagagaagacaatgctgagagtgaaatgtttgttaagtataaccaaacactacatgggaagaagaaaagaggccaaacacatgataaaacccttacgattaagttcttgaagaagtacattcattacgccaagcaccgtattacaccaaagctcactgatgaagtgagacagtgaactcaaatatataaatttttatgtatctgataatctcttccactaaatctcttttgttattaaatttgcaggcatcggaacgtattgcagaagcatatgcagatctcagaaatgcaggttccgatactaaggtaatttatttcataaaataacattggacactgtatctttttcgtcttgggaacttgtatttgacacaaccatcgaaatctctgcagactggaggtacgcttccgataacagccagaactctagagacaataattcgtcttgctacggcacatgccaaaatgaagttgagtagcgaggtaacaatctaactcaaatcttctgtttccccacctggtcgtgaatatgttctattcagattctttctaaagtgataactttattttgaaaggttactaaagctgatgcagaggctgccttgaagcttatgaactttgcaatatatcatcaagaattaactgagatggatgatcgtgagcaagaagaacgtcaaagggaacaagctgaacaagaaagaacaccaagtggacgtagaggcaaccaacgcaggaataatgaagatggagcagagaatgacactgcaaatgtcgacaggtaaactaatttgatctcctccatggaaacctatatcacagctttctcaacccttatacttttttctttctcttttgctggtccattcagtgaaacagcagatccaatggaagtagatgaaccttctgtagagcaattcagcggcacggtctctgcagcaaggattgaaacctttgagcgagtgtttgggcagcacatgaggacacacaggctcgatgacatctctattgcagatatagagactgttgtcaacaacaatggggttggagcatctcgttactctgcagatgagattatggctctcttagaggtaattcacaaattaagagacaagctttctcattctttaactttttatacaatatcttcataactttactctattgtggattttatgcagaaactgcaagatgataacaaagtgatgatcagcgatggcaaagttcatatcatttgatcatatgaagaaatcaatattgattgcatcatcatcatcatattagaactcaaaaatagtgtagtagtaaactcttggaaaccaaaatatcattttgtaaaatctttattcatacgttatgttttttgcatttactagtgaagtaaaactgatgataaaatgcttaaaaaaacgcatctgattataaaatttggaatttataacgaaaagcacaatccgagaataaaatactttcatatttatcctataatttcttgagctgtttatgccaaattttatacatatgtaatcgacatcaagattatagtgtatatgttgttttaacccaatggtaagaatagagttgtgccatatataagccaacttcaaaaccctaataatcactaccttggaactctctcgtctaaaagatccatgtttttccatttggtctctattactttttttttttttttccaaaacatgtttgctttgtccatgatggatcctatacgtttctaaaattgtacatataatcaggttaaattccacaaagacggattgaaatcagttttggtatacagagtaatacaacaaaatctatttttttttttgttgccaaataacaaaatctattttggtaggttactgcacacgtttctctatcaaccctagtcaaaacaattgagttactaaataaacttacgtagttaggccatacatgtctctgattcagaccagagcttctcagaaatgttaaggccatgagcaagagaaacttgtctccactctaagaattctaaattcttaaagtaatcataaagtgagacgtatgtgtagtaatgtaaggggataagacattagaggctatgaaacatttgcttatgaccttgtacaaaagatgattaagacatcaaattggaaatatccgtcaagttgtgtctgaaacaatagtgaaactgattagtgaagacttttgtggccgtgtttaatatttttatataattaaatcaccaagacgtacgattacaatcttaatctccaaagtctttgttcatagtttcctcctctcattctctctatg

SEQ ID NO: 1235 - DNA, 3000 bp, Unknown
  misc_feature (1)..( 3000): cDNA_ID_3061248_gDNA_ID_1620374_Annot_ID_155099 3000 nt of promoter + ATG
ggttcttggctcactttatctattttttcgggcaaaattggatattataaattcagacggagaagacaagatcaaggaaagtaaaagctcaattgttctaaaagcccctaaatgcttacaagttacaactattcacttttttggcctcgtagttctattccctcaagatttaagcctcccgtaaaataagacatttcactttcaaaatgtacaattgtgctgggtgtattaggtttgtagaaaaaacaattgacttcaggtagattgtaattgtagtgctaagattggcaaagtaacgcgatagcatctttgtgactcgtgaatatgtaatgcattgtatagtgtttgttttacgaaaatatgatgctctgtaaaatagaatggcaacatgctatcaaatagaatggtagcatgctatcaaataaaattccattgaaactcatcaaatttttgtttggaaacccctaactatgttatattgcaaatcaatgaaatatatgggataatttcatgttgtcaattatttactctctaaatttttatttatcactttctttacatcccgaaaactgccaatttgtcaactcgaatttgtaggtaagaaaatcttgcgaaatttcatattttatgtagttttaaaccgtgtttgattgtcaatgaagtaaaaaattaacagatctgttattttttaaagttgaaatcatgtagacaaattacctataaatgtaacaagtaaccggaaaataaatactggaaatgcagttaaatagagttgggcaaggtgggtgaaccggtattcacgtgggggcattgatcttacaatagccaagtcaacaatcaaagttgtaagtagaaagctggtataagttgttcaccacccgagtttttttcttctaacctttcatataaagtcttattgtcttatgttacttgtttaaatgagtatgtacaattgtcactattcacacccaaaaaataggtttataatttgatcgtttcaaacgtaacttttgtgtttgtatttttactttcatgtgaattttacttttacatttttgacttacaattgtcactattcacaaaaagtaccagttcgttaaatttgcttcggtgcttcaccgtaatagcagccaaatccacatttaaatataaatccgttttggttcaattttgcttagcgtcagccgtcaactacgtgactcctgcatcattctcttataacaaacataaaattttaagaaatgaaaatcttgttttctcctacgtatatgtaatgtatcatagttttcagaaatatataaaagtagcattttaacatgtttgagcaaatgtaatacttttgtgtcttaaaagtatactatcaaaattagacgagaataaatgaaaattgatgttgagaattatcattgggtttttattgggccaaacccaacacaatttctataaacccaaacaatttgagaatctgaaagaatatattccacacaaaaaaaaaaaaaaattgttattgaatgaatctagtgcacgactggctaatctcatgtctattaaggtaaaagtagggtctctcctatacaaaaattgaggcaaactacgaaatcaggagactagaagtagacattctccgataactttgagaccaaaagcgacgaattgttttatagcttccaaaactcactggcttgcactatttacgtaggtacaaatacatttgactttttacaaatacaactctacattgaatttttgactaattcaacatccgttcgtatcagtcaattctacattacattgactcaaattatactaacataatttgcccgccaaaaaagactttgaccctttatataaactattgagagaaatttgagaatcgacttggttggaatcattacaagatgactagaacttattactaccaactctagtttagagtttcatacacaaacaaaaaaattgcatgaaatttgatcagcccaaaaataactcaaagccccaaaaaataagttaatgaatgaacgtcacgtgaataacacgtgttggttttctcaaaaaaaaaaaaattttttctcaattctcgtaaaacctaattttcaatttcttcttccttttgttaatgatgataaaatttgcagttttgagttatctatactaacagagttaaaaaaacacaaacacagagatgaataagaaactttcatattgaattgaaggaatgaaaaaacaaattttacaaataaactagatatacaaaaaaaaacagagttacaaaaaaatcaaaactaacttttgttagaatttacaaccacaacagaggaagaagaaagcaagcttggataccaaaaccatagcctcgatgatagacatgattctgtatctcaaagtttccaaaaacgtcatcttcagattcaatctcttccactttagccctcctccaagtcccaaaaatttcaatctcgtcctttctttagtcgtcttccatatcgaaagcttcccttttctcatcatcttctcaaaattttgagctgcttcaaaaaccaaaatgtaacaaagaattagggttctgtttttgtttcaggtgttgttgttataataaagtcttcgaagagtttattttttatacaagctaaagttgagggtattttggtagttttcacagtcatagattcgaagcgcgtttccatgatatcaacgtaggtgttctgacgtgggagcactctgtttctccaaagaatttcgtggatatattttttaactcctttatatagataatagatttgtttttatatatacataccagttgtttttactgaatttattcttttttagtttcaaatgattatcctaattcttacttcttaggaatgtataaaattacgaatttttttaacgtcagattgatcggaaaaagattgtttatttctgctaaatttatatacacacagcccaagttttttttaatggaagacatacattacaatattggaataattgaagccc

SEQ ID NO: 1236 - DNA, 3000 bp, Unknown
  misc_feature (1)..( 3000): cDNA_ID_3061251_gDNA_ID_1620374_Annot_ID_155097 3000 nt of promoter + ATG
ttcattaacttattttttggggctttgagttatttttgggctgatcaaatttcatgcaatttttttgtttgtgtatgaaactctaaactagagttggtagtaataagttctagtcatcttgtaatgattccaaccaagtcgattctcaaatttctctcaatagtttatataaagggtcaaagtcttttttggcgggcaaattatgttagtataatttgagtcaatgtaatgtagaattgactgatacgaacggatgttgaattagtcaaaaattcaatgtagagttgtatttgtaaaaagtcaaatgtatttgtacctacgtaaatagtgcaagccagtgagttttggaagctataaaacaattcgtcgcttttggtctcaaagttatcggagaatgtctacttctagtctcctgatttcgtagtttgcctcaatttttgtataggagagaccctacttttaccttaatagacatgagattagccagtcgtgcactagattcattcaataacaatttttttttttttttgtgtggaatatattctttcagattctcaaattgtttgggtttatagaaattgtgttgggtttggcccaataaaaacccaatgataattctcaacatcaattttcatttattctcgtctaattttgatagtatacttttaagacacaaaagtattacatttgctcaaacatgttaaaatgctacttttatatatttctgaaaactatgatacattacatatacgtaggagaaaacaagattttcatttcttaaaattttatgtttgttataagagaatgatgcaggagtcacgtagttgacggctgacgctaagcaaaattgaaccaaaacggatttatatttaaatgtggatttggctgctattacggtgaagcaccgaagcaaatttaacgaactggtactttttgtgaatagtgacaattgtaagtcaaaaatgtaaaagtaaaattcacatgaaagtaaaaatacaaacacaaaagttacgtttgaaacgatcaaattataaacctattttttgggtgtgaatagtgacaattgtacatactcatttaaacaagtaacataagacaataagactttatatgaaaggttagaagaaaaaaactcgggtggtgaacaacttataccagctttctacttacaactttgattgttgacttggctattgtaagatcaatgcccccacgtgaataccggttcacccaccttgcccaactctatttaactgcatttccagtatttattttccggttacttgttacatttataggtaatttgtctacatgatttcaactttaaaaaataacagatctgttaattttttacttcattgacaatcaaacacggtttaaaactacataaaatatgaaatttcgcaagattttcttacctacaaattcgagttgacaaattggcagttttcgggatgtaaagaaagtgataaataaaaatttagagagtaaataattgacaacatgaaattatcccatatatttcattgatttgcaatataacatagttaggggtttccaaacaaaaatttgatgagtttcaatggaattttatttgatagcatgctaccattctatttgatagcatgttgccattctattttacagagcatcatattttcgtaaaacaaacactatacaatgcattacatattcacgagtcacaaagatgctatcgcgttactttgccaatcttagcactacaattacaatctacctgaagtcaattgttttttctacaaacctaatacacccagcacaattgtacattttgaaagtgaaatgtcttattttacgggaggcttaaatcttgagggaatagaactacgaggccaaaaaagtgaatagttgtaacttgtaagcatttaggggcttttagaacaattgagcttttactttccttgatcttgtcttctccgtctgaatttataatatccaattttgcccgaaaaaatagataaagtgagccaagaaccataaggcaagtggcttgtcatctcttatcatgaacacgagagttcgactcttgtttttcctagtggggcagcaaatggtcccgtcgaaataaaaaagttacattgaagtatcattaaacttgtttgaaatgtttgtgaactacaaacagtaaaattactaaattaatttctaagtaaacaattgggacaaaatgttgtattattgtatccacattgtataattgttaagtattatcatccaattcaaatgtaaacgttgttatttaagattttatttccttgtggactatatattcaatccaactttctaccaaaaaaaaatatattcaatctaactaaagccagatcactcaaaaatgaaaacaataaaactgaataatattctattaataactaaaaaaaccaatttacagaaatccgaagctaaacgaatgaaaactgaaaccaaaatgtgtgtgtaaatgttaatttgagtataagaaatctatttttgaaatctaaaaaccaaaggtgaatttgagccaaccaatacgtaaaaatccgatctaaaagatattgtaacagtaaacgattctatgttttcgaaaaatccaataaaaaaataatcgagttcaagctaaaactgaagacaatcgaattatgatagcgaatagatccattcttcgattcgtaatttttgttgagttacgaattggagaatggctcaaagcatccgtacctattttaagtagaccaaatagtagaataacataaactacaaggctagaactaaaacacttgtaaaattaagggacttagagaaaaattacagtccaaaaatttcctcgaataattcgctgttttttttataatatagtcttgctcctgaaatctgacgaacataagctcttttcgcaaaacacacatcacacaccattttcacaacatcgtacttatcgccttcctctctctctcaatacctctctcaatttctggatccaccatg

SEQ ID NO: 1237 - DNA, 3000 bp, Unknown
  misc_feature (1)..( 3000): cDNA_ID_3061259_gDNA_ID_1620374_Annot_ID_155093 3000 nt of promoter + ATG
tagttttttttggtagggattaacttcttctagctcgtggtaattgttttatatatcaaatatatattttactaatatatatatatatatatatataaataatactaaatatgatgaattaattctatggtaaaaatgtcagtagaagtagctacactataaactttggtatgttatgtatatttttatataacgaaagctacattttgggtattgtttttatcagggaatgattgatattgaagcaacttttatttagaaattcattaaaacattttaatggttctcttgtaagattcacacctatctttaaattttctagtcaaaaaaagaaagaaaaaaaaagcgagagagcttctgtttttcaaaattagtgcaaaacagaacaaatgcgaaattgtacattttttcttattaaaaattattatagccaaaaaaagaaaaatattatggcctcctatatttgtccccaatcatcctatttattttgacactgacttttctcacccctattattaggcaagttctacaaaaatgatggccatgaaaaatcattatgagttattttccctcgtggctcgcgatggttatgtttttttgacaccgagtctcacgtgacttccacgtgaactatatgagtggaggttttggatatggatcaacttgaccatatactagatttgagaccaagacaaaagagagttcttaaaagtctcccaagatcaaaacagtaaaccctaatgattttctataacccttttgttgtatggaattttagagaatacagaattttagtgtctctttctatagttttaggcttttagcaaaaagtctcaccttttctttgtaatttctctaagataaattgtttttcgaaaaatgctcaaaaagtactgcaaatcagaatgtgtactgcatatcttctatctacgcgaacaattggaataaagcactgttattctctcgtgaaacgttgatacattatatacaacacatatgagtttgaagtttctgtattacagttttctttttgaacagaaatcatttaatgaaccgtgttacttttttttgggtaacatgaaccgtgttactataagactatgaattataggaatcttctaatttgtcatttatgtacgagttaaattgtatttgaagtttcatcaaaaattagtacttgattatgtcgaatattatctatatttctagtgataatttagtgttgttacatcaaatattctaatttagaaaagaaaacaacatgtgtgtacgatataaattgatagttttattttatttaaagtaatgagatgcccttaaaacaaaccttttactcattataataatattatcaagaacaatcttgatcaaacaatgtatttatcatttacagccaaaagtaaaagaatttgtacttgatatagactccatacaaactgtagtaagagagatgatagaatataaatgttccccatttatttggtggaggaccaaatgtggaccaaaacataacttagccaatcgcatcttaaggcaatcgagaagaaactacatgcatgggcatgcaactatactgtttcatttattttgaaattcatttggtccaaatttatcttcaattcctttaaaactagatgtacatgacaaggttgaagtagggaattcacgtaatcatacttttgactttgacaactatatttagtcattcagtgttttattgctatatcgaattatgttcaatgtggcaagaccacgagattatgtttcatttagttaacaatttatgaagttttgaaaacctttgtgtaaaaatactgtaacattacttaaaaacctttctgtaccagtacaatcatttcgacctatattctaaaatgtaaaagtaattcttacattattcttctattaaatgggaaatcaataacttatacggaataaatcactcttaaacttaaatggtcaatttcaacatgtatagtgatcaatttggtaaataatatttgatgatatgttagtgtatagatcaacattccttttaagtggttgataagagagactataaaattttaatctccgagtcatcattccaatataagtgttctcaagatttgttgctctctcatgtcctaatcgcttagggttccaatccaaaccaatgagtttagtcacatcacttacaaatgtgtatatcaatatatctttacggaaaaaagatatattgataaaggatgtacaatcaaatacaacaaattagtatgcaatgaaaatacaattttagaccagaaccacaaaattacaactactcaatatatcgagtattacaatatattgagctataattcaacttttcacctatagttagctagttttgaccataatttgtagtatagtagtatgtgttagtacgtcgatgtgtcaacattcatgttcaaacttgcatattacatgttattgacatgttcttcctgtagtatacaaattacacattttcataacttcatatatgaatctcctgcaattttacctgcaaactattggtcaaagccttttaaatgggctagatcaagcccactaactgccaaaatattcacttcatttattcttgtagacagtatacacattatcaaatgtacacacattttcatgatttgatcttagatattatttcatgcaattttagcctctattgctaggctttcctttaaaaacttaccgggctaatcaaaacctcttaaaaagcctccatatcaaaagcccatcaatgttacctcgaacttagtggaatcaaatacggtgtcgtttgatagaaaatgacgaaactagccctttgaccgttcaggaaaaagtcttccgacatataaaaacggagaagcgagaagacgtgtcggctgagaggtaagaggaagagagactcaaaacggcaattagcgaaagtgggcgggaggattcttttccggcgactcttttatgtcttctcttcctcttcgctccggtgagaag

SEQ ID NO: 1238 - DNA, 3000 bp, Unknown
  misc_feature (1)..( 3000): cDNA_ID_2131856_gDNA_ID_1620375_Annot_ID_155123 3000 nt of promoter + ATG
tgattggagaatttttctttgagttgggattttgtggattcacatgtgtattttcaactgttttgtatactgagcattaatgatgttttttatggtaattttaaattactatttttaccaaaattatacttcctctattttttttccgtttaattcttttttaaaaacacaaatattaaaaaacatattaaatgttgtttttaaatatattactttttgtaatttataatttttaataactctaaattaataatatttaataattttattaaattttacaatttatttattaaattttacaatctatcaattataactaataagtattgcattgaaaacctaaaaaattaatcttttagaaacaatattttttctataaaattaaacaaaaaagaacggaagaaaatatttgtggatttaaacctttagatacccagccgtttagattttacaatctatgatttatgcatatataatttttattgcagatcctcaatatatgttgataagaaaattagtttagattaatatttttgttttatttattttaatattggtagctaggtaattaaagttgaagatatatatatatatatgacccatataaaacaaaaattcattaatgaaaacgtaatttgtactcgtctctccatgaaatacagtactccctctgtttcatattagttgtagtttaaggtttttacacacaaattaagaaatcataaaaatctcatttaatctacctcttttatataaaaacatcatttattataaccaattcaaccaataaaaaaatagatgattaaatataattggttaaagaatattaaatacatttattatttgcataaaaagttgaaaacaacatttaaattgaaaaaaaataaaaacccttaaactacatttatatagaaacagagggagtattatacaaacacaaacttaaatgttagaatttagaaagataaataaacctttagtcttcaattggtgagaagttaatcatatttatatggtgacataagattagtgaaatgaagctacttattggtcaaacttacattaatctaaaaggttaatgatatgtcatatgtctaagatggagcatgctcaaaagaaaagcttagttaatgtttcatgttgatgcaattatttgtgtttagctttatgcaaaaacactgtttttaaccaagaacaatactgtcgttttcagctttatgaatgttcaaaaagtttctacttttttgcttttatgttttttgccctttgtttctgagaattaaatttgtttcctttcttcaatcactttgacagacattatctccaatttagtatattgtctacccaatgttagaaatgtttatttatcgtgatattaaaatgttatttgtttcctcatgatatttcgctagactagtaaacaaaagtattaattaactagtaaactaaaatatttatttatataaaaacataagtgattactattttcacgggtaaaattgtgtaatgagttttaagtgtacatacatgactctatatataaggttgcagttcagattgatgggaacagatatattgacttacactaggctcaaagcttaacacttttataactggaaatttctcttttgtttttattgcatgggaataaagtaaagaaatgataacataaaaagagaaagtaaaacaattttagtattttctatcaaaaataaaaaacattttaagattaatagttgtattcttagttgctaagactacagataggtctatgtataggtagtgtatgtatttggtatcaatatgtatgtgtatacgtgtaatcaatgatgagaaagacacaacctttagactttgaacctttgaagagtggttataggctgtttatttcaagttttttgcttactctttttgccttttttctaaagttaatattcgttgtgccaattttcttcagaaaagaaatcaggaagtagagagtagagacgcattctgttcacacttcactctcaacttagaaacaattatgcgtcaaaactcaaaactagtaaaaagcatatcaaaatacaatttcgaagtaattgccttcgtatttggtttgattcatgttttaaattttcgtatacactaactttgtatttatagcaaataagaataaccaattttctttaaaaacgtttattttatatgcaaccttactcatttttctttgttagattttcgctatgcatacatggaccatggttgattgttgcatgtatgtatactatactaacgaatgtaattttgatgatctcatcttgggccgaagccaatgcaactatttttgtgttgaaattccattgaatcttaaagcctataaatactttttaagtcgtgtctagctcacaatcaaaaagcaaagtctcacttagaaaccagattctaaaaatattttgtaaatgtttgtccatctcaatatcaaaaacattatctccaaaacgaaatgtgaaaataatgtcaaatgttttacgatataatctttaattcatagatatttcctaatctaaaaatgcatagtaatttggtaaacgcgttttgttttcaatctttaattcatagatatttcatatttagcaaaaacaacgaatgtattatgcgtagtgactagtgagaaatcagaaatatataaaattagcttttagttatgttatctatggatgattaatgaaaagttttggtctattagctgagtataggttaacaacaacaatcatatgatacatagagctacttcttacctctctcattgcaatacataaacaataagccttgtccaaattcggcagctttatcatcatattgtgtacaccataacaaggatcagaggttgggttgatacaaaaatgctcttaaaagtaaccatagctcggaagcaaagatcacttgcaagtgcaaaatggtgcaccatataaaatccacagtaactacatctacggtggccacgtctcaaactacatg

SEQ ID NO: 1239 - DNA, 3000 bp, Unknown
  misc_feature (1)..( 3000): cDNA_ID_3061294_gDNA_ID_1620375_Annot_ID_155136 3000 nt of promoter + ATG
gaaaataaagagaaccagtgaccccaaagtgaagaaaaaagagacaaagataatgaaaataaagctaaagcatcagtcttttggaatccatttttgttgagcatgcataattaaatttgatctcatatgattaacaagcataatccaactgaagttcttatcaagaattaaacccttttgaacaatatggtacaacatatgattacgaaccccccaaaatatgatcagtaacaaccctaagtatcgatgattttggttgaaaaatgagcaaaagatactaccttccgtcgttctccagcttcttatgttcttccatccatggaagtttcggaagatcatcaacgttaagtgatgaagaaggcaaccttctttgagcatctgaagagaacttatctttcttaggccacaaccaaatcttcgaaaccgaaaagctctctcctttagccacagtattgatctttttattgtcttctgatgatgaattccctgtctgctcagattctttgtcctgaggtttcaaacgcggcagtctgtcgttggcaaacgggactttaagttccgagttaccgagtatatactgatacgaacccattgagaaacatctccttgcatccaaattactactactagtctctcctccggcaacaacatcctgaccttggccattaccaacattgtcaagcctcttaaatttccccaatctaaccggtaaaacacctttctccacaacgatttcttgaatctccatagttttctgacttccattctcggtcacaccctcttcgtcttctcttatatcatcgaaatcaaacatcgggttctccattgagaaaccaggggaaaagagagtaccacgacaaagaggacaagtcgaatttgactgaagccaagtatcaatacagttcaaatgaaaagcatggctacacattggcaacaacctcagcttatctttctcagagaactcacagagacaaaccgcgcaatcaaacggctcttgagcagcaccattaccaccaccaccaccagcactaccaacaatctccttgtagtgaaaaacaggtaaagcatcgataaaagcttgatcaagaccagaatcattcaaatgaaaaagctgttgaagctgtctttgaagagcatcactagttgagatctctgggaatctattagaccttgaagaagcagtagcagaaggatgcttaataagaaacctgacgagcaaatgaagaagcccagaaatgaagaacaagacagctagaatcacaattacaaacaaaaccgccggactgattctgttaccggacgacggtggtggaggagacggcggagaaagaattgggtctttgtaaaacggtggtgggtacgcaaagttcccatctttttgctcaattgtgaatcgaacccaagacatcttgtaagatttaggtcacttagaaacaaacaactccaagatctcaattttcaagatctcaaaagctcaatcaaaaaacaaaacaactccaagttaagtggagaagagttccaatttcaataacatcaacatcagagatacacaaaactcacctaaaagctctctccagaatcttgacacaaaaccctaatcaaagagggctttttttggtttggttcaatatgtcagatttgcagaggaagaagagagagttaaaggaactctctttcttcgtcctttctctctcttctatctctatctatttcgctataacctttccttttcttgagctttaatggtggaagtagaaaactcgaagaaaatagcaaagtgattttgtaaaatttcgaagtgcgaggcaaaagttggaaaacaacaacattagtgaaattaaaaaagtaaaaagctttgaaatatgaaaatgaaaataaattagcggtttttagatttgggcccacgtgcattgatgtcagatggtcaactccacagacaaaaaaaaatgacggtttcctatgtttttggacttattattagatccgtactgggccggaccatcaagcccaattgtcttatcctaatcaaatctactgttaggagcgtgaccagctctagctatagtggacattccggtttagtttcggtttcggttatcttggttttcgtttttaatttgaattaatagaacgaaaatcagataaccagcgttttagttatggtttcgtttccgattatatcgattttaattcgaccacttggtttatagataaatatcggttgaaatggtttggtttagttttttttttcggtttagtacggatcaaactctactacaattgggaagcgtgtaactgtcaacgagcgtctcaaaatctaaccgttgatcaattcttttgacggtcgtaaattcgccggcaacatcgaacgagaagtcaccggaaaggtcacggagaaatgtcccccatgagcttctccgccgcgtacgactgataattggtgcgattctttaaactagttactgtgatttagttgctttatcttctgttgttgggggaattgtaggtcactgatgacactgctcttggaatttgtcttaagttattacgattgattgagttttaggttccttttgatctttggtggattctgatgttggagctgattcatcaacactaaagcaaagctacaagttttatcattggaggagatatgttcaaatgcaagttggaaaatttctccaattggatgattggggttgatgaaggtattagagtctatggctaaaggtccttgtctttggtctcgtggagtattagaatatggatccttgtgatgtgaagttttgggtcaagttgggatattttataattaaggagaggctgattttttccacattgtcgtcattgataaagtcttggttttgtgttaaacaatgaccaaattcccagacgtggtgtagtgaacaaccaaaaaaacaacatgattgattgattctgaaattcactttaattttcaagagagagtttctgaggatcttgatatcagaatctgtcatg

SEQ ID NO: 1240 - DNA, 3000 bp, Unknown
  misc_feature (1)..( 3000): cDNA_ID_3061291_gDNA_ID_1620375_Annot_ID_155137 3000 nt of promoter + ATG
cacccaagaagtcaagttgctctccgcaaaaagacatactggtactgagattagtgttgcaaataaattgtagaagaagactacggttatctcttcagggtaaacctccatgacacgagtctgaaaccatatacagctacagaatttaatgtgtaaacccaaagtcttttttagtgaaattttcaagtgtttgtacctgaagaatataccagacggatataagaaaatactgtgaagcaagcaagagccctccgattatccagcttgactctattgaggtcaactgctggtgaagtgtaacggtaggtaatacagttgtaaaagatgcagaggcgagaacttgtgggcctttatacagcacaactaccagagcaccagatatagatagtattgcaccaatgattttagcctgagtcgcagagctccttaaccttacttgctccatccttaatgagtcacccaaaagaaaaaccagttcaaaaaaaagattgatagtaacaaatagaccacatatcatcatatgcaccaaacttatctcatgaaagaatgagggcaaaccatttctaaccaaccactgagttgtacttgtattagtgagtcttactcttatgtgacgactaagtactttgtagtttaaataaacgtgagaagttttccgtatttactggtatcgattggcatcgaatgctacagcgtataaactactagtcactgaacataagatggaaaacccatgacgtccaaaaaggaaaatttaaattcattctatatacgcaaaaggcttgagattttgtatgcttagtaagtgtggaattactccgttttccactgtctagactaatttccaaaaacagaaacagaagagaaagaggtggaacctgaagataacagcgagtgtgaatgtgaaagccggtgtgagattgctgatagcagatgcaagagttggggaactgtatgcaatacctttacaaccagcaatctgcgacatgaacctgttccactcaagttaaaaaaagccagaaatgcccataaatctagaagcaggagtacgatgttattacccaacaagcccaagtaagaaaatcttgaagaaaagaggagacttagctgctggtaatcttcttgacctgcatatgtacaaaagtaagttcatgttcttgaaaagattataccgggcaaagagaggagatcagtaccttccaaagattacagaaagtggaagaaggagaagtgttgaaacaatataagagtagaagacaaagacatagaagctcaatcctcttaaagtagcagccttaaacagcgtgtttgacccaacagtggcacactccaccgcaaacatcgcagcaaacggcacaacatctctggtaaagtacttccacgccactttctcttctcctgcttctctcatgacagattctgatatcaagatcctcagaaactctctcttgaaaattaaagtgaatttcagaatcaatcaatcatgttgtttttttggttgttcactacaccacgtctgggaatttggtcattgtttaacacaaaaccaagactttatcaatgacgacaatgtggaaaaaatcagcctctccttaattataaaatatcccaacttgacccaaaacttcacatcacaaggatccatattctaatactccacgagaccaaagacaaggacctttagccatagactctaataccttcatcaaccccaatcatccaattggagaaattttccaacttgcatttgaacatatctcctccaatgataaaacttgtagctttgctttagtgttgatgaatcagctccaacatcagaatccaccaaagatcaaaaggaacctaaaactcaatcaatcgtaataacttaagacaaattccaagagcagtgtcatcagtgacctacaattcccccaacaacagaagataaagcaactaaatcacagtaactagtttaaagaatcgcaccaattatcagtcgtacgcggcggagaagctcatgggggacatttctccgtgacctttccggtgacttctcgttcgatgttgccggcgaatttacgaccgtcaaaagaattgatcaacggttagattttgagacgctcgttgacagttacacgcttcccaattgtagtagagtttgatccgtactaaaccgaaaaaaaaaactaaaccaaaccatttcaaccgatatttatctataaaccaagtggtcgaattaaaatcgatataatcggaaacgaaaccataactaaaacgctggttatctgattttcgttctattaattcaaattaaaaacgaaaaccaagataaccgaaaccgaaactaaaccggaatgtccactatagctagagctggtcacgctcctaacagtagatttgattaggataagacaattgggcttgatggtccggcccagtacggatctaataataagtccaaaaacataggaaaccgtcatttttttttgtctgtggagttgaccatctgacatcaatgcacgtgggcccaaatctaaaaaccgctaatttattttcattttcatatttcaaagctttttacttttttaatttcactaatgttgttgttttccaacttttgcctcgcacttcgaaattttacaaaatcactttgctattttcttcgagttttctacttccaccattaaagctcaagaaaaggaaaggttatagcgaaatagatagagatagaagagagagaaaggacgaagaaagagagttcctttaactctctcttcttcctctgcaaatctgacatattgaaccaaaccaaaaaaagccctctttgattagggttttgtgtcaagattctggagagagcttttaggtgagttttgtgtatctctgatgttgatgttattgaaattggaactcttctccacttaacttggagttgttttgttttttgattgagcttttgagatcttgaaaattgagatcttggagttgtttgtttctaagtgacctaaatcttacaag

SEQ ID NO: 1241 - DNA, 3000 bp, Unknown
  misc_feature (1)..( 3000): cDNA_ID_1032925_gDNA_ID_1620375_Annot_ID_155138 3000 nt of promoter + ATG
agtaatttggatgcaaggagatgtttctcaatgggttcgtatcagtatatactcggtaactcggaacttaaagtcccgtttgccaacgacagactgccgcgtttgaaacctcaggacaaagaatctgagcagacagggaattcatcatcagaagacaataaaaagatcaatactgtggctaaaggagagagcttttcggtttcgaagatttggttgtggcctaagaaagataagttctcttcagatgctcaaagaaggttgccttcttcatcacttaacgttgatgatcttccgaaacttccatggatggaagaacataagaagctggagaacgacggaaggtagtatcttttgctcatttttcaaccaaaatcatcgatacttagggttgttactgatcatattttggggggttcgtaatcatatgttgtaccatattgttcaaaagggtttaattcttgataagaacttcagttggattatgcttgttaatcatatgagatcaaatttaattatgcatgctcaacaaaaatggattccaaaagactgatgctttagctttattttcattatctttgtctcttttttcttcactttggggtcactggttctctttattttcttcttttccatatactttcctttactctctcaacaaattcactgttaactttataaatataaatgtatttgttatatacatgctggttcctgctggtcatcaactaatgcattatagtatggtttacttttttatttttataacttgtctagaatttttaactgatatactcaagtctggatccagaaaacaaatgggaacttttgacttgtgttcaaacacaatcttgaatcttctctttggtttaggttaggggtttttggctctttgtgctataaaccaaaacaaaaatgaaatcttctataaaccaattacatttaggactttaatttcaaaagtctttggctctaatggtttatgttggttgttgtagggtcaatatgtttttctgacactgatataaaaccattatatacccactcgatcttgatttgattgcacataaacaaataaagaaaaagataatccagaataaacaaatgatgaattagaactctctagttcccttgcactgttgcacatatatctcttaaagtatatgataagtataataatatatagttatattgttatattaataagattatttattaaataatcttactatttataagattatttaatatatatatatatatatatatatatatgagaattcaaattaaatattttcatttgtaagaccaccctctagcttatggaaacatatatcataccatgacaatttggctccgagccaaaacacaaaaagagctgcaaagactattaatccttctaataacctgttttggaaggaaaaaagcactagtccaaaactacagtctaattattgttgtaaatttgaccacaataagtgtaatgcgttaaaatgtaaaatcttcaaaatctatgtcagtgtgaattaattaatttctgtacttttgaaaataaacgtaaatcttgttatagaaatctacgcaaaaaataaagaatttgacctcaggatactaaaaacagtaaaacgtatgcaattaagactaaaccgggattgcattgataaaccgatataaaaatttgaaataaccatccggtttattttccgtggccagcaagtcccatgaattttgtttgatggtcaaacaaatcccatgatatcgctcgtagattttgcatgtgtttgttgtgaattgtactgttggtggcaaatctcgtaattatatagaactttaagaccctatcagtaatctcaaaaactaaattctgacgtggcgtgtaacaacaactaatacggacgtaacggaaaactttgaacacacgaccactctgaaaaattcagaatctttttaattattagaaaaataataaaataaattaaaaacgactaattaatttacgatttcatgcttatccttacgattcaaacaaaatttatcttaaaaccaaattgaatatcattagttttttttcttcgggtatattgttttttaaatatattatgcgttatcaaaattaggaacgttccaaaattagacattgtaccttctttttttcaacagacgttaaattggtattctttttttttgcaaaatcagatattataatccgaccttaattatagcagtttaagataatatttggtcaaaacaaataaatttactagtctttagataattaatagttggataatctttggtcaaaacaaattaaaacgactaattattttcagtttttactcagatttcatgtttatccatacaattcaaacaatattgatcttaaaattctatcaaagtgataatataaattcttgacatacgataattaagtttccaagtcaaagatttaatactatcattaatagttttttctttctccgcgtataaaattgttttaaagtgatggaactattttaaaaattattatgctttatcaaaattagacattaatgcacattccttttttttcttgtcaacagaaattaactttttatccttttcttgcggaagaaaatcagatattataccctaagataatctggtcaaaataaataaatttggtagtgtttggataataccaaaaatagaaaagataatgataatttccaaaaaatgtttaaaataacaaaaataataataaaagagaatcataagttgataacaaaaaagtattacgaaataattaatacattatgataattccccaagtttaggagaatattgactccttgactcaaacgtctctcttatcttaatctctaaaatctctcttatctctctctctctatatatacacacacataatacccaaacgctctcaattaggttttcttctacacttgttcttcttcatttgctctcttcttcatcaatctctctctttttgtaaacggcgattttaaa

SEQ ID NO: 1242 - DNA, 3000 bp, Unknown
  misc_feature (1)..( 3000): cDNA_ID_3061287_gDNA_ID_1620375_Annot_ID_155139 3000 nt of promoter + ATG
tgtatgttaccattaatgaatccaaattcaaacggtcgacctcattgattaaaatcatagcagccaaaccacagtaggtatacctaaacaaaaaacaacttggtaataagcaaagctgcaggtgacaaatcctatttcagaaaattaattatacttaaccatcaataaccatgtcatcaaggaagagggaagcaaagcacaatttttatctaagcctcaacataatggaagtaagtaggagaccatacccaccgtgagcttcggagccaggttcccctccaatgccaccttcataagtttggcaactgctcaatataaatcgagttaaaagagctttcccagggaaattaatgaattcctgaatttacaactgtataacagtagttcagctatatatatataatgcgagataaaagtaataagaaaagctacctcaagatgtaatctcctaggccctgggtgagttcatcatccataatatttaggatgcttgcaacctgtgtcacaagagagaagtcaaacatatcagggagaaaaccagccataggatgcatttgcaacacgtgtaagtctcaaaacgagtaatctctattcaaagtatctggtgggcgcaagtgtgcaaataataagatcatatcgtaatctgaatgtgatgtttaagccatgaaaacggaagaaacatagcataatgggtccagactttgttgatctcattaatcctaaaaagttttggtgtccacaaaaacagagaaaaggaaaatagaagttggtaaaactcaccgaaattgcagtgtagcatgcacgaacatccatttctcccatatcatgcatcctaacgatcagtgagtaagtagaattaagcaagaattaaaaaaacaacatgactgaaggtatggcattaacagcgatacgaatgcataaagagtgagctgtcagtaaaaatgatgcctttaagaagttcaagcagaaagagaatcaaacctgaaacctccacttgtatccttcatccgtcttaaaaaacaagacattttttctctgaaagaagaatgagtcacatgtaagtattctagaggaaacatcactagactcttaataaaagaaactgaccacaaagaaaaaagaatgcaccacctattaattgaagaaagggctttgtcacctcctaaagtaacaagtgcattcactgcagcataagtagttgcaagatgtggaagctgggaaaaaatatctccattactagtagaaaaaaaaaggaaactgaaaaaggcagaccaaaagttatatatcctaactttctctgccatgtttggaaaatttacaaccacaaacttaaacaactaaatgctgcttgaactaaagacaccattttacgtcttcacagaaaaaaacttaaacttaaactacgtgtgctgcttgaattaaaggcatcacaaccaaacaatgagatgatgcataaaaaaaacacctaaaagagatctggcagaataaaataatctggtctcaatgtttattctccaattgcatgaaatgaaagtgatccacacactttaaagaaacagacatatacttacttggccaggaccaccaccgtatccaccttcagagccctgacaagcgacatgagaaagcaaactaagtacataaagaacaataacagataacactaatagcaacgggaaaagaaaacgtgaactaaaggagcagaaaatcaagaagaatgcaagagcaaatatgaagagttttcatgattgggtacaagcaaaaggaattgagcctaacctggcagcgtccaaggaagtcaatggcattgctttctaattcatcatccacagtctccccaagcaaagctattgaatgaagaatccagtaacaaagccaaggtcgactgttccaaaatccaaaaaagccaaaatcaaacttctaatctattggcaaaaatccaaaggggctttactctctcactggacaaaatgtactaagaaattcatgaaaacaagaagccaagcatcatgtcacttacttagcatctaaggaagaaaactgcggaccaagctgccttaagcctttcatcagataatccaattgcttatctcgctgaatctccatcctaggatagaacaacttccatatcagtaagattcatctatcgacgaaaataattctttcacgacgctactaaaattcatcagatcatgaagaaaactagaaaatcaaatccgtgagcttacatgtatttttgagtagaaacgtcgctggcgtcgaagtaattatagatcccgaacacatcgttctccaccagaaattgctcgcgctgactcacggttaggcttgaaagctcttccatcactctccgccgcgttgattccccgtgtcctccgtgacagattcgccgattgagtccactccggtcaagtctgagccctacacacttcaaacgaatcaagcgggttactactggcatctaaatttcattgccaatttggttccggtttaataccggttcggtttggtttaagattctcaaacaattaattttactatacgctttaatgtttaatctgttgcttcttagtataatttcctcttgacaaaaaaaaaaaagagtataatttctgttacgcccagaccaaaccagattcattgttttatttataagattagttagagcatccttatcaataggttgttaacaatatcataagaactatcaaaatattatattaaataaaataagaataaaaaaataaaaaagtgtgcttaagaaatgaaaaatggctcttagctaagttttttttttctttattctctttttttgtaagagccattctaatgtttaaacattattttgtatatcaaaattgtttagaactttatgtaagagttcattgataaggatggtcttagaaacttcttcctaggctaggtctatatttctttagggctatattattgcttgctcttaacggaaaaatacataaacctcgtttcatcttctccatg

SEQ ID NO: 1243 - DNA, 3000 bp, Unknown
  misc_feature (1)..( 3000): cDNA_ID_2131893_gDNA_ID_1620375_Annot_ID_155133 3000 nt of promoter + ATG
gtcgcagttgaaggatggaaactcattcttcaattccaacagaatctcaacttgatcgcgtgggaaaggaaatggtagagtgtaaactgaatcgctggtcacaaagacgcaacagaagaaacaagttatgaagaaaacggccaaattcgatttcatgatatgaagatatgaagaagaaattggtatgtatgatttggtcaattttgcagtctactcttctaacaatcatatataataaagataaagagttatatatataataaagataaagagttatatatataataaagataaagagttatatgtcacatcgcttgctaggaaaatttgagtctttcagcatgtaaatattgaccaccacatatttagttcgaccaagaccgataccaaccgggtagacagtggaccaattaatcaattttctagatactttatattgtctctacacaaacgtttcaatctagacaattatccaactgtagtcttctagatattttttcgatcttgtctgtggcaaaaagatgaatttcattggtgattctgtagccagaaaccacatggagtctcttctctgcctcctgtcaatggtaagattttttttttggacaacatcttataacataactccttaagcttgtgacttaagaaatctcgtttctttgctttggtttcacaggaagaaactccgaaagatatctacctcatggcaaagtttctagtggccggactcgaaaggactcatgctaagaagaccggaacaggaatctatgatctcgacattgacaagcgagcaatgggcaattgatctgctaaatacagacattgccattgccattggaaatcttaacatctcagatagaacagcttgaagatatttaaacgtgacagcttaaaaaagaagaagtttgaggttttggatgtgactagggttatgctaatgagaccagacgggcacccgaattcttactggggaaataaatggatgaagggtttcaatgactgtactcactggtgcttgcctggaccaatcaatgcctggagcgagtttctcatggccatactcagacaactcaggtaaatcttgaggataagaaattttaaaaagtataaggtgatgtcttaattcaattctcattacaacctttagttatatgtgtaagaaagagaagacacatattatttacaggacatatacaaaactgcacatacctggcattgtttaatgtattcatgatcatagcctgcaaaaaaacattgagcagaggaataacagtttccaccattcttagtgttcatgtgaagacatgaaacataaaaatttcctgtgatcttcctaagaatctcaaagtgcataaactcaaaatgatgacacagaaaccaaacggaaattttcattcaacggatcatagcgatctaaaagaccaccttgaacagtccttgtcccaaactccagagactaaaaattacagagaattgagacagaaatagtaacagctaacttactcaccaaccatgactacaacacaaagcctcaattgtatcctaactcttaactctagctatcataacacaattcagatcgaaacacacatcgacaaaagatgagaacataataagagaagtgagaaaggtgagattgataaatagcaattctccaactattccttagaaatatccgagttcaacagtaaagacataaaacacatatcataggaacttctaaagatatcgactttgactacaacacagagcttctatgtgttctagtagttaactctagcaatcaaaacatcattcagatagataaatagcaaattctccaactattccttagaattcaacagtaaagttcgaagctttacatagagaaattacataaaaaccaacaacaacagatcaagactccaaagtgttaccaagaggaaatgagaagacttcacgaacaggagaaaactcaacgagaccaatctccataccataaccattcaccggaagcttcaaatctctcaacacagagaaagcctcagccatacgagacttaggaacatcaagagccacgggacaaaacggaacccaagaatcaacacgatactcttcaccaatgtcaacagattctttcttcaacatatcacataactgagtctgcaactgaagaagcgatagagacggagtcggagatagaaacagtacgttgttgtcgctagagaagctaccgatagtagagaacgagatcgagattggttcttgcttggatacgaagtttttgatgacggattcgagtctcgttgaatcgaagaaggaggtggagaagagtgttatgtgtggacgagactcagtgttgatcaatttggtactgatttgacggcgagcgaagacgttccatgctttcaatacttggttttcgagtgctggatcgaagtatagctcgattgcgtagccttctgacattttattccaagtcggaattgaagatcggagatggaattgaagatggatcgcgatcggagacagaaggaagatggtggagtaagagagatcgatttactcaaaaagggaaagtgagaacatcatcaaatttcagatttggtttgtgcattttaaccgatcctaaccgaatcgaaccgaaccaactctaaatccaactttattaaattcggtttgagttcagcaacaaattacgaatctctgtaactaactaattatggtttagacttttaagatgaagaccaacaaggccaagtttgtggttttaacctaatgatggcttgggttaacataattataattcagtaattagaagcccaatatcgttattgggcctaacttcaggcccatttgtcttatattcaggcacgacgggacaatgatcgccgtttcttacaaccactctccgattataaaccctagccgcgtcttcttgcaaatttcaatttcaatttcactgagaagttacaatccagaggaaaagattatctttttccttctgggttgagggaaaag

SEQ ID NO: 1244 - DNA, 3000 bp, Unknown
  misc_feature (1)..( 3000): cDNA_ID_2131876_gDNA_ID_1620375_Annot_ID_155128 3000 nt of promoter + ATG
agaccggtgtggtgaaggagctgtcccttggtcgtcaatgtcttactagtctcaaggctaatagtagcctcttcagattccaacacctcaggtacctcgatctctctgaaaatcattttgactcgtcccctataccctctggatttggtagactgacctacttggaatccttggatcttagcaaaaatgggtttataggagaagttccatcctcaataagtaacctaagccggttaaccaatttagacctttcatataacaagctcaccggtggtattcccaatctacatagtttaacccttcttgagaatatagacctatcatataataagttttctggagccattccttcttacctcttcaccatgccttttctagtttctcttaacctacgccaaaaccatcttagtgaccctcttgagaatataaattattctgcaacctctaaacttttaattttagacatggcttataaccttatgagtcatcgaatcctagaacctatctcaaaattagccaacctcatacaaattgacttatcttttcagaagacaccctacacattcaactttgatttcttgctcttcaagtctctagtgcgtttggatctttccggaaatagtgtttcagtggttggtaccggttcagaaaatttgacacatctagacttgtcgagctgcaacatcaccgagttcccgatgtttattaaggacttacaaagattatggtggttagacatttccaataatagaattaaaggaaaagtgcctgagttgttatggactctgccttctatgctccatgtaaatctctcacgcaactcctttgattccttggaaggtacgccaaaaataatcctcaattcgtcgatttcggagttagatttgagttcaaatgccttcaaaggatcttttcctattattccaccttatgtcaacatcatggctgcatcaaataactatttcactggaggcataccacttatattctgcaaaagatatcgactcagtctccttgatctatcaaacaacaacttcagtgggacaattccgagatgcttgacaaatgtgtcactcggactagaagcgttgaaactcagtaacaacagcctcactgggagacttccggacatagaagaccgcttagtactacttgacgttggccacaaccaaataagtgggaagcttccaaggtctctagtaaactgcacaaccctaaagtttctaaatgtggaaggaaaccacatcaacgacactttccctttctggctgaaggctttgacgcgtcttgaaatcattgttctgagatcaaacagattccacggtcccatttcttctcctgaggtctctctttcatttacggcactgcggataattgatatttcccgtaacagcttcaacgggagcctaccgcaaaactactttgcgaattggagtgcacctttggttaataccccacaaggatatcgttggccagagtacacaggagatgaacactctaaatatgagaccccgctttggtcttatccttccattcatttgagaataaaaggacgaagcatagagttgggaaagattccagatacatacacgtcgatagatttctcaggaaatagttttgaaggacagattccagaatcaataggtgatttgaaatcgttgattgttctggacttatctaacaactctttcactggtcgtattccatcgtcgttggccaaacttaaacaactcgagtcattggatctatctcaaaaccgaatctctggaaatatacctcaagagctaagagagctgacgtttttgggatatgttaacatgtcacataacagactcaccggccaaataccacagagtacacaggttggagggcaacctaaatcctcctttgaagggaatatcaatctttgtggtcttcctcttcaagagagttgtttaaggggaaatggagtaccatcaacaccacatacacaagagcaagaactaccaaagcaagaacatgcgttgaactggaaagcagctgcgataggctatggacccggagtgttgtttggactggcgatcggacaagcctttgctcgatacaaaccggtcttgttctataagttgtttcgactttgagatgtattgtttcttcttcttcattttggtgttgaatcatatgtaaaataatcagtttactactctttgctttttgggctttgacgataaactaacaacacagctttgattttctggttaatctgtttcgtattagacagactttgtaaactttaaatgttgctcaaatgcttgcttgtttagtatacacactttgaactactctttctatttcaagactaatgtactctgttattttgtaaagtacttgttatattattagcttgagcacatataaaaaaatatatatatattatattttatagttttttttagattcgttaattattaatattatagattattaagttccaacaagagtgatattatttcatttagcaagctatttcttaaaacccactatatttgctgagatttgtgtatcttttattctttttaattaactataaaaaatgtaaaagaaaaatatattttctgtttatttagtgtttatttaatattataatataataattcctatgacacaggtttaaaacaaataaaatcccagtaaaaataatttttgggattataatttaatactaaacaagaaaatctatgatgtatttgctaaaaatacaaagtttaaaaaactaatttttttatatacattaaaaaaacataattttaatatttagttaaatagagtttggccaataaaaatatttactgtagttacaaagtatataaatttaaaatagttttaatgattttattttattttttgtttataacattttatattgtgaaacaaaataaacatcctaatatgaaacagaatgacacttccaaagatatgcccaattgaagcaaaagccagaacagcttttaaattgcaatg

SEQ ID NO: 1245 - DNA, 3000 bp, Unknown
  misc_feature (1)..( 3000): cDNA_ID_3061325_gDNA_ID_1620376_Annot_ID_155150 3000 nt of promoter + ATG
gaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataaccaaaccaaaccgatccggtattcttagttttgttttgttttcaatgttatttttggttagacaaatattcaattgttaatatactccgtggtcagagtgttttgtttttcttttagttcgaacgttgaattaattcaggggtaggttttgaattctctgaaccttatgtgttttttggtaacatcatttggatttgtgaactaggtttaaaaactggtcttagtcttgttgttttctcattagataatttaaactggtttgcttctttatttttggttggataaagtgaccggttctggtcatctgtttgagatgtaattactatttcataaaattaggaagttgaaagccaaatatatttgtaactactcttttatttgtaattttgctcaaaaaagtgatgaaatgtagttttgatatatgaatatctaccattatacataagtatatctgaacatggtacaacttatgaaagctaaatgtcaatacttgcaaagatataacaaatacaagttacatgaataagagatgtgtgttgaatttataagtgtcattttcttttcactttaaaacaaacttcatcttcttttgtttcttatgtgtcaaagttgccacagttgctctatttgagtctttcagtgtcagtctcagtcactgtactgattttacttttttttgttgagtgtgccaatgatgacatcactcccacgtcctccatccgtcttcttttaacggtcacgtggctcccaccctcttttctcgatgtctttaccgacttgttctagcccaacttacttgggccatttagattttttggtggcccaagttgctaaaagaggatttatcatagaaatctgaacccgttgcagcgctcaacacatgtcacagtcctgacaaacacgtattcaaatccttgttaagtcccgccacctgtcaccagagcaccacgaggcaaactctgatcaggacaccgtcgtactattatgtcggaagacaggaaagcttaattaagcttaaacctgacgtatttaacttcgttaactctaccttactaaagggttttaatttaaaacttatcatctcctcgtaagaataaaaactacttactctataaatttaagcttcaagaaacctccaaaagcagagaaatgatcaacgcttttaagactatccgatcactgccctcgaataccaccgtctcgttctgctcaacaccatctcgattaggccggaaagtcactggagttagttttgccaccacttctgatcagcaaaagatggataaaaagcctgaaaatccaaacgagaaaaccgggttcgtctcctccccatatgtgtgtagttgtttctgattcgtaatttggatgttattcaaaaaaaatttcgttctcttctttactttgatggagcagtgacgtgatgtcgcattcttatggagaagggtacgcaacaaggtctgacgaagaagggtttggaggaatctatggaggaaatcaaacacttcagaaggaaaacgagatccatgagaatcaccctggtactcagaatagttagttatcatatacacgtttattactacttatatgatcacttttattgtttacgattctgggtgtgtgtgtgtgtgttttcatgttattgaagattacgacaaaacgcaaggtagcgaatcgaaggagaaggagaaagcaaggaaccagacacaatcccactgctaaagaaaaaatgatgatttagtgtctttgttctttatgctttaataaaatcagacttgtgctctgtagttcgtagactctggttagagttttttttttgttaattgcgttttttgacccgtaacctttaccgggtttttgttggttatccttatcacttttgtaacactcgttgaattagtagtttttgttgattgttgaacattcccttaatttgactgtgtttgtttatttatgaacaaatctacggttttttagttgaaccgtcgaggaaaacattcttagataacgtcagcaatgaatattagcctgttttcggactttcgattccgatgcaacacgttaaaagtaacgtcagcgaagataaatttggtaaattcatctgaaactccaatgctgatggaacttagctggtgtgttgcgtgttcataatttatgttattagtaacgtcttagaagttggaatattcactccaagttcgcacttcaaaactttcaacaagtttttagttcttatcgtacgtctcaaaacagagttgaggagatttagcttctactgtttagtgttctacacttgcttcgtacaaagaattgaatttttatttccatagttacatgcacatatttgtattaacaatctcttattattggttagtatcatatctgtagttattcgaacactgggggcaaatttcatttaatcaatcacctaacgaggctatgatgcatgattaacgaacgttaaagccaaaatgtcaagactacccccttattatcagctcgcagttggtcaatgcctcaatggtctgaagttcagactctgaactataatacaaggtcaactcaacccgctggtagtaacgaaagtacgaaacagtcaaaaacatatcttaaaaattacataaaaaccggaaacgaagttgcagaatttacagtttctgccattgggacaatcattcgatctcatcattatccttctttctctcc

SEQ ID NO: 1246 - DNA, 3000 bp, Unknown
  misc_feature (1)..( 3000): cDNA_ID_2131990_gDNA_ID_1620376_Annot_ID_155164 3000 nt of promoter + ATG
ctatgccttccatggaagctattcttaacaattatttccaaaacatcaataagaagctcgaccgtttgagtggttctcctgctcctccgcttgtttcgaagcgttgttctgttcccaagcttgataatatggttctggttggattggattggccattggtggagctgaagaagaaactccttgacaattccgtggttgtggtgtctggtcctcctggttgtgggaagaccacgctggttactaagctttgtgacgacccagagatcgaaggtatgtatatatatgaggtgtcttaaagttttgatttttacacatgtttcttgtttctcatgtagtgtttgttacattggcaggagaattcaagaaaatcttctatagcgttgtgtcgaatactcctaatttcagggccatagtacaaaacttactccaggacaacggttgcggagcaattacatttgacgatgattctcaagcagaaactggcttaagagatcttctggaggaactcacaaaagatggtcgtatattgttggtgttggatgatgtgtggcagggatccgagttcttgcttcgaaaatttcaaattgatttaccagattataagattttggtgacttctcagtttgattttacgagtttatggcccacttaccatttggtacctttgaaatatgaatatgctaggtcccttctcattcagtgggcatctccacctcttcacacatctccagatgagtatgaagatcttctccaaaaggtattattattagtttcaacattcatgttttaagcttaaattgtcctgttagtggaaaacactagattcatcttcttttttcacatggtagatattgaaacgttgcaatggattccctctcgtaattgaagtagtcggcatttcacttaaaggacaagctctgtatttatggaaaggtcaagtggaaagctggtctgaaggggaaacaattcttggtaacgctaatcctactgtgcgacaacgtctgcagcctagcttcaatgtcctgaaacctcatcttaaagagtgtttcatggacatgggttcatttcttcaggaccaaaagatacgtgcttcgcttataattgacatatggatggaattatatggtagaggtagttctagtactaacaagttcatgttataccttaatgagcttgcttcccagaatctgcttaaacttgttcatctcgggtacgttggtgttgttttttacaacatttgtttcattgcaccttcttgccatctaccatttgatcatgaacttatttgttttacttactaccaggacaaataagcgcgaagacggtttttacaatgagttgttagtcactcaacataatattctgagggagttggctatttttcaaagtgaattggaaccaatcatgcaaagaaagaaactaaatttggagatacgagaggacaactttccggacgagtgtttaaatcaacctattaatgctcgacttttgtctatctatacgggtaattctttaagatcctcttcttctttttcccctgaaaatcatgcatagaaatatgaccaccttttttttttgttacagatgatttgttctcatcgaaatggttggaaatggattgccccaatgttgaggctttagttcttaatatctcctcattagactatgcattgccaagcttcattgctgaaatgaagaagctaaaggttctgacaatcgcaaatcacggtttttatccagcaagattgagtaatttctcgtgtctcagctcattaccaaacctgaaacggattagatttgaaaaggtttcagtcactttgctggacattcctcaattgcaactcggcagtctcaagaagctatcatttttcatgtgtagtttcggtgaggttttctacgacacagaagatatagatgtctctaaagctctatcgaatttacaagagattgacatagactactgctatgatcttgatgagttaccatattggatccccgaagttgtttcattgaagacacttagcatcacaaactgtaacaagctctctcaacttccagaagctatagggaacttgagtagactagaagtgttgaggatgtgttcttgtatgaatctctctgagctgcctgaagcaactgagagactcagcaacttgcggtctctggatatttctcattgcttaggattgagaaagttgcctcaagagattggcaaactacagaaactggagaatatctcgatgaggaagtgttcgggatgcgagttgccggattcagtgaggtatctagagaatctggaggtcaaatgcgatgaagtaactggattgttgtgggaaaggttgatgccagaaatgagaaatttgagagttcacacggaggaaacagagcataacctgaagttgcttctaacgttttaagttttgagtgaaaaaaaaaacattttcgtagcttgtgtattcttattgactctttaatgatcacaatctagactaaacgagtaataatattacaagagtcaacatgctatgtctcgggtttgatactagtttattgctctgtaatgaaattactaaccacgctgtatcattgtatgtactagtgattttaaattatgagcttttcaaatacgcatgttatattgggccgtagaaacataaaggcttaatttgaataagccgctttgaaaaaggcccaatctaagaaaggcatactctcgcacgtacgaggagagcacgttccgtctatcgaacaacgtgtggttaacgtaaaagaccaaacgcaaacgcagtcgttttccttggtcattgcgcggcaagggaccgagtctgagaagtcaaaggcgacagctttgctatgcaattcgtctccttcgtctatctacatttttatgaaccacacattgatatttcagtgatcccctttttcgattttcagcgattctacaaacaagttttttttttttttttggattctgggttttgtctgagaagtgaaagaatg

SEQ ID NO: 1247 - DNA, 3000 bp, Unknown
  misc_feature (1)..( 3000): cDNA_ID_2131986_gDNA_ID_1620376_Annot_ID_155163 3000 nt of promoter + ATG
gagtgttcctgcgcctgtttttagggatctttgttcggttcccaagcttgataaggttattgttggattggattggccattgggggagttaaagaagagactccttgacgattctgtggttactcttgtggtttctgctcctcctggttgcgggaaaaccacgctggttagtcggctttgtgacgatccagatatcaaaggtatgtattgttgatccacattaagtcttaaagtttcaatttttactcgtgaatagttgagctggtttctcatgtagtttcctttggcagggaagttcaagcatatcttctttaatgttgtgtcaaatactcctaactttagggtaatagtacagaatttactccagcacaacggttacaatgcacttacatttgagaatgattctcaagcagaagttggcttaagaaaactgctggaggaacttaaagaaaatggtcctatattgttggtgttggatgatgtgtggcggggagcggattctttccttcagaaatttcaaattaagttaccaaattataagattttggtgacttctcggtttgactttccgagttttgattccaattatcgtttgaaacctttggaagatgatgatgctagagcccttctcattcattgggcatcgcgaccttgtaacacgtctcctgatgagtacgaagatctcctccagaaggttgttgtttcattcatctagatgaacctctatacatttgtgatctacgaaatctgtaactatatcaatagattcatctttttcttttttcacatggtgagtattgcagatattgaaacgttgcaatggattcccaatcgtaattgaagtagtgggtgtttcactcaaaggacgatctctaaatacatggaaaggtcaggtggaaagctggtctgaaggggaaaaaattcttggtaagccttatccaactgtgctagaatgtttgcagcctagttttgatgctctggatcccaaccttaaggagtgctttttggacatgggctcatttcttgaggaccaaaagatacgtgcttcggtaataattgatatgtgggtggaattatacggtaaaggtagtagtatcttgtatatgtaccttgaagaccttgcctcccagaatctacttaaacttgttcctctcgggtatgttatttatgtttcaaatctatatctttgcaccttcttgccatctaccattagtggaacttatttatttctttatcagcacaaatgagcacgaagacggtttctacaatgacttcttagtgactcaacatgatatccttagggagttggctatctgtcaaagcgaatttaaggaaaacttagaaagaaaaagactaaatctggagatactagagaatacatttccagactggtgtttgaatactattaatgcctctttattgtctatctctacgggtaattctttggggtcttctttttctgaaaattaaacttaatgattatacaaatctctgctgtttctagaaatatgacttctctataactatgattggtctctctttttcttacagatgatttgttctcatcgaaatggttggaaatggattgccccaatgttgaggctttagttctaaatctctcttcatcagactatgcattgccaagcttcatctctggaatgaagaagctgaaggttctgacaatcacaaatcacggtttttatccagcaagattgagtaatttctcgtgtctcagctcattaccaaacctgaaacggattagattggaaaaagtttcaatcactttgctagacattccccaactgcaactcagcagtcttaagaagctgtctttggtcatgtgtagtttcggtgaggttttctacgacacagaagatatagttgtctctaatgctctatcgaaattacaagagattgacatagactactgctatgatcttgatgagttaccgtattggatctctgaaattgtttcattgaagacacttagcatcacaaactgtaacaagctctctcaacttccagaagctataggcaacttgagtagactagaagtgttgaggctgtgttcttctatgaatctctctgagctgcctgaagcgactgagggactcagcaacttgcggtttctggatatttctcattgcttaggattgagaaagttgcctcaagagattggcaaactgcagaatctgaaaaagatctcgatgagaaagtgttcgggatgcgagttgccggagtcagtgacgaatctagagaatctggaggtcaaatgcgatgaagaaactggattgttgtgggaaaggctgaagccaaaaatgagaaatttgagagttcaggaggaggaaatagagcataacctgaacttgcttcaaatgttttaagtgaaagaacgttatcgtagtagcttctgtggatcttgtaatgtttgttattcattattttcgttgttatatacattataatggctactgagtccaagtacagagaaaatgtcatgccaaagaattttgtgtaggtcaatcttttaaaaccatttaagagtactactaaatccttgatccttatctaacttgaatagatttgaacagagttattcaccaacatttttgacaaactataaatgtaatattcaacattcttaatgttaaaaatataatgttggtaaattctttgaaaatcctaaaatgtgaagtcaagtctcctttttcctttgctagctaaacttctgttctgggattcaaacaatggtttgtttgaaacttcaaagtaccgcgtgacttttccgttataaatttgatctaatggcttttatgaagagtcacgttttttataatcaaagaaagagtcggtcaatagattaaaatttctctcaaattgcttggttttcatcttaattcataattctcctctcccttcataggaaccattatgaattcgaattcgattcaaagctttgatgccttgccccacaatcttcgagagtgtttcttggacatg

SEQ ID NO: 1248 - DNA, 3000 bp, Unknown
  misc_feature (1)..( 3000): cDNA_ID_2131994_gDNA_ID_1620376_Annot_ID_155165 3000 nt of promoter + ATG
tgaaagtgcttgataacccaacattggagattctcaacatgtaagtcttccctgaaagattaaaccaaagacacagagtaaacaccagaaaacaaacacaacctatttactcaaaagaacaatttgtggaaagctgagaccttggtcgcctgaaaacgttgattgggtttgtccatttataagcatcccatcgggaaatggaagaaccccaccagaatccaaacgctgttgaagcgttttgtggttggttttgaaccaatcaccaacgagtaaagtgaaatctgcggttgggagagggtaagggattggaattccaggtcttgcgtagacattgatggctccgaatccaccggcggctttgtgaaaagcagtggaagggaagtagttgaaagttccgatctgatctttggtttggaatttgtaagtgaagtttgagtttggttggatcggacagtttgttcccaaaacaccatcttgccatgagttcttcctctgcttaatcccattcctaaacccacaatttcgagtgtgaacccaattagcctaaacctttaaattgatcaataaagttttcagctttttcgagtttaaccactaatgttcaaatctttcagaggactaatccacaaatgccttaaaaggtaacacaatatacattgatcaacagggtaacgcaaaacagaggatttcttcttttggaagcatttgaaaatgataaagttcaaatctttagggtcttttttttcttaatcagaaaaaaaaaggaaattaccaggtcaagaggaaaggctggtcaagtttgttgatgaggttgaggatgatgttgtcgttggtcacaacttcaagttttggaccaggaaactgaccattgatgagaataacctaaacagacaaacaaacaaaacatccataaagagtataaaaggtcttgactcttgagtatcaaacaaaaatgggatacggagtttccataaatggaaattgttgttgttgtttgtacctgttgaggaacaccaagaggagagataatgccataagtcacagtccaagtgtaaaacttgtaagggctttctcctttcactatcaccaaactgctcaaaagagtcaaagctccaagaagaagaagatgattaagcaaggatgttgtttttcttgatgccattttcatggcttccgtaaagaatgatacagacaaagagattgaagacagctaagaactcttcttctaaatggggtttgagaaaatagagtaatgtagggactttggtctataaaaagtgcaattagatagcgaaagttgtgggtgacataagtaagtgagagaagaaaaaaaaaggagtcccaaaggtggttccaatcaatgacagtgaagatctcgagtgactttattttattgtttttgggtttggtcaaatataatcataatcaactctctcataaatcaacttcaacaacttttaaatttacaccctttagattttaaacacagattatattttatgtcagaactatgaatcttatacatacttgtcggcagatttgatctatatacattatccattatcattcacatttgaaaatgctggtctggtttgttgtaaaagtataagttttggtggtttggttgattagtgtaaaataaaataaagttgttaatgtgagaaaaagtggtagtggataatgcggtgagaacggacttgaatggtttcacgcgttttggtttatatgattattgcttccagccaaagcttagctttcattattcggataacggttaccataaaaagctaaatggaaatagtttaaaactagaaaacgaaaaaggaaaaagagtcagaaattgaacgaaagacaaacaaatcaattaagaaagttttttgtttatttttcttggcactaattaacgatgtttctggttccctacatttaaaaaaaaaggtttatgtatggagtattatgcttttgggaacgagcatctgttgtgaattgtgatgggctcggcgttgagctattgaaagctgtgccatttttgctgatttactgcaaatctgatagaaaaagataatttttattttatttgttttgtttggatgaattctaatgttttaaattgtaagttgcaaaagttgacaaaagaaactcgtggttgtgaaattagtcggtgtaatattatggtccacctattaaaatgttttcaattatattattaattacatatctaattagtatgatgaatgaactcaccgatcatatcaaaggtccatccatgcatgcagatcacaatacatgagaaacgacaaatgacgttagaagaaatcgaatacatacatacatgcattgatacataagcaacacaatgatgtatccggcatgattttatatattagaacaaaagatgaagcatgtgaggagtagttgattaggcatcattttcttaattaattaaactatgaaccactaattttgattatgtatttattcttaatagactcttaatgatcactgtttagactttagactaaacgagtaatataaaagagtcaacatgggcttgacccaattccgacatgtggaagttctcacaaataatggacagtcacatgctatgtctcttgtttgatcatattctattgatttatgagcttctcaattatgcattgtttttatgggcccatataaggtctatcaaaatgggccgtatgaaggaaaaatatatgtatcaatgggcctgaaacttttgattgcaatgacgtaaagaaagatgacgtcagaaaaaaaaacattttgattgcagtttccaggcactgtgaagtgaagtcaactacgagattgctttgcaacaaatctaaagcatctgatatagtcttccttgtctaaatctttctcaacatgttagattttcagtttctacagacaaatctgtgagctattttttcattcttggttttctctgttttggcaaattttggaggaaaggaatctgaagaggaaacaagaatg

SEQ ID NO: 1249 - DNA, 3000 bp, Unknown
  misc_feature (1)..( 3000): cDNA_ID_2131961_gDNA_ID_1620376_Annot_ID_155157 3000 nt of promoter + ATG
tatttgaagattcttatacaagcttaaagacacttacatttctctatcttaaaccccaagaaaactttaagaaacagagagagacttcttactattatttttgacttgattcttgacatttttgactaacaaaaactcaatcatcatcaatggcaaaagctctgttcttcaatttctgcatatctcttcttattattgccatacttgtgagccatgaaatcataccaacagaggcaagacacttgaggacccatagaaagtcaatcaagaacagtactcttactgtacacgaaggagccggtggcttgagaaccggtggtggctctgtgaagactgacattagcaaagaagaacatggcgttgatgagttccggccaacaactccgggaaacagccccggcattggccattgatccattagaacctaaataattacaatatttacaaacttgtgcatagtgtaccaagcttaatgtgtttgtctttctgatattctcttctcttttcgtttcatttttctttttttttacaattattggttaaagtgtattatatcttgtaaatacaatcaaattattattcgtagcaacctacgttgggaattgatgtttttaattaggtttgctaacataagaagtcatatacggagatggaattacctttaacccaaatgcaagaaaaaaacttgctaaaataactcaagtattacttaagtaaccaatttatagcggtaactcactaatgttaagagattatatatggttcgaatcttcttagtcatggtcgttgttagatctatgtagatataattcaaattcaaggagacaaaataagatgtttacggacaaaaaacattccgtaaatttatttattgttgttgacaatgtaaatatttcattaaaatgaaaagagtttggtgatctctacaaacaatacaaaaaatctgttaggtgagcactttggagttgagtgagtgatgtaaaaagtaaacattggttgatatctgtatatactactactccacacgtgtgactaaagctcggtcgatcttttaaaagtaatttgtaactacaaaatcaaataaaataaaatatcttcggaagttcttattcaaatcttctttattatttgcaaagttgctagcatgcgactgctgtacatatgctttccatgcttgagagtctgaaagacatgctaaccaacacagaactagaaaaaaaaaaaaaaatacctttttctgggccgtattaaaaagtgatggcccgttaattttccatcaatatgagcatctagttaaagcccattagttgtgcacaaaaaaaaagagttaagcccaataaaggtataatcgaaacccatttatacatcctccacttttttggtttttttcctctcttcttttttccttttaacatacatccttcgttaccttcactattcagtgtctgtaaataacatatataatatcatcataacaatattttttcaacttctcttatttataattccatagtttgtttgtttttttttatggtaaaatacaactccctagtttatatatttttttttttcccctttaacttttcattttatcaaaaaatgtttttaaaaagagtagaggactcataaagcttcgtacttgttttatttatataattaataactcgtatcaatgtcaataactatcatccatcccttttttcttcctagttcaaaaaccttttaatattgtttgtataaatatctagttatctactattagaccattaatacaagaaaacaaaacttttaaactgtaaatagtggcttgattttgaatgacgagacttgtatgtatacgagtggggtctagaatattagtcgctgtctagtacatggtttaatggttcggttggtgcaagtaattaattatgagaatctttgcttattttttaaaactaataattccacaagtaaatagtttaatacgtcaattatatatgtctttgtctaatgaaaattttaaaacttccacttaattctcagccgtccgatcatccaagatgtgaccttttcatgggcctagaaccgcgaatcgtagcaatgtgggcaacacgtcgagaggaatctcttagacgaagtaaacgccgttagacttcgagattccccgttattaactccgttagtgaggcaaccgttggcaattgtaccggaccgtaccggtttttgtcgtcgtacgcacacaaaagtccaacacactcgcatagcaacccaaacatgtgtaacgccgattttgcccccaaaagtctcatacggattctcatgccacgttccaaacaaaagtatttggctttttctttacttttcttttttgctattagtatattttgtttttgttatatcattttaattacaccaatttaccacgaatctcgtaataataatagtataatactatacacataatagttaatatctttatcaaatttaataagcttttaaaatatttttgatatataattcattgttctgtttgtaaatgtatttgtagctcactctgctagtaaaattaaattacagctttagccaattgaactacaaagtttaccacttgaaatataaataaacggtaagtatatgtaaaacaaaataaagtagaaatacaatcacaaaaactaaaaatttgtcttaaaatgtcattatgtaaagaccattttaaaacaaaaaaaaaggtaaaaagaagacgactgaataatattacgaaaggacccaagccaaaagattaacagttaggtcataagagaagggtaataaagtaatttaaaggaagagtatgtcatcttgttcctctcctttaattttccagtctattggtcctcagcctcccttctccttcaggtggcgttgctctctcgtccccaagaaaatcgcttcttttatttttttgtttactaaatcttcacataatctttttaaaaaaaaaagtcctaaatttcagatgattcgatgttcttttcagac

SEQ ID NO: 1250 - DNA, 3000 bp, Unknown
  misc_feature (1)..( 3000): cDNA_ID_2131969_gDNA_ID_1620376_Annot_ID_155159 3000 nt of promoter + ATG
gtacttcccctcaaggtattgttagcttccactcatttcgatttcaatcgcgatcgtataatgaatttagtaaaatgcagatgttgtgagtgaatttggtgatgggattagaatggtttggtgtttctgttaggttcatagagacgaagaaactggaaagatacttaatttagtattcgtatgggctgatgatggggagaagttgaaggttgatgttcctgttgttttcaaagggttggatcattgtcctggtctccagaaaggtaactgtttcttcttttgttcgcatcacttgccttttttgcagctagtttcacaggttatgcttactgagaaatcatgtagaactgataggagtagtattctgtgtattggccttgatactgatgagaacttcgcagatcggttttgtctttgtttttgcatggctagtgctcatgtgcttctgttttactgctatccagccattattttgatcgagctaagctttgtaaagagaaatctatcacttgtatctgatagtaaagtttgcattccaatggtaaaaggaactaagaaaccagatatttgatgtgtttgtgttttttctcatcggtgtagagcaaaattttcacctttttcctcattgggtaacatagactagtttcatgaatgttcctagtttaaatctgatcgtctctgttactgtgagcagggggaaacctgcggacaatccgaagcactctgaaactactagggccagctgagcacattccatctaaaatcgaagtagatgtgagcaatctggacattgaagacaaagtgttattgcaagacgttgtatttcatccatcattgaagctactgagcaagaatgaaaccatgcccgtgtgtaagattgtcgccacaagcccggtgaaagaaccagaagctgttcaagcataaaataagtctttgaaaagagtaatgtaatgtctctctgaagtttctgttccatacaaaaatgatcatttgtagaattctcagaggaaagaagcagatttttagaataaccctttttgtataaacctttcaagtggaagaacacttaaaccctctacttgcctttgggtttttgaacgacccagatcaattttttttgcatcgttaagtatgttgttacttcactaatatccaattaaatgggtttggactagctgatagcctgataatactagtgagtaaaaatcatctcgtatttgaatgggtcgtacttaagactacaataagagccaacgacttggtccataacagtggtaactgggacgacttggtccagaacagtggtaactgggacgacttggtccagaacagtggtaactgggagtctgggactaagaatgacacgtgtcgtttgttgtgaccagataaatttgccacgtattatttggtttattttgaccgttgacgttttgtggaatcttgccaaaaatgtagttgaccttcggaatcttccctcgcttgaactcgaaatttccatttctttctttttttctcctttttctggttcattttttttctgttattattttttttggtgggaaattcttagtaaataacagtcttcgttaaaaattcaagaccgaattttcatttagatccgtttcattcgtatgattgtttttacatacagcatgtgaaatcgaattcatatggtctcatttttcaaattcacggttatatccaaaaaacattttacatacgaatttattatattcggatagatctccgtttcaggaagaaatgaatattccagctgctttttctagctttgactgatctatacgggacttttacttatttagaatttttctttccgtcaagtatttaattttttgtaattctgttgcatttattgtggtttgtcattgaactctagatcaaaaattggaaaagatctttgaacggaagcatcctgcggcttgcgtattaccaccggatcagaatagaaaacgtaaaagtagagtgaatatatcagaaatactatactataaagtgaaataaataaaaagcttgttgacgaaaaagtggcttaacttaactaatgactaaggttaacttggacctaaaccacgtttaaattttagtcaatgcctcgagatccgtacagtacggttttacattggagtcggctttacgcttgcaaattgacattttctcgcatctttttctttatatttcctttcacatcatagacttttagtagtatatttttgtggtaaaacttttgcagactttgtgtgtgtgtgtgtgatgcttttatgtaaatgaagaaacaatctaatgctataataatgtggatgatggagtaggttcatgacaaaagatgaactttgaaaatgaatagaaaaaattaatgtagagacaaaaactaagaaaagtgaataacgtttgtagtaaaatatattctacataaaataataaattagaaattaccacatttattttagtgttcatatatgatatataccactcacaaaatagtttaattcaaataaacttctaaattaactttttaaaattaatatacgaatttaagttcagatttacaaattactaagtcaaatatggtcaaatattctaaaaatgaattttcaaatatatatacttttacagtggcgaaaatgaaaaagaccagaaaaagccgttgcaaaccgtgtcacgaaaactcgaactaaacccgtaaaccgcctctaaaagataaatttcccaaaataaaaagaacatatttggtcctaataataaaaaagtaaaataatcatttattcgttcttctcctcgttatacttttttttttctggttttgtttttgttatttctgttaaatccgttgggttcttccatggatcctcatcgtcatcgcctccatctccgtctttcttcttcttcttctgctcgattctaattccgtaagagagaaataataaaggattcatgttcacatcttctacctgatgagcataccatgattctctcgctatg

SEQ ID NO: 1251 - DNA, 3000 bp, Unknown
  misc_feature (1)..( 3000): cDNA_ID_2131973_gDNA_ID_1620376_Annot_ID_155160 3000 nt of promoter + ATG
tctttgtgacaattcagtccaacgtccaattattgaatcaaaacttagatttgtatttgacttaagtaatagtagtataaagttttatgttattcacaaatacagtacgtactttcgagtaagatgattaaggtcacatgcccactggagatggaattaaagtgcttcgttatgttcaacacaagtctaatgttgcacatggttgtgttttcatcactgatacaaatacagtacgtattttttttgttaaatctatattgcgaaacttataattaattgcagtaattcagtcaagttttcttagaaaaaacttcgttaaataaatgtaagctaagcattcattgttgatataaataaagtagtaaatttatatcaaatttttggccattagtaggggtattatcgtagttacagacaaagcccactatgagttgccgcacgtgcgccagaaccaaactatggagttccaaattttcgtctggtctcatcaattcatttattaaaattttacaagattcaaaacaaaatggaaggatttagatgcccttaacatatgtatccatatgcaacgtatatgattaaagcggatgattcaaattcttaaatttgttgatccacaaaattcgataatccatatattttagttaggatttcaatttcaaactttatgttagtgaataaaacgaataatatcaaaccttgtatcaatgagctcaattcattggttgcttatatgataaggacacgttcacgcgtaggcatttttaacttgcaaacaaacatataattttcacaataatctttccatgaaaacgatcaagattctttttcaaaaattagatttggatacttttaaaacttcgactattaatgtttttaacaaaaaacaatcgactagtatttcttatatcagatttacagaatatatttatacactttaactaaaaatgatgaggaaataagaatacaaaagtcatagtgtatatagtttagtttgataacgcttaggtcagaaaatcattaaaaaaccaaaagtttcaagggtgcacaaatacccatatagaaaaataatagagtattggttttcacttttctcccatttgtatcgttgagttttatgaaacctaggcaaaaaattaacgtagaaacgtagaaaagttgcatacgaaaaatatgtacaaggaaaaagggattggcgttaaaagttggtatacaatggcacttttcatacgtactcgtacgcattatactttcctttttttctcgtacgcattatacattttaattagttcttttgataatatttcacaaaccagttttgggaaaccttcactgcaaaaaacaatcttactatagaaaactaacaataactagaaaacatttgaaaagaaaacaaaaaaaaatctacgagttgagatccgatctttaagacgtggacctctgaagactatatactttacatacaaacttgtttcattcgtgcaaatccgatggcattgctgtaataaactattgagagtagaacgacgaaaatagagaaccaattggatgacgtcatccatggccaatcgaataagacggaagtttaaaagtaggaacaattttaagaagagacaaaaagaagataaatgaatacatcatatcatcgctctatgaataaataaagattttataaacaataagaattatataaatttaatgatgcaatataaaattatataaattaacgaataatttggttatatatacatgtttgttgaacatgttcttagccaactaaataagaaattaaatagcacaactatttctatttttattttaaatttactgttccattttttttacagttgttttaaaacgtactatagatatgcttctcgactaattttctgttctaaagacgtatatttttgtttatgagtagttatcctgtaaatatgaatatttgtttttttttgttttttcgttattctttcttgtggcgtgagacttgttgtggttgatatctaatttgaagaaggaattgagatataaggtaaaacactattcgttcgtctcattctaaaacaaatatatatttgaaaggttaaaagttagaaaattcgttgggtttgttatatattattgtcagcatgttgactttgttatttgctatgatagacattgtcacgtgcaatggaccgtctcttatttgcatgatattattgttttttgtgagtcttattgtaatattctgattgtctcctcccctctagactctagttacagtcttacaaaaacaactaatctgaagtgtgaatagattagacggtggatacaatataatcatatgaaataagcataacatatatagctagctattgtcaacaaaacatcaattttaccttgcaaccatagaaatgttatatatataaaaaagggtatgaaacacaattatcatgagcaaaacgagaataatagactagagagggttgaagtcacgaaaagaaacatataaaaataaagtaatattggttggtaagaaaataagtcaaaattaaataatcagagaaggtatatggagtatatggacatttgcatctttggcctatggacgtatatataagcttagcgtgtgagcaactgcatactgatacggttttggaaaaatcataactaagacaatgaaagaatgttgttattacgaaaaagacaaaatgcacgaccaaattattcgtgatcatattaatcgacatattattgtgtagttatatatataactggataacaagcaaatttcgattaagataaatcaaaaacgatctcttgtctttttacattctaacccaaaaaaaaaaaaaaagaaaaaaggccgaaacaatgataaaataacactatgggccaataaaagcccaatgtatatagtccatagaaagcccacagagcttaaaccctccaacgcctgagttttgaaggaaacaaaccctaacgtcacatcgaactctaaaccacactgagatg

SEQ ID NO: 1252 - DNA, 3000 bp, Unknown
  misc_feature (1)..( 3000): cDNA_ID_2131982_gDNA_ID_1620376_Annot_ID_155162 3000 nt of promoter + ATG
ccggataaataattagggtttcgatatttgtttcatatagttttttcttttcattttctctgcattttgaatgttctttatttatggtatagtacagttacagtggtacagaggaggttttgctctttatatataacatttaatgaaaaagccttgtcatttcttcaataactctcctgctcttatagccatagcccatatttttaaactacttcctttttgttggattctctgaacaataatgcattaactaacctagttattattaataatttagggtttaaaagaaaataaatcgtggtgggtcacatcacttcaccaattcttgatatggtaattatttgatatatgttggctttgttctacctactagagatgaaaaagagaatttgtgtgtatcagagtctaagatttgcttacacctttctgtctggaaatcttttaagtgttgtcccagaagatgcactttatacttgcatgtattatcaatttagcatcaatcgcatcgatcaagttctttatattaataatattgtttcttaagtctctcttttggttttacttatatttcctcgacttttcttgcagttggaaactctgactttgctcaaggcattatggacgcaatcgagtttttctttcttcctgattttgtcggacgtccaacagcgaaaagacactcaccacgtaaaagtcaaacgactaacaaagaagtcagcttatttggttgattttgagtcctgcagacagttttggtataaagtataaaccaaaggcctcgtatcaatttgaacaaaagatctccactccatcccgaaacaaatactaccttgcttttttttttctttgtaccctattaatatttttttgacatttcttttggttcaagtaaaaaaaaggagaaattagtgtttttggttgcaaatctatttgtaaattagatgtcaagagaagtgttacttgccctagtggtttatcacatatccgacgtcaaccggaaatattaaattaaaaagtatgaataatctatctttgtatatccgcatttacatttttttttgtttctggaaaagtatcgatcctgttatatatacctaaagtttaaaatgcgaaataagaaacaaaaagagtttagtttatgaaaacattatcataatgataccaaaaaggctaaggaaaaacaaattacaaaaaggctacatcattttttaaaagagagtgtgtgcttcacatataaacaaggaaacgcatataataatcatcaagtagctagatgaagctaaagaagtagttaagtgtgaatgcttggcaattaagattgtgttggttcatttattaacaatctttgaccactcactaatttatttttggctctctcttctatatcatcaccgttttatctttataaaccatccctcaagactctcccaatattacatgatgtgtttaatcctcacgaattcgcatgaatcaaaaccggctgaaaaacagatgtaacatttaagttaacatactcacaccaatctaaattattagactttcattcactttaacacatttgtccataccatgatgatcataacaatcagtagctaaatcaatgtgagtgtggcttagatatttgatctgaatgattcatgagaaacatggatacttaatgttcatgtgcatgtgcatataatagtatattaatctcaccagtaggatgcttagtatagcaataaagagaaggtggtgaaattgatgagcatcggccattaaattaagcactgacccattaattgcgcacttacccataaacaccattcactccttttcattaacttaagagtaaaattatacatacacctcgctatctctaacactagtcacactagtgtaccttcctcggtactcttatcaatgtctcgtgtcgcaataaatccatataaagatttctaactaggtcaatccaacatccaatttaatacaacagtccttagtagattctaatttaagtgtgtctctatatatatatggaccgacaaaatcaatgacctaagatttgactatatatttcatgcaaatatgataaaatgctattcatccaattaatcatcaatattgtaattgggctggccttttgcttatatctttaggcattttctttaacaaaattagagccaggcccatcaattaaattgaaaaatgcttagaagttgtcacgtcactgtccatgtcatccatggtgggattgggctggcctaaaggacttttctatgtaaaaattagaggcaggcccatcaactaaattaaaaaatgcttagaagttgccacgtcagtgtcaatgtcatcagtgtctatttctaacgccgtcaagtaacggaataacgcaaccgaatattctttcatcacatggccgcttctgcagcacgtgactttcaagcttctgttttccttatgaactaagtttttctgtttcctccaaactattttttttaattagaatatcttgttatttataacgaatatatcttcttcttttacttatttttaacacaaatatttatttgtttgatacgaattctcaaaatgagaaaaacgaagaaaaatagaaaaaaatcgaaacggataaatacagagaatttagagaaaaaaggtttgtattttaggagacaaggacgagtgaagtcgtgctttttctttttttatttcatgttaattttaatatttttgggttatagtttcttaggaagcaacatcaatcatcaaaacgcggcggctcttgtcgtatcaaagcaactgaacgttgtcgttttgggacaatccttatctcttggggcaaccaattattgccttttttcttcctctctttccttattcgttctcttcttgaagatatttttccatttattttctcgaatcttcttcttcttcctagattccagcgacttaacaacaacaacaacaacatattctctgctgggtattagattcgaatttctctttttgtgatcagaa

SEQ ID NO: 1253 - DNA, 3000 bp, Unknown
  misc_feature (1)..( 3000): cDNA_ID_2131965_gDNA_ID_1620376_Annot_ID_155158 3000 nt of promoter + ATG
cagatcagaagcccacaacctagcagaccatcttcaccgttgcattcggttgatagctcagctccaccgcgagatagtgtttcctcacctttgcatccgaggttgtctactgatgttacgaatgggcgacgtgattgctgcaatgttcatcctttgcctctccctcctggagctacttgttcctcttcatcagctgcttctgttccgtccccgcaggctcctctcaaactggattcattcccaatgaattcccagtggaagaaagggaagctaataggtcgtggtacttttggaagtgtttacgttgcaagcaacaggtagtcttttctctctatggtatgatctttcctacagtttttgagtgccaatatgcttcttcttttttagtgcaatcctgagttgtttttcatttgcagcgaaactggagcattgtgtgcgatgaaagaagttgagctatttcctgatgaccccaaatccgcagagtgtataaagcaattagagcaggtaacctccaggagagacaattctcccagtgctctcagtcacggctgtgtttggttgttcgtttgttatatatcttatagctttctatttatttatttcaggagatcaaacttctaagtaaccttcaacatccaaacattgtgcagtattttggtagcgagacagtgagtaatcaatctgtttatatatcctctgtttacatatatataatctacctacccaaggcagtgtggctgaaaattcattgagcaattctctgattgtgcatgtacaggtagaagatcgtttctttatatacctggaatatgttcacccgggttcaataaacaaatatatccgtgatcattgcggcaccatgacagaatctgttgttcgcaattttactcgtcacattttgtctgggctggcttatttgcacaataaaaagactgtacataggtaaagtcacaatattactgtaatcaatcttggtgaatattgttctagtgttgaacctaagcatattggtttccctatttttgttatcagggatatcaaaggtgctaatctccttgttgatgcttctggggttgtcaagcttgctgatttcggcatggctaaacacgtgagttctatatcctgtctagtattattgctgcttattgtcttttaagtgatgagtcgaatgtgaatatcatgctctttgtttagtttccgttttataataataaagttgctatttatattcttcagcttactggacaaagagctgatctctcgttaaagggaagcccgtactggatggcaccagaggtggtcattgttctatgatctttgaaataaactagactctataaaccctatatatatatatatatactaatatatacgtttactcacacagctcatgcaagctgtgatgcaaaaagatagcaacccagatctggcttttgctgttgatatatggagtttaggatgtacaatcattgagatgttcactgggaagcctccttggagtgagtttgaaggggtaagcatacacatatgccttctactaaagagagttttttgtttcttctgatatctaaaaagttctttgtatcaactttgccttatcataggctgcagctatgttcaaggtcatgagagatagcccaccgatacctgaatcaatgtcacctgagggtaaagacttcctgagattatgcttccagagaaacccagctgagcgaccaaccgcatctatgttgctagaacaccggttcctaaagaactctttgcaaccaacctcaccaagcaacagtgatgtctctcaattatttaatgggatgaacataacggtaagcaaaacctcaatacaagcgtgaatctctctcatggaccgccctatgtcataaataacaaaatatcccccccctgcaaattgacaggaaccaagcagtagaagggagaagccaaatttcaaactagaccaggtcccgcgagctagaaacatgacatcctcagagaggtaatcaatcattcatcacagttacattggcataaagttttgttttttgaacctgaaacatgtttgtgaaacctgtgttcttgtttttgcctctctgttgtttgtttgtgtgtgcttggctttctacagcttcttcacacgtacttctttttctccagtgaaagtgggcaacagcagcagcaacaacagtaccggtctcccgatctaacaggaaccgtgaaccgtctgtctcctcgttccactctggaggctatcccaagcccgtgtccttcccaacgacctaagcccagcagcagtgacaggagaagaacgggcgtcacttcagatcacctttgatttgcagctcgagaggttaaccaatagaagctacttctatacgtattcttgtacacgtaagtgtatgtcaatgtacgtatttagagtttggggtcgcgtgggggaatacgattgggatgaaatgaaaatcctgtgggtggtagatgaagaatattgtgtctgtaaaattataattcaatgttgaatcgatagaagaagcttttttctttcttcctcttttttttttttttttgcttgagagagttgtgtataaattattttaacgacgtcttgtgtacctttggtttcgggtctgtatccacttttagatttagatccatttaaaacaaaattaatctctgattaaaagtttcactttttttctctcgaatctttgattatgatgtagttaatatggaaagctcccgctggatttaaactgacatttataaattaaattattaaactcaagaaatatagattaaataaataaaaatttgtgattggtgaattcaaaaactggttatatattgtaaatacttaaaactagaaagtgaatcgtgtaaaatatccaacctataaggctacccactatcaaattcggattcaaaaaagggaaaataaatcagagagccgtttgatatttcttttgaattgtatttgtggtgattcctctgaacagatctctaatg

SEQ ID NO: 1254 - DNA, 3000 bp, Unknown
  misc_feature (1)..( 3000): cDNA_ID_2131947_gDNA_ID_1620376_Annot_ID_155152 3000 nt of promoter + ATG
gttatgacaaaacatcatgtcatatgtactgatgtacacggtctgacattttggcaatgcaaatcacttcatattatcccgacaataaaaagctaaaatgaaataaaagaaaaattaaagttgcagttaagtgtgttaccaaacattaaaaccaattaaacgcaacacaatatgttgaccaaacaaaatctaaaaaaaacaccattcagtaagaaaaaaaaaacgacccaatatacaataaatttaactattatatcaaaaaatattataatcgacgatcaagacttagagcatgttcataagtgatactcacaaagtatcattaagagtttttttagtattatttataatgtttgtttaataaatctatataatattttttgtttttgtcaaatgtgaccaatcagaagaagtcacgtcagatgatattggtatcacaaatattagtgggctgatactgatcaagaatattctaattgctttactaatataaaaataatttttggacttgtgatactctaaaaatatcacccatgtacatggtcttatatcctcttgacgaaaaaagagttatatcctaatgtattatattaatattgttatcgcgtcgcaactctaattcagatatgggtaatagcttgtgtgggaagtgggagattttttcatttggactactgaaattcaaatactacaattcacatagtcgagagtttttaaaaaattatatgtttgaatatctgattggtatggaaaatttctagatacatacacctatttatcccttaaaaaagaaacgaaagaaaaaacagttccatgtgtttttaatttagcaactgtatcggagcgtgtctcagcagaaattcttgggcctatttttgtccaaattccaatagccgaacagtcaattgacacgtgtataagacatcaccatcccaagtaattactctctattgtactgtacagattggtttgatgataaatattcaaatatatgccaaacagtaaataataactaatcaattttttaaaaaaaaatcaacgaatattttctttcataataaaaaccctaaataaggaataacaaagtaaaaaaacaaagtttttaaaaaaagatataataatattaatactattttggttattatggcttcatcattgatcctttgtgcataagaactaaatgagtaattgagtactatataatactgcacaaggctctctctgtgcaattgactgtccctaccaaaattaactctctctatctctctctctttctttctctgtgtaagaagagtctttaaaagtgagtatatttcgacacaaacgagctctgtctgtaatggcatgcttagaaatgtacaactccaatggtggtggtggaactcccatgagtcctagaatctccttctctaacgatttcgttgagattaggccagagacgaccaagacgacgagatcaagccctctctctaaacaagagggttcttcttcttctttttcagataatttcgagttctctgtctcaaactacacaatgatgccagctgatgaacttttctctaaaggaaagcttttgcctttcaaggaaaccaatcaagtccagagaactttaagagaagagcttctcgttgaagaagacgaagaagaaggtccacgtgatgctaccaacatcttctctctcaagccaccaatcttctcatcatcttcttcttcttcttcttcttccaagggaaggtggaaagggcttttgggccttaagagggcccatgttgggtctaagaacaatgaagagcgatttgttcatcatatgattaacaacaacaaacaatctcaggtactttctctgatctgccttggatttgttcatatatatgagcatggtgtcgatgaaagtcgtgtaatttgtttttatttctcttaaatacgttatgtaaaaatacactttttgttctcgaaatgttcataggaagcaattggtggaagagaagggtcaagttgcagggagatgaagaagagtatgtagagcttaaaaacaaaaaaggctttcacttggtttttgtttttttaggaacatggctgcttccaaatttttaaaaatttagatttatgttaatcttagatctgaaaaattactaaaaaaaaagacacttatgtgttgttgacggagatggtttatttcattaactgttttccactacacatgtttcatcgattcttctgagtttttatcttgttttttctttttcttttgaagggtgtgagtattagatctatctttgtcgactatttggaatggatgtagtttttttttttgtcgttgtacaaaagaaaaaaagaagaacagagtgtgagtagttcagaaaatttaagttccagttgttttttaaaattgaagcaacgcatatgtctattgtcttcgtctttagacatctcttgtctgtccattcgttattagctattaccattcaactccaacttctctctcgttgactgtgttatctagtgattactatgcctcagagattcagaaatatgtcatataaaaattactagcgtttctttattgcagtttccccatataatggcaatgcagcgagaaatttacatggtttcctaaaatattgaaaggcccaaaaattattgtttggtcttgttgggcctgaaatggaaataagcaaatacatattcatatttttttattttttttcaaagaagatattcgatatttatcaactgatataagataagctattgggcttctattttaacagttgtaacccgccagtaaaaaatgcgctagcttatattattaccgtgactcgatctttcaaaatgccacgtggcatttattatgtggatttggattttctaacttgttctcctcacgaaacaaaattcacccacacaagacaaagcgatcgtcgatcccacccacaatctaagatcgccggccgattctcgtcgccgacaaaagaagaaccgaggaagaggaaagcaact

SEQ ID NO: 1255 - DNA, 3000 bp, Unknown
  misc_feature (1)..( 3000): cDNA_ID_3061416_gDNA_ID_1620377_Annot_ID_155174 3000 nt of promoter + ATG
tggtgcggcttgaggagaagagcgtggggatcagagtcgatgtccttgttgggagacttgaccaacccggcggcttcaagagctctaaactgtgtagcagagcttcttaccagttggtaactgtacgtccatatgtagaaacccccgagctgcccttgacaaaaattaatcacacgatcaactcaacaattaagtctgagcagagatcagaagatcatatgtatgtatgtttgacttacggccatagagaaagatgcgtaggagagcccaatggatctgcagacactacgattcccaaaaggactgccttcctcgtcacagatggcagggaccagtataagcataaggttccccatattgcctacgtagacaggacagtaaatatgattcatgtgagaattcagggatatatctctcctccttgagattaaattttgaggttttaatgttacctgaggcacaagtagcaattatgaggccatgaagttgaggtttggggttcagtagcttgaccaccaaccatccaagaatgcctcctactagaaaggtgattccaacatttatgggcataaaccacctacaaaactaattttggtcaaatcaaagccacacgtatgtattctcagagggatgataggagactggtagtgcataccatgaaataatgtcctgcaatgtgacagtctcggcaaggttggcaaacatgatgcagggggtgaataccacgaagacgagctgcgagggaaaatgtttgttagtgatgatatatgaatgcatgcatagttgacaccaaacagaaaaaagaaaagcagagacggaggttgaccttgttcacggatcttcgggtgtcagcagagagaagagagcagtaatcggttgccaagaaagcgccaaggacgctgataagaagaacttgaacgattggcattgaagccacctccaacaactctaagaaacccatccctaatctcttctttttcttttcttttctttttttctggtttcttgtagaagaagagaagcagtcaaggttaaagatatagagatgaaaggtttgatatttgggctgtttgtgtagatggagaggattggtgggtatatatatttagattaaatacgtataggagtggggtacatgaagtgtaaaagaggagtctaacttttcaacataggaaaagtcatgcaagaaaggtgaataaaaaggacaagttggcctctaggtactgttggtctctcaggtagtgcatatgcaaaatcacatagatatcaaaattagaagattcaatattgggacgaaagacttttgggattgtctcaggttaataatgttgacagaatcaaagtaagactcatcgtcatgctgtagctaaattgctcccagtatctttctttccaaatatttttatatctttatttccgctttctttttctctagctagagagatgtatttaaactatccatggatattcgagcacatgagtcacaactaacaaactaacatttttcaaagtggccaaacttgaccttttaatcataatattatttgtctttatcacctaacataaagtcacgatacaaaacatctcttgaatttgacccccaagctgattgctatgccaagtccacaatgctcctcataggctcatactctctactttattacaaatatcaataaaaaaaatgtcaactgtgatatgtgtgactttcacaagccactctgctaagttgactgatcccaaccctgcacatatcacatatgcacacatggaaaacagttgcattgtaatttggggaaaataatctcatcctgcacatctcctctgtttcctctttacaactccacagtatcttgttcgaatttatttatccaatcaaaaaataagtgatatgctaaaaaaaacttgtgggattaaaaccaagatgaggaagaggaaaccgtcgtttgcttgtatgtctcggagaattacgtgtgctgatgattataataaattaaaagtaagagagtcaaatatttgtttaaacaagaaaacggtaagaaggatgagaccaggttttgtggtagaacaagtccgggagataagatagttgcgtgactaggaaatggcgtgtctacacaagggcaccttttgatttcgatcatataacaaagaagtagataggcctaaaagagcccatggtatgtatgtatgaggcagctattgtgaggcctatatatgggcttagctcattgtccatttgtttccaaattattcatatgatcaacgatagatgatcaaatgaagatatatttctaatacatttagttttatcattgtcaaaatatatatttctacaaagaaactttacaacatgatcggattacgtgaaactaaaaagagggaagaaacttgatagagacaaagaggagccttttgttataatcatattagttatcccaggctgagaaagtgatgattcctccatgcatttaaaaaattgtaggtacataaagaaaagaaaaaataaataaaggtggtagatagtggagcaacggccaagagtaagataacattctatatctctaaagttgcaagttgggttatatttaactaaaagtggaaatactaaaaggggaaagcaatcataaaagcataaccaaatagtcaaactgacgagtgtgttggacgattctgttcttctacccctctgatctctcacaggggatcaaattgtcatttagttttgatatatagagccacaacagtgacattagtttgttgttgactactgtaagggttgggtttcgaaaagagacatggaggagtgttattaggttgattgttctcaagtacctccagtgtcaaacaaacattgacgattgattctcttcccataatttattgttatgcattacatatcacagtaaacggactttcagtcaacaccgcatttatttgccctcttcattgtttcacgtacgtaatcaaggaccaagggattttcttcttttggctaccatg

SEQ ID NO: 1256 - DNA, 3000 bp, Unknown
  misc_feature (1)..( 3000): cDNA_ID_2133084_gDNA_ID_1620377_Annot_ID_155205 3000 nt of promoter + ATG
atcacagaaatcaacagaatacgctcttaacacttactttgcttgtgtggattttgatagctagtactaacctggtttgataaaatccgataaaccaaaatccgtagcctttagaggcgaatctagttgagctgatttgaacaaaaagttctgcaagaaattggaggaggagcaaaagcagaagatttattattagaaacaaaaagcacatcctaagaggtataagcaagagaatgtacctctggtttcatatctctatgtacaagaccgtgtagatgacattctcctgcaactttgagcatctgcctaacgacaacggctgcatctttctcggagtaccgattacctttcctgaaaaataaaaaaaggaaagcatcaataatgagaaggtaggttctttcttacgattccaccggtaatagattaaagagtagtgagagatgctgactaacttggataatatcctatccagcaattcgcctccttcgcacaacctagaagaaaggcaagagtaaaatgtgaatgccaccgatacatgaaggatagactataagaaatgaggaaaggagactcactccataacaatatagacgtaatcgtcatcctcaaaggcattgtgaaactgaacaacattctcgtggccagagagagcaataagaatctgaacctcacgcttgacatcctcaacagcaataggaagaaccatctgtgagcaaaacatggtgatgagtgacctcaaagcagagcagaggatgcagtaaaaccacagaacaatgttgcaaatgaaagaacagagaaagagcactaactaactaaacaaagtacaaattgggaatcagtgttaaactaaattaaaaagatccgcaactatttttctgatgtgaatctagtagatggtagtggaggaagataccaacaactagtaaaaggggaaaagaaaccctagtaagggctggaaaaagtgtaccttagacttatcgagtcttttgacggcgacgcgatctccattgggtctgtggatggcgacgtaggtgtagccgaattgaccatggccgagcaacttgccgatggtgtagtgatcgtggaagtctttggagtagccaaaatcggtacgcttgccgcaggggatggagccggttcggcgtttggtagaggccttggtatcgatgggagtaggagcagccttggatttggtctgactgcttcgtctactgctgctagcaccagtgactctaatggcggagaaacagacacccatggctctgatgaatcgagaaagttagaaaagaaaggggattaataaaagaaagagatgaaagaagaaagaagaagaagagaggaaggcagagaagattattagagttgagttggtcaaacccaaagcgccgagtgaacccctccaaggaggatccccaacgaaagatccttctcactttcccactttttttgccttttcttcttctttttttttttttattattattattatctgtgttttttttacctttgttttgttgttatacatttctgagaattttaactgtcatttcacgaagtcaagaataatgaatttgtattttggtgtgaaagcgaagaccactgactgaccacccctgtgggatgtgggaagctccatgtttgggcccgacaccatcccccggtaagactcaattcgattcaacttcagagtttgccattatcattatttattgccactaaattattatggactctgtgtctctcatttattactttctaacaaactccatattttagtagagcctcctcctactagcctggatcttttgtgtattttgtactagtattcaagtccctgtcttcaatccctactcaaactgagattactttaaccttagattattggtctactaaattgacttggtcttttcaaacaagatttccatttttctaaaacgtctatatatatttagtaatgtttataatacaatctaaggcgtatacgttttcttttttcttttctactggttcgacttcttagaattgaattttgcccagaggaaagtaacaaattatctcttttgcaaatccggtcactgacggtgcactgcatcacattcacgtgccattccaacgcacaaccgtattccgatacttttttccttcttctacccgtacgctgttattataagtaagggctcaaattatattttaatcatgtatggtataagaagaagaaattgtttgaattttttttaatgggaaaaccaaagtgtttttatgatgacgggaggcacttacttggcagtatgaactgaaactgatttttcattatttttttacttgtctcagattgaaaaacgtgtgcatgaccatgttattaaacaaatactactacttcacctaacgtattttaatgtttgttttgttatacaacttggatccctctcaccaattatgatcactagtgagcccaaccaaccgggcccaatacgctttcatcttttgggcccaatcatttttttcctcaaacttcaaaattttcattacagcatatcgctggtgtgtgcacggcatgcatgacaagctaaaacgaatggtggatataactaacatatacagcttatactatacatggtatacaaacaaaaatgatgatccaagctaacctactcactcatagttgtccatttattctttctcaaaacaaaatcccatacaccagacctctaagtctaagtctacgattacgagcatagtcacaatgtctctcgccaacagtctcttatcatcaagtaagtttcattattttctccccaatatcactttgtcgcatgcatttccatcctatcatttccccatccaatctcctttaaaaataaaaataaaattggatttatttctttcagtaaaaatgaaaaagttgtaaattagtatagtcttcattaatgttcatggaccttgattataaataaatgtcaaaaaatgaaactagacttgagttggtcttcctcgtcgccc

SEQ ID NO: 1257 - DNA, 3000 bp, Unknown
  misc_feature (1)..( 3000): cDNA_ID_3061372_gDNA_ID_1620377_Annot_ID_155203 3000 nt of promoter + ATG
ttcgtccctaaaaaggccatgattaaaagcccacactattacattagattttggaaggcccacctcttttatttgatcactgattttttcattaacacaaaatcatctttcataatctttagaatcttactaaaaacataaaactgtcttaattaagtcacaacaatctttattttagctgtcatcataagtcacataacatcctccgctggcttcattttctaaaattattcaagattgggcgagttggaatagtttcaattttttgtagcaacgttgacgttagcttcgttgtacgggtcttttttgttcatcagcttagataatctctcagcgaggctcttccttgtcgcaggggatacaccattcttccctatcatcgactcaagaactgcctcacccaacaacttattcttgataaccgcttttccagttttcgggactctctcctctttcgaaaatgcaatctgcatcacaagttgtcaaaagatctcgatcattcattcgaccaatattattcgaaatgataatccgaaaaataaagttgactcactgtgagagagcctttaggacagatagcgaagatgattgaagagccgggagggaaatcttggtttttgaagaccatcaagaattggtcaatggctttggcttcggatcttgtgtatttccctgacgctttcatgatctcctcacagttttctactactttctccgagtattgtatccccgttaacctctttttcatcgtcacccttgccaatttctcaaactcaccttttcccaccagagaagaaaatttaaaaaatgtaatatatgacgtgtttaacttgaccatgtaataactacacaaatcgtgtgaagtgtgaacgaatacaaaagtgttttaattatatttagcacgtaataaagtgtacacctgtgacgagttggcggaagaaagggacggattccgtcaactcctttgcattcttgcctttccacttagcggagattgacggcagtgccatggcttcaaggtagactccgatgaccgtcacaatcacgaacttgcctttaatatcaaaccatcatatccctgcgtgattaaaggtaattagccacataatgctgctgtgtgcattaattgtatagacagactatgatgctaacctgcaccaccgaggaaaagtcttttgtgggaagcgggcgactcaacagccggaggaaaagtaaatgcgtcgacgtggagtggcgtcacggaaggcagcggcatgggcgacgaggaagaccaactcaagtctagtttcattttttgacatttatttataatcaaggtccatgaacattaatgaagactatactaatttacaactttttcatttttactgaaagaaataaatccaattttatttttatttttaaaggagattggatggggaaatgataggatggaaatgcatgcgacaaagtgatattggggagaaaataatgaaacttacttgatgataagagactgttggcgagagacattgtgactatgctcgtaatcgtagacttagacttagaggtctggtgtatgggattttgttttgagaaagaataaatggacaactatgagtgagtaggttagcttggatcatcatttttgtttgtataccatgtatagtataagctgtatatgttagttatatccaccattcgttttagcttgtcatgcatgccgtgcacacaccagcgatatgctgtaatgaaaattttgaagtttgaggaaaaaaatgattgggcccaaaagatgaaagcgtattgggcccggttggttgggctcactagtgatcataattggtgagagggatccaagttgtataacaaaacaaacattaaaatacgttaggtgaagtagtagtatttgtttaataacatggtcatgcacacgtttttcaatctgagacaagtaaaaaaataatgaaaaatcagtttcagttcatactgccaagtaagtgcctcccgtcatcataaaaacactttggttttcccattaaaaaaaattcaaacaatttcttcttcttataccatacatgattaaaatataatttgagcccttacttataataacagcgtacgggtagaagaaggaaaaaagtatcggaatacggttgtgcgttggaatggcacgtgaatgtgatgcagtgcaccgtcagtgaccggatttgcaaaagagataatttgttactttcctctgggcaaaattcaattctaagaagtcgaaccagtagaaaagaaaaaagaaaacgtatacgccttagattgtattataaacattactaaatatatatagacgttttagaaaaatggaaatcttgtttgaaaagaccaagtcaatttagtagaccaataatctaaggttaaagtaatctcagtttgagtagggattgaagacagggacttgaatactagtacaaaatacacaaaagatccaggctagtaggaggaggctctactaaaatatggagtttgttagaaagtaataaatgagagacacagagtccataataatttagtggcaataaataatgataatggcaaactctgaagttgaatcgaattgagtcttaccgggggatggtgtcgggcccaaacatggagcttcccacatcccacaggggtggtcagtcagtggtcttcgctttcacaccaaaatacaaattcattattcttgacttcgtgaaatgacagttaaaattctcagaaatgtataacaacaaaacaaaggtaaaaaaaacacagataataataataataaaaaaaaaaaaagaagaagaaaaggcaaaaaaagtgggaaagtgagaaggatctttcgttggggatcctccttggaggggttcactcggcgctttgggtttgaccaactcaactctaataatcttctctgccttcctctcttcttcttctttcttctttcatctctttcttttattaatcccctttcttttctaactttctcgattcatcagagccatg

SEQ ID NO: 1258 - DNA, 3000 bp, Unknown
  misc_feature (1)..( 3000): cDNA_ID_3410225_gDNA_ID_1620377_Annot_ID_155200 3000 nt of promoter + ATG
aaagacactaaatccgggatatgtttatcaaaatgcatatggtatgtcttcttctttggctttttctttatttccgaagattggaaaagtcagtaaacaaggaggggcataatagtagtttattacagtaatcagcggcagtaacacaacagccgcgtttgacattttctgaaggaatcattcgtccgtcgtcgacccatcttcttctctccaatggagtctcctcttcttcttcttcttttctctttcttattatttccgatccagtcaatttctcggcttccgtaaaacccagttgacaagaaaaataaaaaagctttatcctttttaccctaattcctcaaagtttagtcctttctctttcgggtttctgaatctcgattcgccatttgatctgatatcgacgatggcagacatcgtcaagcaaatcctagcgaagccgattcaactgtctgaccaggtggtcaaagccgccgatgaggctagttccttcaagcaagagtgcggcgaactcaaggctaagaccgagaagctcgccggtcttctccgtcaggctgcccgcgccagcaacgacctttacgagcgacccactcgccgtatcatcgacgacacggagcagatgcttgagaaggctctctcccttgtcttaaagtgccgagccaatggcctcatgaagcgagttttcaccatcatccccgccgccgcgttccggaagatgtctggtcagttggagaactctatcggagacgtttcctggctcctccgtgtctccgctccggcggaagaccgtggtgacgctggctaccttggtcttccaccaatcgccgccaacgaacccatcctttgcctgatctgggagcagattgccattctctacaccggatcgcttgaagaccgctctgatgccgccgcctcgctggtatctctggcccgtgacaacgatcgctacacgaagcttatcatagaggaaggaggtgtggtgcctctccttaaactgctcaaggaagggaagcccgaggggcaagagaacgcagcgcgtgcgttagggttactgggacgtgatcctgagagcgtggagcacatgattcacggcggcgcttgttccgtcttcggcaaagtcctcaaagaagggcctatgaaagtccaggcggtggttgcgtgggctacgtcggagcttgtgtccaatcaccccaagtgccaagacgtcttcgctcagcacaacgccattcggctactcgttggccacttggccttcgaaaccgtgcaagagcacagcaaatacgccattgccaccaacaacaaagctacttccattcaccacgccgtcgctctcgccaaggaaaatcctaattccacctccgccaccgccttgcccaagggtcttgatgaggatcagagctctattcctcatcctacagggaagcaaatgcccaatcagatgcacaatgtggtcgtcaacaccatggcggttagggcaaaccctccgaggaagtcgactagcaacggtgtgagccagagtaatggtgtgaagcaacctagcagtgtacagcagcaccagaattcgacttcgagcgcatccaagactcgagagctggaagactcagccaccaagtgtcagattaaggcgatggccgcgagagcgctgtggaagctggcgaaaggcaattccaccatctgcaaaagcatcacagagtccagagctcttctctgcttcgctgttctgattgagaagggcgacgaggaggtcagatacaactcagctatggcgttgatggagatcaccgccgttgcagagcaggacgctgacctgagacgttccgcgttcaagcccaattccccggcctgcaaggctgtggttgatcaagtgcttagaatcattgagatagcggattctgagctactcatcccctgcatcagaaccattgggaaccttgctagaacgttcagagcaaccgagacacggatgatcgggcctctggtgaagcttctggacgaacgagagcccgaagtgacaggggaagctgcggctgccctcacgaagttcgcctgcacggcgaattacttgcacaaagatcactcgaggggcattatagaagctggagggggcaaacatctggttcagttggcctactttggagagggtggcgtacagattccggcattagagctcctctgttacatagcactcaatgtcccagacagcgaacagctggccaaggacgaggttctggcagtgttggaatgggcttcgaagcagtcatgggtaacgcagctggagagcttagaagctttgttgcaggaggcaaagagaggactggacctttaccagcaaagaggatcaaggggttacaatttcaattgattcattatttcgattttgatttcgtgaccagcgaacgcagaataccttgttgtgtaatactttacccgtgtaaatcaaaaacaaaaaggcttttgagctttttgtagttgaatttctctggctgatcttttctgtacagattcatatatctgcagagacgatatcattgattatttgagcttcttttgaactatttcgtgtaatttgggatgagagctctatgtatgtgtgtaaactttgaagacaacaagaaaggtaacaagtgagggagggatgactccatgtcaaaatagatgtcataagaggcccatcaataagtgcttgagcccattagctagcccagtaactaccagattgtgagatggatgtgtgaacagttttttttttgatgtaggactgaaatgtgaacaacaggcgcatgaaaggctaaattaggacaatgataagcagaaataacttatcctctctaacacttggcctcacattgcccttcacacaatccacacacatccaatcacaacctcatcatatatctcccgctaatctttttttctttgatctttttttttttgcttattatttttttgactttgatctcccatcagttcatcttcttcttcttcttctgatcaaccatg

SEQ ID NO: 1259 - DNA, 3000 bp, Unknown
  misc_feature (1)..( 3000): cDNA_ID_2133067_gDNA_ID_1620377_Annot_ID_155199 3000 nt of promoter + ATG
tctctctccttcttatagtcactttcctgttgattgccttctttgcacccagacactggacccaatggcgagggaggcacaccaggaccatcaggttagatgcaaagctcgtccacacactcccctgcttcaccttcactgattctgctcaccacaaggccggggaaacatgtgctatatgtctcgaggattacagatttggagaaagcctcagacttctcccctgccaacatggtacttactcctattcttctgtggaaataaactggcaacttgccacccttaatgtgttcattgaggtcttggaaatgtatatttatgagacacagatcttcccttcacaggattgaaacatgtgcttactattctaggaagactttgataggtttctcttagattctaactttataaaatagatttctttctagcataaattcctctgttttagggttgaaggtacaatatattccgtttctgtcaattccagtttgataggtaagcaccgaatgcgaactttttggtattactcattgcttcgaatgatatgatgggtcgaatatgtacatcagaagaataaattaaagatttgaccttttttagtttatgtaagtgggggtaattcatagcagttggttgatttgaagctcttatgcagcttttcacttgaattgcatcgactcttggttgacaaaatggggtacatcttgccctgtgtgcaagcatgacataagaaccgagactatgtcttctgaggtgatcctgttagactgaaatgtataaatcctttcagtagttattttgttgtttttgcgttgggttcaatacactgtttgtgttgttttgttgcaggtacataaacgagagagtccgagaacagatacaagtacgagtagatttgcctttgcccaatccagtcaaagccgttagagttattatcggcttagcagctgaacactcatatcagtgctcggttacctggatcaggtccaggtttgcatcttatattgaatggttaatcatggtgggataagtttaggtaaagggaccggatctgccatactggtcgtgctttgctggattcccagatcaaaaagatatgagttgctttgcctctttttctttgcatgtgtacatttacatacgctctgagtcatgtgtacatttgatcattgtgtgtgtgtgtgtgttatagattgaaaaaatgtgtgtgatagtacagatatgcaaacaaattgatagaaaacaaatgttggtctaatcagattttctctctccgatccaggcaaatctctaatgttatcttgttgataatttctttgcctaaagtttgtataatatgaatattgaatctgattcccttacatgggggaatggaatccattgaacgtggctttgattttgtcttgtctgtagtaataataagaaaagaacacgtcatcctcatctctacctaacgactcatccaatacgatgactcgttcatgggtttgttagttgcgcaattccatcaccaaaactttctattacatactcaacttcttttgattactaaattcagccaacatttccttctcatctctaatcagtgaacacgttttctatgcaggctttggggcctatcttaccatagctgtctaagaagactattatcttatattctttattgtagatttcatttacttgcgtatggaattggaaacaaatttctaattgttgaatcatataccattatttttatattggccatgcatgtgtataagtggaagatagaacaatattaaaacaatattattgtgtttggtcctatttattactctctgctctcttcctgaagcttcttcatctttttgtttgacaagaagaggtagagaagaagatgtctcaatcaatctcctccagcacaaaggcagaagaagttgttagtgtagatgtgagccaagccaagactctcctccagtctgggcatcaatatcttgacgttaggtgagcttctgatctattctatcatatcaccatgcatgtaccagctgctgcggttgttaatgaaaaatccttgcacatggcaggactcaggacgagtttaggagaggccattgtgaggcagctaagatcgtcaacattccctacatgctcaacacacctcaaggtaaatcaaatatcaatcacctttaattagagatatcaaccagtacatgagttaaagccttgtgatctctactcttaggtagagtgaagaatcaagagttcttggagcaagtatcttctcttctaaacccagctgatgatatccttgtggtaactcttttcttcctcatcacacccacaagaattaaaatctgccggtgaaaacgatgataaaatctggaaaatgatattgatacaaacagggttgtcagagtggagccagatccttaaaagccacaactgaacttgttgctgcagtaagtgtataatagtccctagtttacatacataatttactcctacttgtgtgtttaatctcaaagaatcaattcatatatacataaaaaaatagggttacaagaaagtgagaaacgtgggaggtggctacttggcttgggtggatcacagctttcccatcaacacggaggaggaggagccatctgctaattaataatcttaagattctcttcttttcttaatcaaataatataactgcctgtgtgatgtagtaatcattttcaatttaaaattccagtttcttgtaatcaaaactttcgtgtaccaaattcaataaaagctgtgtttctctataagtgaaaaccaaaaaaaaaaagatgaacaagtaaaagtgtaaaaactaagtaacaagcctttgtttgtttcatcggtcaaaacgtttgggctttttgagtatacatacaaaaaggctttgggcttcagcctaagcccttatcttctctgttctcgcccggcgattctccgacttaattaattttccgaccgaacacttctctctctctctctctcgggtttctc

SEQ ID NO: 1260 - DNA, 3000 bp, Unknown
  misc_feature (1)..( 3000): cDNA_ID_3061380_gDNA_ID_1620377_Annot_ID_155198 3000 nt of promoter + ATG
aaaaaatctccctttctttgataatacacaaatcaatcaatatagagataattaaaccacgtctttacagagaatagaagcaaatctttgagctagtaacattttagtataaaaatctcaacaacaagtcatttacatcattgcaactgttttgttctcttcatttgacttgggggttgtttgcttgcaaaggaggctttgtttgtacgtcgtcgtttttattccgtatataaaatataaattaacgaactaatctttaaagcctctgagacgagtagaaggttctctctggtgaagaaaccaatgcatttcggcgacagcctgaaactgaaaagccatcgatcgaccgagaaagcgaaaagagagagagatgagactcgtcgtctcaagctgtctactagttgcagctccttttctctcctctctgttacgagtctcactcgccactgttgtcctcaattccatctccgcctcttttgccgatctcccagccaaatttggtcaatttctccccctcttcctttttccttatccgaaacaatttctcgaacaatctggttaaaaagaagttgattttgattctcagacggctccgtgaccaaaaacggaatctgtggagctctatacgtcgcagatcctctcgacggttgctcaccgcttctccacgccgccgcatccaactggacgcaacacagaactactaagttcgctttgataatcagaggcgaatgttcttttgaggataagctgctcaatgcccagaactcaggttttcaagctgtgattgtctatgacaacattgacaacgaagatctcatcgtcagtaagccttttgcctcccacccaagtttaaaattccatcttttcttctcctgatgagctagggttgagctgaatttcattggagttatttaatttagtcaacgcccccataagtttggagattgaccaacatctgttttgcacagtgaaggtgaaccctcaggacattacagttgatgcagtcttcgtttcaaatgtcgccggtgagattttgagaaagtacgcgagaggccgagatggtgaatgctgccttaatccgccagacagagggagcgcttggactgtgttggccatctccttcttctctctccttcttatagtcactttcctgttgattgccttctttgcacccagacactggacccaatggcgagggaggcacaccaggaccatcaggttagatgcaaagctcgtccacacactcccctgcttcaccttcactgattctgctcaccacaaggccggggaaacatgtgctatatgtctcgaggattacagatttggagaaagcctcagacttctcccctgccaacatggtacttactcctattcttctgtggaaataaactggcaacttgccacccttaatgtgttcattgaggtcttggaaatgtatatttatgagacacagatcttcccttcacaggattgaaacatgtgcttactattctaggaagactttgataggtttctcttagattctaactttataaaatagatttctttctagcataaattcctctgttttagggttgaaggtacaatatattccgtttctgtcaattccagtttgataggtaagcaccgaatgcgaactttttggtattactcattgcttcgaatgatatgatgggtcgaatatgtacatcagaagaataaattaaagatttgaccttttttagtttatgtaagtgggggtaattcatagcagttggttgatttgaagctcttatgcagcttttcacttgaattgcatcgactcttggttgacaaaatggggtacatcttgccctgtgtgcaagcatgacataagaaccgagactatgtcttctgaggtgatcctgttagactgaaatgtataaatcctttcagtagttattttgttgtttttgcgttgggttcaatacactgtttgtgttgttttgttgcaggtacataaacgagagagtccgagaacagatacaagtacgagtagatttgcctttgcccaatccagtcaaagccgttagagttattatcggcttagcagctgaacactcatatcagtgctcggttacctggatcaggtccaggtttgcatcttatattgaatggttaatcatggtgggataagtttaggtaaagggaccggatctgccatactggtcgtgctttgctggattcccagatcaaaaagatatgagttgctttgcctctttttctttgcatgtgtacatttacatacgctctgagtcatgtgtacatttgatcattgtgtgtgtgtgtgtgttatagattgaaaaaatgtgtgtgatagtacagatatgcaaacaaattgatagaaaacaaatgttggtctaatcagattttctctctccgatccaggcaaatctctaatgttatcttgttgataatttctttgcctaaagtttgtataatatgaatattgaatctgattcccttacatgggggaatggaatccattgaacgtggctttgattttgtcttgtctgtagtaataataagaaaagaacacgtcatcctcatctctacctaacgactcatccaatacgatgactcgttcatgggtttgttagttgcgcaattccatcaccaaaactttctattacatactcaacttcttttgattactaaattcagccaacatttccttctcatctctaatcagtgaacacgttttctatgcaggctttggggcctatcttaccatagctgtctaagaagactattatcttatattctttattgtagatttcatttacttgcgtatggaattggaaacaaatttctaattgttgaatcatataccattatttttatattggccatgcatgtgtataagtggaagatagaacaatattaaaacaatattattgtgtttggtcctatttattactctctgctctcttcctgaagcttcttcatctttttgtttgacaagaagaggtagagaagaag

SEQ ID NO: 1261 - DNA, 3000 bp, Unknown
  misc_feature (1)..( 3000): cDNA_ID_2133061_gDNA_ID_1620377_Annot_ID_155197 3000 nt of promoter + ATG
tttgtgcagccaccttttggtgctttgttcattaggcatgccagcgcagaattcaccacagcttctgcctacggaataattagatgattactgatataagaaaaaagacaaaaaagaaaagagttttcatatatagtatcttacctcagaagcaccaagagcaaggcgtttcatgtaatcatttgttacatgctgcttggcagttccagtgacagcatcatggtgctgcgctatccctaaagcatccccaagactgtaagtgtttggacctccagagttcttgcccaccagaaattcaagttgccttgcagcctgttttggaaaaaaaacagacaaatgcaaggccatgtaaattcattttgaatttcactaagaaaatgggaaatcggactccgtaagatgcagtttgataccatgtagtatccgctaagagcccgaacatatcgtttaagagcaggacggctggtgaagtagccagtccagtaagcgtatgcccgatccgcatatctgcagagagtagggggaaattattgactattgagaaaatcaagttgttgaacaaaaggaatatgtaaatttatttggtgacagtactaaaggcactcacgggaaaaagtcatgagtcttgagaggccaagtaacattggcaacattcttggcatcaacatagagagatggtgtggagtacaaggcgttcacacggccatcctgttgaatggaattattggtgatgagaatctagtctccaaagacagcgagattgatattgagcaatcacagcaagcaagagatatgaaaaccttgttaacataatggataagtctgtccatctgtctgaaccaagactcggcgaactggtactgaaaatcatcgcccattgtccacatcacatggttccctcgactcacattagcctatgtccacattgactactttcagaattaatccaagattacacacacacttgaaaaaaaaaaaaatactactcaagacttacataaacaagagaagcattgacgaaatcattaaccgcctccttaatgttatagccatcgaaacgagggttgtcctgcaaaatgacgagtgaaccgaattcccctaaaccaaaaaccaaacgggagaaagaagaagcgaacctggaggggtacgtaatcgtcggtgacttcatagtgaaagccagtgggagggccgtaatgaacaaagaagatattggtgaatatctgagaagaagaatccagtgtttttgatcctctccagatgacttcaagtgatttctcggcctttcgcttttctctgtcttggtaatcgattctcgcgaaatgcacagaatccaaccctaactgcacccccaccaaattaaaacacactcataaggaaataaagaaataaatagattagaagggacctctgctccaaggaggtaagcttgaacagaggaatgaccaaagggatcgatttgccaagcagcacgtggagttgtgttgaactgttgctttataaaccgatgcccctttgtggtttggtctatcatatctatgtaatggcacgttgcttcatcattcatagcccatcctccatttctgcacattgattgtgtgaattgtatcaacgctaggtagccaaaatgataaaattaaggtcgtgacctacttacacaaactctagttgcccggatttcactagtctcctcacttgctcttgtctctcggggctttgttcttcccaccaacgcgtaaagaaggcctttttcatgtacattgatgttcacataagagaagaaaacatatattatggttttatgaacaaaaccattattaatgttttaccatttccgcaaacacaaactttctattgggatcacgaagtagagaatccaccaccgagtctaggacgttcctcacgcaagcgttctgaaactcacaattcatttgggatatatagtacgttagactcgtctctacatacatacatatatatgattcatcattcatctgtagataacatacctggattctgttgttagatcctacgtagtactgatcaacagttttcaaccagccgacatcgtcatgcgaatgcggaacaagatgaacatttagtttccccggaaccactttagcttcggttccatacttcacgtatcccccgcctttgacgctctcaaccaacgacaacagaagaagaaaaacaataacacaaagtgatcctttcaataaagacatacccggtttctccattttccgatggcagagttttcagatgtttttctttcttacagggtgtggaggaaacttataacaagaaaatggagagagagcaaaacaagggtcataacaaaagaccaaatccttatcgtttgtttttgctcagatccgtcggtctttgttagagtctctctattgttttactgtgactagattgtcatttcaccatatgtaataattaattaggttctacaataatcttattttcctacaaatttaattaaaatcttgaccctaaaatagtactttattaaatctttttttcttctactttgatgtcaacattaaaattgaagttgatctgttttgagttttgacaatagtcatttaccttttctttaattttatttaacaaatagttttgggaaaaaatctccctttctttgataatacacaaatcaatcaatatagagataattaaaccacgtctttacagagaatagaagcaaatctttgagctagtaacattttagtataaaaatctcaacaacaagtcatttacatcattgcaactgttttgttctcttcatttgacttgggggttgtttgcttgcaaaggaggctttgtttgtacgtcgtcgtttttattccgtatataaaatataaattaacgaactaatctttaaagcctctgagacgagtagaaggttctctctggtgaagaaaccaatgcatttcggcgacagcctgaaactgaaaagccatcgatcgaccgagaaagcgaaaagagagagag

SEQ ID NO: 1262 - DNA, 3000 bp, Unknown
  misc_feature (1)..( 3000): cDNA_ID_3061387_gDNA_ID_1620377_Annot_ID_155195 3000 nt of promoter + ATG
ctggaaacacccttgatgctcaatacatccccatggataatgtcacgagcaacctcagaagtttctacacaaaagcttatttaggaatatcttccctgcagcgtccaaagtattggctcgtgtttaaagcaaaggtgccaccacttggttggaacacattcttcatatctaaagcatccgcacaaggtatgcagacacaggctcatgctatccatagaaagttaaacagttgcctttccctcataattcattttttttttatcattcatgatataggaagcaacaatcacaaacactcttcagtgatgcttagtccgatgaacaatacgactgaaattggtccaggaaatctaaagatggtgttttcttcagactctggtcgtctcgaacggatgtacaactccagaacaggagtaatgtttcgtttactccttcacactgaatctttttggttcattcatttggttagacaaaatattcagtcacaattgcttttaataaatatctttcaggctgacataaaggtggatcagaactatttctggtatgcttcaaatgttggggacgcaaaagatccccaggtttctggtgcatatatatttcgacctaatggttccttggcgtatcctgtttcgtcgtccaaagtgagtctatgaatactctaagagcattgagatgctgaggttctatcatcaagatattagatcataattttttttagcttttctacacagcatcgttatgtaggaagcagataattgtctttgtagtttagaaatacagataaacccataaaatctatatgataaaagtaatccatgtaaatatttgtttggaagatatgtaccgtgactagtgctttcattggcaatggaaacgtgcagtcaaagttgcagattgtgcgagggcctttaatagatgaggtgcaccagcagtttagtccttgggtggcacaggtaagtcacgttttgtggtaactctaatcccatagaaattgtcaaccatagctagttgcaacgacaatttatattggagaatccttagttgataagtacatgtgttatctaggtggtaagactatacaaagaaaaagagcacgccgaatttgagttcactgtgagtgttgtccaaaactctatttcaggttatttaaggtgttttggataaaaagatccctcaagctcattctctttagcagattggtccaatttctgttggtaagggacatctaacaggaaaagagattatcacgcgaatggtaacagatatgactacagctaaggagttctatactgactctaatggaagagactttctgaaacgggtaccctaagatttttctgtgttctcgtattttaaacaccaatgagatcgtattgcccggtttcaacaaatagattaaactctattgcaggtccgggacaaccgaacagactggcatctcgaagtgaatgagccaatagcaggaaactactatccggtaaactatttgatgtccagcagaaattgcaaaaccaagaaaaatttggactatatcgattgtgaatggctttacagttctaacgcattgttagtgtatcttttcagcttaatcttggaatgtacataaaagacgagaaagcagagttgtcggtgttggttgatcgggctactgggggtgcaagtattaaggacggtgaaatagagttgatgcttcacaggttccaaatttcattagtgtcattagtctgtatttttaaaacatgaaacattattgtgtagttgacactgatgaaacatccatgggaacaggagaacgtccatggatgactcgagaggagtggaggagagccttgtagaaactgtgtgtgtgaatgacacctgcgcaggattgacggtatgaatgattaattgagaaattgtgtgtgttttgtccaggacaaaacttgatacatacttgtgtaaatgcagattcgtgggaattactatgtaagcataaataaggtaggagaaggagggcggtggagacgagagactggacaggaaatatactcacctcttctaatggcattcgcacacgagaacaaggagaaatggaaagcctcaaatactgtgaaaggttatgccatggatcatctctacaccttgcctcaaaacattgctctcatcactcttgaggagttggatctcgggaacgtccttcttcgcctggctcatctctacgaggtacgtacagttagatgttcttgaattgggatatacctgacagtaattgagtgttgagcgttgtttacaggcgggagaagacagtgattactctaaaatcgctaaagttgagttgaagaagttgttttccggcaaaatggtaagaaacacacttgctcatctacatgtggagagatactctaacatactagctagctaggtggtgaatgaatccatactatttttgcagatcaaagaagtgacggaaatgagtttgtcagcaaatcaagagaaagtaaagatgaaggagaagatgaagtggaaagtggagggtgaagcggaacaaccttcttccccgctaagaggcggacccgttgacaagtcgactttagtagtagagcttggtcccatggagattcgtacatttgtggttcagttttatcagaaacaacgaagaagaaagttgtttgtgggatgattgcgccaatatgtttgtacaatgttttaaatcattcattcatcaacggtttggttagttagaaagcgcgggaggaaggttcatgtattttttaatcgaccattatactgtgttaatgggcctgttatggaagttttgggtatataaggcccatttaaaggaaatgatgagtgcgcgatttgtctctcttctcaaaaacttgaagatctgagtagagtatttccttcttcttttttttttttttttttctgttcttggcttgtcgcagaagttgggattcgtctttttataatttgccctgaaaacgaaaacgaaaataaaaagcggagagagagatg

SEQ ID NO: 1263 - DNA, 3000 bp, Unknown
  misc_feature (1)..( 3000): cDNA_ID_1033176_gDNA_ID_1620377_Annot_ID_155182 3000 nt of promoter + ATG
tagacaaaagtaaaacataactagattagttcaacgtttatgaactccgtcaattacttctcattttagccacttcgatttcggcctgtaagtagttgctttcagcgatttccagtttagatttaagggcatcgcatgaagcttcccaagtctccttttccttttcctaaaggaacaaaaaaaaatcatggcttctatgaattacaacaaaagaaaatagaggaatttatatggccaaacaaatagaaactctaaacatgctgtctgatgacagactgacgccttagatcatgtttacaattatctatacgcactcctatattcattccctggttaaaaccatgctagtaaatctgctaaatgatggaaatcatttgacgagtagtatgcaaaacaatgtcttagaatatacgaatgggcaacaataacgaaggacaaatgacagttggcatcagagagtcctgcgaatccatctttaaacattccacttacattctctgatttaaggtgtgcaagctctcctttaagagtttctgcagcagcccttagccttgctgcttcgccagttgcagctgcctccatctctgcaattttagattccttctctgcaagcagtacctaaaagaggtgtatacttggtgtgaagaatttatcacttatttcaaactattctctctcgctcatttgaaaaccaaagcacatcatccagtaatagaactaaagaatttagtcaaaagactaacctgcagcgacgaaatggtttcggctgctttgtccctctcagatagagcatctacgacctgtgcttccaaaccctctaagttctgtcaagaaggtggagagaagagaaaaccttggatgtcattagcggaaaatggtggctcatagcatataagaagtaacacaatcgctgatgctgactaccttttgatgcttggctgacaactcagtaactgcaatttgctttctctcttccacagcttgtaattgctttttcaggtcctccagaatctaggattaaagcaagtacgcatatgaagcagagtatacagagccatccctccccccccccccccaccccccctctctctctctctctctgtctcttttgtctctctatttttctatatattgcagactagtattacagaaaatgaaagagatcaaacctggtccttatcaagaagtgactgttgcaatgtctcaatcttattttctttaggctgcaatgagccacgtagttcctcgatagtatccctgagcctgtgtaaagagaaaactccagtactcaaattcttagaggtagctggagaagtgggaaaggcgacattcattttatacaatttctgtaaaaattatcttcgaattatttacttgttattggcactccttagttgttgcctctccgcatccattgctttaagtgcttcattcgcctgttgcctagtgcgttccagctcttgttgcatggatgagtgttgagaagatgctcgttcagctgtttcattcacttcccggaaacgggcgtcgagatcatctttttcctgaagatagcaatataatataccactgagattaagacagcacatagcagcgaaatctatatgtctgaaaatgcagcatagaaattccgaaatagtataagatggtttttgaaactcacagtagcctcaaagtggctaaaacagaaagcattataaaatgtagagaaagacattcaccttttggatttcttgaatgcgttgtttagcccttttgtgaagcctggtgaatttggcgtccaggtcggcatatttctcgtcgcgctctttgatttcctggtccagtttctgttcaactacaccaacaatgtaatagcacaagttgagaaaaggcaaacactggttccggtcaatgaatgagcaaatagaaaagatggcttctgaccttgggaaaacttagaggagtattcttgggatttagcatcagcctcagagtatgcttcccttagatgctcaagagcttgctcagctgcaactcgagtttgtttttccacatcaatttctctgctcaatgatgcgacctgttcttgaagttgtttcagctgagcagagtccgcttccacttgctcagctttctggagagacctaccttgcgctacctcatccttgagtccctcaaattgggatctgagaaagtcattttctaatctcagttcagcaatcatttggagtagctgatcaccattttctgtcagagtctcgttggaggcatcatttaactctttatcttctttgatcacatggctctcctcttcttctccaaccacatcagattccttgtcttcggacatcttggcagagcagatgtcagaaagatgaacccagacactcaagagagcgacgacaactagtaagcgcaaaatcgggatttgaatcaacaatcaaaagagaaaggagtcaagtcgtgaaattcgaataaaccagcaaaagcaacgcaaggagaagagagatttgaatgtaatcagtgccagagaagaagcttaccttgaggtgagggattagagaagagtgtggaggcagagagagagaggtcacaaacaaggaatcacgatttcgaaatattggatcggatctcaacccaaaggttaaaaacgtcgtcgtctctttcccgtcgatcagtgagacggtaaaacgttgatctgatcgactgacgaagaatggtaagaattgtgtaaagggtgttttactaatgaataattgcattcagaagccttaaaccttttgaaaattcatcaagtaaacccaagacgaggttagctaaaatgatgccgttttggaatggtaatatgaaaatatgaaggacagtccgaaaacagcttagcccataaagcagcaacttaggcccattatgtatttgtaatatatggcccaattataatcactttcccaactaatttatataaaatgaaattattgaagtctttgtccagtcaaatataataataagccattgaaaaaa

SEQ ID NO: 1264 - DNA, 3000 bp, Unknown
  misc_feature (1)..( 3000): cDNA_ID_1378596_gDNA_ID_1620377_Annot_ID_155189 3000 nt of promoter + ATG
tgacgatgatccatcaggaaaaggtttggaagcatccaaagagggagacttgatggaagaagagcgagcagaaagagagagagcaggccaggattcggcggcgcccatgacagggccgacatcggaggagctattagaagaaggcatgttccagacaggaggaggcttcttatcagcattgtcgtagtcggaagagttatttccggtgggcggggagaccgaaggcgctgagaagggatcgtcctgggagagggaaagagtcggatgatcatgggaatcagaaggtaacaaccagggagaggaatcgccgtgacgtgatcgcgagatagaggaatcaatggagaagcgagatgcagaattagcggcactactcgccgtcgtagccatcatgtaacagaggaagagagagagagagaggatcaaagaagctggggattattatactctgaaaccaaggaaaagaattagagaagaagaagaaggaatcagccaaagagaaagctaacaacgccggtggctcctccgtttggaagacttgtgtgcctcctgccctttgcaaacaaacaaacaccaacgctccttgtacagttacttaaatacccctctcgctaccaatccgtgtgatttcacctgattggttaattaactaaccctcgtagctaattactgaggttaacaaatccctgttttaacttttgacgtgcctatcaaatttataagttgtgtttattaagcctcctgtagtaatttgattctattctacatgtaccaagtaattcattaggggataagattaaaaagattttctcttctaattgagttttttttttttttttttttttttttttttttttttttttaatttgtggccgaacacgttagtatgtgagtaacggagaaaacaaaggacacaacaacaacaaccatgataagacaggaaatgcttgacacatgcatctcacaccttgacacatttccatcccctctcctagtaatgctcttctacggcaaccaaacacagagaaaaataaaacaagtggtatgtctatcatataagcatttggcgggagcgatcacaagggcaagaggaggacggggcaggggatgaactcagcgagtagattggcgtcaatgtacttagagtggatggcttccatgctcatcaccaccagctccatcttcagctcatctgccacctctcctattatggccgtcgcttttttcccttccccaagcctctccaacagcttgaactcctcgaacccacctgcaaccaccacattatagttaacctttcttcaataagggattccaacactatagtttacctacaatttcctacaagtaattcctcaattttaccttcagacaaatgccaccggatgttggatacttgagtctcatgctccgaagatgattctctcttttcttcgtcaatgactgaatcaacaacggtggtcacagatgatcaacacggctatataattcatatgatacataaggggatattaatgcaacactaattgttcttacctacaactgtgatatcagctccatacttctttgccaagctggttgttgtagcagcagcctatcaaattaagtgtaatcagcttttttgtttggtgtcaacatgttctcaaaaagataacaagctaaacaataacctgtctggtgccttcagaaagataaggattccgatcaatcaccggcaggagaagatgcttcacattactgaatgcgtctcccactcccactggacttggactagcttctgcttcttttgcctgcgcctttactcgacctaagctaaccacaaactaatcattgttggctcatcaacaaactaaccatatcaacaactactcattacgattgtgctaatttgaatcactcccctcttcgttgtcccaaactatattaaaattcaaactggaaatgcgactgtacccaacaaaggtagaattggactattacgtttaggagaagcaactcgtattccaaataaacagagaaaaagaagagaagatacctttgagagcgacactgcgtagggagagaagctgctggcgaggtttagatcgaagagaagaaagagggtagagcgcagaggaagaagaagaagaagaaggaagtgttgcttgcttggaggccgcatcgagaacagaaacggcggctatggagtgagcagatgccattgaagttgcgacggagttcagcaactatcgcgacgattccagaaaacaaactttttttttgttctcttattttggttctgcccacggcttggactagagtatcggtgaggggcttgaattcttcttataaggccgaagctatatattaaatttattaacgggccatatattgaaaaatatcaaatagaaagggcccatataatcaaagcccaataaggggatgcattggtcaaagggtttgaaactttgaattgaatagagttaacaatggtggtgcaaggcaagaaggaaataataataatgagaacagctattgtatgtttgtaaatcccacatgggaggagttaaggagtgcacgtgcacacgtatgtgtgtcttcttgtcctttctttgatggtcaaatatagaagaagagttatttgagagagagagagagaggctctggaaatcttgtgatccataaattgtctctcttcttttcctctgttctcatatacaaggaaaagggcttcctctgttctgttcctaataaatatctgaaatcaaaaacagagagagtcttttctttttttctttcactctatctctctccacacatgttacttacaacttaatagtttctctatatctccttgagatctccatccagctgttgctttttttactaaacaaaactcctctttgtgtgagtgaatgaatggaagtttccgactctctcttcttttgttttttcaacatacttcattcattcattttagcataacaatcggtggttggggatgatatgagatgaggcccgatg

SEQ ID NO: 1265 - DNA, 3000 bp, Unknown
  misc_feature (1)..( 3000): cDNA_ID_1382662_gDNA_ID_1620377_Annot_ID_155190 3000 nt of promoter + ATG
ttgagagaggttctagatgtttctattaggtgacaagtggttgaaagacaaaattaattaaaattgaggtgacgaaacaggactttcaggtgggagagacagttagaagtttgccgcactgccatcatatgttccacctaccatgcatcgacaaatggcttcgcaggcatgcttcttgtcccttgtgcagaagacatctttgaattgattttgaactcttctttcttctcttctttgtacatgaggtataggcatacacacacacacatatatacacactagtagtcttccttgattttttttagattacacgttacacagattttgatgcaccaatcattgtaacttcactcatctcttggagatcctgtttatttatgctacttattcttggcttcatcattcaaaaaggacatgctgcacttcccaattttagaaagtttgggatcggttttgcatagactaaatcccaaatgaaaaagcatatatacatacatatccttgtcgtcgaaaacaatgctctactcttaagaactaagaagagagataatacattttacatgaactagtccgagtacaaaaatatttggcatgagatccaacatgtcaatagcttcagttttaaattatacatttcttataccaggaagagtgaacccaaaaagacaaaaaaacataaagaaagaaaaaaaaaacacatatctttggttggataaatataactagaagatggatggagcctggttttaaagtttcttaggtaaagtgataccaccaccacggatagaaacagaaggggttttaagagaggaggctctgctgagcagattggtgtccaggaagaggacgaccacagtgatgtcgtcatggaaatgcctcctgactcctctctcaatcttgttgagatcagaatatctcatctctcttttctttgctgcctcctgcagcgcagctttcaccagtctcctcgctatcccctgcatcagcattctcacatttactctttagaaaaaatcatctatatatgtttagaaactgagagtgtctcatacgtttcttgggtggttctgaacgatttcaacagcctcttggttgctaagctgctcccaaagtccgtctgatgcaaatatcagaaactgatcgtctggttggagatcatgcacggttatcgacggttcccaactcaagataggtcttttcattggctcccgcaatcggtactttgtgtacaaaggttccttgttgaactccgatttcttaagatacacgtctcctatggatcgtgatacctgcaaacacacagacaactaagctttcaagatttgacaagtggccaacaataatagcttatccaactcagtgaaggaacatgacataataatattggctcagattttatagcataagaagatctctttgtagagagcggcacctgaataatgcccttaacacgccagacattgtgttttaagacgacaatatgggagtcatcagggtgtaaggagtgcatttcctgcctcacagactctatgctcacgttatgctcagctgagagctgaagcgcattaacctcacctgtggccttgatgacctttcccaaaaccgcacgggagtccccaacgttagctacgtaaagcttcccatcgcagaccacaccgatcaggcaacaagagccaaccgctgctatatgtggcttcactgcccactgcttggccaccacccctagaaacccttcttcggttgcctcataggcctttcttatcacatccacagacatggaatcctgctccgctgcgaatcctgcagacatgaatgttcagttccaatggttccctagctaaataaaattcagtggtgagtagtaacaacaagtagttactcttgagatggtgaaagagatgatcgttgacaaaacgggaggtctcagggcctccgtggccgtcatagacgccaacaaaggttccatagggaccagaagaagagagggtggtcaaaggaccggattcgacctggctctgatcctcgaggaggttgttggcctggacaacggccatggagaaatcaccaaaaaggtggtgagcagagtctttgtaccagagaaggccgtcttgtttgcctttggaatcagaataagtgtgggaagtggtggaagaagagggccagagacaagaggtcaaaaagttgaagaaaagggataacatcgggcctcatctcatatcatccccaaccaccgattgttatgctaaaatgaatgaatgaagtatgttgaaaaaacaaaagaagagagagtcggaaacttccattcattcactcacacaaagaggagttttgtttagtaaaaaaagcaacagctggatggagatctcaaggagatatagagaaactattaagttgtaagtaacatgtgtggagagagatagagtgaaagaaaaaaagaaaagactctctctgtttttgatttcagatatttattaggaacagaacagaggaagcccttttccttgtatatgagaacagaggaaaagaagagagacaatttatggatcacaagatttccagagcctctctctctctctctcaaataactcttcttctatatttgaccatcaaagaaaggacaagaagacacacatacgtgtgcacgtgcactccttaactcctcccatgtgggatttacaaacatacaatagctgttctcattattattatttccttcttgccttgcaccaccattgttaactctattcaattcaaagtttcaaaccctttgaccaatgcatccccttattgggctttgattatatgggccctttctatttgatatttttcaatatatggcccgttaataaatttaatatatagcttcggccttataagaagaattcaagcccctcaccgatactctagtccaagccgtgggcagaaccaaaataagagaacaaaaaaaaagtttgttttctggaatcgtcgcgatagttgctgaactccgtcgcaacttca

SEQ ID NO: 1266 - DNA, 3000 bp, Unknown
  misc_feature (1)..( 3000): cDNA_ID_3061393_gDNA_ID_1620377_Annot_ID_155193 3000 nt of promoter + ATG
agaaacctggatgaacatggctgcttgtttccatacaacacaccacgaacagcaaccgaggcaccggctgactgtggaacatcctctgtgttgttatgtccactcatctttcctcttatatcagcgagaaggagatcagcatccgccaaatacgaagaaacacaccaggcatcttctatggctccgtcactcacaaaatctaacacttcattaacataaagagtccattttagaaaatctttcagtacgaaaagcacaaacaaatgtaagtttaggtatgctctcatgtgtcactctatcaaggaggaaatagtgcatatgctaactcaatactggatagtcaagacgaggtagtagttgataccattttcatgtagaaaatccacaacccgccccgcctgtccatgagcttggctgagaaccttctccggcgcatccattttcagtggcaaccttgcaaactcgtcatgaacaagagagctgctgcactctacacaaactttagcttagaagatagtgatcctgagctctaaattgcattctttaaatttcttaataacgaattacctgatataatgacattatccgtctctcttttgttgtggagaaacttgcccagagcgtgaaacaacgaaagggtctcatctctaccaaaacaggaagatattccactatccaaaccactgtacattgtctgctcgtttccatgataattgtcttccatgccaggccttggtgattttatcttagtatgatttagctctggcttaacggagaagagctgcaaagatgtaatagcatgtctgatgtcgcctccacttgcagttgccatctgatcaatctccatagttgttaccttacaatgctcttccctacatattctctgaagtacctttttaattgagttcttcgtgatgggattgaaagcaacctgagaatacatacctggacaatcaactagagttgaaaaaatgatatttctaataagatttagactgtaaatagtttgataaagcaacctttaaagcccctgctcgctcaagagatgactgtgtgtcctccatgcgtcgtgcagtctggtcagaagagtccgcgttattgtggtcagtgattaatatcactgttggaatctgcgttgatttcaccaatagtagtaggcaattttgcagcctttcaaaagcatgcctcccattggctagaggaaggtcatcaatcaaaagaacaacgggcgcctttattccgtcagtacttgatgaagccattactccgtatttcctagtactctcaacaaagttttcaaactcatccagcttcgacgtgtacttcagtcctagaagaattaatgaaaatccagtagattataaccggattagtacaacaaccatcctctggtctgtaatagcagtgccaaaactgagtaactaacaactataattccttcaagtacctgaactagtgttgtgcacatgttcttgccagatggtaggaataggagcgttccactcatgcactgtgactccaaggatagacgtaatcaaatggatggtagcagattttccgactccagcttgtcctgtgactagtagaacgttattccttaaaccattctgctgaaacagaaaggcaaaaaagtgaatactgccattaagcatcacgagctctgaaatcataaatcaatttcaaagataaacgaaacattacctttaagaaatccaaactttcctgaaaccacaatttgacttcgtcaacctaaagataacaaaaacaagaaaggagatgagttggtgaaccaaggagaaagcagagctaaaaggaaaagaaagaacaaagcaaccttcttcttgtgaacagaaagctcttccaaggtgcgaggcctgtatttgtcaacccacaaatcggtattcttgctcctttcataacctaaacaagagaccacagagcaatgaaatgacagacattataagctccaaaaaccgtaagaggaagcatcatagcggaacatcaataaaagtgtgaaaattgtggagtaggatccaggcaaagttggcgcgtaccagaagataccttgaagccgcttaaagcttcatcgaaatcttcgaaagacaatctaatctgcgagacatataaaaagcgaaactcgagaccttcatcaaggtgacaagccaaaacataaacatatgacagacactaggcaaacaaaaaatgtagaaacaaatgcagaccttatctacaagactcgagtcttcttgagtcgcactagcacccgaaaggcgagctctctttgacgctctaggattcgttgcggtaccagcagaggacctgggtttcgacttggcattagaacgcgatgaccttaagttatacgatctatcgtcatcttcatcttctagggatagttttttcttaagcattgaatttccttttgccgaaacctttcagaaatcccaatcgccttagggtttatggaagacgaacggaacttgatcactcaattaaactctctcagcaacgatccccaatttccagatgagcaggaaacttccgagtagtcggatcctcctcaacggcgtgtcgtcgccttccgcgtttttgtctcgaaatgaggagtgagtgttggctcgctccactaaatgactatttcatcgctcgatattttcgcgggtcaatcaaacggcatcgtttttatccgaggcgtacatgagaagacaagtagtgaggtctttacgtgacgtgtcaatatctagaccgcctatctcacgtgagtaaaataaataacctgttttagcgtagggtgagttgtaggagattacaccaatggcctgagagagtgaccaccacctaccccacgccgtctccgaaggcttcaccaaacaacaccacgaaatcaatcctctaatgtatttcttcaattcagtcttcttcttcttcaccaacccaatttcttttcttcaactctctcttctccccaaacccgacttctgatccgcatcgatttccatg

SEQ ID NO: 1267 - DNA, 3000 bp, Unknown
  misc_feature (1)..( 3000): cDNA_ID_2133032_gDNA_ID_1620377_Annot_ID_155191 3000 nt of promoter + ATG
aatgttcagttccaatggttccctagctaaataaaattcagtggtgagtagtaacaacaagtagttactcttgagatggtgaaagagatgatcgttgacaaaacgggaggtctcagggcctccgtggccgtcatagacgccaacaaaggttccatagggaccagaagaagagagggtggtcaaaggaccggattcgacctggctctgatcctcgaggaggttgttggcctggacaacggccatggagaaatcaccaaaaaggtggtgagcagagtctttgtaccagagaaggccgtcttgtttgcctttggaatcagaataagtgtgggaagtggtggaagaagagggccagagacaagaggtcaaaaagttgaagaaaagggataacatcgggcctcatctcatatcatccccaaccaccgattgttatgctaaaatgaatgaatgaagtatgttgaaaaaacaaaagaagagagagtcggaaacttccattcattcactcacacaaagaggagttttgtttagtaaaaaaagcaacagctggatggagatctcaaggagatatagagaaactattaagttgtaagtaacatgtgtggagagagatagagtgaaagaaaaaaagaaaagactctctctgtttttgatttcagatatttattaggaacagaacagaggaagcccttttccttgtatatgagaacagaggaaaagaagagagacaatttatggatcacaagatttccagagcctctctctctctctctcaaataactcttcttctatatttgaccatcaaagaaaggacaagaagacacacatacgtgtgcacgtgcactccttaactcctcccatgtgggatttacaaacatacaatagctgttctcattattattatttccttcttgccttgcaccaccattgttaactctattcaattcaaagtttcaaaccctttgaccaatgcatccccttattgggctttgattatatgggccctttctatttgatatttttcaatatatggcccgttaataaatttaatatatagcttcggccttataagaagaattcaagcccctcaccgatactctagtccaagccgtgggcagaaccaaaataagagaacaaaaaaaaagtttgttttctggaatcgtcgcgatagttgctgaactccgtcgcaacttcaatggcatctgctcactccatagccgccgtttctgttctcgatgcggcctccaagcaagcaacacttccttcttcttcttcttcttcctctgcgctctaccctctttcttctcttcgatctaaacctcgccagcagcttctctccctacgcagtgtcgctctcaaaggtatcttctcttctttttctctgtttatttggaatacgagttgcttctcctaaacgtaatagtccaattctacctttgttgggtacagtcgcatttccagtttgaattttaatatagtttgggacaacgaagaggggagtgattcaaattagcacaatcgtaatgagtagttgttgatatggttagtttgttgatgagccaacaatgattagtttgtggttagcttaggtcgagtaaaggcgcaggcaaaagaagcagaagctagtccaagtccagtgggagtgggagacgcattcagtaatgtgaagcatcttctcctgccggtgattgatcggaatccttatctttctgaaggcaccagacaggttattgtttagcttgttatctttttgagaacatgttgacaccaaacaaaaaagctgattacacttaatttgataggctgctgctacaacaaccagcttggcaaagaagtatggagctgatatcacagttgtaggtaagaacaattagtgttgcattaatatccccttatgtatcatatgaattatatagccgtgttgatcatctgtgaccaccgttgttgattcagtcattgacgaagaaaagagagaatcatcttcggagcatgagactcaagtatccaacatccggtggcatttgtctgaaggtaaaattgaggaattacttgtaggaaattgtaggtaaactatagtgttggaatcccttattgaagaaaggttaactataatgtggtggttgcaggtgggttcgaggagttcaagctgttggagaggcttggggaagggaaaaaagcgacggccataataggagaggtggcagatgagctgaagatggagctggtggtgatgagcatggaagccatccactctaagtacattgacgccaatctactcgctgagttcatcccctgccccgtcctcctcttgcccttgtgatcgctcccgccaaatgcttatatgatagacataccacttgttttatttttctctgtgtttggttgccgtagaagagcattactaggagaggggatggaaatgtgtcaaggtgtgagatgcatgtgtcaagcatttcctgtcttatcatggttgttgttgttgtgtcctttgttttctccgttactcacatactaacgtgttcggccacaaattaaaaaaaaaaaaaaaaaaaaaaaaaaaaaaaaaaaaaaaactcaattagaagagaaaatctttttaatcttatcccctaatgaattacttggtacatgtagaatagaatcaaattactacaggaggcttaataaacacaacttataaatttgataggcacgtcaaaagttaaaacagggatttgttaacctcagtaattagctacgagggttagttaattaaccaatcaggtgaaatcacacggattggtagcgagaggggtatttaagtaactgtacaaggagcgttggtgtttgtttgtttgcaaagggcaggaggcacacaagtcttccaaacggaggagccaccggcgttgttagctttctctttggctgattccttcttcttcttctctaattcttttccttggtttcagagtataataatccccagcttctttgatcctctctctctctctcttcctctgttacatg

SEQ ID NO: 1268 - DNA, 3000 bp, Unknown
  misc_feature (1)..( 3000): cDNA_ID_3061412_gDNA_ID_1620377_Annot_ID_155180 3000 nt of promoter + ATG
atgcccttaaatctaaactggaaatcgctgaaagcaactacttacaggccgaaatcgaagtggctaaaatgagaagtaattgacggagttcataaacgttgaactaatctagttatgttttacttttgtctatggactatagacatttcattcatataaattgtcaggtcagctgggatctgaaatgtccatgcagacccagatactaagcacaaaagatgcggaactcaaaggtgcaagagaagaggtacatagttttcttttggttcttttggaaactattgtagccttggttaggtgaacgaatttattagtcatccattcttaatcacataacgtgaattattatggaatcaaagagccattttgagctttaaggaatgttctgctttagctagtcttcatttaaccatattgaattccttgtaactgttcacagatcaaccggctccaaagtgaattctcttcttacaagatccgtgctcacgcgcttttgcaaaagaaggacatggagctggctgcagctaaagactctgaacaaattaaatctcttgaggaagctctaaaggtaagttatctagaatcttaagatggagatatttttagatggttgccaaggtgcttaccaactaattatctttttgggtggtgttaggaagctgaaaaagaagtatatttggtatctgcagagagggatagggcacagcaagatcttcagagtgctttggctagccttgagaaagaacttgaagagaggtatatattgacactgaatctttttcatgtttgattccggaggttggctgctcattctcctcaatttgccagagaaaacaactgagaaatggtgttctcaggggactggttatggagttcttcagacatatattggtcgtctgagctatttttgtttcatatatatttcagagctggagcacttaaagatgccagcgagcagatcaaaagtcttgaagtgaagcttgactccactgttgctcgcaatcaggcggagaaacaagcttgggaagaagaccttcgggttttagaagaaacatggcgacgtaattgattcaaatctaaattcggttttttcattagttcttggaaattgaaattcccttcctaaaaggctacagtaatctataggaagatgtgaagctttgaccgctcaaaatgaagcctcacctgcagaaggtatagaaaaagaactagaaaatgccaaactgcggaataaacgaatgaaggtaaatcactttttgttatactcataaaaaagtttttttgtctaactgacatacctgcaggaggagcatgaatcagtacgtgagcttgcagatagactcattgaggagaaggatcgagagatatcgagacttgtggatgagatgacaaatcttcgaaaatctatggagtcaaaaccagtagtatgtggatggttctttttttttttttttttgcttattaccttacttctcctttttatctttggttttacgctagtaacttttcatttaatttgcactgaaacttttcactcttcatgtggcattaagtggaacaaatctccatcccaggttcaccactatgggaacaacaacacaggtacaagatgttttcctgataccatatttttttaataagggctccctatatgaatgaatcagtgggttccctgtcatcaataacctattattttctttaaacggggtttcagagtcacaacagcaggatgtatctaacttgagcacttctgcagcagagcaccagattctggtaggattttgtaatgttagctgtctgcttgtgtgagcaaggagcgatctttaatcctagaacttaatttccttcaaatgtaatgctatggcctacgggacaaatcagtgagagctaatcatgacacataataatcaaatttcagatattggcaaggcaacaagctcagagagaagaagagttagcacagacacagcgccatattttagctcttcaggtgtagtagaattggttgcattgatctgtttctgcacatgttgcaattagtaactgtttattctgaatcaggaggaaatcgaggagcttgaacgagaaaaccgtcttcacagtcaacaggtatgtgattacacgagagtttggttgctttgccagtttcttaggatcttatttcaaacttccggtggtatgctaaattacaggaagcagtgctaaagacggagttgagggagatggaaagaaaacagaagagagaaggcgtggatatgacatacctaaagaatgtgatattaaaactgctagaaacaggttaaaaaacctggagattaaaggtggattcacgaagtagatgttttaggggtaaattaacttgtgataattgcaggtgaagtggaggctttactacctgtagtggggatgttgctgcagttcagtccagaggagatccagaagtgtcagcaagcctaccatagctcaacaacagcggcaacaacaacagaggcgactccaagtccggcaagtgagggttcaggtctatcagtcttctcaagattctcgttttcatagtcgggtgggcactggacacattcttttgggccaagatacatacacatacatacgacattgtgtttaagtccttcgtttttgtgtaatgaacactaaaagtcaagaaaacactttttgtccagatgtaaagaaaggataagccactgaattgagttgttgggccatttttaatggagtctattgtaatcatgcagaaaaccgctgattatcggaattaatgaaactaaaaaagtcaacgcaaaattaactacaaagatagtataataataacggtcgtcgacttgttgttattggtcaaccgttatgtacggaatcaatttgaacgggtctcactctcactgccttgaaggccattttaattgagcggaattcatttcgcctactagtttcaaatctcgtaacgaagaaggtgattggttcttcttcctcttgctggaagccatg

SEQ ID NO: 1269 - DNA, 3000 bp, Unknown
  misc_feature (1)..( 3000): cDNA_ID_2105173_gDNA_ID_1620377_Annot_ID_155176 3000 nt of promoter + ATG
aatacatctctctagctagagaaaaagaaagcggaaataaagatataaaaatatttggaaagaaagatactgggagcaatttagctacagcatgacgatgagtcttactttgattctgtcaacattattaacctgagacaatcccaaaagtctttcgtcccaatattgaatcttctaattttgatatctatgtgattttgcatatgcactacctgagagaccaacagtacctagaggccaacttgtcctttttattcacctttcttgcatgacttttcctatgttgaaaagttagactcctcttttacacttcatgtaccccactcctatacgtatttaatctaaatatatatacccaccaatcctctccatctacacaaacagcccaaatatcaaacctttcatctctatatctttaaccttgactgcttctcttcttctacaagaaaccagaaaaaaagaaaagaaaagaaaaagaagagattagggatgggtttcttagagttgttggaggtggcttcaatgccaatcgttcaagttcttcttatcagcgtccttggcgctttcttggcaaccgattactgctctcttctctctgctgacacccgaagatccgtgaacaaggtcaacctccgtctctgcttttcttttttctgtttggtgtcaactatgcatgcattcatatatcatcactaacaaacattttccctcgcagctcgtcttcgtggtattcaccccctgcatcatgtttgccaaccttgccgagactgtcacattgcaggacattatttcatggtatgcactaccagtctcctatcatccctctgagaatacatacgtgtggctttgatttgaccaaaattagttttgtaggtggtttatgcccataaatgttggaatcacctttctagtaggaggcattcttggatggttggtggtcaagctactgaaccccaaacctcaacttcatggcctcataattgctacttgtgcctcaggtaacattaaaacctcaaaatttaatctcaaggaggagagatatatccctgaattctcacatgaatcatatttactgtcctgtctacgtaggcaatatggggaaccttatgcttatactggtccctgccatctgtgacgaggaaggcagtccttttgggaatcgtagtgtctgcagatccattgggctctcctacgcatctttctctatggccgtaagtcaaacatacatacatatgatcttctgatctctgctcagacttaattgttgagttgatcgtgtgattaatttttgtcaagggcagctcgggggtttctacatatggacgtacagttaccaactggtaagaagctctgctacacagtttagagctcttgaagccgccgggttggtcaagtctcccaacaaggacatcgactctgatccccacgctcttctcctcaagccgcaccaaaaccaagaccttgaaatccaaggcaaacaaaaagtgtctaccaggacatacatcaaggacttgctccatcagattcttgaggaactcttcgcaccacccaccattggtgccgtaagtctttttaaaaaaagaagacatgattacgtttccaaccaacaactaataaatccactgctctgatgcgttgttatatgttccattcagattcttggcttcgtcttcggagcaaccaattggctaaggaatcttataattggggagaatgccccgttgcgagtgatccaagactcagtaaagctacttgggtatgaactcatcttttttgaatatggaaattacaattacatcacgactttgcgcctaatagttgacttggcagggagggcacaattccttgcatcacactcatactggggggaaacctgattcagggtctgcgttcatcagctgtgaagaaatcagtgattgtgggagtgataattgtgcgctatatcctccttcccgtggtgggagtcggggtggtccaattagcaggaaatctaggctatcttcctccagaccctctctttcgatacgttctcatgcttcagttcgcactaccgcctgccatgaatattagtaattactcaagccatcccccttcacttcattgttagctagatacggatgattaatcatacactatatatatatggattgcaggcacaatggcacaactgttcgacgtggctcaagatgagtgctcggtcatcttcttgtggacctacctggttgcatctttagccctcaccgtctggtcaaccatcttcctctccatcctctcctgagtctgatttgaaaagaaaatggagtttgtttggtctcttgtatggatttttttgatttgttaatactctcatagtatttttgttcattcacatgttgccaaataaaacagagaaagacaaaagtatgtatgtttcacagtgttgtgggcttttactcagaaaaaaggaagtgaggtatgggctcatagagaaagagagagcccaaaattggagaggcgtgttcaagttggccacagaagaaggggagacgtgcgatgcatcctccacgttgctttgcttcgattggttaaaacctcttcaatcatttctgaaacttctacatttcttcacacctgtcctctcctccttacctgtccgttttttgtttattgttctgctttttgatatactgtatcaaagatcgattaattaatttccgaattcaacagctcattcattagttgattagaaaatttagtttggttaagcacataagtaacacgagtcaaatgtcagagttttgtttattgcttaagcaaatactactatttcttaaattgagaaaccccaaacaagagccaatgaaagttttgtatctttttcttaatgacttaaaaaagggaaaaagataaaacagatatcatttgaccacacaaacatatacaacacacccaatcagagatcgatcgccattaacgtagactgtgactctcggctcttcttcactctcaatttcgatcggc

SEQ ID NO: 1270 - DNA, 3000 bp, Unknown
  misc_feature (1)..( 3000): cDNA_ID_2133115_gDNA_ID_1620378_Annot_ID_155232 3000 nt of promoter + ATG
agaaaaaaatgggtgtacttgaaaacctttgggacgacgttgtggctggtcctcgacccgaagccggtggccgtggccatctccgacgaatctccaccagcttaactagcttgaacaataccacaggtgaaccaaaatattaagcaatagtaagcattagcggaaaaatgaataaaggaataattttgttccactaattcttcttgaatatagttgatgatatttatttcttttaacttttttaacaattagaaatttacccaaaagaatgggttaccatggtgaaattttgaaacagtcaataattaaatcatatcatattgttctaattgtcatatcatttaaatatatacattcctctaatcggagtgttacatatgtgggggtttagaaggaatgtcagtggccggatcggtatctcttccagcgagtccggctactccggtgacaccaggatctggtcggaaagtggatgtgtggaggagtgtatttcatccggcaagtaatgtgaccacaagggagattggtgctaatgtctttgacaaaccctctcatcctaattctcctacggtttatgactggtaaatgatttatattatcaattttatagttgcatctcatagattttaagatccaatttaaccttataggtatacattttttatatgaatctaacaatgggtattaagggttacaaaacttgtaattaaattgcgattagtttttttattgattacaaaaagtgtagttttggttgttgttgttgttgctgcatgacaggatgtatagcaacgagaccaggagcaagcaccgttgaagcttaccatttatcaacgcaccgtcaaattaataaatcaagagttcataaaattaagtcgtcaatttcgattttcaagatggttaaggttaataataatcaattgcgtatgccgtataattaatgttttaaataaatttgaaagacgaacgatcatctttattgatttcaaacaatctttataacaatctttatagtccaaaaagaagtttctaacttttgcatgtagcgttcaaaggtttattcgttgctgcccaccgaaaactcaattaattcttctcttcgtaaaccttagtgatgtaataactaacctttcgtataacaacgactctaccttaacatttttcgtaatatcaatcaaacttagctcgtggtctcgtggataccttttgtggttcaaatacgattctaacactgaatgtagtgttgcaatatttaaacattatgttttcactgataccgttgtacgcagtggactatcccaatacccgtttctcttttgacatctaaaagttataatttttactcattcaaaacaattcatgttcgaccaccgtctttcagtcctagttgtccgttgacatttcttaattcctagacacaatcaatttatgtctataagtgtagttaggttggatgacaataaactcacaagaaattaagagtagcaaatagaaagaaaaaatgattgcttgtctaatttttaaatgcaatcggatataatgttacctctcattaagttgttacaggaggataattttcttgtaacatgttacttttatgtaggaatcaaaatttataggtgtgtaaaattttgaatacatgattaatttttgatagaacactatatgatcaattaaatctccagaaaaaaattaggacaattctcaaaactatcacacttaggttttcgttttccaaaaatatcatttaagttttggtttttcaaaaatacaacaagactaaaactaaactttcaactttcaaaactaaaccataaatctcaaacctcaaatcctatctcctataataactctatcgtaaatctaaaatagttacctgaacgggcaaaattaagaatataaattctgaataaaaactaaagcttgaaagtatagtaggttgaggaatttctcaaaaaaaataacatgttatgaaattttttcattattctactaaaacttaaataaatataaaattatactattcctataaaagtttaataaatgataaaattagaactatgaaatgttcattttgttttatttccatttactaaatttgttttttttgttttattattatctacttaaaacatttctccatatatggtcatctacatataatgcacaacaaaatatggtcatctacaatattataatctatataaaatactgaaatcaattaaacattttattcattttccaaatatggtcatctacaataatatcatattataatataaaatattcattttccaaaggagtagatttgaatttagtaattttagccaaagaaaataagtgatggagaaaaatctcaatctctctctccgttgacgttggcggctaagttattagctgtttgcataaatatatgtatgtatagattgtttacatacacatctctttctctgtgtcaatgcagtgtttcttcggtcaaatgataccaatctgaaacaaagaaaataataatccaatctacttttatttttgcgtacatctctctccatcttccattaaagtcttaccctttcttcatcacttgctcttgaaattttctctcccaaaaaaggtcaaattccccacttgattccacttcccctttcatgggtttgcgtttgaattgtgtttaaagactttatatttgatcatcagattcaaattcttcatcaagatcgttgttttctctgaaagttgttgcctttttgctatggaggtattagggttctacagtgtatgaattggattcttcagctgttgttgttgatgggttcagttttctttcttgattgagtttgaatttgacatcaaagttttgttttttgctttgtgtgtattcagggatggtgttgggtctcgctgagccattaaagttgttgtctttgttatggatgaattagggattaggattttgagctgttgttgttgttgattcttctctatcgaaaagaagttgttatg

SEQ ID NO: 1271 - DNA, 3000 bp, Unknown
  misc_feature (1)..( 3000): cDNA_ID_2105896_gDNA_ID_1620378_Annot_ID_155247 3000 nt of promoter + ATG
tttttctatacaagtatcaactttccaaattatggagtgaggtttatccgtttttgcgtattttaattgatttggaaatctaaccaaaatcttgtgattagattactggtttattactaaaatattgtgctacaagtttaatgattcttaaatactatttaaatttttttgttacttcaatatttcatttcacattgaaaatttagataaacatttagtttatttttttctcaaatttttataaatgttgtgttcagatttgaattttaacacatttagaagaaaaaaattgagttaaattatacaaaaccttacatttaagggtgaactatattattttgaaaagttatctagagactaattaaattagatccacatgtagagcaaactttgtggtccgcatgaattagatccacatgtttcaaagtcaatgaatttaacaaagattcaagcccaactgaaactagtagagcaagagttcagtggtctctagcctatggcaatttaaaaagaaataaaactcttacaaaagagtttgtggcgaaaagtttcaatattttcatttttcagatacgtatttttaggtaactacttttaaaattctaaaaataggtccaaccgttcaaactttatatatttcgcacattaaaaagtccaaaaaagtttgttcgtactaaggttttcaattatattggaccggtcttgtgtaaatttcttaatcacttggactacacaaatcgtaacacaatctataagcttttcagttttccacaaacgccaaacgaatatttgctttgtttaaaacgttaagggttgtggatcatttgaaaacatttatactaaatgcaacaaaacaataacaacaaaagtgaactatgtttcagtattgaatatttggtttgttgacttcagaattgcagagaagagcaagtttcatggattccctgcaggtgtttacccgagcttaggcatcggtgggcatataacaggcggtgcatacggttccttgatgaggaagtatggtcttgctgcagataatgttctagacgcaaagatcgttgatgctaacggtaaattactcgatagagcctcgatgggcgaggatctgttttgggcaattagaggaggcagtggagggagttttgggataattttgtcatggaaaatcaagcttgttcctgttcctgaaaccctaaccgtcttcacggtcaccaaaacattcgagcaagatagaagtttcaagattctttcaaagtggcaagaaattgcggacaatcttgttgatgagctcttcttacgagtgttcttcactgtatctggaaacaaagcaaacaagacagtgacgatggcctacataggtcagtttcttggcgagaaaggcaccttgatggaggtaatgaagaaggattttccagaacttgggctaactcagaaggattgtatagaaatgagttggatcgattccattatttacaactctggattcccaacaaaccctcctcctcctattgagattctgcttcaagcaaagtctccaatcggaaaagtttacttcaaagggaaatcggatttcgctaaaaaacctattcctgttttagggctcgaagggatgttcaagaagttgcttgaagaagacgcagcgttagtaatttggactccttacggtggaaagatggataaaatccctgaatctgagatcccatttccgcatagaaacggaaccaacttcatgattcaatattacaggagctggtcagatagtgagaaaagaccaaacagacgcaccaaatggatcagagagttgtacggatacatgacgccttacgtctcaagcaatccaagacaagcatatgtgaactacagagatctagacctgggacagaacaaggacaactcaaagtctaacttcatagaagctaaaatatggggagctaattatttcaaagacaatttcaacagattggtgaggattaaatcaaaggttgatccagataacttcttcagacacgagcagagtatcccaactctgcccgtatgaagctaagctcatgacaaccacacacaaccatatgatttgagtaaccaactaggtgttgttatccgattgaaccgtgttttgcaaatttaattacatgtcaaaaaaatatgaatccgtatgaaatcttttaacgtaattgcatttttttgtcaacttaatggacggtaatccacaaaacaagctaaaacaaagtcaacattttcaagacatgacaaaaattgcctaactgtcattatccgccgattcgtttgactacgcaacatgccaacatgtaaattaatgtaggcatagtcgtcgaatcgtcattaagcaacgacggtcatattatggagaaacaaaataatcgtaattagtactacctctgtttcatattagttgtatttaaggtttttacacacaaattaagaaaacataaaaatctcatttaataaaaacatcgtttattataatcaattcaactaataaaaaaatagataattaaatataattggttaaaaaatattaaatacatttattatttgcatagaaatttaaaaacaacatttaaattgaaaaaaaataaaaacccttaaactacatttatatagaaacagagggagtattattaacgcaaccaaatttctaattagacttgactaatttaaggagtctcctttgatcacaatattttatcttcatataaagacatttcttcattgaaccaaaacaactattcaattccatcatgtgaaaaaataattgtaattagttgtaaactcaaccaccttatcttatcttataaaattcatactagtgtctaagcacgttacttccatattatattgtcatcgactaatcaaatgaatcttgttttgacaatcctttataagtatataaacacattttcttcattgacgctaaaaagaaaaaaaacacaaaactcatccatttggcttctctcttgcatattcgctgcaaggatg

SEQ ID NO: 1272 - DNA, 3000 bp, Unknown
  misc_feature (1)..( 3000): cDNA_ID_3061448_gDNA_ID_1620378_Annot_ID_155241 3000 nt of promoter + ATG
ttttccagcaccaaaatgttttaaaaccaagcattggatttatcacgtttaaacaattgtcaattttgtttaataattagttacaaactgcaattatttactatattttttttggattcggcatctaacagcacgcatcatcatcaacatatccacctctcataccagcaattaatatggctagttctaaagaggttctatgtgtgtggtatctcaaatcttaacttattagaacaaccattgctcacagtaaaagagtaaattaggtgaaacaattatccaacaagattaatgatgagtcaacaattggtcaagtgctaaaccaacgaccaaactgtactaatatataagaaatagaattaaccaattattatttcttattttgcttctgcaaatcaccgagaaccaattggaacaaagagtcattcacgtttatttcccttaactccatgtaatgcactttgcttccatgcttgtaggaactagtagtggttccaatttccttattataaatagaaaacaaaacaaaaagagatgcagaaaaatttacctctatcaattaattaatgacagttatatataacacatgcatgaggtacatcaccagtgatcactccatgttgggatctttatatatagtatgatcttcaccatactcaatcattgtatcaaatattcaagtctattgtttcacctccttcgctgattgaattcttgtatcactcttatatagtgtaaagaaaaagtctcaagcgcacatcattaataagagcttaagaaatcattagaaataattaaatatgatccaacctagagccaaactagttttattacaaaaatctcaagtcctaattacatcacttaccaaagcttcacgtcctctatatggtttagaaagatattaactattttttaaggaaaaacttccattccttggatttgaagtcttatgattgtctttctctccatattgtagtagaagaggtagaaaggcacagcatagcacgtcgccaacacaatttcatttctctgagtcactccaacaaggcgtaagtaagcatcccctatcacattatgccccaaagctggcaatacacatgtatatgctttgaccattcttgcttatcgacatcttctagaacccaaaattcaatactctcacttgatctataaataaatatagacgacgtattggacataactgtagctaatttaccattgtagtttattagggttccataacctttctaatgaaggtttccaaaccttcttcaacgaatctgaagttctcatacttaacatcaaagcaaacgaccatgaaatcctttaacaacccagtgactgtacctacgtaatacaaaacaccgttaatgcatatccctttatacaaaggataatgtaaatggggtctgcagcatttgatgtttctccatgacggttctccaattcctaatgtgagaacttgatactcttcaaaaccatcaaaccatgtcaataccttgtattgtttctcaacaggatcataccctaaatagcttatcatccaatcactactcgtttccactttgggtaagcttacgaatgtcctgtgctagggttacatatcacctgcaccacttccttcttttccttccttctattctttagaaggatcaaactattgacatgattacaaattttatagttatacatatcaagaggacgaaaactcatatgataactggcgacaagaggaggcaacttctcattcggattctgaggttgaggtgacgagaaaaagagcaacttcttgtcttttacgtaggcaaacaatagctgcgggcgagccaaatctggaggacgaagtatggatgcccaatgcttcgatacacatcgacatgtagctatagacttaaatggcaacttcgagaatatctcgataatgagatcaattggaatatgtaatgagttttcttttttattctctaagctctttggtcgcgtgtcgcgtaaggtaacggttagatgattctcaaagacgtttttttgcagtgaatttccatagtggatacactaaaagtttaaaccctagagactcgttcgttgtagagtaaaactagagaaactagggcttcagaagaaaaaagaacactaaaaagttggaggcggaagaggaagatgtaggtcttaactcttaattaatttagatcattcttgctgaaaatgatgggcctttttaaattattgagaggtcccaacttatgtttgttccggccttagtagggaccgcccctgagaacaaatcagtgaaggagagtgtgataaaacattttgaaaattttaatgtgtgtattagatcatttagagacgcttcataatatttgttttgctatactaaaagtaatgggcctttttcaactatcgagagggcccaactatatgatctctgtagtcaaaacttgtttaattatgcataatcgttgtatccaaaaccggtttagcagatcctgagtcgaatactattcaaattaactagaatgaatctctcccttcaataaattttcaattttcaaaaataatgtaatttgtcattatgttataatttctataaacggcaaaaaaaactaattttctttgtactattaccgaatatgattattctattcttgttattaaaaataaacttaaatagtaaaaatatcttcaagacaagtgggacagtacagatatattttgaaatcctccgctgtcatacagcgcagagtacaaaaacaaattatctaaaactatcatgttacaatgtacaagataaaacaaactataaggaccaatttgaaaataactattttagaaaacttattgaagaagacgtaaactatatatagctgattattacctattcaacaaatccctctttttaaacctattcaaagccaaggacaagaaaaaaaaaaaagagtcgcccattttcttctcattttttttttgctcttgacgaagaaaccaaaaaaaaaaaaaatg

SEQ ID NO: 1273 - DNA, 2341 bp, Unknown
  misc_feature (1)..( 2341): cDNA_ID_2106958_gDNA_ID_1620379_Annot_ID_155257 3000 nt of promoter + ATG
gatcacagagtatacaagtctttttgttactagtgttttaattgtttaatcaccattgcgtaatgggttcattacgacaaatctagaaaagtatcctctgtttcgttttactagttgacaactataaaggttttagataaagttggaaaataccatttggatttttgtgttgtcagtgtcacctgtttaaatacttactattttaagaatatactatacatggcaatatagcttattcgctatttactagtctcggaattcggaaattacaacttaagaggtcaaaaggttagaatgatagaccagcgaaagtacaaataagcaaatttataaaaatcttcgtttcgactagtagtacatatatttgacaaatattgacaaatttaacgtccatgaaaatgtgtactttttaagaacgcaacaaacaacagaatattttcttatctatattcaaaaaagttataagaagtcaaaacgttagaatgagagaccaacgaaaatactatagattagaaaaactactagtacatgttaacacataatatctgacatatgttacttgtaaacatatgaaacacttgacaaaatttaacattttatcaataacaaggtgtatttttcaaactccacaaacaatagaatatttgaattgtcatatttattaaaaggttttattagtaatttgttttatacctcacattctacaccaacctaaaatgtcaactccgcgatctatccgagcatgaaccagaacatagaattacttgaccaaagacctccgacatcaacggaacgttctagaaatttgaatttataaatttcattcaaaattggtttatcttatagtatatccttgaccactattctatatataatccgacaaaataaaataaaaatgaggaaaacaacgtggaaaaagagagaatgggctccataacgtttagatgatagaaaaatcttctggttgagattagttagccaaccatccccactccttccaatagtacccgccattttttcaattgtattgccaaatttagtaatttcacgcattttaatttatacaaaattttaataatagaaaaaaatttggttatcatatttttttttcggttcttatttttctctttattataatatttttttattttcataattttcttatcaacaccagctaattttggttcttcgatacatgctctttttatgcttttgacctgccttatatatactcaactgaaaataatgaaacaaagtaaaatattcgtgttccactaaaatcaaaatattttctaatcattttcactatatatcgaataaaacattaccataacatgaaaatctcaaaaagtcatatacagtatatgtaaatccacaggaagctaaaagatgatttttcaatattactatatttagagaagagaagatttttctgttagaacaaaaaagattgttatataggtgaaatgaatgatgacttcattgagatatgttattcttatccatttcttttgataaagatatatataataataaactccgaaacaaaaaaaaaggatcaaaaattgaagtatctctttacctttgcccacaattctagagagaaaaagagggtctgctttggcggttggaagtagcagttgctatcaaaaacattgcttcataaacaaaacctcaggtgttagattaggccaaccgttatcttctatatcttcttcttcttcttctctttgattcttcaaaccaaagcattaacaaataaagattcctttttgttatggtttgatttattggtcgccatctctcgcccaacttcaccttctctgacataatcactacaccttcttcctctctgtttctatatcagaaacttcatcttcctctcaagttttctcatttcacactcaaattcaattccctttgttcgtgaggttgaatttcggttgcaaacatttgggtttgttgtaaattaaggttccgtttgtaaaagagattcctttttatttggggaaatcgaggagttcgtgtacggagctgagtttttgcctttttgatggttgcagataaggtatttgattatattcctcagtgaagtttcatgtgtgttattcttttgttattgttgttgggtcatggaaatttcatgactttaattcttttttttctttcatgtgtgtttcatgatcatttcgtgtatatagttaaggttccatgtgtgtgtgctcataacttataaacctttgttgcagaatctcatttaattcttctctctatgcaatctttttttgtttgtttgtcctgtgaaggtctaaaatcttgaaggattcaaaaatttccgatg

SEQ ID NO: 1274 - DNA, 3000 bp, Unknown
  misc_feature (1)..( 3000): cDNA_ID_4370965_gDNA_ID_1620379_Annot_ID_155264 3000 nt of promoter + ATG
cagtcgacttaatcattaggggtgttgagacattggttatctttttatcttttttttttatgttttcgtttgaactaatattttggaactattttctggagtttatttcttctatcgcttgttttcgtgaagattttttctctgaattcggtttgatgacaaaggttctcttatgcacaatcttgcaaatccaagcttattttggttatgtagcctataactaagttattagtatgactaatatggctaataaaatacatgaagcagctccaaatcatattgttaagcatctcagacaacacagcttacatattctttacaataataaataatttattgttcgacataatactgttgttactgtttgacttagcgttaattttctgcacaaatgttgttactactttgattaaaaaggataatttgtgtaacaattttttggtcagttttaaaggttattattatttttttaaataacttttacgattagaatatgagtagtgcaacgcaaaataacactgccgtttaagacgacggtcccttgacagaatcttcatcaacgctcgatttgacgtctgccgatttccttagctccgacgtaaaccactgatcgtcggtattcagctatattttgatttctcagctccaaaaattcccaacgaaatggagaaaatggccaaaggatggtttccgatgagcggcactagtagcagcggagatcagcagcagcaaccgctgcaaacaggaggaacgtctctgctagctgattggaattcttacgcagcatcgagagattttgaagaagacaccggaactttaggcttcgatatcgaatccgccgttagatctgccaacgacactgtttccggcacctttaatgtgtaatccatccatctctttctcttaatctttaggggtttaacgattgatcgtgaccgtatctgagaaattaggcgttttcgcctgctattgaggattggattggtgtaaattaaatctggaatctgagaaattgtgattaaccatatagtttaagctttgccagattcgttgatcagatttacaaattctcagggtttgaagctattgttagtgaatgattttgattagtgtcttctctcaatgacttagaattgattaagagtcttaagcatatctttttcttgaagtgttactaactttttgattttgaattttgttgtactcaaatctggattgttaacagtgtttcgaaaggagttagagataacctgcagtctgcaacaagtagtatgccttcaggaaaagctttgatgtatttcggtttacttctagcaagtggtgtattcttcatcttcattgccttcaccatgtttcttccagtcatggtgcttatgccacagaagtttgcaatttgttttacccttggatgtggatttatcatcggatctttcttcgctcttcgtggcccgcaaaatcaactcgctcacatgtcatcggcagaggtaataactaataacaaaaccttgtgttgtgcagcttcttatatctgctgtatttcgtttacatttttctctttggaattttaatttcttgtttgctggcttctccagaggcttccactaactttaggtttcattgccaccatggttggcaccatatatgtctcgatggtgctccatagctacattctctctgtgattttctctgcattacaggtacttaaatttcatcttccttcccgactcttgttggtgtttatatcctctgtttttcatatgttaaaattttcctcttccccatttcacaaatcttacctatgaagttcttttttaccctgcatgtttcatctagtaagctcttgcctcgtcgaaacataatgtgtttagtaaaaaacatgtagactttcttattgctgttttaaaatacaagttgggttagtatgaattatgaagaagccttgaacgccatatctttggttggtctcttggcttgtttttgcaaatgcacttacttgcgacagaaacagctttgatatattattactcacccgttatcgatatggaatatatactttaagaactcactaaatcatatccttcatgtcggtttaaagattagtcacgtatctgcacattctgtaagtatagtaatctcataaaaaacctggtctctgttctctgtgaatccataggttattgcactggcgtactactgtatatcatatttccctggtggatcatcgggaatgaagttcctcagttctactcttacctcctctgtcttccgaatgtttgggagatgagctttcgctttgacctatgcaaagaaaataacttgattctctcgtgtataaagaaagatgaaagatcttcaacagtggttaaatgacaaatctggtaaaatatgttggtccaatggctcaaagacagttttgttataaatttcctatattgatactttctgctaaattggttcaaaacttcaaatcactagccactggatgaggtatggaacttgaagagttgcttggtggatacattctctaatctagggtaagtcgttagcttcaatgtcttactgtgaattattacatcagaattaagaaagttattacacgtatgttttcactgagtttactacactggcaatgtggcatacatctcttactgcaaattgcagacaagtggtcaatcaaatcttttttagttgggcccaaaatgtctgttattggatacgttgggccttaaaatggcccccatcagtcaaaaacatcactgcttggagaaggatctagaaaaacttgcaagttagttcaaacaaaataaaggaaaaagaacgatctagaagaaagaaaaaaaaaggaaaagaaacccttatggaggttcccacaccactctatatataataacatccttctcctaaatcccgcatcagtacttctctctgctctcaagataattttgttctctcaatttcattcttaaaccctagttcttcgattttttccgatctacgaca

SEQ ID NO: 1275 - DNA, 3000 bp, Unknown
  misc_feature (1)..( 3000): cDNA_ID_3061501_gDNA_ID_1620379_Annot_ID_155270 3000 nt of promoter + ATG
attggatacaagaaagctctaagaccatgagcacttcttagcatcaccacagctccaggagccatatgcttctctaaatgctcaatagctttgacctttgactctttatccatcccaacaagagctgccaagaaaacaacatcgtattggtctaacccctccttagcgtttaatacatcagttgtgtggaaaatcatgcgtttggaaaggtcagaatcacgagaaacgaggtttgaagcgagtgtgttggcgtgtgagtcgatgtcgaagttgtggaacgttgtgttggggaggtggaacttggccaagacgatggaagtaagtggcatcggaccggaaccaataaaggcgactttggtcgggacatgggttgtgtgttgagataggagatcgaattcgagtttgcctagtttgagatagttgttgtaataggggaagatgtgtaaatggtttagagggttgtcttcaaaagagcctaagattgctgaaaagtgttgctctaaataaccttcggcttcaccacaaagcttgatgagatgagatctcatgtctttgactttttcatcgtgtatctctgtgacatcgatgttcgtgtccgttggtaagcacgtggacacaagttgtctgaacaaagtgtcgacattcttggatggttttaagctctcgaggtttgagatttggttgtataagtccatgatttgcttcacaacgaggttgttttcgcaagccatgtcgacactatgaagagagaatattgagttttgaaattgttttcaatacttggaaaaaagcttgtgttgttgtgttgccttaaccctcgcaaggggtcgttatttattgacgcatgtggggtccattcttggctaaattttgttattttatttatttgattcgattcatataggttacaaatatttcctctaggtcattttaatgtatgttttagaactattgtttttttgtttcaaaacgtttcgtttccaaataagtcctcacaaattttataactgacctttatcattactatcctcaaaatagtaaaaataccatgtacaacttaaaaaatgtaaaaagaggacaatactgttacctattttcacattgcttaggaatgagagtaattaatggctgatcaagttactttagtcacaaattggcggggaacaagacaaactagtaacttatagaatcatatacactcttcaactaaaaatcgcgatatgttccatttatggattttattgggtttggtttcatgacgaatgaatttaccaaaataataagagtttaacacacattagaattggcttcttttgttacacataatagttttagacacatattttgtaaatcagtaaatggtaaatgccaacatgcaacgcaaacatttttttcttttcattttgtttatcgtgttttcatttacaaatttttaggtctattaattatagttataaggtaacggaaatgaacattttaactatattttcatgaagaaaaacgaaaaggtaaccaaaactcaaaaaattaagagtaatttttctccacaaattcacattaaatattagcgttactcgtcgagtgtaaatattccattagtgatgtgtgcgtatgcgtatgcttatgcttgtcattacgtaatctcactgttatgcatgaatggaatctaaaggaaaatactacgatttagtcattatacgtgtagtcgtgaataattgttaattgtatcaatcatacgagataacgtatagttagagttggtaatttaggcatgtctcataacatttttaagtcgccacgaaaatgcatcatattttttttttttttttaatgtaaaagaaataaagatgaagtaggtgatgatagcccgaaaaaataatgttctatctgaattttatattatatactgttgaattctaaacagtcatcaaacttaaaaatcttagattccattcactactcatcacatgctaatgctttgttgggaataaatctcagtcctttggggtcactcatccaattcagacatgtttttgtttttgttttttgaagaatattgttagacacgtaaattaattgaactcgctataatatccgaatcaaagtttgtattctaaacatgttttttagaactgaataattctgaattacatataaaaaggaaaaaataaatctgttttattaaagcaccaaactgaattaaaacatactactatataggttttgcaatagactgatgttacacatacattaatttatatcaataatgcctcttgcatgaaatgaatggccaattttacgtagctctcatcatacgttaaacgatcctataaaagaaagaagcggttctgttttcagatttgaatattaaccgtactttactaagatttatattcttgtcaaaatgcatctattaattatctatagtagatatggtaatgctataccctttaaattaagtgcgtatacatcatggtcatgttgagtttgagtgcgacgatccacgtagtcatatactcatatggtatcaaaatttctggagatttagtatggtaatcgaaaactcaaaaccctttatgatttttttgttaaaacttaaaacaaaacctttaataataaataaaatttgataggtatttagatatgtacttgcatattatgtcggacttttaaaataaaagtttagatcgtttgaacatccaaaaatcattaagtaagtcagataaaaaaaaaaaaaattattttttttatcataaaaaattaaaggaaaaaaaaaattaattgtttttttgctattgatgtatgttgtttcctgttttcgttcaacacatcgtgtcgtttttatacccggacattgttagtgtctaccatatagccaccacagcaaaacccgaacccggaaatattcgggtcgggtcgaagttgcagaatgagatttgatttgccatactttttgtcgcctgaacgcaaaaaccttgcttaaaccctagagagatagag

SEQ ID NO: 1276 - DNA, 3000 bp, Unknown
  misc_feature (1)..( 3000): cDNA_ID_2133326_gDNA_ID_1620379_Annot_ID_155275 3000 nt of promoter + ATG
aattgatgtaattcgggattagaattctgatcttgatcttattaatttcattcttcgttaataataaacaacattgcttgtatagtaacaaatttttgcaataaataaaatgccagattcagaactgcaaactttcaatgtatttagtgatactgtaagattattccaacttgatatactgacaatacatatttaggtacactaggcacataaactttttctaactcaacaaggaacaatcaagtggagttgtgtatcatgtttcccgattcagtgctctgttcctacgagctctcaaaaccaaatatccggaaaacacctgcaaagagatccaagttgttgtcattgttcattttctgctaccaatattagagttttgagttgttgctaacaatgaagtactaatacgcggtagtaccttcatcagtattatacttgggattcttgtcatcacctgcatatgcaagtaaattgtatttgggattccactcaacactgttcatggctgcccgacatggaatctgatgcaccgtccgcccggtttggacattagcctgtttggtagttagtggtcagatacgaggaactaatctcatattgaggaaactacattgaaattagcagtgtttaagtctgggcaatcacttacaatatcaatgaataaatcttcactggctgaagcaatatactctcccgaatagttgaagcttattgttctgactggccacctgtgagaaatagttataaattactaacatgtaacagaaattaaacctttttctactctatggaaaattcatgttgatactcactcaagtttggtaaatgttctcaaacaaagcatgtctgagatatcccaaaggcttactaaggaatccgcactcccgacagcaaaatatctgttaaggtaaagaggaagaattagatgcaaaagcaaaaagattatcattcgtgtctcagaggccagcccacaaatgtaaatatatattacctccctttaggatcaattgcaatacaataacacccggctgtgtgggctgtgagagtgtcaagtggtttaagagatggatatgaaagaacttcaacagtgcctgagcaggacaacatacaaagtaactttcagtaagatcattttctcaagttcaaaaacaaagaaatctttggtagggaatcgtgtgcaggaaagtacagaatttaaaatcctcaccaagtccagtagtcaagaagaaaaaatctccaggcatgttccaagcaatctcattaacctgttacaagaagacaaaagataagagaacattccatacggcaccagaaaattacttgacgattattacatgaacaaggaacttaggtgacatataaccgcatgagcttgaaacaggagatacggaagagccttataaaaaaaaagccattaataaagattaacatgagtctgagcttacgttacctcataattgaatttgcgcctgtgtagaggtttaaacttacggacatccagaattgtaagctcatcatcctacattggccagtaagagaaaggacaacgactatgaaaagggatctatcaagtaatccatagacagtaagaacaatgaaagtgtaaagatatggggctcgagacaataccctattaccaacagctacatgtgtcccgtcaggtttgtaggtgatgtttatattctctccactaagttctacctgctgtgtgcattttccacctgtagaactcgaagaagacatatctcagcaattgatagtaaaacatacaatagtagccacatatcaaaaacctgatcaaattcctctcttatggaatctggctaaataactaatttataattctaagaaacttagatccgatcctcatcaatcaatagtctccgcgatatgactcaaaagcaaaggccaagattgcgagaaatatttgtgaatgacacatagctaatccattagaaaatatacagatttctaaaccaagctccaggcatatttcaggagcaaaactaaacgattaaaagaatataacttactgcgagcatcccaaagacgaacgcttttatcaccagaggcagtagcaacaagatctgaatgtttgggatcccaacatagctgatccacactatcagtatgaccctttagctcaaggtccttagccttgctctgtatccacacaccacacaaacaaccaaattacaaaaactacataactcaaaaagtaacaatgacaaagataataatcgagttttaactcaatctacaatacttctccatatgtattcatcatcatcaaaaacacatagaagttcccatagctcaaaaaggtaaagaaattacatgaccgtgtggttcgatattccaaatgcgagccgtttgatcaacagaacccgaagcaagctttgttccattcgaattccaagctactgaatgtaccttcaatccaaaaattcccccagattcagcaaaaaactagggtttcgcaagttttattgagtacagaaaattagactggagatagaaaaaaaaaaccttcttcttatgaccttgatattctctgctatgtaagctcttgaaaggaatcgtcgtctcctccattttttaattctcaactcttcttcttcaaccttccttcgcggcctactgaatatcagagcttcgcttcctgaaacgcagcgtttagtcattccggtatagataaaccgaatcgaattttagtaaaccggatgtaaaaaaccttctagatggttaagagtcttcagagagaaactaacaagaagagcggtaaaattgggtaaaatatgaaacaaagaaaaaaggtgaaaaaaaaaacagctaagcaaacaacaagtaatcatttcacagtctctataaaatgacctcttaaatccaccgacgttatagagagacaacaacagctttggttctgcctccgccgcttcttcttcttcttctaatctccgacagatttactctgattctgttgtcttcgagatgatgatg

SEQ ID NO: 1277 - DNA, 3000 bp, Unknown
  misc_feature (1)..( 3000): cDNA_ID_2133334_gDNA_ID_1620379_Annot_ID_155277 3000 nt of promoter + ATG
atgcgtaattgcttgatctgtttctgaattgttcgttgattttctctctgtttgatcgaattctgatcggattgtctcttgggcttgagtgtttgatttcgagatttttctggttgatttcttcaggaggtgtatcttaggctaattatcaaagctgatttgcataaagtctttccttttaggatagctatgttcttgctccatatgttaactggtttttgctgtgtactgcttttgcatctgtacttgtagcagtatagtaatttttttgatttgattttgttcctagctagcagaagctaggactattcaatggcgtcgaaaagaattaacaaagagcttagggacttgcaaagagatcctcctgtgtcctgcagtgcaggtgagtgttttaatctatgatatctactgtgaaatttaaagaaccactttgatagattcagtagatgatgtagcattaacctcagaatcagttttaggagaatgtttttttttttgtccttaagatacattatgagctatttagattttaatgaattggtgatgttattaggtcctacgggagatgatatgttccaatggcaagcaactatcatgggtccagcagatagcccgtttgccggaggtgtgtttcttgttaccattcacttcccaccagattaccctttcaagccaccaaaggtaacagaagttttttgttttttgttatgtttatttgtgtagcttaatgaatttgttcatccacaccattatgatttagagagagtgttcaatcaagtaggctttttgtggcaataaaccttcattgtttatgatgcaggttgccttccggaccaaggtttatcacccaaacatcaacagtaatggaagtatctgtcttgacattctgaaagagcagtggagccctgcacttaccgtatccaaggtgatcaaattgtttcacttccttactttttagtatagcattagtctattttccaccacaccttcttgtgaccatgtcttagttaaatggtcatgtcttagttcgttctctgatgtgattatcttctttgaccaacctctctttacattggttttatgaacaaacaacatcgcaatcccttggatatagtcaaggccattatcataaaagattgagctctgttatttgtacccttgtctaaatgctgtgatatggattagtcaagtaaattctagttatctcttttaataggagtgttacattatgttataatgtttaaaggccttcattatcgctgttgatgacatgttatctagatttaatttgtttaatgactctcattagcgagacaatgataatcttttatttgcatataagctgaagaactaaagttggtggtgcaatttccgcaggttcttctgtcgatatgctcattgctgacggatccaaaccctgacgatcctttggttcctgaaatagcgcacatctacaagacagaccgagtcaagtacgagtccacagctcaatcctggactcagaagtatgcaatgggatgataacaagcaataatacccaccaccagtacattgcgtattaaacaggagaaataagaaagaaagaaaaaaactcagtttggcttttactttggctacttttgcttattagttttttttttttaattatatcttgaagctgtgtgttgggtgtgtacatgagctttatgccttatttgaaacattgagatcttgcaaatgcttttaagccaataatccgctatcatgatgagtcccttgctagtagtgtagaagaatatcacataagtttgcagataataaaacatttgcgcataatagtgattgtgaaattagattggagttggaccaacacattttggtgatcgtgacaagtttatacggtgttagattcctattggcaaactactataaaagtcttgagaatagaataacaactgaatatgactattgacttgatccatttgtacggttttctctttcttttttatttgaaaatttcaaattgggtttggaacaagttatatttaactggtttacgaatttagctacttattcggtctttttcatagctgacaaagatacataatgtatatagctgttaaataaaaaaatgaattccgtgtgacttcaccattagaacgcgtttttggttgggtgaggtctgatgtgcatcagaaacaagtgattatttggggggaaataaataaattcgaagaagaagtgtttataaatttaaatcaaaatgttgaattcggttaagtttggtcgaccatacgaagcttcaaatattgatgacatttaagaaagaaacgcatgaggtaacagtgtaactcaacagttaatgcgaaatacacgaatacacgcgatgcaaaaaccgcagaagaaaacgtgcgcaagcaatttattaccaaattgatcccaaaacgacgtcgattcgattcacataaaccaaaacgacgtcggattgatgcaatcatataaaaaagaaaggcgtggaaggagttaataaaacttggaatgagacatgtcggccatttcatggtgttaagaaaacagagccctcaaatactttttaaaaagaaacagagtgcaccaaaatcctcttaattttctcaaaattcaaatctctctacagatcatctgagaaattttagattctggaatctatttgattgtctctctctacagatctctctgtatatagaaagaggtataactgtctatcgccatctttatctccttggctttttctctctgttacaaactattcttcctatttttagatatcttctctctttgtaatttacctttcgttaaacactttaaggattcattagggtttttgtcgatttccttctgcattgcttttccttccttttggaggaatttttaggtctcggagttttgatttcgacctttaaattttgcttcagaggagagattctatccgttacagttcgtgaatttcgcgtttgaagaacttgaacttgattctgaaga

SEQ ID NO: 1278 - DNA, 3000 bp, Unknown
  misc_feature (1)..( 3000): cDNA_ID_3061490_gDNA_ID_1620379_Annot_ID_155280 3000 nt of promoter + ATG
ctgaaatttcaatgcaagagttctgatattttggagcaatatccatcagaaagcactgaagtgtgaacaaggcttacctgattaactgcacacactgcagggacgttcatgtcaaacaagacattgaaaatagcagtcttaagttgccgccttgatgccttggctgattcagtatctgataacaaatttaataaaaccttaaaactggaaccacgagatgtaatcctgaacataaacaagtataataacagtagctaaccatcaaaatggcagagaggtagtgataccactattggctgcatagagggctttacctgcatcctgtaagcaaactatccacatgaaatcgggaaagcaaaagccatagagacaaatgctaaaatcattcagctgtcactccaaaagaaacgaaaaacaaacctggtgaaaatggttgcaaagaactgttgaagtctagcataaatcggtgactcaatgttaccaaattcctggcgatcgatcaaactagtaagaactatcttgtgttgcaagagagaagacgcaagcttactatctttgtaaatataaataatgatccgcatttagtacaaaaactatctcaccaaaaaagtagcagaacgtccagaaggagacgcatacttgctccaaccaaacttacaatatccagaaccaccttcaatgagtcgtagacgacacatacagaaacaaacgagacatattgagcacaattgaatgacataaatctatatgattatccagaaagaaaaacaaaaacacaaagcataccatcaataatgatagaaccaggaacttgtgccctctgactataaatgtgcataaacgacaactctcctgattgactagaaatcattctgcaaaatcgttaaactttgaatcatctacaatgttttaacactgaaactaccaaattcaaaaagaaacaaaattcaaaccccatcaccaaaattctctaccgataaaagcaagcaaaaaacactcaccggagaggataaccagaacgcaaactagtttcagcgaagaaaatggagtcccatggctcttgagaacactggagataaaatatccagagacgattaccactagctacgcatttccaggctttgcacgttaagcccaatttcacagcatcttttggctccatcatcatcagtatctggactagaatatccatcggtagctgatcaaacgcaccaagagacgatgaagaagacaataacagaggaggaacatcgatcgctctctgatgattcaccaaatccttgccactattcgatcggttccacaccgatccccatactttcttcaggatcatcgtcgagtttgcggatttttgttttttctcgaaatcagaaattttcccaagaaaatcgaatcaggaaaatttgataaacacggcgttttttctttggtgtgacgtcgtttctagttgggatgagactgactgacgtgtactgtttaatataatgacacgtgttcaatagcgttgaagaattttggtactggctcactaatgtcaataatcataacgatattttgtgagcccaattggaaaaaaaaaactcgaagtggtcaatatcacgtgctcaacttttattgttgttgttgtgaattacaaaatttcatagaaacagaaaaataccaataagtattgtttttagtggatttttcttaatctggtcgactccaaattttgttattttgttgtgagagcagtcctcttcctttttaagagtgttttgttaccaggcctgatcatttggttcctctttaaaagtgttgttactaggcctctgatcatttggttacttggatcatttttggatcgtatccattcagattcggattttgggtcttgggattttggttttgttaagagattttaattttcggtttcgatttggttcaattatatatggttcccaaaaatatttagttctacgaaaaaaactttcaatttcaaaaccgtttataataaccttagaaaaagtattttgttactttggcttccaaatttttagaccggcctacgggttaccattcggtttggttcagacttggtactggttattctagtataggaatcgagattctattcggatatttatattggtttattatgttcgggaattagtccgggcctagttgttaattgggttaatatctgatccaaaccaatttggcaaaaataagtaattccatgatgtatctgacacgtggatactaggtattggctgctattagttgacgtgtatagtatttgaaaaaaatgattaactaccttttttttatttacggagcatagatttttttttggagaagctgtgtataaattggatcctcagatccggtgattacctaaatcgcgtcaattctcaacccagttttcagatttggtattcgattttatttatgtaattctcatgttatttatcttttctgttgaaacctctctttctcgaaactactaatattagggttttctgggtttgagaccacgatcttatcgaattattaatatcctttttttttcctgtttcaaacatagggttttagtgcatgagatcgaataatatttatttttgtttccgtttctagggtttattcaattttttgcgtttttacgttgcaatttttattgaaattcagatttctggagaagtgaattttgcggtaagcgtaatttagaatttgtaatccgtattctcatggaggattcgaatataatatgagctctaaattgattttatgtttgcaactttgttttgtttatgtttttttttaattggtttgtgaattttgattataactaaatttatgaattttgcatggttgtgaattactatattgcaggtttttggaagctaacttattgttggaggtggagagatatggctgactttggtttgttctgtttcccttgtttaatggaagttgtttcatcatcatcatcatctctgtgattgtaattgatctcacacc

SEQ ID NO: 1279 - DNA, 3000 bp, Unknown
  misc_feature (1)..( 3000): cDNA_ID_3061494_gDNA_ID_1620379_Annot_ID_155279 3000 nt of promoter + ATG
gtgcgtgagcagaagctcacaccaggtctatcgagatgctggttgcagggcgcaaaaaacacaaaattagaacatgaataagcaactaactcctttggcattttaaatcagtgaaaagagacttcatagccagttggtggaatcaccgcggtttgctatcatcctaaatatccattttcaaagcctctaaactaaccttgcaaatgagttctccttggaatccaccagcaactagtagcctttcttttactgcaagagtgctaacttgagtctctgtaaatccttccaacaaactctcgggatgtttctgaaaaatacggaacatcggttttagctaaacccagcagagacgaaaggaaaccacaagtcaaattaattagatggtttagataagacttgagaaacgaacctcagacggagccacatgacctttaacgttaagaatttcactcctacaacctgtcaaagaagaccagtggctgatggagtagttggacaataaataaacatcgtgttttgaggtagcccagaccaaattcctcaactgtaacaaagaagcaaacataatttagtcttaactatgatcagcttcacataaaactatggttccatcagcaatactagcacagggaaggtctacattatgattaaaaaactaccaagttacatttagaaaccccgagagagccaccaaattgttggaagcataatagagacaggggttatataacgcactagacaaacctgaaaatggagaatcgttgatctcacggatctagaattccttctgaactcatagaaagagctgcctttctcagtattcatgcatttctggttccaatagacaagactagagtgagaaaagagcaacataggtgcatctactaataaataaccttaaagaaacatgaaatgtaattcaccttggcagattcatcaccagaattgggtatattttcatagtttttatattgttctagcctagtttttctgtaatcttttctagtaagagtaagactatcccacggtataccctgaatatccttcccattccgtgcttgagcagcagaagtatctgcagccttgttctgaaaacactccatatacaagcaattgtgtgttaagaaaaatatacagagaacacaaagctgaagagtgtgagaaacagaggaagaagacaaaccaattgatcgaaatcttcgacttcggaatcagaagcatcgatatctcttccatcaaacgcggcattcatatcatcctcgagatcatccatgtcatactcatcagccatatattcatcttcaagatcatcaccattgtaatcagacatggtgtgagatcaattacaatcacagagatgatgatgatgatgaaacaacttccattaaacaagggaaacagaacaaaccaaagtcagccatatctctccacctccaacaataagttagcttccaaaaacctgcaatatagtaattcacaaccatgcaaaattcataaatttagttataatcaaaattcacaaaccaattaaaaaaaaacataaacaaaacaaagttgcaaacataaaatcaatttagagctcatattatattcgaatcctccatgagaatacggattacaaattctaaattacgcttaccgcaaaattcacttctccagaaatctgaatttcaataaaaattgcaacgtaaaaacgcaaaaaattgaataaaccctagaaacggaaacaaaaataaatattattcgatctcatgcactaaaaccctatgtttgaaacaggaaaaaaaaaggatattaataattcgataagatcgtggtctcaaacccagaaaaccctaatattagtagtttcgagaaagagaggtttcaacagaaaagataaataacatgagaattacataaataaaatcgaataccaaatctgaaaactgggttgagaattgacgcgatttaggtaatcaccggatctgaggatccaatttatacacagcttctccaaaaaaaaatctatgctccgtaaataaaaaaaaggtagttaatcatttttttcaaatactatacacgtcaactaatagcagccaatacctagtatccacgtgtcagatacatcatggaattacttatttttgccaaattggtttggatcagatattaacccaattaacaactaggcccggactaattcccgaacataataaaccaatataaatatccgaatagaatctcgattcctatactagaataaccagtaccaagtctgaaccaaaccgaatggtaacccgtaggccggtctaaaaatttggaagccaaagtaacaaaatactttttctaaggttattataaacggttttgaaattgaaagtttttttcgtagaactaaatatttttgggaaccatatataattgaaccaaatcgaaaccgaaaattaaaatctcttaacaaaaccaaaatcccaagacccaaaatccgaatctgaatggatacgatccaaaaatgatccaagtaaccaaatgatcagaggcctagtaacaacacttttaaagaggaaccaaatgatcaggcctggtaacaaaacactcttaaaaaggaagaggactgctctcacaacaaaataacaaaatttggagtcgaccagattaagaaaaatccactaaaaacaatacttattggtatttttctgtttctatgaaattttgtaattcacaacaacaacaataaaagttgagcacgtgatattgaccacttcgagttttttttttccaattgggctcacaaaatatcgttatgattattgacattagtgagccagtaccaaaattcttcaacgctattgaacacgtgtcattatattaaacagtacacgtcagtcagtctcatcccaactagaaacgacgtcacaccaaagaaaaaacgccgtgtttatcaaattttcctgattcgattttcttgggaaaatttctgatttcgagaaaaaacaaaaatccgcaaactcgacgatg

SEQ ID NO: 1280 - DNA, 3000 bp, Unknown
  misc_feature (1)..( 3000): cDNA_ID_1032019_gDNA_ID_1620379_Annot_ID_155276 3000 nt of promoter + ATG
gtatgactactaaccattaacataactctctaattcatactactgcaatagaagttttattgacttaagttataatactgacataacatatttgactgcttttagtcctagtttatcatgacaggtaggctaacacttcatatccgtaatgtttgtatgttcataccttagatcaacactaattagatactccactatcctcacgagtaggattgaaattaatgctataattttctcatatatctgtggtcactgtatgcatattattaggatataacagctacaggttgaaatgccttgatacagtgaccactctcattgaatgaagttccagggcaagaagttgcagtattcatgtgcttatgcttaaaggttgatcttgcttctaattttgttggttgatcatttgcagagatctgttccatcatctccgggaccaaattggcttaactcacctggtagttcgtccggtctcatcgccaagcgtacaatcagggtcgatattccagtcgacaattatccgaatgtatgaactttcatttctacactgagatatactacttcctggttggaatgtaactccttaattttctatatggcagttcaattttgttggtcgcctcctgggtcctagaggaaactccctgaagcgagttgaagcaagtactgattgccgtgttcttataagaggaagaggaagtataaaagatccaattaaggtatttattattaaactttacaacttcatttgtatctacatttcaatgtttgtacaaggtgttaatatatttcttcttgtaggaggaaatgatgagaggaaaaccgggatacgagcacctaaatgaaccacttcatatcttagtggaagcagaattaccgattgaaatagtcgatgcacggctcatgcaagctcgggaaatacttgacgatcttcttactcctatggtttgtttttagctctccccctccctttgattttaaaccagttattgttacaaagttttcacactcggtttctgttttataggaggaaacccatgatatgtacaagaaacaacagctgcgcgagctagcattgctcaatggaactcttcgtgaagaaggatctccaatgtccggttctgtttctccttacaatagccttggtatgaagagagccaaaacaagagaagggtaaaaaccatcgaacagtttggctgtgatcataaagcaatatgaaaccgatccaaaagtcgacacaaaaaggccataccactcttgacgacacggtactgtctcttgtccttggggtagaaatgttgtatatatgatttatgaaatgtgtttgtcagtctatgtatcattgtcccggagagagatcagatgacaaaattgcaacggaaacacaagagctgatgagtctctgtctctctccgagactttgattttgtttttgtttatgtttttatgtctggaaagttgggttccaacagttttcttttaagttttttgtttatttgttgttttagcaaaaagaaaacattaaatcatgatgatggtttgtgtctggtattggtaatgataataatcataatatgttttggatacataaacgtcaaagtaaagcttgtttcaatatgatatgtggaattatgtaaagcaaatgttctgttctcgagtatttttcacatttttattactggaagtcgacattttctattacatgtcaactctgttttcaacattgaaagattacttgattaaactttaaacagatctatatatttaagtaaatcggttagtatacccatatgtcaatcggtttaatggcctgtgacccttataacctagtttcttgtgatgcaaggtagctttcctttactgttttacaaaaaaggcctattcaaaaattgttatgtactttatataaaagataattttaaaatcctatcgaatttggtaagagtaacatcttacatatgaaatctaccattcacaaatactactttattagtaatatgcaaatgcataacaatttttgtaatgtatagattttatttgcatataagaaagtgtttttcttttcatataagaaagttttttaagaacaaaaggaacatatgtcaaaaaaaattgtgataagttttccacttttcccttttccccttaaggtaccaaatctttgcaatctgaaataaatatcattttcttttgatttcctgtttcttttttgaaaatttcttgtttaatccttcttctattttctttttccaaatttgcataacgtttcttattatggacaaaagagtcaatgggctccgtcagtaaacgattgggccttattatagcccataagtacagaatctagctcgctacgtggcaaagcttcaccgctcgaaagagaggaatctatataaaccgtatcgatgctaacaagtttcatcttcaaaacaaccccttgagatttccgaagatcatcaaatccaaaaccctagaaaccgaacaaaaggtaggtcaaaattagctccgataaatctcgatttcgatttgaatcatcgttactcttagggtttattcgtttcccagttcttgatcttcgtcgtttgattctctcgcggttttgtttccttgcgtcgatccatgtgttttttctgttatcttggttctagaatattctcgtacctacttctgatgatttacctttaactgatgcgtaattgcttgatctgtttctgaattgttcgttgattttctctctgtttgatcgaattctgatcggattgtctcttgggcttgagtgtttgatttcgagatttttctggttgatttcttcaggaggtgtatcttaggctaattatcaaagctgatttgcataaagtctttccttttaggatagctatgttcttgctccatatgttaactggtttttgctgtgtactgcttttgcatctgtacttgtagcagtatagtaatttttttgatttgattttgttcctagctagcagaagctaggactattca

SEQ ID NO: 1281 - DNA, 3000 bp, Unknown
  misc_feature (1)..( 3000): cDNA_ID_2133315_gDNA_ID_1620379_Annot_ID_155272 3000 nt of promoter + ATG
aagactgaaaaattacttaaatttcagcttgatcatcgccttctggcaaccacaacattaatcgcaatcggaacaatgtggtggttcacaaggaagctagacatacatccagctgttaaagctttgatcggaagtactgttggaatgactgctgttcaggtaaaatcaatcatcataaactttaatggaaacctaaaatcaaaaccattgataaggtttccctttttgtattttgcaggtgacattaggtgtatcaacgcttctgagttatgttccggtttcactaggaagtgcacaccaagcaggagctttaacacttctcactttgatgctacttctcaatcacactcttcggaggccatcaccttctcttctcaaatctcttccacaagttgctaaatcaaatttcagctaagccctcttcaccaaaatctttcctttttcattatttactaaaaaaacaattctttggctcactatgctactagcaagctttcatcgaatcttgtgtcaatgatgttgtatggttcgaaaaataaagtacaaaaacaattaacaaaagtttcatatgaatcccagaactctgataactttcattgatagcttcgtgttgtttgtttcattgccaatagaaaatcattggataattctagttttagagtcaataatttcttataccaatttggttcagtggtaaattttagttcggttttagtttagatacgattcggttaattcagtccggttcaaatccgtaagccttgtggttgtggataatgtttcgagacagttttttggcgttttggatatacaagactatccacgtgtcgtaatactgtagcttatcggtatccacgtgtcagtagcctaccatcttcctttctatatagccatggtacaaaattctttgttcaacttcacactactactatggagaatcctggaggaaggagaagaagagacatagccataaccgatggagaaagaacgaccggttcttcggttgtggctgcaaccgtagcagctgttgcagtggtaggaccgctttttggtctgatgagtttcagctttgtggcgacggtgactctgtttctgatcgcttctccattgctgctgatatttgctccagcttttatggtaacggtagcggttcttgtgtcggctatggttggtgttggggtagctgcagccatgtggatgatgggaatagccgctttggtatgttgtggccgagagattggtattgaaaccggactggctgggaggatggttgagtcggtggtgagagaattaggttacggtcggagtcgttacttgcgagacaaatcagaggatagttattcaacttcttctccttcttctcgggattactcttcttcttagttcaaacttggaaaaagtctcatgattcatgggaatttcaagaagatggtgaataaagaaacaaaaaaaaacagagacatggctatgataagaaaacaaaattaagtagattttttcgagagtgaaaatttgtaatatctatccaaagaaaatctagtaatgctatatcatttttttcaagttgtgttttttcccaagtcaagacaaatagcaaacagatgaaaaccaaaaataatagaataaataaattgtaagtttctttaggtcaaaacagattgttaagtttaattgatataataattttcaaagataaaattaatcacaagttgtgggggatggattatccgaagtacaatcaccatgtctatctgaattgtttgaattatccaaatccacattatccggattattatccatattatcgaaaacatagttttccaattttttttttttttttttgataaaatgtgaattatattaccaaaaggaaagaggttatttacaaagctgggggcaaggagcttctatggccaaaaaaaaataaaaagccttagataactattacagagaaactgaaactaattttccaatgttaacaagataaatacatatatgtctgtaaagtataatgtattaattatcaattgattttgaattagaagtctaagaattttataagtgtctctcatctaattttcaaattcaaaagtatactactatatctattccataaatattactatatatttacattttgatcgatattcaagtttgtaataatgtggatttaccactacttgtttacaacaaaagatgacacaagtagggtccttcgtgatttagaacaaaaggtacaagttcgtacgcgaaaaaggtacttctacaagattctgtgcttttcacgaatgctctcatagtctcactaatgcacacgaacgctttcgcaatattctccgtacttgtcggtacttcacgaatacattcccttacaaaatgaaaaaaaagttgtcataactttttaaaaaaaatcgtgtcataacttcaatatgatcacaaattatattaaaaaagagtacaatttcacttcataatccaaaggctagtttgttatccaagtcgttctaccaatccccaaaatgtttaaaagttggagtttgcatagagaatatcagaagaattatataatctaagtgtaaatatatgaagaatataattttatgggtgaataatctgaatgtaaaaggagttgaccaggcgttgagtgggtgacctaccggcttaagggaatcacacgctctgtagcgttgaattctttaaagagtttaatcaattcatgcacatctgatgctaatttttactatgttttcatttttgttaaatcaattttattatatatatacatacatttcctttcttcttttgcaatttaaaagccttgattacaagaaagtacaaaaatcaaaagtttggcagttttaattctttgggtggggcaatctttgatatatataagtttttttcatttcttaaccaaattttcttttttctcgttagtaaattaagtaaagagtaatcaaatcgatcaagagataaaaactagaaagaaagaaagaagaa

SEQ ID NO: 1282 - DNA, 3000 bp, Unknown
  misc_feature (1)..( 3000): cDNA_ID_3061509_gDNA_ID_1620379_Annot_ID_155265 3000 nt of promoter + ATG
ctttgattatatattgactatgtgattcgtcgtccacattaatttaagcatgaatctaattattcgccttttctaaatactaatattagaaaatttcctcttttttggattggttggttttccatattatcagcaagtatctaaatggttttcttactacagtgtcttcgtagtcgtatgagtggttacaaccaatggaattttatcaacatggccactcataagacgtagcattatcatgatcaaccataatatatgttatattcattggatcgacaaattaacaaagaaataagtagttttgatcgatgcccacttcttttcacacttctgccactacattcttggactgcttctgctactaaataccccacagtggaccagtttttattattataattgaatttataaaattgatacagacaaatgcttgtatatacttaattagcagaaagaaagaaaaaaaactaagtaaaaaattgcccatcataatcatcgatcagatccacttaattagtaatttataacactcacttagtaatatttatccttagttgcttatatatatatccctagacgtattttctattgctctatcatcatgtggtgagatctctgacctaatcgaaacgtgatatagatccagatcttgttccattgtcgtaatcaagtctacatcttttaatttatcttaattgttatcatcactattaactttcttaaaagtaagaaaaaccatcacacttcattataataaaaaccatcacccttcattgcatacatatgtgaacatgtataatttggaagctgcttagctataacagtcattaattgtcgacgacactaattcaaataacgatagatgcgatagacaaaagaacaatatggaccatttaatgataatcataagatttgagaaagaaatcaaaattttaacaagtttggaaaatacagttgggtacttgtcttttctcttgcatcttttgctgtctctttacttccttcttgtttgttggtttttggcttattgttttcccttttatttttcctctttatggaccatattcatttaactctccccacacatgttcgtctcttattttaattttattttggtatgactctcttatttatttattaaaactaaacaaatactccataagttataaaccaaagaaagaagttatagatcaagggttgacaaaacgttggagcttagtccaaatgatgaaatgcctcacacgaaatatgtacatacgtcgaattcaaagcgttagcaaaacttttggtcttaaagttgaggtcatttgtaccacggtgcgcctgagaatgatttagacacactagtactgtttatgcaaatgatttagtatgtacatttcatgtaaatgtggtagaccccaagagatattcgtatttttgtgagaaagaaactttgttacttgcttaccattaatgtaactctttaaaatgaaagaatatctgttgtctctaacttacaacaaaagttacatattacgaaacatattacatcaatatatgattaacatcaccagtttttaagtgaaatttacggtaattagagtacacactattccataattaaatacctgcagaataaaaccatgttgtcgaaatgctttctctcactttactatgtgtatagatatgcacatgcataaccatctctctacatatctattgatacatatttaatcttttgattctactatggcatgtgacttgaggtgtggtgttatatctttatatataatcttcttgacctaatgatgcttgacccatgatcttaattttagtttactttatcttttccataatctttttgttttgtccagttcctcctttttaatttttctaatcagtattctaaatttccagtccaagaaattggatctaaaacaccttcatcttaattcaatatatgtatgagcaagtgtatatatgtatatggatattaattagtattagcatacgtatgatataaacagataattacagcgaatgaaatggaccgacaatgctagcagagatgagcattagtaaatttaattaatctttcacataaattcctagctttcatgtgcatttcacactcttcaagattccatgtttcaactactaatttaataatttatatatcagaaatccaaagtagatatctccatctttctttcagttatttactaatctcatttttaccactatatagccacttcagactctcccaaagtaaacaaaaaaaaaaacaaataatcacaatccaaattatctaaatgtttctttcgaagcattagaaaaccccaattatgttatgcgtcgtttatcaataataggtagtagtagtactactagtagtagcattcaacaaatatcattattagtaactagaagtctagaagtcattattgatctgagtaaacgttatcttccttttgtttcttaaaagataacaatccagaaataacaaataatagggccaattctaacatgtcattttctgaatttgataacctaattttcttagatgatttatgactatgtaatagttagatctataggagttttttttttttaccatttatgaataatattatcagcatgcctcatctagaagcatttaccacagataaatccacttacaagaaaaggaataaatataatttaccactcttttcatctatatttttatttaattttcaacttatataattctgttttgttcacaaacaaataatggtgaaaaaataaagtgacattgtttggaaaataataataaagggaaaaaggtagaggtgctttttgggatccagatcttcctttactacttcttcttctctctctctcctttggtttgctctgtttttatatatttctataaaatcaaagtaaaaaccaaatccatggggttcttcgcttcacaatcccaacgcacctctctctctatctctcacttcttcttcttcctctccctcttcacca

SEQ ID NO: 1283 - DNA, 3000 bp, Unknown
  misc_feature (1)..( 3000): cDNA_ID_3061517_gDNA_ID_1620379_Annot_ID_155261 3000 nt of promoter + ATG
agcttcaggttcttagagaaagcctcatagaacttgttgtagtcctccttgttctcagcaatctcaaagaagagctcaagacacttcttcacaaggttcttgcggatgaccttgaggatcttgttctgctgcaatgtttctcttgagatgttgagaggaagatcttcagagtcaacaatacccttgacaaacccaaggtactcaggaatgatgtcttcacagttgtccatgatgaagacacgacggacatagagcttgatgttgttgggcttcttcttagtgtcaaagagatcaaaaggagctctcttgggaacaaagaggatagctttgaactcaagctgtccttcaactgagaaatgcttcacagccaaatgctcttcccagtcattgctcaaactcttgtagaaagcagcgtactcctccttgttgatctcctctggcttcctcatccaaatcggtttctgcttgttcaccaaatcccactcatgagaaacctccttaatcttcttctttttcttctcctccttttctttctcctcatcaacttcctcaaccttgccttcctcatccttcttctcttcctcctcttcatcatcagagatctccttctcaatggtcttctcaatccagagagagattgggtagctgatgaactcagagtgcttcttcaccaaatccttaagccttcgctcctcaatgtactccatctggtcttccttgaggtaaaggaccatcttagttcctctaccaagagcctcaccagaggtgtctctggtgacggtgaaagatccaccggcctgagactcccacacgtactgctcatcgtcattgtgcttggtagtaacaacaaccttgtcagcaaccaagtaagcagagtagaaaccaacaccaaactgtccaatcatgctaacatcagctccagcagccaacgcctccatgaattctttggttccagatcttgcaattgttccaaggttgttcaccagatctgaaaaataaaacaaaaacgtattagccaacacaccaaacacataaataatcaacgaaaaccaatacaaattgcttttgactgaaatcaattacgtaccagccttggtcatcccaataccactatcgataatcgtcaaggtgttgttagtcttgtcgggaatgatgtgaatgaagagctctggctgaccatcgagcttgctcttgtctgtcaaggactcaaacctaatcttgtccaaagcctgttttcaccagagtaaaatcacaatcgtaagtaaccaaccaatacacagaacgtatatacaaattacatataagcaaactttgtaaatctaacaagagtctgcttaatcgttggtatcaacactaaaactaatcaacagatttgaacacaaacagcttcgcaacttcaattaccaaccaaaattctaaaatcggctagaacactaaaccctaatcaatcctaaatctacagatcgaacagccagatcaatcaaacgagacagacaagtataaaataaggtgtagagagatagagatcgtacatcagaagagttactgatgagttcacgaaggaagatctccttgttagagtaaaaggtattgatgatgagggagagcaactggttgatctcagcttggaaagcaaaggtttctgcgtccgccattctcgttgatcggaaaaaaaatctaagagctagggtttatgaatcaaatcgagagataaagagagcaaaattttctttagagagcagagaagtgttgattgatacgagactttggggaaggatgttattatatatagtggtgtggggactgggaacctataagggtttctagatccttcctatttgatttatgttaatttgcttttcaggtccacataatctgcaatataattaaatggaaattacaaaatacaaaactattttttggtagaaaaatacaaaactttattaaattttttaaaattttattcccttttattttattttggagaacaggtgtaatttactactttttgtaacaggttttagtttacttctttttttttttggttaaattttgtaatttactattttattttattggttgatgataatttactatttataaaaaacagtcagatttaattctactccctttttattttgcagaacaggtgtaatttactacttttttgtaacaggttttagtttccttttttgttaattttgtaatttactattttattttattgatgataatttactattttaaaaacaaagcaataattttattttttgcttacaactttttttttcctgtttacagattggtatgtgtatcttttaataaagtttcaaaaaaatcaataattaaataataatattgaaagttgtaaaataaataaattaaaacaataacaaaaagaaacacatattctctaaaaagcgtggggtttgtggggagaaaaaattgattttttttttttaacttcagaattgattaaaactttttttttttttttaacacaactatttatcttgttgttataaattaaatacataactaaaatttgaaataaaattttgagatatcttgaaactaagggattaactttatcgatttcaaaaaataacccaaaactaggaccgatctaaaaaaatctaaacatagataaactagaatgaatgggaacttgtaaattcaaatccataacaaaatcgaattttgtatatggagaaaaacattgtttttattgattagtttagctaatagaaaaatttaacaaaaaaaaaaaaaaaaaaagtaagtagcacttgttccaaaaaaaaggaaagtaaaatattatgacaatttttatattttacaatttccattatattatgacgtctgtttccacatcccctatatattacacacttttcccccttaatcaaaccatcaatacttctctgcttctcttaagaatttgctttttgattcacataaaccctaattcttagatttttttcccgatcaacgataatg

SEQ ID NO: 1284 - DNA, 3000 bp, Unknown
  misc_feature (1)..( 3000): cDNA_ID_2133275_gDNA_ID_1620379_Annot_ID_155262 3000 nt of promoter + ATG
gcaatcttggttctgttttgggagtcctcgtggatgccgagcttcaggtttttagagaaagcctcatagaacttgttgtagtcctccttgttctcggcaatctcaaagaagagctcaagacacttcttcacaaggttcttgcggatgaccttgaggatcttgttctgctgcaatgtttctcttgagatgttgagaggaagatcttcagagtcaacgatacccttgacaaacccaaggtaatcagggatgatgtcttcacagttgtccatgatgaagacacgacggacatagagcttgatgttgttgggcttcttcttagtgtcaaagagatcgaaaggagctctcttgggaacaaagaggatagctttgaactcaagctgtccttcaacagagaaatgcttcacagccaaatgctcctcccaatcattgctcaaactcttgtagaaagcagcgtactcctccttgttgatctcctctggcttcctcatccagataggcttctgtttgttcaccaaatcccactcatgagtaacctccttaatcttcttctttttcttctcctccttttctttctcctcatcaatttcctcaaccttgccttcctcatccttcttctcttcctcctcttcatcatcagagatctccttctcaatggtcttctcaatccagagagagattgggtagctgatgaactcagagtgcttcttcaccaaatccttaagccttcgctcctcaatgtactccatctggtcttccttgaggtaaaggatcatctttgttcctctaccaagagcctcaccagaggtgtctctggtcaccgtgaaagatccaccggcctgagactcccacacatactgctcatcgtcgttgtgcttggtagtaacaacaaccttgtcagcaaccaagtaagcagagtagaaaccaacaccaaattgaccaatcatgctaacatcagctccagcagccaatgcctccatgaactccttggtaccagaccttgcaattgttccaaggttgttcaccaaatctgtacaatagaacaaacacgaatcagcaaacacaaatcaaacacatagataatggttttgaatgaaatcaagtacaacttgcttttgaatgaaatcaattacgtaccagccttggtcatcccaataccactatcgataatggtcaaggtgttgttagtcttgtccggaatgatatgaatgaaaagctcaggctgaccatcgagcttgctcttatccgtcaaggactcgaacctaatcttgtccaaagcctgtttcaccagaataaaaagctcaatcataagtaacaaaatacacacaacatatatacaatcaaaaactaagtaatctaacaaatttgaacatgaaaaggttccatcaattaacaaacgaaaatctcaaatcgaaaagaacactaaaccctaataaaacctaaatctacacatagatccgtcaaatcaatcgaaggagatacacaaacacattaagcttaaagataaacatagaaagacagagagggagagatcgtacatcggaggagttactgatgagttcacggaggaagatctccttgttggagtaaaaggtattgatgatgagggaaagcaactggttgatctcagcttggaaagcaaaggtctctgcgtccgccattatcgttgatcgggaaaaaaatctaagaattagggtttatgtgaatcaaaaagcaaattcttaagagaagcagagaagtattgatggtttgattaagggggaaaagtgtgtaatatataggggatgtggaaacagacgtcataatataatggaaattgtaaaatataaaaattgtcataatattttactttccttttttttggaacaagtgctacttactttttttttttttttttttgttaaatttttctattagctaaactaatcaataaaaacaatgtttttctccatatacaaaattcgattttgttatggatttgaatttacaagttcccattcattctagtttatctatgtttagatttttttagatcggtcctagttttgggttattttttgaaatcgataaagttaatcccttagtttcaagatatctcaaaattttatttcaaattttagttatgtatttaatttataacaacaagataaatagttgtgttaaaaaaaaaaaaaaagttttaatcaattctgaagttaaaaaaaaaaaatcaattttttctccccacaaaccccacgctttttagagaatatgtgtttctttttgttattgttttaatttatttattttacaactttcaatattattatttaattattgatttttttgaaactttattaaaagatacacataccaatctgtaaacaggaaaaaaaaagttgtaagcaaaaaataaaattattgctttgtttttaaaatagtaaattatcatcaataaaataaaatagtaaattacaaaattaacaaaaaaggaaactaaaacctgttacaaaaaagtagtaaattacacctgttctgcaaaataaaaagggagtagaattaaatctgactgttttttataaatagtaaattatcatcaaccaataaaataaaatagtaaattacaaaatttaaccaaaaaaaaaaagaagtaaactaaaacctgttacaaaaagtagtaaattacacctgttctccaaaataaaataaaagggaataaaattttaaaaaatttaataaagttttgtatttttctaccaaaaaatagttttgtattttgtaatttccatttaattatattgcagattatgtggacctgaaaagcaaattaacataaatcaaataggaaggatctagaaacccttataggttcccagtccccacaccactatatataataacatccttccccaaagtctcgtatcaatcaacacttctctgctctctaaagaaaattttgctctctttatctctcgatttgattcataaaccctagctcttagattttttttccgatcaacgaga

SEQ ID NO: 1285 - DNA, 3000 bp, Unknown
  misc_feature (1)..( 3000): cDNA_ID_3061544_gDNA_ID_1620380_Annot_ID_155297 3000 nt of promoter + ATG
gagaagtgaactataataattaataaaaattaatatgataatttagataccaaatatagtttgttgattttaattggttacttttttggaaattaataatgtatttcgtttttctaattaaattaaattaattaaaatttagatatcaaatcttatatgttgattttgattggctattatttttggaaattaataatgtttttcgttttttaattaatttaattaattaaattagtatttgattttttaatttttaaagagataaattaatttaatttttaaaattttatttctaatggcatacttatgtaattacttacaaaaattaaagttatatttaaaatataattctcaaataatatagtaggatgttttaaatggctatatataaaaataatgtataaaataactaatatatttatatgttgtaggattaaatgacatcaaaataacatcaaattataaatttgaatggaaatataatttgccaaaaaaaaaaaaagagaatataataaattactttattattcgtttgtcggcgatattctgtcctcgtcactcgtcactcgtcactcagtagcttttctatacttttctatacttttcgatatgttcatcggctgaatcagagtaggtcactggatctctcgtaagtctctcttctttctttgtttttcgatgctattaatctcatattgctttttatattcatcgtgattcctcttttttgatttggtaagatctgttgatactcgttactaaatcccagaaattgagatcttctcttgattgtttcgatcatctgttattggactatttatgtatgtacaaaaatttcaaggatcctcaggatagttcttctcttttgtcattgtttcagaaacctatttgatgctctttcgtttcatgtttgaaatttgcagatccgatcataggttcaacaatatggaacaaatttggaattgatgcaatataagctacattgaagtatgggatctgtatcgctgaagattggcgatggaaccgcaagattcaagcgatcaacgcttttttcttcagctatcaacctccttatgcttttctctatagtcactacaaatctctttgcactatacgccttctcgtctcggtctcaatcccacacgccacaccctcttcattccaacaatgtctctttggtttctcaacatctctcactcatcctcagagaaatcgattcctcccaccacacactcactcagatggagaaacagattattggttatgaatctctcgatctctcgcaacaagaagttccacaagagcttaaacttttccttcaacaacatcagcttcctcttggtaaagattctcgtactggtatcacacaaatggttgcatctgttggacattcctgtgaaatgtctctagatttgttatctcagtatatgtcgtataatgtctttgaaaaatgtcctgatgattggagcctagctcagaagttgattctccgtgcttgtgaaccgttgccacgccgtcgatgtttggctaaaacggtgcataaaccaggtctcgctttgtttcctgattctttgtggagaccagttggtaacagtagtgttaactggagcggtcttggctgcaaaagtttcgaatgcttgaaaggtaagaaactgagccgggattgtgttggttgctttgatctagctactagtcatgagaaagataggtttgttaaggttaatgggaagactgatttcctgatagatgatgttttggatttaggcgatgggaaaatccgaataggattcgatattagcagtggatcaggtacgtttgctgctagaatggctgaaaagaatgtgaatataatcagtaatacattgaatatagatgctcctttcagcgaattcatagctgcgagaggaatttttccgttgttcatgagtttggatcagagattaccgttctacgacaatgttttcgatctcatacatgcatctaacggattggatttagcggttagtaataaacccgagaagctggagttcttgatgtttgatcttgatcggatcttgaaacccggtggattgttctggttagacaatttctattgcggtaacgatgagaagaagagagttcttacgcgtttgatagagaggtttgggtataagaagttgaaatgggttgttggagagaaaactgatgctgaggtttttctctcggctgttctgcaaaagcctgcccggatttgattgatatatatttttttgaaaaatcaagattttgatcttttcataggttataaaattttgagctcattacatatttttttactattgatcccaagagacaattgaaagtgtgaatttgtattttgaggttttgtatgaattatgattgttctgctgtatgtgtgtaagattgtttgtaagatctttataagatcttcggatgtctcccaatgcattgttaagtttttcgttaagtgatcctataactccatgaacatttcctcatgttcagccaatttgtctctgagatggagctctgccttcttttccttatgtgccgaataagccagcttacagagtagtctagcaaagaggaacaagttcatgatacaaatccagtctaacagggttttttttccggctcaaacgagaaagaaacaataaatccgagtaaaagaattcgagattaaattgaaactcaacataaaatttgaggtttcaaatcactaggtgcaaagtttatgcttggaattcgcgatttcgagcggtgtagtacggtccggagcgattgaaaacattttctgtaattggatataacgttagcaactgcaatcacccgcaaatgcagcgttagcggcgggtagcggaaaaaccagttaaacccttaaatgatattttcccaaatatgtttttttttaattttttttttaacattttattttcttttaaaaattgggagggaaggggaaggggactggagcgagagagcttctgcgattgtgaaatg

SEQ ID NO: 1286 - DNA, 3000 bp, Unknown
  misc_feature (1)..( 3000): cDNA_ID_3061530_gDNA_ID_1620380_Annot_ID_155308 3000 nt of promoter + ATG
ttctgaaaggtgcaaaatgcaattatttgtcataaaagagagaatcccaataattagtgtatagtataatctaaccattatttacttaacaaatatggatttggaagcaaaaggaaatgactgtaaccagattctgcatgaaccccttcttatctattcaatgtattcaccattaatgccaatataacaaaaggacatatattttggacttccaagattttttttttggtcgaaatggactttcaagattttatattctaagattttgcaatcaaaactcagtagaacaaaaatgaagattgtaaggatagtgaaatcaccttaccttgtcatatgttgccttctcttgatcattctttggttattgtctcatcatgatcataatcatcactcttgtgctccatacatgaatactatcagaggaacacaattctcgcatcttcaacctgtaagatcaagattatgatccaattatgatgctttttatttaataacattatatattgatagatttggtatttctgatcataggaatcttcaggcttatcgagtctacttaaagaagcagctacagaagacaagatagtgattattaccatggtcgatcgagaatgggcaaaacctgactctattcttgatctattcctggagagtgtacggattggagaaagaaccaaacacttgctaaaccatttgatcgttgtggctttagatgatcaagctcttcgatattgtcttcgtgcccacccacattgttaccttcatagatattctagaaaaaaatcagaatctttaaaaccagatggtcttgttaccggttggaacaagaagtctttggttaaagagatcttagaactcggctaccacataatgttcaccgtaagttctcttaatgcaaatgtttccctttctacaaccagtttttatagaacaagtatgactttgtattcaagaacctaggttaggtacttaggtgggcacctagctagattggcatatcccgctccatgaataaccttagatggtggatttatgagttttttccacctaatatatatttttttttattcaaatttattgtttttgtccatctaattcttcagaatcattatttctaattattatatatgtcttagaatagtgaaacaactagagtttgaagtagaagaaatgttctgatatcacaaagccaaaaaaatagatcaaaatttattttatttttatctaaatcatttgtttgtaacaaattgtaatattgatttgttaacaagttttaaaattgaattattgattgtagtgtttatagaccatgttgtttacgtttttggttacatagacgcttaaaattggttgcaggaagcagatgtgatgtggctaagaaatcctctaatgcactgcaacccacaaaatgcaatatcagtggcttgcgggaactcattaattgatcatcaacatgatcatttaacaacggaaaacacaggaggtttcttctatgccaagtccaatgatataaccatagacatgtttaatatcttgaacgtagaaagggttttgtatcctgcaactggaaaccaatccttgtgtgatattgtcaagcgcgaagatgtaatcaaagcccttgataagaaagtcaccttcttggatgatgctaactttgggaagttttgtcaaccaaatccgcaagatcaaagcaagataacaacagtccatgcaagttgttgtcatgatacaaagagtaaggtgcgttacctaaagctacttctccaggaccggaaaaatatgaatccgcaatggattattccaagccagttatgcagatgattttattcgttacaattttttttaacatatgtataacattttgtacaacatgaaagaacgaaaaactacattaccttaagaccatgtttataggtgattttatttgagtatcataagcccaaaaatcattttttaatgcagtaaagcatgtatttgggcatgatctgtatcagtccactgatacttttgatactgagtatcagatgacgtgacatcacaccattggttcagcgaaaacaaagaaaaaaaagaaaaatcttctctcctctctcactgataatactatttttctttcgttctcttctacaaacctaaaaaatcagagcgataaacgaacaggtatgattgaactgaacctaaaaaccattttcctttcgtttttatatatttattttcgatgttgcaatttttttctttttatgatatttaaaccggtctcaccaatagaaatcgatttattacgagtatcatacaaaatcttaaataataaacaaacattaaaattaatattaaaaaattactaatgatattctatgagtatcaactatatacatgctctaagttttgaccaaaaagtagcctcatctgaagattcatcctctaaataactcatcttttagactttgtggcaacagttgaaggcacatgggatcaatgttatctaccatgtagattatccatccgaaggataggcgcttgagatcttttgtctatatgcttttaaacaaagttctcggcgggatggttatgaagagcatgcagcaaaagtagttaagctttgcggtaatcttccactggccattcgtgttgtgggttcttcttttaatggagacagctaagatgagcggatgcttcaattatatgggacagaaactaatcttgatagaaaaattgaggatttcgtcttcagagtgggttatgacaaattgttggagaaacatcattctcggtttcttcatattgcatgttttatgtgacaaccatgggtcgaagaccccaatatatttttgtattctttattgggctgactttatcataaagcccataaggcccattactttattctgtaggattcgtgaaacggccttatgattatgaattctgcaataaaaaaaattcgtgatttgtcgttacggaagaaaaaagggaaaaaatcgcgaagcttgagaacacatagat

SEQ ID NO: 1287 - DNA, 3000 bp, Unknown
  misc_feature (1)..( 3000): cDNA_ID_2133226_gDNA_ID_1620380_Annot_ID_155300 3000 nt of promoter + ATG
atttttccataagaatagaaaaaataattttggagggagtgatagtctgatagtattagataatttataatttatttaattaattttggataaacaaaatatatatatatatatacaagttaattttttgaataggaaaaaaaaaaacattgctgttaaaaattaatcaacgaagataacaattgaattgaaatatgctaatgctgattattgacttcatatttatatttaccttttctaaattctacagaaaaagaagtaaataaataatataatactaccacactaaaagataacgactagtttgatggaaatgtgagctgtctcactccttcacgcatcgttaagagcgtttaaacgtttataactgcgcacagtcattttgtataacacgtgtccggttaaaagtctacgtggcgtttaagtgacagcgacatctcatagaccattggtccgacgtggcattacgttgcgaatgggcctgaatagaataaaattatgcccaataaaaagtctctcgacctaactcttaaaagcccaataatttgatcaattcttatataagggcctgactggtttaaatacagcgggtgcggttacggttgcgcaagtttgcggaaacggccggttgcggttttaagcgttatcaagccttttaaacgactggttaagcgtttgataatgggtgcgttttcgggagttttatgaccggtaaaccagcaagtgtgatagtaattaaataaaaaaccaaaataaatataatatattactattaaaagaaagaaaaatacaatatattattatgataaattgataatattagaaaaattaaacatgcttaataattaaaaccataaataaaacattaaatttaaaataaataaattttgtaagaaaaagtttaatactttatgcatttggtacataccaaaaattgcatcaagtagtgtgataaactataaataacgttgaactcgcgggttttccggattgcctctatacatatgataaagtttcttcaagatatccaaacgatttttaacacatctccaactcaaatttttcccaaactggtcgttaatattcttaagaatattttctttttgaacatcacttagaaatctgattttgggatctttggaatcttccgttaaatattgattaggttttttttaataagaataagatatatagggtttgggtagaagacataattattttaattaattaaaaaaaaaaaataacctaactgctaccgcccgcaaccgcaaatgcttgcgggaatgagcttttgaaatctggcgattttgaacggtgtaaagcagtatctagcggtttctatgattgatgtcaatcgctaacaatcgctagcacccgcaaatacagcgtttgcgagtgacaaagggaaaaccaattaaaccctaagtaattgtctttgtctttgatattcctttcttctgacccaattaagacaaaaccctctacacacttttctctttcgaagacaaagatgaactgcattaataattcaacgagcccaaacaggcccaatggcccaatacggtccatcgactaaatatatcagaccctagttcccaagaaatgtccccgaggaagaagatgatgatgcgaaacatgaatgctcaggtaaaacatgaccagtaccgtgcaacaactttccccataatttgcttgtcgtgttgtgtagatgtcaagtgttttgctaaatctaagaaaacttgcagtgtgatacagagacatataatcaaatatgtagtcagcggtgttaaaaacagaatctgtcaaaccgtcttcttcaaatccacggaatgagaagcttgattaatgagatgctcccaaccatacccaaatattaatcagacattcattattgtctctagaggttaatgtctttgagtgtttttaggtgttcctagaacacaatttatgggaagatccagctgcatctccatctcctaatttggagtgaaagagcctagtctttcacaccaattttgagtttcaaatatatgtgcataaatgaatgaagatgcaaggtttggatttcgtttttatgactcttgtctaatcttacgtttgaggtaggtgagcaaagatgctatcacagcaaaaaatgctaaattactagattcaaattacgaatctaccctctgcatagctccgagagtgatgtgattccccttgaaagcatcaaagggttagtaaccttttctagagagtgccctttcgtcgtcagaaaaacgtaagcaaaaatgctacaaattaaaaagtgtctccaacatgtgcatattcacacacaagttggtgtcaacgctcagacaagaaaggcgtgtgttcattgttgaatcttcccatttcctcatccaaattccgacataactatcctagccgccatttgttctccacattacaaaaccctcagcagcttcaaaactcttccgatctctccctcacgctcgcaattctctcgtctccattttaatagtttttcttctcggaatcacaaatcttcggcttcttgttccttggtgagtttataatctatcttttgctctgcttcgatacttcaaagtctgttccttttgtctctctgagttcggtttttagttgtgttttatttcgacttctgttttagcgctttttctgaatctgatattgaactctttatcagaattaaggacccagatcatagttaggctcttcaattatatctgggttttgtgccaattgaagaaatcagtgaataatttttgtcaaattaaaatctgggtttggtcctacttgttgctccttgatgaatccttctcttgtagtaatcatatgatttactaactatagtttctgagtttaatatatgttacgatgatgttgatgatgttgctgttatgatgatgtggatgatttgatggtgttgatgttattaatgatgaggctaatgatggatacgaatcttgtacaggcgtgtgtgtgtgttgttga

SEQ ID NO: 1288 - DNA, 3000 bp, Unknown
  misc_feature (1)..( 3000): cDNA_ID_3061538_gDNA_ID_1620380_Annot_ID_155303 3000 nt of promoter + ATG
ggaaactttcagcatagtaattttacaggttatttactgactgatgtgatgaaaaacataaacgatatagatgaagagaaaactttttaccactttctaaaaagttatttagatcgttgtatttccccaacagaatttctggttctattacaactactggttcaagtttctagttccttctaaactgtgtgtttcgtaatggctttaatattttttatttgggcttccaaatattgggccattggctctgtaaaacttttttttctgatgctttatataataagacaataatgcttaattgttttagaaaaaatcaaaatataacatgcttaattgattaacattattatataatttattattttgtattttttgaatataaaaaccttttctatatacatatataatttagtgtacaatttcaggatttaatatgtggtatgacaggcagaatctttttttagtagtatagacaataatgttagattttacaaatttttttttgtattaaagttaataattgtgtataagtacaattaaaaaaaaaattgatgctgataaaatattcaaataagatttaaaccgtattactacttttggttgatgatattataaatttgtattaatattgatccaaacccgttccaccatataactctcgtgaaatattactttttataagtttaaatattaataatgtttataaagtttaaatagttcaataatatatttcaaaaattaatatgtttttgccttttacgtaatgacattttttgtaattcttactaaaacaaaataactctataaaatgtaattcaattttttaatgtagataatgttaaaatttataaataaatatttagtttaatcataatttatgattgatatgtatttgagtttttggactacctttcacgtcatttaatagcctacattgggtagttttgtaacattctttgaaataataatattatcttaatctatatatacatttttgcagtcattttagcaaataaatcttatagttggacttatttacaacccaatgccattagcattaaatctttttccaaaataattaattttactttaaatttttaatttaaattgtcaattacattatcaatcaaatttaatccaaacaaacttcacatcaatcccttaaaattagcataaacgtattttattaacaatattttaaaacaaagttttttgtttaaataaatattgttcttactaaacgttttttgtttaaataaacaaatcatgtatttgaacttatttacaatatcatgctacttacattaattatttaggcataaaaatatttatataagatttaaatcttctaaattcttgcttttagagttattatatcattacctaaaaggcaaaaaatattatttttttgaatattattatttgtatatttaaacttcataaaacattatcaatatttgaaattatcaaaagtttaatatatcaaaaaaattaacatcattatataatatatagagtttaaaaaaatctcaaaaaaaatttcgtcatattttgtgattcgaaattttaagaatgaacatatattaaccaattggcaaaaaatgtgtggattcaacgtcccgcaacgactaaaatattttgacaatgattcataaacatattataaagaagatcaacattaataaaataaatagtttttttttttgtggacgggtttggcaggacgttacttagtaacaatggtaaactataaaataatttacaaatttttatatatattaattttagaaaatgaattgtcttcatggtgtaccgcgggttaaaatctagtacatgtacattttactaactgaaaatatgagattgattctttatattacactgataatgaatgattcaaaactaaagatcagagtgtaatatagtttagcttagaaaataattaaaacaattttattatttatttagtttcctaaattttagtttagattcagaaaataattgtttaacttctttagaagatgataaacatatatggaagatttgaatctctattcatatatatttaaaaaatcaataatgtcaatataattaaaggatagtttagaagaaattttcttgaattctaaataattaatttgtatttttaaacaaatattaaatactgtaaaaacgaaatattaaataaatatggaaagaaaatcctgccttaaaagattttgtattattgaaaccgatttttttttacagcaaatttaaaccaaaaattaataaatacttaaaagagatcttaggaatgattttgtttgaagtaatgatttagtcgcaaactctagcaactaatcaactcctaaatcataaaaaccccaaaatatgcgtttttctttaaataactataattgtaattatctttaaaaatgtaacttttaaaattataaataatgtttaagataattataattgaaaatttcaataaaagcattttagagcagaattttgttttatccacttttggactattttgatctcatatacattttcctataacaagtgtagctttgttgattggtataaaatggaagtaaaaaagtggaatattccttattatgtcttttattttcacaagcccaatacagtttctacgaaatgtatatctatttatccaccaaaaaaaaaatgtatatctattttatttgtttcttatttaattagcatcaccacaatttggtgcaataaagagtatcaaattatcaaaacataaaataaataaatttataagccaaatattaaaataaaatctaatataataagatttgttcctatcccaaatcctaaatgtaagtacaacacattatttataataaacaagacagaggtctgatatttgcgttgaacagaatcgttgtcacttgttcagtcttcactacggagctgttttttttcgattcgccggaaaaatcataaaatccaaatctacaaccacctttttatcgcaatcca

SEQ ID NO: 1289 - DNA, 3000 bp, Unknown
  misc_feature (1)..( 3000): cDNA_ID_2133244_gDNA_ID_1620380_Annot_ID_155306 3000 nt of promoter + ATG
acccgcggtttacagcgggcaatcggtttatttggtttttatactaaatattcgaataaatttgatattctaaacttataaatataattttttagtgattagtaagaatcgtaatatatgatttgaatattatttttgttgaacggttttgattgaatcggatcatataaagtttaggagattgttaagacaaaattacccttaataattttgaatagcataaaacaaaatccaaaattgaaatcaaaattgatgtcaaattagacaaaatttcaatttgtacttcctttttaataataaagggattctcagttgaacaaaaccatgctcccagaccccatagcaatcttgcaattctaggattttagtcccacactatccatagtacccgaactagctaggtaacaatataatgtgtttgtcattgtaattaaacaaatggtacaactcattaaaatagatttcctgcattaaaaacaaaatttatataaataaaaagaagtaaaggttatttatgtactagttatcaacttttgaatcctaacaaatagagcaaatttcgaataactactgtgacgggaaacatagctaaccaccagtaaaaatttgctcgaagttcatttagatttgattaatcgcttatgtacaatcacctcagacgctcaataccttagagctaatagcattttcttagagtatttatttcatatcttctttttgggttgtataatttctatggttttgccactcatacttttgaatatttatatattttttttcataataatttctcatatttagttatgggatacttcagtctcatccatttcatattgatttacaacttataagtatatatataactaaattatacttattcaacaacaaagtagactaagtagtacacaaaacatcgtataatgttaaagattaattatatctacgtttatgtggtcaaatatatttctccaattggacgtttctagggtccggaatatataaatcacgtgtttggagaataaatgattagagataaatactcgtacaagagaaaatttaaaaagggctgttcgatgacctcaagggtcggaattcttttgatcgttggatcttggaattatcgaacgaatgtgtaagattacacatgttcatacttattggttacaaaggtttttgctgatctgtcagacctagtggctgagttgtcatttgacacaagtcaccaatttaacagaagagagatatagtcacttggccagtacgcaaccaaatgggcaaatggctgatcaatgaagaatcaagaatgaattatatgaattagaagaaaaataattacaaaatcttatttaaatgttgatatttgatttcttctttccatatttttaaaagttaagtaaaaagtttgaatcgatatttatatgaaaacggatgaaatgatatatgaaaaaagtacatgggagaataaaaaagatagaagctacttattcaggtaatgtgtgatgtataatgaaaaatgaaggaattaaaaagaagattattattgtgatctaccatgtgtacacaagcaaccgaaacaaattttgtttatgtcccctagtgcaaattgtagagtattctatgagtaatgttttttatggacaatgtttgaatatcattagttttatacatgaaaacagaaaagatttgtcaatgccttagagatccacatgcaaccgtctttgtcgatccaaaacggaaaagtatggagagcgttggtctgtgcaagaaattcatgaaaatatttaaaatgtctattttaaaataattatgtatttgataaattaataaataactaattgtgatattaatagttgttagggactattacttagagaaatttgggatatggagtagtatttttggacttccacatatgcatttttgacagtacttttcaagaaaccctattatgaaaccaaattatacaagttgcactatgcgcccaaagattttggaactatcgacgtaaaacattttatgtctgccacaaaaattcttaaaagttaccttaatgtttatgtaaatcatttttctttccctcttcaactttacgtcaaaatcacatattgatttgtaatgaaagaaataaaaaaattgagtacaaattaatagctagataatagtcgatttctacacacacaaaaagggttatatccttagtggataagaattatttcaatataaaaaaattcgtcgttgttcaactacgtcaaaatcacaaactaatttcaaatttattttgggtattaatatacatgaaaaacgagtaaaacaaaagtatgtatatagctaaagacaaagtagatttgtacacacaacaaaatggactaaaaatattgataagaataaataaactaatatagggtttgtatacagaattataactttcttccttctaacttcaaaaccaacaatggatttcaaaactatatactgtattcactattcagattgaaacatagctagagaatagtagatgcctacacaaacacacatatcatgccttcattttaggttttttttttttttttttgatgacaacctttattttaggttatattatttaagtaggcaatataatatagaccaatgattgtcttatctttagtgagaatagcatatggtacccatccacccactgtgactcctcctcacaacaaataacatttaaattaaatgttatgtttgtatcaccatacatataatggtgtatattgatgcatgcatgtatcatatgtagagagagatctataaagcttcataaaagtgtttctctagaaaaaacgacaaaattcgcagagaaaatccaaaccaaaagtagttttgtaacagagagatagatagaaagctcttgaagatctaaccaaaatctacttttgttcttcttcttcttcttttcataaattttcggagtggtcctatttattgtttcttggatcattagagagacagctatcgatg

SEQ ID NO: 1290 - DNA, 3000 bp, Unknown
  misc_feature (1)..( 3000): cDNA_ID_2133240_gDNA_ID_1620380_Annot_ID_155305 3000 nt of promoter + ATG
cagtcctcttttcgatttatgctgtaggatttgtaagcataggttcatctaacctagttaggtagctttattttgtgtgtgtatatgagacatgagtaaatacatggaaattctgctctagggaacatctcattgtgtctcttctctggtttcttcttccttttctgcttcctactgttgtttttttactagataactctatatgttcttattccatcctttgagatgctcctctgtaaaacatctcttttatcttctgagcttcccatgtgcctaatttgttttctgaggatgttatgttcgtttacagtatgcaaagtttgtgaagccggcatttgatgacttcgtgctcccttcaaagaaatatgctgacgtgatcattcctcgaggaggtgataatcacgttgcagtcgatttgattacgcaacatatccacacaaaacttgggcagcatgatctctgcaaaatctacccaaatgtttatgttatccagtcaacatttcaggtattttctcactcttgctctctttgatacttgatttagatggtaagtgttatcgatggtctcactataggatcatgattgcagataagaggcatgcatacacttattcgggaaaaggacatatcaaagcatgactttgtgttttattcagatagactcattcgtctggtatatctctcccttatgtcttctctttcaacgtcactcacttttcaggctttcttattttaactaatatcagttcaatttcaggtcgtggagcatggtcttggtcatttgccattcactgagaaacaagtagttactccaacaggtatgagaagagaatgcatgagctgtaacaatactgtatacacttttttatataacttggtcatcagatgtccgtctccttcacgtcaatctagttagagttagcttattcaactcatttaaacttatcttttccacaccaggagctgtatataccggtgttgatttctgcaagaaactttgtggggtctcaattattagaaggtgagcctttgaaaggtattgtatttggttaagtttgatatgataagatgcttattcttccaactgttttacatcatgcaaggcataaatttacttgtttgcgattaaattatctctcctacgtggtttctgttttgtatgtttttcctagtggtgaaagcatggaaaatgcattacgcgcttgctgcaaaggaattaaaatagggaagattctcatccaccgtgatggcgataatggaaaacaggtcttcctattaatattttgctctgtttttaaaagtatcaagtataatctctttttataaacacgaattttgaagtttctcttgtcgtgataatcagcttatttatgagaagcttcctcacgacatatctgaacgccatgtcctgcttctagatcctgtcttagccacaggtactctgtctctctacgctgtatatttcgattttggtcctttttgatggatttttggttctcgaaattcatatctcgtgatattgcttcttcttgaaggtaactcggctaatcaagccattgaactactcatacagaaaggtgttcctgaagctcacattatattcctcaaccttatatcggtgagtgtaaaaagctatatatcgatctttcgctcttttgtgaatgtagaagctaaagatctcattatgtatctgcttctctatctctttgcttctctctttccctcgtcatgaccttgctttctgacaggcgccggagggaatccactgtgtctgcaaacgttttccagcattgaaaattgtgacgtctgaaatagaccaatgtctgaaccaagaattcagagttataccgggcttaggcgagtttggcgatcgttacttcggcaccgacgaggaagaccagtagccaccactcaacactgtgactggtttcaaaggaaaagcctaaatttatgactagagcgacagtagaggcacttgcatgtctttgtagtttgtgctaaagaatctttatcttattgtttatgaagctcctcttgcttacttgaattatttttgaaaaactacgttaattttctcattaaaaaaatgatcgggacaatgctagttttctaaaccggtggaaaaagacataaccaatccttttatacatgattttgacaatcgtacgaaaattccagttctctctaattttaatttctttatttacatgttgattaatatatatttaccatttttcttaaggatcttagggtttagggattatgacctaaacctaatgatagaatttaaccttagttggacccacgaatgatgggcctaagttaagcccaactataaattaatgtagcgtaaccgccacacgctcatctataaatacaccactcctatgcaagacctatagttttatttcagtcgactcttgaccttcaatttcctccgtctctaaatttccttttcttttggctctctctgcgatcgagttcgaaaccgttccctaatcgaagatctagattcaacatacgttttatctctcaggtttgcttcttcttcgactacgttttctccgcgattatgatgatgccttcttcttcctgctttcactttgggttgcgtttcttcatctcctcgattcgcgatcctcctattcgcatcgatacccagagatctagggtttccaccgatatggatatggataaatcttagggtttcaccgataaggattatggattcgagtttctcttctatgtacattgtcggagctacatcttctcttcttgttgttagtgttagggttttgaataggttttaggtgatgaattataggtttagagttctgaattagagatttatttggttttttctgtggacgtggtgctctatgatacctggattgaatttggggttacagacagaagaatgtgttgcttttgattctctagcgattggggaattcagaaactccttgcttctggacttgttacccttgtgaaaatttatgt

SEQ ID NO: 1291 - DNA, 3000 bp, Unknown
  misc_feature (1)..( 3000): cDNA_ID_2133222_gDNA_ID_1620380_Annot_ID_155299 3000 nt of promoter + ATG
gaagaaaaactattaaaatggagacgagagaattgcgagcgtgagggagagatcggaagagttttgaagctgctgagggttttgtaatgtggagaacaaatggcggctaggatagttatgtcggaatttggatgaggaaatgggaagattcaacaatgaacacacgcctttcttgtctgagcgttgacaccaacttgtgtgtgaatatgcacatgttggagacactttttaatttgtagcatttttgcttacgtttttctgacgacgaaagggcactctctagaaaaggttactaaccctttgatgctttcaaggggaatcacatcactctcggagctatgcagagggtagattcgtaatttgaatctagtaatttagcattttttgctgtgatagcatctttgctcacctacctcaaacgtaagattagacaagagtcataaaaacgaaatccaaaccttgcatcttcattcatttatgcacatatatttgaaactcaaaattggtgtgaaagactaggctctttcactccaaattaggagatggagatgcagctggatcttcccataaattgtgttctaggaacacctaaaaacactcaaagacattaacctctagagacaataatgaatgtctgattaatatttgggtatggttgggagcatctcattaatcaagcttctcattccgtggatttgaagaagacggtttgacagattctgtttttaacaccgctgactacatatttgattatatgtctctgtatcacactgcaagttttcttagatttagcaaaacacttgacatctacacaacacgacaagcaaattatggggaaagttgttgcacggtactggtcatgttttacctgagcattcatgtttcgcatcatcatcttcttcctcggggacatttcttgggaactagggtctgatatatttagtcgatggaccgtattgggccattgggcctgtttgggctcgttgaattattaatgcagttcatctttgtcttcgaaagagaaaagtgtgtagagggttttgtcttaattgggtcagaagaaaggaatatcaaagacaaagacaattacttagggtttaattggttttccctttgtcactcgcaaacgctgtatttgcgggtgctagcgattgttagcgattgacatcaatcatagaaaccgctagatactgctttacaccgttcaaaatcgccagatttcaaaagctcattcccgcaagcatttgcggttgcgggcggtagcagttaggttattttttttttttaattaattaaaataattatgtcttctacccaaaccctatatatcttattcttattaaaaaaaacctaatcaatatttaacggaagattccaaagatcccaaaatcagatttctaagtgatgttcaaaaagaaaatattcttaagaatattaacgaccagtttgggaaaaatttgagttggagatgtgttaaaaatcgtttggatatcttgaagaaactttatcatatgtatagaggcaatccggaaaacccgcgagttcaacgttatttatagtttatcacactacttgatgcaatttttggtatgtaccaaatgcataaagtattaaactttttcttacaaaatttatttattttaaatttaatgttttatttatggttttaattattaagcatgtttaatttttctaatattatcaatttatcataataatatattgtatttttctttcttttaatagtaatatattatatttattttggttttttatttaattactatcacacttgctggtttaccggtcataaaactcccgaaaacgcacccattatcaaacgcttaaccagtcgtttaaaaggcttgataacgcttaaaaccgcaaccggccgtttccgcaaacttgcgcaaccgtaaccgcacccgctgtatttaaaccagtcaggcccttatataagaattgatcaaattattgggcttttaagagttaggtcgagagactttttattgggcataattttattctattcaggcccattcgcaacgtaatgccacgtcggaccaatggtctatgagatgtcgctgtcacttaaacgccacgtagacttttaaccggacacgtgttatacaaaatgactgtgcgcagttataaacgtttaaacgctcttaacgatgcgtgaaggagtgagacagctcacatttccatcaaactagtcgttatcttttagtgtggtagtattatattatttatttacttctttttctgtagaatttagaaaaggtaaatataaatatgaagtcaataatcagcattagcatatttcaattcaattgttatcttcgttgattaatttttaacagcaatgtttttttttttcctattcaaaaaattaacttgtatatatatatatatattttgtttatccaaaattaattaaataaattataaattatctaatactatcagactatcactccctccaaaattattttttctattcttatggaaaaataggaaattgcacaattaaaaaggagaaggttttttttttttttttttgatcaacagagaaggaagtatcaattaaaaaaaaatgcataattaagaaggtgtgattttctggtcaccgtctaattaggaaaatttaaatttatgacacctaattcaaaacattttcaatttccaaaactacataacttgtcaatagactttaaaaagtttaattactctaaaacgacttgaaaataaacagattaagcgtgacttaacaagaaaaaaaaaaactaaaattaaaattaaaagaaaaaaagttaatcggtttagtaagaagcttgttccgtacaccgcttgaccgtttccttctcctcaatttcttctctccctcgcttcactattttacgaagttgctcgctctctctctctctctcgctgctctcttaaaaaaaactaacctttgtctaaaacccagaatctggtaaaccttcacactcaaaaatg

SEQ ID NO: 1292 - DNA, 3000 bp, Unknown
  misc_feature (1)..( 3000): cDNA_ID_2133371_gDNA_ID_1620381_Annot_ID_155318 3000 nt of promoter + ATG
ccaattttaatccaaatctaattctgtaaactggagaataacgataaaggatttggaaataactctaccaaatttcgttaccttttaccacgatttgatatgacgaaactgatttctcccaaaccctaacgattctgctcattctccttttctctctttttctcctttataaaacgaaaagtggctaactaaagccctaatttcgagtttccttcttttataggcaaactctagggtttctaattaacccaaccaattaaaccggataatttaaaaacaaaccctaaccaattttctggttcacgggcgttacagaatcattggatagatcgaatatatgtagtgcgttttggtgtttagaaaaaaggaaagacaaggagttttaattttctgtagttgcttaggcccaacgaaacctcttaatttccttttttttttttctggaattaagggagaagactcatcaattagagtatacacactgtgactaaattaatttgatagtttactactttatagatttattaaaatttgttttcaccggaaaatgtatacacctatagaatatccaaatctgatcaaattaatatctaattatgtttcttttgatgcataatcacaaatcaggatgaactttattgacacacattttcaatttttgtatgtcaggggttgagtttcacaagtttcctataccgtatatatgtatacatgtgcactacatatatttttgttaaaattatccctttaatatgaaacggagagaataggtatttaggtataaaaatgtgactaaatcatgtggtttagcattatgtccgaatgatatgatgtccctttgtagttcctttttttttttgttgaataaacatttgtctccttaccatccaccaaaaacaaataaaaataaaatatcccttgtcttgctatatatatatatatatttttttacctgcattgttgaaataatcttgttattattttcttgttaaacgaattaatcttgtacaaaataaagatagatatgatatgaatcttatcatatcatatgatattgacttttcaatattagtaacgtctagttgtagaacaccattaagcatttcagtttcattaggaagaaaggaaatgaagaagaataaacgtacgtcaaagttatcaaaaagaaaatgttgatgaatacaattcgattttgatcaaacatacaagcaaaaacatatatacaaatataatgttttttttaaaacattattagatatatctgaatttggcaaaaacgtccaattaaacttgtgataattaaataatttttggctagtccaccataaataaaagacaagtccactcaacaaaaccaatacccctctaattccaaagccaaaaataacaaacgaattttaatctcctcacaaaaaaagaacaattgaaccatagtccatagttttgttgggtaccttatcttttattgtcactaatatttagtggtgtttacgttgtttaggcagagaatcttgctaaattcatgtctcaagattccaattgagtaaagtcaaagattctcataaattcaggtctgaatgttgcatccgattcaccatccaccgactcacgaagacaaatcttcatcagaattcttactttattactttctattaaataatcatatccattaaataattctatctatccaatgacatctcgtatggtcacacaggtcacgtccttggtgtctctgactcgactttcttaatagatttttgtttttccgaaacaaatatgttctgtcagaaaattacggcgaaattcttctcttactctttactccaaattaattagttttatttcattttagatttttgattccatttcattgttaaatccttatctgcaaatataattatcacgtttagtaactcttgggatttactatgcttcaatccgaatcttatttatcgcattaactttcattacggtttctttgatataacgaatgcggaatttacctatcaagaactatatatggattattattatgatctcctattaatgagaccataaattgcaactaaaattagaaaaccacgtagtattgacgtcaagtcaacatcaaaaagccacgtgatatttgttatgcaaattatgaagataagctatataacttcaaaatatgcctatcaaaagtttagagtttatctatttaaaatggtaaccagcccctaaacctccaatatttttttatacttcaagagacccaaatttattttggatgatttaaaccttatttgtttaataaattaaaatttgaagaaactgatttattactaaaatcatgaatctcaccattatattaaaaattatattaattagattcataaattataaatataataatttctgatagactaatatagtttgccataaaataattaaaactaagactttcaattttaatactttcagtaactttgatcaaacacatttttatttaaatagaatcaattttttaaaacattaattgaataaattatatatttttttgtttgtatgtacgagatttttctttcagtccattaatatgtaaatccatatatatatatatattaacaaataaatgagaagctgaaatgacttatccatcattattttgtttgaaaattctataactcccgtcaaaccaaaattaggcaattttcattttttgaaagattctctcctaatttttgataattttttccggattctatcaattttaagaacatttaaacttctactatgatattatcctaataagacatatagtaacgtatattgacatctattagattattaccaaacatatgtacacacacacataaagcttgattgtataaaattataaatatatgtagcaataacacaaatacacacaaaccccaacacacaaaaacgcttgtgaaaaataaaaagagaaacccaaaaacagaacaaaagaaagaaaacaaaacgttcttaagagtttaa

SEQ ID NO: 1293 - DNA, 3000 bp, Unknown
  misc_feature (1)..( 3000): cDNA_ID_2133614_gDNA_ID_1620382_Annot_ID_155340 3000 nt of promoter + ATG
gacgtctattaaattgaggatataaaatacaagcatgatgaattgatgagtatatgtaatcagttgagttttaaaaaaatatttgtgtattcttttatacactagtaaaatttggttatattcaagaaacatcagatatttaatattatggaagagctaattttaagcgcaatataataagattcacacgatgggccttctcattacaagaaatgggcctttgaaacatatctcgtatttagatcagtaaaaccggacgcggatgcgattcaattttgcataaccggatcattgttcctcgagattactgaaagctcgtgtagattacgaaatacgaacgagcctcgtctacaattaaacgctagtatcggtgaccgaaacatctgaaaaagcatgccttcattgagcggcccaacttacaaaatttctctagtttacattattcggatggggtaaatgtcattttgaaatcaaaatttcataagaaatcatgtagcataatagtttgataaaagtttatggtagtgttgttgatgtgtgatattatggtttaaatttgacacatgtttttgagtaataatatttggtggatttttaaaaagcattggataaaggtgtttggtaatgtgacctttttacctgtttagctacatatttaaatagatattttatataaggggtggtaaatttcagatttttggtttttcgaaaattatgtaactgatcattcatgtcgtgtgatcaatgtttctagaagacaaaaaagaacatcaagaatctagtggaattagttgctttcataggataaccagctcatcaaccaaactctgtttgtaagattatataattctcaatttaaaagaaacaccaaacctattttagtttatatttttctattctaagattttagatgggtacatacgaaatcatcatattagttgtcacaatacaaatgactaatctttactaatatatacacatttaacaaaaagtcccaactccaaataccttttttctttactaatcccaccttgcttttatgctctttcttttgtcaattaaatatatatatatatatatattatattttattttattttctcaaaatgactgttagatgttttctctgtataattgtattgtttgattcagaaacacttaaaagtatatattatttgtataattttaatttttgttattaactacaaagtaaaacagttggtaaaaaggttagtgagtaattcaaactgtgaaaaagaaagtcgatttacttgtagaattacaaagtaattgaacttttttttaatgtttcttatctattgtcaatatatctataaaaatactactgccagactaaaataatacattttgtagtaaatgggcaagatcgttacagagacagacagacagctatctcatcaaagctttgtctcctttcccattacccaattttaaaaatattttgcagcgtgtgaatatcctttgtacaccacatactcttttcacatatataatattaaattacactaaaatttgtgtacaactattacctatatgtatatatatgtcagcatgcagcagctaacgaagcaaaaaacatgtattaatccgactgtctatatatgtaagtaacttgcgtttagaaaaagaaaaatatgtattagggacttgcattgcgtttcttaatcagaatgtaataagttaataacaatgctgaaacacattgacactaattttaaaaaatcttttcggttagagcaaatcaatttgcatggccaactactggaccgactactattgcaacttttttttgttttgtatagtatttcgttgcgtgtatctgcaatatatatcacccatgacccatgtctatatttattgtatttaaacgaaggttggtccagtgtattaatactgattgattatgacattttaattgaaaatatcccaaatatcaactctactgtagtccgtagagagacctgaatctctaatttactgttttttaaccatgccatcaaccaatccaataagaaaaacaggaacaaaatacaagtgaaaacgaagtagcaattgcataatttgggactccagaagtttttttattaatcctatagaatcaaatttttttcggaatcaaattttaactttaactattgtatcattacgctaactatgagaacatcttatattattatatgatttttcaactgttaaatttaaaagttgatcattttgttagtatatgtttcaaaaaatttaattttcaaaattatgtcgtagtatatgaaaaagcaacgagtgttttatatgataaagtagaaactaatgattttgaactaatttaatgaatctttaaaatctatgccggctcctaagtagccgagctgaaaacccatggcattgtcatgattcacgtcctggaccaaagtctcatgagtaaaccggtgtctaactctaaccattgtaagctattttgcatttaattacaaagtttaaaaaatcccccgaaattcctgaaataactcaagatatctccaacacttcctctagggttatcctgtcgtcttatttaaaacccggagttggggtgagaagccatctctctccctctctatctctctccctctctatctctctcttaccaatttccatttctcgggggaaaataataatacgacttttgaaatctctcactaatatttcccaagaaaacctgatgaattaaaagttcatattttcttggtgttgattggtattagatgactatttcttagtattagtcaattctctgtttccatcttatatggatagtctagacacagagcaaagatccttctttggagaaaaagaagatgagagacgagagaggatcgtttcttcacgtattggtcgtagatagatcttaatcgataaccatctaggccttgatctaaccattcaatataaactttatttccttcttcttttcgatctcaattgttccgaccaaacaagatg

SEQ ID NO: 1294 - DNA, 3000 bp, Unknown
  misc_feature (1)..( 3000): cDNA_ID_3061589_gDNA_ID_1620382_Annot_ID_155356 3000 nt of promoter + ATG
aaagtcgaattcagttccacaatatggtgacgaacaacttcgagcttttccttggagaccgtcagtgttgcaatgttacagccaggtggtggatctaatcccattttaattctacgaactgtacaaaatcttactcttgtaagcactactgcgatttctacaagtggtaaaatacagtggaagggaaaaaagatacaaatgtgtataccttggagtttaatttttccaatagtcttcttcgattttggaacagacgtctcagtaaccaactcagaaggtccctttcccagtaactcttcttcagaatgaaggaaaaacctctgcaaactaaatgcattccgcattatggtgcattcattgttgaggaagtaagaagcctcgctgacactatccgttgaccatgaatgaagacataaccgtacacaggcttcataggcaatcatcgcagaccatggaccttgctcactgcattcaaaccacacaaaaaatgatggaatgaataatcacagaggattaaaaaaacaagaaagcaaaatctaagtcagcaatgtaactcaaacctcgcatgaaaggtggggaaacgaggcaatgaacttgttgaagtgcttgtcccgttcagagtccttcctgaagttccagcctcaacatttcgtctttcaaattcattatgtgaagatatattgttccgcacaccacaagcttctgcttcctgtaaacatgataatcaaatcagaacatatttagaaacggtaaaggaaaacgagagacaagggggtaaaaagtaagtacatatgaaacttcagtgctagtagctgagtcagataaatcatcagcagcaccaaagaccttagcaccattacgtccaagtccattttgagctgcgacgtgaggcaaaccaagatgaattctataatcttgaggagagtgttgcctctcgaatatctcttcatctgaatcagaagcaatgtccatgtctgaacttgaaccaccattgttattacctctcacgggtttaattgatgaagacaatggaggagcactcctgaatccaaaaccatgaccagaattggcattgggaacagacttagcatccaatttccgattaccaatcgtccacctcgaatcaacatcctacaaaacaagcattagttacagcaaaatcaaacaacatcgaaaaatgcagataaagtttttgttcgtacctctcctatgtttcttaagccagcttccctgaacattgctccttaccttttaacctaaatttcagaagaaaaattatcaaaattttcattcacattcaacaatcaaatctcagttctataatgaaatccctaaaacatagcaactgaaacgaaatcaaacgaaatcaaacgaatcgaaggctacaaaagcgaaattctagtgaaaacggcaaaaagagaatgtagcaagaaagatgagaattactttttctctctttcacgaaattcacatgaaagaaagcgaaatcgtgaacggaaactcacaaaattgaagaatcgatctacttctcaatgccaaaaaatgttaatgcattagcttacttacactgcccagagaagactcttcggagttttttcgtttctttttttccagtgaaagagtcaacacaagtgtgaaaccagaaatttttccagtagaacaaactggttaaatttcttcaaattgactacaggtggaaaattcgaccagtgacagtcattggactcaaatttcacaatgaagaagaagaaaaatggaagatcgattgaggaagctcttatatttctttctctttttttatttaatcttcctttttttttatgtaagtttagtaaaaattgcgccaccataggaaaaaaatatatacggtgagagcggagaagaagagcggcgttggatggagacgtcaattaacggtgacggcgacttttattacgcttagcgtaaaactgacgtggcaagtgaagatacgccctttctttctcccataacggcaacgttatgcgcgcgtgacggtgcgtctatcagagaatcaatttgcattacattagttttggagaatttaggttttgttataaattagtaagaactacgagtgtatacagatttttgttaacccaaataatctaaacaactttccagtattaaaaacatgagtaatcgatttcttcagatttttcgatctaatgatttggtcgcatttgattaaccaactctttattattttgtttttcatgccaaacaaatgtcctgccggatctcaattatctcatttgactaatcaaattaatatagcataattttcatcaattctcatttattgaaatttacaatgaatcaacaaataaaaacccacaaaaaacgaattcaattaatttgatccggtcttttaaatttaaagtattggaaaatgaaaataattaattttctttaatcaacaatataagaaattaaagaatatgagtattgaccaaaagaaaaattaatatcaacgaaagaaagaatttggacaactttttcttgtcttcatatgccttttctccgaccacattagttgtgtccaggtcacgccgaaaacgcatatgcttagccagcaaggtaatagctttaacaggcttcaaaaagcccatctaaagcctaatcaaaagcccgtattctaacatttgaccttgaacagtgtcaactagttggggaagctgacgcactaaattattatcgtccattcactcgctcttatcaaaaaaaccgaaacctagccacgcgcctcgtacactcaacgtgggtttcacgctgttaatccttatttcaactaacgacgtcgtttatcagagtgtgttaatcacgcgcgagtgaagagaatttccttttacagctcattatgactcggctttgaagctttttattcttcttctcaatttctttttttcttccagaaatttcctccgatttcaaaattttccggtgaaatcgaaaaaaaaagcgagatcttcttctctaatg

SEQ ID NO: 1295 - DNA, 3000 bp, Unknown
  misc_feature (1)..( 3000): cDNA_ID_3061585_gDNA_ID_1620382_Annot_ID_155357 3000 nt of promoter + ATG
aaggaataatttggttaatgtgaagcgttagtcaaaaaagttatatcaaaagaggactttgcagaatgtctttttctttagaatctctgtttattaaaaagaagtgggtccgttcagaaagaagaaagagttactttttataaacaacttgtctatttctggtaaaggtttcaaaattccttcaaatcaacccaacacaatgaatacaagatggggccaataggaatagtaaaacaagtggtcaagttagtaactcaaaatgcaaattacactctccctaaccaaacttaagacaatgatgatcagacagagaaactctacttgaaacaaacatgcagtatagtggatgaagaaagagtacctgtttcgccatgctacaagctttctctgaagagttgagaatctcgtagtaaaacactgagaagttaagagccaaaccaagcctgatcggatgtgtaggtgctagatcagcaactgcaacgtccttcaatacaaaaacccacgaatgagcaaaaatacatattttcagaacaattatatattactaagacatattagggaagcaattgatcttaagcccaaatagtaaaagttgactacttctaacgataggatcaatacaatagctagattcgagaccaatttacttattatgagacaactgattacagattagctaattgaagtaatctcagaaatagggttttagctccacaacaggatcgattcaaggatttagggaatcaaagatatacctgagcagctttgtaagcgatcatagtatcttcagcagcagttttcctctcatcaccagatttaaactcagccaaataacgatgataatctcctttcatcttcaggtaaaaaaccttagactcactggcagtagctgaaggaattagatgcgaatcaagtaacctgagaatcccagaacagatcgaagaaagctcagtctcaactttagatctgtaatccttaacaagcgacacgtgttcttcgttcttcctgctctcttccttttgctcaatcgaagacacgattctccatgccgcacgaagagatccaatcacgttcttatacgcgaccgagagaagattcctctcttctacggtcagctcaccggccggtgtagctccacttacgagctgttccatgaattgaaccatctcttcgtaacgctcggcttgctcggcgagcttcgccatgtagacatattgatctctgcttaaggtcgtcgccattagagaagaagatctcgctttttttttcgatttcaccggaaaattttgaaatcggaggaaatttctggaagaaaaaaagaaattgagaagaagaataaaaagcttcaaagccgagtcataatgagctgtaaaaggaaattctcttcactcgcgcgtgattaacacactctgataaacgacgtcgttagttgaaataaggattaacagcgtgaaacccacgttgagtgtacgaggcgcgtggctaggtttcggtttttttgataagagcgagtgaatggacgataataatttagtgcgtcagcttccccaactagttgacactgttcaaggtcaaatgttagaatacgggcttttgattaggctttagatgggctttttgaagcctgttaaagctattaccttgctggctaagcatatgcgttttcggcgtgacctggacacaactaatgtggtcggagaaaaggcatatgaagacaagaaaaagttgtccaaattctttctttcgttgatattaatttttcttttggtcaatactcatattctttaatttcttatattgttgattaaagaaaattaattattttcattttccaatactttaaatttaaaagaccggatcaaattaattgaattcgttttttgtgggtttttatttgttgattcattgtaaatttcaataaatgagaattgatgaaaattatgctatattaatttgattagtcaaatgagataattgagatccggcaggacatttgtttggcatgaaaaacaaaataataaagagttggttaatcaaatgcgaccaaatcattagatcgaaaaatctgaagaaatcgattactcatgtttttaatactggaaagttgtttagattatttgggttaacaaaaatctgtatacactcgtagttcttactaatttataacaaaacctaaattctccaaaactaatgtaatgcaaattgattctctgatagacgcaccgtcacgcgcgcataacgttgccgttatgggagaaagaaagggcgtatcttcacttgccacgtcagttttacgctaagcgtaataaaagtcgccgtcaccgttaattgacgtctccatccaacgccgctcttcttctccgctctcaccgtatatatttttttcctatggtggcgcaatttttactaaacttacataaaaaaaaaggaagattaaataaaaaaagagaaagaaatataagagcttcctcaatcgatcttccatttttcttcttcttcattgtgaaatttgagtccaatgactgtcactggtcgaattttccacctgtagtcaatttgaagaaatttaaccagtttgttctactggaaaaatttctggtttcacacttgtgttgactctttcactggaaaaaaagaaacgaaaaaactccgaagagtcttctctgggcagtgtaagtaagctaatgcattaacattttttggcattgagaagtagatcgattcttcaattttgtgagtttccgttcacgatttcgctttctttcatgtgaatttcgtgaaagagagaaaaagtaattctcatctttcttgctacattctctttttgccgttttcactagaatttcgcttttgtagccttcgattcgtttgatttcgtttgatttcgtttcagttgctatgttttagggatttcattatagaactgagatttgattgttgaatgtgaatgaaaattttgataatttttcttctgaaatttaggttaaaaggtaaggagca

SEQ ID NO: 1296 - DNA, 3000 bp, Unknown
  misc_feature (1)..( 3000): cDNA_ID_2133676_gDNA_ID_1620382_Annot_ID_155360 3000 nt of promoter + ATG
cttgtttatttgttgaaaatgtagaagaaactaaaaaaataaacacaatgatcatttcaaaattacggtgcaatgagtatctacagtagtctctgtatttattttacttttcgtatcagtagtctctgtatatattactaattttaatacgataaaaggatggtaccataagatgatgatcatgacaaaggtgcaatgaaaatcgaattttaattgattaaatgataatggcacacgcagatctgtgtggtgcatatgattttttttttttgttattaattcttttggaattttggaccgaccagatagcgtgacattgaaggtaaataattactcactcgtatttataccaagaaaaaaaaaattgattacaaaagttttggtgggtctactttatgaaagaagaaaaaagtgtgtgggagaaaaattgagctttagagggataacttctgaattctctaaaatctacatataattttacttaaaaaggcccaaagttattgtattatttttggaccttaaacagtctactacaatgaaagggccttatcttaattgttcaggcccaaatgattttaagcattgacactcaaaacaatatcttaaaggcaattaaaggaaatctcaaggcactaaatatttgtggaaaaaaagcttaaagtctatttaataaaacaaaatcagatgatgtatattgacattaattacaaaattaaatgaatttctaacccaaaaaaatggttagattcttggcgttatggtactatttactttacttgcgctttatataaactttggataaattcatgaataccgttgtttaataatttgttcgatgtgatattgtaacccgaactaacccaaaactttaactttatacaatttgtttatgtacgaaacactttaatagtatgattcaactcatcttctatacctttttcctaaactttaaaaacttttttttaatgtatgactaacttttttttccttgaaacacactatcaagttatcaacgtacagctaaataattgcttatttgaagcaaaaataatgatataaatactgaaaaagaaaagtagaagaatcatattcacacgccaacaaatcgtataatgctgcttcatctaaaattggtccttcgaaagtcacgtccatttagctctcacgttctacccgaatcaattttaaatccttaatttacagtcataacacatatctctgataacgttattttctggatatgtaagacgcagaatttcatttctattaggttaatttaccaaccggagtaatttataaatttgtgaaaatctcgcctaacacaaagtgaataataataaatcacttgatagatgtttagccaaacgtagatataagagtaatcttattgttatttttgatagtactataggacagatttattgatgagaaaattaaaaagtgaaaaaagtgggtgaaaagaagagagcagaaattaaaaaaaggacgagaagcgagaagagtgcatcttttgatggatattgaaaatcttaagtcaagctgtaatgggaagaaagaacacaacaagtgtcggtgcctctaagcaaattccacataattctaaagaaacaacataattattattttatttttttcgcaatatttttaacagaaattgtttttattccagccatgcgtatatataagctgtcttttcggaaaaaataaaaagctgtctttatctatcccaacggtccaaaaatttaataaaatagtattataaatgcactcgtaatacccaatgttttatttttcctgaggattaaagaggcaaatatactagcctttttgttttattaacagctagctaatgagcaaaatagctgtagatagatagcgccactaatctaatccaaggccattagcttatgttgtgtatgatgtgatacccccaagtctaaattagtgatggtgacgtataattaataatggtaattttgacgacgagtatggaacgtgttccgaatttttctctcaaataatgcgttttgattttgattatcaaaagattccaaaataaatacattgaagaattcgttctctaatcttctaaaccaacataataaacttcggaccactcgacgaccaaattttcagttatgcgtaattactatttaagtcaatcaattctgttatttaatgacattaccaaaaatcttaataatcctaggctatatgtaattatgtacgagtcacacataattaatatagatccgtgatgtatgtctctagacgttatatataaaccataacagcaaaataaattataacaacacatagggaaaagattttatgaccactaccaaatagaggcagtcatagataacaaataacaaatgaggcatcgaactttaaagcttaaagatttaataccgcatttgtatcgtcattaagtgcgataattctgtaattatgtaacgttgtcattcaggagtccggaaattaattaattaattaaactatccgttgtcgtgtcacgagaataaaaggttaaattcgccgtgtttttattaagaggagactaggtggggcccaattgagacagacagcaaatttaatgaacaggtgtccatgtgagacgcattcacacgctctctctctcaagtctctctttccattactactactataaaccgttctgggaacttgatcaacatttttaatcctaaaacttcttttgagtgtgttgaagaagaagaagattaaaattcactaaaaacccgagaaaagtggaagaagaaggaaggaagaagaagacaagagagcattctgattcatgtgactctggtttcgtttctttctgtgtctctgctgtgtcgttttctcggcatatttctgatctttcgttctcggttggtttttggtttctgggtattgattgattgattcaaaagtcttcaactttcctggaaactggatctgggtttatccgtttttactcgtctgagaagagaaaaaagg

SEQ ID NO: 1297 - DNA, 3000 bp, Unknown
  misc_feature (1)..( 3000): cDNA_ID_2133672_gDNA_ID_1620382_Annot_ID_155359 3000 nt of promoter + ATG
cacctagtctcctcttaataaaaacacggcgaatttaaccttttattctcgtgacacgacaacggatagtttaattaattaattaatttccggactcctgaatgacaacgttacataattacagaattatcgcacttaatgacgatacaaatgcggtattaaatctttaagctttaaagttcgatgcctcatttgttatttgttatctatgactgcctctatttggtagtggtcataaaatcttttccctatgtgttgttataatttattttgctgttatggtttatatataacgtctagagacatacatcacggatctatattaattatgtgtgactcgtacataattacatatagcctaggattattaagatttttggtaatgtcattaaataacagaattgattgacttaaatagtaattacgcataactgaaaatttggtcgtcgagtggtccgaagtttattatgttggtttagaagattagagaacgaattcttcaatgtatttattttggaatcttttgataatcaaaatcaaaacgcattatttgagagaaaaattcggaacacgttccatactcgtcgtcaaaattaccattattaattatacgtcaccatcactaatttagacttgggggtatcacatcatacacaacataagctaatggccttggattagattagtggcgctatctatctacagctattttgctcattagctagctgttaataaaacaaaaaggctagtatatttgcctctttaatcctcaggaaaaataaaacattgggtattacgagtgcatttataatactattttattaaatttttggaccgttgggatagataaagacagctttttattttttccgaaaagacagcttatatatacgcatggctggaataaaaacaatttctgttaaaaatattgcgaaaaaaataaaataataattatgttgtttctttagaattatgtggaatttgcttagaggcaccgacacttgttgtgttctttcttcccattacagcttgacttaagattttcaatatccatcaaaagatgcactcttctcgcttctcgtcctttttttaatttctgctctcttcttttcacccacttttttcactttttaattttctcatcaataaatctgtcctatagtactatcaaaaataacaataagattactcttatatctacgtttggctaaacatctatcaagtgatttattattattcactttgtgttaggcgagattttcacaaatttataaattactccggttggtaaattaacctaatagaaatgaaattctgcgtcttacatatccagaaaataacgttatcagagatatgtgttatgactgtaaattaaggatttaaaattgattcgggtagaacgtgagagctaaatggacgtgactttcgaaggaccaattttagatgaagcagcattatacgatttgttggcgtgtgaatatgattcttctacttttctttttcagtatttatatcattatttttgcttcaaataagcaattatttagctgtacgttgataacttgatagtgtgtttcaaggaaaaaaaagttagtcatacattaaaaaaaagtttttaaagtttaggaaaaaggtatagaagatgagttgaatcatactattaaagtgtttcgtacataaacaaattgtataaagttaaagttttgggttagttcgggttacaatatcacatcgaacaaattattaaacaacggtattcatgaatttatccaaagtttatataaagcgcaagtaaagtaaatagtaccataacgccaagaatctaaccatttttttgggttagaaattcatttaattttgtaattaatgtcaatatacatcatctgattttgttttattaaatagactttaagctttttttccacaaatatttagtgccttgagatttcctttaattgcctttaagatattgttttgagtgtcaatgcttaaaatcatttgggcctgaacaattaagataaggccctttcattgtagtagactgtttaaggtccaaaaataatacaataactttgggcctttttaagtaaaattatatgtagattttagagaattcagaagttatccctctaaagctcaatttttctcccacacacttttttcttctttcataaagtagacccaccaaaacttttgtaatcaattttttttttcttggtataaatacgagtgagtaattatttaccttcaatgtcacgctatctggtcggtccaaaattccaaaagaattaataacaaaaaaaaaaaatcatatgcaccacacagatctgcgtgtgccattatcatttaatcaattaaaattcgattttcattgcacctttgtcatgatcatcatcttatggtaccatccttttatcgtattaaaattagtaatatatacagagactactgatacgaaaagtaaaataaatacagagactactgtagatactcattgcaccgtaattttgaaatgatcattgtgtttatttttttagtttcttctacattttcaacaaataaacaagctctatttgataaattcctgactctataatattttgatcggtattactattaaaaaaggaccgaacaatgaactgaaatcgaacacgagaaggcgtcgttaacgcacagcacaaaatattttgtgtcttaaaagacgttttggtgtctctgtcattttattatttttaatttgttttgtttattaaaaaaagaagaagaacaaagcaaaaacgacatcgtatgatactcattgcttcggccttcatttttatatctgagagagagacaaagagacaaaagtaagaaacacattttttttggatttggaggtaataaatttcaaaaacttttgaatgttttcatttggaatctgaggttgtctgctcgagaattttggtgggtttgtgctgaaatctggaataggattagggttttttcgtgaatttgaaaatg

SEQ ID NO: 1298 - DNA, 3000 bp, Unknown
  misc_feature (1)..( 3000): cDNA_ID_2133647_gDNA_ID_1620382_Annot_ID_155350 3000 nt of promoter + ATG
ccaataaagataactcaatttcataaaaagaaaaagacacgaacatgattaaacagttctgaaatcacaagaatcagatctcgagaatacctgattttataaaaattatgaattttctttttgagttcttacattttattcctattaaaagagtgatgaaacatgtgagaacgaataataaagtaattttattagcctattactggatttacacaacatattccacgtagacaacaaaccatgaaaagttacacgtgtcaacatctcattttaactccaccgtaaacaatcgaataacgaaaaatcaatcaaattatcgaaattaacaccgaaactataaaatgtaaaacataatgttttcaagatgtaaacaatgagatcctaagccaacacgacggcgtaaataatcgcggcgacaagtgaaccgacgacgaaagctttgttggttaaagcggcgttaggtggaggagcggaagcatcggaaggtgtcggggctagttcgccggggctaactccgggaccttccggtgcaggtggagaagcggtaggggcatcagacgacggagaaggagctgaagacggaggagaagaggtgggggcaggggagacggcaggtggtggagtggtggtcggagcgggagttgcggcgggtggtggagtggcaacgggaggaggagtgacggtggtggttggagaaggagctggagcttgagcgaggcatgaggtagtgaagagagcaacgatgaagaaagcttcgatgatcttcgaattcattttttccactctctctaaagatttgtttacttaagaaagatagagagtgaagcagagttgtttaggtgaggaatgaccacgatggaactatataaagcgagagagagagataacaataattataaattaagtagtatctaattaaatatcttgcggaggggatcataattattcgattattattagtataaataatgattagtagctaatattcaaatgaaggaataacattttagtagtcaaatagcagaaacgtttaagtgaaaaaaaatagcaaaaatatttgatcagtaacacacacatatcagtgattaacaacttgttttatcgtaaataagagaatacattttcaaaactaaacataattaagtgatagatcattttatcactataatgtagtcgcatatatgtatatatataattttgtaggatttttaggttaactcaatttttagctcttagttgtaaatttgtcattttttaatgatttggtaagtatagtagatgagaaatcgaagttgagaaccaattctatccgttgagtataaaatcatcaatggttttagaagaccggattggtttagctaaatcgaatcatgattgtcaataataattggagagagaaaacgtataatgaagtagtattgaatattgtatcatgtttgtcttactgtctaatcgatccacccaccgataataatagtatactttttctgatatagtaaatagtaacgatctctttgcccgtatacgatgaaccttaatgacaaaaatacagatctatcaagaaagaacgatgtcgttattatcgtatatcccatgtgcgtagcagacctatcgggataatttttgattactggttatggttttattgttgtcgttaccgttggatatttgctgtttttcgttttatttattttcttttgtccattactatctcttgtgtttgttgctagtagtaacaagagttggagatagctgtcagagaattttatatagttgaataataaatacaaatattataaccccaaataaaacgggtacatatacattacaacataacataacaacggaagaagacatttgatagcctgtaaaggtcattttacagtgaatccagaaggttcgtattaatcattaaattaaaatataatcggtatttgacaaaatgaactgaattatagttggcaattttatgaggcccatatgatgcgaaaccaaccgacgattatacactatacctacaatttttattgcactgactcgattgattaatccctaactaaaagttcaaaatatttgcatccaactttattttcattagtgtgaacatcaatataaagaattgagaagatcattacaggttgtttcagatgataacgacaagttcgttatatatgcactataacttgctttgttacatatgctataaagttcatttgcaatatatacgatttgattacatcagtgtgggattcctagaggatgaattaagtgttaaaaatgaatctatacatagtagtttgctttgaatccatatgaaaaaactgttgaggtttaatgtcgaaatttctttatctttggcttcggctgcagtcaaaattgccgaaagaccacctcgactccaaaccattttcttgataattgtaaaaaaaaaaaaaaaaaaaaacatgatgtcccatatgcgtgtctaataatatatatagccaagaagcatatatttatttaggggaagagaatgctaaagcatgagttttgtgctggctttatgttgttgtaactcttagagcaacatgtattcacttctaactgaactttacataatttaaagcatgatttggattatctaaaaaaaagttagattatgatgaatatacaagttttttttgttagtggaaaactctcatttcttcgagtaagcttctccatacataattttcattgtctatatatatattgatctatttgtaattgtaactcttgaaagtttggaaaatatttgtaataagagataaacaatgatatgggccgatatttgcgaaactgatttcaaaggattcttctttatgggcctatagagttttgggcctttctaccaaaactttcgcgacaagcgatatgttagggcacaaggacaattcgaaacctgagaagagagctagagcttgtcagatgttaggatactcctatccttgtttccaaacgggattacggttaacgacggcg

SEQ ID NO: 1299 - DNA, 3000 bp, Unknown
  misc_feature (1)..( 3000): cDNA_ID_2045820_gDNA_ID_1620383_Annot_ID_155371 3000 nt of
cccgtttttatggttttttttttaaggaataattttttatctaaataataaactaataaactacatataataaactaatagacaaacaaaaacttatgtcggattcttggtgcttaaaagaaaaatataattttggtgtgtgtgtttttttctttacagattagttttgatgtttttttgtaaatcatttgtattgtctctattttagtaattttacatcttcctattcaaccatcatttttttacagcaatctgtcatgggcttgttttcaaaagatcgtgcatcggtcgacaatctcaatattatccgaccaacttttctaccatcgaccatctccaactagttttgtcctgctttgagcttattaggtgattgactttaaatcacgaccagtttgtgcaggaatggcctaatctcctcatctgtgtttgatcctcaattagtaataaagactcaaactctacccaaattgttctgtctaactccaaaataattcctccaacctgagtcatccatgcccttcactaaagcacattcacctgctccagtgaaatggcccagcggaagccacgcaactgtcatgatacatcccaacaaaagggtcgtgacaaaccgcaaccatttctatagaattttgcatcccttaaaactagtcaatgcatgtatggcatcagttacatatataacaaaattttacaaacaaaaatagcaagattcacctcaaaaattaaagggattgaagtattttgacgttgtataatcttgtagctaatctcgttattggttcgatgacataaaaatttgctattaaagttcgacgacttatattggattttggagttgtaggattagccgtggcccgtggtagcatctacagttgttgtgtattaattttgatttctgactaaaccatactttatcacaattccagcatccacttgcgtatgacagatgttttgttcacttaaagattttgaaaattccaaaggcgagtttatagtcattaagaatcaaagaaacgtccgagggcattaattggtggagggcctataaagatgagacgaggggaccaaattgtagaaatagtaacgggtggacctaataataaatggtagtgataccaaattaccaatcgttaaatagatttcttccctaggtagagcacaaatgggttggtaaagtcaatgatgcacggaatcgtccacgagatttacatacgtctattttaatagcatctctaatgtgcacttttatttttttctattttaaagatattttttttaatgtataactgtaaaatagaattttctttaaaataaataactcttagtttttactttttactttatatataaagtaatttccattttttttattttagaggaaactctatttttaaaaaatacattgcagcaacattaattatatttcttctaaaatagagttgtttctaaaatatagaaaaaagaaaagtatgcattggagatgcttttatatatattggctattttgagggtttttcacaaaacctaaagaagagaaatgtagtacaattttcaataatatatcatgtatatttatgaatataataatgaaatactttttctcttctacaaagattaatgatgtgggtttttttcttattccacagagattgattttttgaatcaatattattattatttttattcatgactaatagagaagaaagaagtagaattgatattattaaacaaacaaaatattaattaaaaaatgtaaaatttctcctttttttaatttgtatgaaaaacctacaacatcaaatattgtgaaaccaaattagtatatcatactattagatgattttaatattatatataatataattactaattatattgaagaaatccaaatttgttaatatcttaatcaaaaagttaaaaccatatctagtatatacaaagaagagagaaatagtgtcatttagtgatcataatatgaatggaaaaaaataaaaataaaaaaaatacagcatctatagactaaaatctatgtgtatgaataaaatatataaccatcgaattgttcatagtttggttaggtgaacacaaccattacacacaatttaaaatatattcaactagctaggttaggtgaaccacccagtttaatttgtacactatattcgatagagcgttgtcgtatatactttttttctttatagatgtgcggtcgtatttgcatagttaatgctggtcaaaaatgataattatgtatcgttgtgctgctatatgaggtaatgctttaacaattactaatcacaaatgtaatatttaaaacgttattcttaacttttcttacagtttttgtgtactattctgtatacccgagtgaaccaattattttattcaaaattaaatatgttattttacttagactgaatttataaagaaagtttaagaatttttaaccacgtatttggttaatggtttaagtaggttgcatccatgtgttctctagtttaatttttcggtaaaaacaatgttttacgccatgtcataaagtattaacaaagattggtctcggtctctcggatcgtagaaggagattaacaaaaatttgagaattatttatcctatcccgagttgttttctattatgagtaatgaaattgtcttctgtctcactattcatccgttttcggaaaagaaaaaaaaaaatagccactaaaagattagaactataataatactgtattgtttactaaaaacttgagtgttaaaagatttgtaattagcatactaccatccataatagttacttgtaataccatgaactattactttgttatcaatatttcatttaaaatcttttttgttcttttgatacagaaaaaattagttattgaatttgaaagttccattgacttatcctttgagatagtcctaaagtcgatggcagaacagaggctaatttcgagtctttcagttttgagagcactaaagccagatagaaatg

SEQ ID NO: 1300 - DNA, 3000 bp, Unknown
  misc_feature (1)..( 3000): cDNA_ID_2990891_gDNA_ID_1620383_Annot_ID_155379 3000 nt of promoter + ATG
atcgaagatggtaacaccgttcagattacaaatagtttttggtggttcatatttagttgtaaatctcttattaacatgaagcattgcctctctttttttttttggtaaaagatgaacttgtgtttgagattttatgtaaataaagtatccaagtatattcatataaatcaccaacttttgattcaaagcataatgtgtgtgtatacagtttttattgtttcacatgtctaaaagcatgcctttccatagtttaatcataaagttttataagccagcaataagaatacttttggatcttgtgattcgtgtatcatatgattaccaaactcaagatgccaaaaaaggttggtaaacaagtattttattgatccaataatttgttatactaatacacatacgatttagttcaataattcctaaagaaaagtttttttgtttgtttttcatttggattgttaaagtattcaattctttatgtcgtacaacaagtaaatagaaagaaaaaaatagagtgcgagtttcactttcaataaatgcttgtgtgattatctttatttgtgtacatactagatctacatccaccgacaaaccagtgtcgaggaagcatatgcaactgtcctgcagatttaaagtctcatgtaattaaatgttgttcaatttgtttgttgtgtgattaccagtttgatgtatagttaaagttaccaagtaataaaatcatcaaacatacatatagtactaattttttgtttatcacataaacattttgttgactttttggtgttgtttgcaatagcatcttcttgataaattcctagtgaactcaaaattgacctacaccagttccatacaaatagaaagatactccaaaactagttgtggaagtggttgaatataattttatattccaaacttagaaaattcatgttaaattccgcaaaagagcttataacgtagtttatgcacgatatggttaaacttcctcagttgctatagagttaaaaaaaaacaaatattttgaaattggtaactagtacgtgaaattttttaatgcagactgaaagaacaaaataaaacttaaaatatgtttacaaaaaaatattctttcatgatttacgcaaaccaaaagttacatttaaggttaggaaagaaaaaatgacctaggaaattaaaacaatgaggttcgttgataaaggtcaagaatcaaagtttggtagccaaattaccagcaaacaaaaaaagattaagaccattaatccatcgcgtatactcattgtcttatgaatcttaaacaataatattatattatatacagtaggtccataatttatgtttctttacctactctatttaccaaaaacatacatagtttttatctgacttacacaagtgtactaatggccagacaagattgttacttgttcaagtaaaattgtgttaccagatattcaactttctatatatacatatagatttgacaactattcgactttctatatttaactgaaagagttgtatcactgaaatttggagtattgttccctgtaaataattcgatttgtttccaaaacgctatggaacaggccttgattttgatactctttcgtgctgacacttgaaacggcgtcgtatcaataatagaagaaaaccttactgtggaaataatcaaattgtgaatctccaccaacctcaatgggtcccattgccacccactaatctccccacgtacaccaactccccttcacgttttaatctcttaatatacttttattataagttaattaaatgatttcaaccttagtaatactaaccattaattattcatttctaatctccaatattttttttgaaaaacctttctgttcagatattttcgtcaattaatcaagatctcattcataaattaaaaaaaaaaacaaaattcaagctaaaaatacatacccaacaaaaattccttaaaaaaattacttatggggcatctggtaatttaattttcctataaaagatggcaatattaattcagtttttttttttaatttaccaatatgatactttaattatatttcttacttgttagctctactaatgcacacatacttatttctacgaatataagaaaaaaatactgaactcaaacaatagacaaaaaagaaataatcctacactcaagtgtgttgaaaaataacatcaaattcagagaaaatgcacatacaccaataatataaataaatagggatatttaaaataataaataaaattgcgaaaatatcgagcaccaccagatctacagaaatgacacagagcccaacgatgatgtatctcgtttattttcgctataaataaactcacacagcccactcttcttcctcgctctctctttcgccttctcttagcctaccctttttccttcctcctctccgattcttcctccgtcaggttcgtctccgactttctatgtcttccttacgtctctcttatttagctccctttccttccttctccacgttattattactacttcgcttttagtgtgattcgtttcattctcgtttttttatattcctcgatctgtttgctcatttgttgagatctattcgctatgtgagttcatttgactcagatctggatatttcgtgttgttcgatttatagatctggtttctggatctgtttacgatctatcgtcatctttcctttgaaaatgattggtgtttctgtgttcgtattcgtttagatctaaagtttttgatcgatgaatgtcgcatgtgtttttatctgaaagttttcgattacagtatcaagtggtggtagtagtagtagtagactcaaaaagctgcacaaactttttatacacgtgaattgtgattgctttacggttttcttggagtttgttaattaaatcatttaatattaagaagtttatgaattaagagaacgttattttatactatgattttgattttgatttggtttgtgtgttttaatgcagtaaaagaaaatcaaa

SEQ ID NO: 1301 - DNA, 3000 bp, Unknown
  misc_feature (1)..( 3000): cDNA_ID_3061611_gDNA_ID_1620383_Annot_ID_155373 3000 nt of promoter + ATG
caaactatgaacaattcgatggttatatattttattcatacacatagattttagtctatagatgctgtattttttttatttttatttttttccattcatattatgatcactaaatgacactatttctctcttctttgtatatactagatatggttttaactttttgattaagatattaacaaatttggatttcttcaatataattagtaattatattatatataatattaaaatcatctaatagtatgatatactaatttggtttcacaatatttgatgttgtaggtttttcatacaaattaaaaaaaggagaaattttacattttttaattaatattttgtttgtttaataatatcaattctacttctttcttctctattagtcatgaataaaaataataataatattgattcaaaaaatcaatctctgtggaataagaaaaaaacccacatcattaatctttgtagaagagaaaaagtatttcattattatattcataaatatacatgatatattattgaaaattgtactacatttctcttctttaggttttgtgaaaaaccctcaaaatagccaatatatataaaagcatctccaatgcatacttttcttttttctatattttagaaacaactctattttagaagaaatataattaatgttgctgcaatgtattttttaaaaatagagtttcctctaaaataaaaaaaatggaaattactttatatataaagtaaaaagtaaaaactaagagttatttattttaaagaaaattctattttacagttatacattaaaaaaaatatctttaaaatagaaaaaaataaaagtgcacattagagatgctattaaaatagacgtatgtaaatctcgtggacgattccgtgcatcattgactttaccaacccatttgtgctctacctagggaagaaatctatttaacgattggtaatttggtatcactaccatttattattaggtccacccgttactatttctacaatttggtcccctcgtctcatctttataggccctccaccaattaatgccctcggacgtttctttgattcttaatgactataaactcgcctttggaattttcaaaatctttaagtgaacaaaacatctgtcatacgcaagtggatgctggaattgtgataaagtatggtttagtcagaaatcaaaattaatacacaacaactgtagatgctaccacgggccacggctaatcctacaactccaaaatccaatataagtcgtcgaactttaatagcaaatttttatgtcatcgaaccaataacgagattagctacaagattatacaacgtcaaaatacttcaatccctttaatttttgaggtgaatcttgctatttttgtttgtaaaattttgttatatatgtaactgatgccatacatgcattgactagttttaagggatgcaaaattctatagaaatggttgcggtttgtcacgacccttttgttgggatgtatcatgacagttgcgtggcttccgctgggccatttcactggagcaggtgaatgtgctttagtgaagggcatggatgactcaggttggaggaattattttggagttagacagaacaatttgggtagagtttgagtctttattactaattgaggatcaaacacagatgaggagattaggccattcctgcacaaactggtcgtgatttaaagtcaatcacctaataagctcaaagcaggacaaaactagttggagatggtcgatggtagaaaagttggtcggataatattgagattgtcgaccgatgcacgatcttttgaaaacaagcccatgacagattgctgtaaaaaaatgatggttgaataggaagatgtaaaattactaaaatagagacaatacaaatgatttacaaaaaaacatcaaaactaatctgtaaagaaaaaaacacacacaccaaaattatatttttcttttaagcaccaagaatccgacataagtttttgtttgtctattagtttattatatgtagtttattagtttattatttagataaaaaattattccttaaaaaaaaaaccataaaaacgggattgttaccgtataacgaaattacaaaatctagatgtggttccaagttctaaccattaggttcaacatcccaaagatcagttgatagactggtgattccactagaaaagttgacaaaaggggcaattggtagaaacaatagagactttaactcggtttttttcaaatgttcaaagtttgatttaattattcaaccacttttttttaaaaaaaaatctaataatgaaaaccttctgtttttttttttaaagtcaatccccaatattatctatgttaatatttttgaaatacatatttgttgttttaattgagtcgttttctaatttttgcacctaaacattcaatcgaatcttttcttaaagttcgataatatatgaaaacaaattaaacttcaatattaatatataagacgatataccgcagaaaaaatattaaaactaacaatcaaaaaattatataatttaaacacaaaataaaacaatacaacgtaaaatttaaaaaatttagtaacccaaactcgaatcttttagtagtattaaaagaattacacatatttttctcaccaaaattatcttttaattttttaattatattctacttattaccaactataattatttccaagtagtcgttagtaagttacttacttattagttattacatgttttgattattctaattttaattgtcaaacacattagaatatttttaaactctagaaatattattttaaacactttagttttgaattttaccattgcatttgaacaacttgtttcaatattattaaataagaaatctcaaatattaatatacgaaaaggagagaaaataaaatagtattggcatattctgggaaaccttcaatttctttttgtgtgttaagaatagatagatgagagtgatgatttggagaaagagag

SEQ ID NO: 1302 - DNA, 3000 bp, Unknown
  misc_feature (1)..( 3000): cDNA_ID_3061607_gDNA_ID_1620383_Annot_ID_155378 3000 nt of promoter + ATG
gtccgaggattccgatttcgatgaacaagctgatagcaaaaaacttcaccatgatgtggctgagatagtactaggaagtggtgaaacacaccatgagcaatcggacatgatggaaggagaaacttctgataagggaaaacttgatgaagtcagtgatagtgattcatctttatcagagaaagaagaaaagatacgtgatatcagtgaagatgaagcaatgttaatttcagaacaagtagttgatcttcatgaagaattaggggcgtcttcactgccttcttttggagaattagaaatcaatatggctagaggggtggaggatgattatcaccatgatgaagctcgtgctgaagaatctttcattactgcgcatccgtcacttgacgagtcagccatacatgttctttgtggtttgggggacggtgatcacgaggaacctgtttacgattcgagtcctccctcaggcagtagattcccatcattttcttccgtatcgtctgattacaaaccagatctacctgaaaagaatggggaagaaatagaagaaaatgaagagaaagaacgtgaagtttattctgaaagtataggtcctgaggaaattcattctacttctaatgagactgaaacaaggacaagcgaagtaggagagaatagcatgcatgttacaggagaggcaagccttgtcatgagggagcattcgacaccactggaagaatcacctgatgtggtgcatgacatagctgaaacttcagtaaacaagtcagtagttgaagagataatgtacgaggaagaggaagctcaaaaacaaaaagatgaagtcagtcctcaaacattcaatgctgacatcccaatagatagttatgccagtttgtcttctggagcagttgagtatgttgagacgcattcatttaatgacgaagatgttgcacagttggaacaagaaccagttcactcattagttcatgatgctgaggaagaaactcacaacgaccaaacaatggatattgaagtagactctgtaaatgctagtgcccaaaatgtgggatctgaagaaacaagtccatctgaatcagatagagaactgacatggtcagataaatctgtggtagaacaatcatctcttgaacctggtgacgatcaagtaagtcatgaaacttatcttctctaatagatgcacaatatcacagttactttaacatactatcttatgctgctctcatctacgtttgagatagtctatgtgatatactcaacatcacaatctacaaactattggaaggaatatacggaatcaatttctttattgatacatgtgctacaacatatcttctatatatgtcacgtttctaatctgataatggtacatcatctaaatttgtggtttcttaaatagaactggaaatagtaacaggtcgatacctatgtttggacttctttattctttatacaatttgttaagcgggagatctgtttcttatcgctatgttgcgttattgcaggtaccaactcgtgcaggtcctgtgagtgtcgtcttttcccgcaacatcacttttcacgagtatcacgatgctcctgaagatacaaccgagttatcttgtttgacgtctgatacatcctcttctccaacagaatctcccgagtacacgacacctatggttggtgaaggctcaagggcagagtttttccaagaggatatttatgaggagctagaccatgtggtggagcgattagagcagcttacagacttgcatgcaatatctcaaagtcctcctgaaattatcaccgaagaggcagacgagataaaagagattgatgaaggattgttgtctgaacttgactcgattggagacttcaatgttaaggaagttgtgacagatactgaacctgggccatcttcgatagaaaatgctatgaaccaggctgttgtagagagcatggaaaagcaaccaaagtcaccacaatcagatagtaggtctggagaaatcatgtgtgcagttgaaaccaaaccatcggagtcttcagttgacgaaagttctattgatgaaacaaacgttataacaacatccgatgttttacctgtcgtagctcgatcactggaagaatttccgcaaccttctgaaccaaaagaggggatttcaatggagataatctctgaaagcgtgatgattcccacagaagctactggtcctggtaatgtaacagtaattgatgaagttgtgaccgaggaaacgaaagctgagaccaccgagaaagaagaagaaggagaagaagaggaggaaagtaaaccaaaagagataacaaaatctgatgttttacttgtcgaaactcgagcactggaagaatttcccaaaccttctgaactaaaaaaagggatggcaatggaagtaatctctgaaggagtggtaatccccacaaaagctgctggtcctagtaatgtaacactaagtgatgaggttgtgactgagaaagcaaaagctgagaccactgcaagcaacactgatgcaaatgtccagagtcctgagtccaaagaaactccagagaattcggtggaaactattgcagagcaaaaaggaaagtaggagaagaagacgaagtccaacccttcaagctcgagttcaagctcaagctctagttcgagtgactcagattgaaaattaaagggtaatacatcatctcaaactcaagtaaatatatctttgttaaagggtaatgataggcacttctgggttttgttttttttcatctgtgtcctctgttttaaaaggggcaagaagtagccgctaatcatatttttataccaagttttctccttcctttgtattggttttcttgtgtgtttgtgtttccttttctcttctttcttcagctttcatatttatcgatttgattgatttgtatctcttgaaaccagagaggttttctcagggttttggattgtgtctttaaatacttttctcgcatcttttttggggggtttgttatttgtattggacctgagaa

SEQ ID NO: 1303 - DNA, 3000 bp, Unknown
  misc_feature (1)..( 3000): cDNA_ID_2045798_gDNA_ID_1620383_Annot_ID_155377 3000 nt of promoter + ATG
tcgagtctcttgttttaggttttatccgattctgatttgtatacctgtcaacttcatttgttaatctgtgtgctgatttagcttcctaactctgttgatcgatttggggaattagctctttttcttttcgtggtgaatactaatgatgcaaagctttgaatctgatccatgtatttttttatatgctgcagaaacagatagctaatataattgagtttggatactcgcaagtgaaaatatgtcggtcacagcgggagtgagtgaatctgcaattgctgtaagggagaaactaaaaggtggtattggacagactaaagtgcgaaggtattggccaggaaaagctccggagtgggctgaggaagctgaagaagatgatgatgttaggatgcagaaggtttctgttttggatagagcttttccaaagaatgatgatttgggtgttgctaggaaggatgatccaaggctgcgccgtttagctaagactaaagttgaaaaccgtgacgaagttagagctgatcatcggcggataagacaggctgagattatttatacggaagaagaagaatcgaggaatcaagagaatagagacgaggacgatgatgaagatgccttggaagagagaagaagaagaattagagagaaaaatcttagaagagcgcaagaggaggctgctttacttcctttagaagaagaagatgagatacaagaggaagaagaggaggaggaggagtctgagtacgagactgattcggaagatgatatgcctggtattgccatgattaagcctgtttttgtaccgaaagctgagagagatacaattgcagagcgagagaggcttgaggctgaagaagaagctcttgaagaattagcaaagagaaaattggagcaaagaaaattagagacaaagcaaatagtggttgaggaagttaggaaagatgaagagatacggaagaacattctattggaggaagcaaatattggagatgtggaaactgatgatgaactcaatgaagctgaggagtatgaagtttggaagacaagagagattggtaggatcaagagagaaagagatgcaagggaagctatgctgagagagagggaagaaatagagaagttgaggaatatgacagagcaggagaggagagattgggagaggaagaatccgaaacctttgtcagctcaaccgaaaaagaaatggaactttatgcagaaatattaccacaagggtgccttcttccaggcagatcctgatgatgaggcaggttctgctggaaccgatggtatatttcagcgcgacttctctgctccaactggagaagataggttggacaaatcgattctccccaaagttatgcaagtcaagcactttggtcgtagtggaagaactaaatggactcaccttgtcaatgaggacacaacagattggagtaacccgtaagttttctgatttcagcgtttcttttcttgcgttttgttaggcacagactcgtttaggtctctgaaatatgattaatagcttatgagtagaaacattaagatgagaactgaaataaatcagtgcatgcaaatgtgaacccgggtagtgttgggagattcttgcatctgtttttctcgtttcatgagagctgcagattttgatatttttacttaacataaaatgaatgattgtgcaggtggacttccaatgatcctctacgtgaaaaatacaacaagaaaatggcaggcatggatgctcctatcgcaaaaccaaaagggagcaagaagatgaaagattgggagtcttaaaccgcaccaacatttagtttgctttttaaaaaaaatccaaaacgatacagaagtgttatgtggtagtaaaaaacatcgtaacatcttactcagttatgtcttgagtcctctaaatcgtagtaattaaaaatattgctttgtggaagacatctagtcttttgtatcgggatcaattatgcatcaatcaaagctgtctgcttgtattacgaaagcatagttagttacatatttccatggcaggaggtggttgatgggattttttttggcagaactgatttgagtttcaatagacaattctatggctagaatcgcttattatataacattctgaatacagtgatgcttgccaatctagattagtatttgtaagaatggaatctatattttataagactgcaaaagactgttaaactaacactatcttttacacttcgatatcattattaactggaatttaaatttaaattctggagaagtttgcaccaaaaaaaaaaaaaaaaatctggtgaagctaatttggttagataacaaatttcagaaaatacaaacaaaagtaaaagtggcaataatatgcaaaattagaatgaatttaaataattctgccgaaagtaaaatggtacaacagatacgaaagctgtaaagaagccgacaacaacatacacattagcccactctgcttcttcttcttcttcgctcgccatctttttttttgattagtcaaccattttcttctctctccaatttcaacctctgtaaggtacgtctccgactttccatggcttccccacgtctcgtcgtcccctctcttaattttgcgtttcatttcgttttggttgatcttttttttgaatttgattttatatctccgtgatctgattgctcctacctggttagtgacttcacaaaacatagatttttgtttattgttttggtttcattcgatttctggatttgatccttgatctgatttcaaaattattcactttctggcctcgttgagccttagatccaattctttctattatatcggagacaacatttaatccttgatatcttaatattgtgttgcgatcttaagtttttgattttgaattgaattagactcatcttgttgtttttctcaaatcttaaatacgataaaaactaacttcatcatttgattctgatttttcgtaattcttaatacagagacgacctggaaaaatataaaaagag

SEQ ID NO: 1304 - DNA, 3000 bp, Unknown
  misc_feature (1)..( 3000): cDNA_ID_2133483_gDNA_ID_1620384_Annot_ID_155396 3000 nt of promoter + ATG
tcttatagaacattatatttagtaaagaataagatttcattactcaatgcactttattggccgtaacaattttagccaaaaatttgtgtatatggaaaaaaatcatatgataatattaatggatagtccatttatatccttgtaacatttcaagttcgttgactgtgagtcctcgacttgcttttaaatagattaactaaatgccacaataacataaaaaccattatcttagagaaaagtttaaaagaaaacgtgaaagtatggagaggataccttcacttgcatcccttgttagcttgcttatcatatttgccacaggtattataattttttgtacacctttcaattttcatgttaaatatatttttttaaaaggttattttcttctattatgtgaacaaaaactaaacaaaaaatctcaaagtctaaccttagtttttataatttagacgtccacatagaagattaatgttatgagaattaagaaatacatattacagatatatatattttttttcttaagtcttcttgtagctattttcttgaattccttgtacttaatttctatagagtgaatatattcttatatatctgttaagtttaataaagtatatatacaatgctgtagttgttaatcagacaagagcaagtatctgtaacgacagactaggcctttgcgatggttgcgatcaaagatgtaaggccaaacacgggccatcgtgcgaaagtaaatgtgacgggccggttggaatgttgctgtgcacgtgcacttacgagtgtggtccaacaaagctttgcaatggtgggcttggcaattgcggtgaaagttgtaatgaacaatgttgtgataggaattgtgcacaaagatacaatggtggacatggatattgtaacacccttgatgattttagtttgtgcttatgcaagtacccttgctaaaacaagttgacagaatttggaaaccaattagctttctttgtaactgtaactgcgataatatggtaataaatttccttttgataaaaacattacgtttatttgcatgtaaggtaagtgagataagatagagacattcatgacttgataatatttttaattttttttacaatctatattcttgatttatgcagttggtgaataattcttcggtgaaccgtgcctacggttttagaggcctacgacaatatttaagaatgtgaaattttagattatcaaacaaagagtaaaatgtacataaacttaaaatctgaaaaacaaatctttaaaaagcattaaaaatagaaaagcttctaataaatgagttaagtatcagtattggtatgaataaaacctttggaatattgatcacaagaaaaaataattgagtagttagaaagataatttctatcaaatgtggcttatgaatgaattatatttagtgtagcctaaggcatttgccttttttctataaggggaggctcggctatgcgcgggcggtgattaaggcgtcgggaatttagaactccggagggaagccccaataaaagtagctgaaatcttggactgtcattgtcatgagaattttccggaattgttagaaaattaaggaggggatgaacaaaaaatggaatagtataagagaatttaattcatgtaatatcaaatgttcggtaagtttggtatatgtatttgattttcagagtttatgtaaattttatagaaattattttcggagtaatgtcgattcattttccaatgatcttatcacttgtctcttcatacaagccaagatgagtcgacaacttggttttatccttctttcttttctagttttcttctatgtaaacgaaaacaaatttcacatgtaacgattttttctaatattaagaaataaatacgtttagaacgtctaaaatatttatacaccaaacattaaagatcaaaactattaaagaaaaactgttagaaacaacacaattccaaaagatttagatcaacatctttattctcatttttatcagcttcatcatgcctccaaatctgattagtccagaaacaggttatcaaaattaagttttctaagattagttctcaaaaaattatggttttttgtgtttacaaaaatttgtgttttatggacaatagatttcggaaattcgcaaacctagattttcacaatttatctatattattatcatagctaaaaagaagctccatgaatgtgtttacgcaaaatcaaaataatatcttataagagctatacacctcattatgaattttcaattttgtttaaccttactgtgtctgtacttattgagagtctttcttaaactataagtttaagagcatcaaagtttaaaccagaatatttctatcaacgtattgggagaaggagacattcgactaaagaatgatctaaaacaaaacaattttttttttcttccgctgcaaaatagaaaatgttttagctaaaaatacacaatttaaaatttgaatataaattttacattctttcaaaaaaaatatatccactttcaaaagttcaatcaatacagaaatcattataaaatattaaatttatacattatttgcataaaaaaacttgtaaatacttaattgttatgcaacaaaaaatttgttcaaggagtagtaacacacacctaatcaataatagaatttagagatttgtctactttatgtaacaaagataggttttattacacctaatgatatttagcatttgtccttatttggacaagttgtaattttttaactgactttcttatttattgttgtttgacttttatgtgtcggtcattctttatcagtttttccaaaaacaatatgattaaaaattacaagtagatcgagagactgttgcagattgctcttaaatgacttatctcgataaaatcattttttcagatacaacaaacaaagagaaaaagccctttcaatttctttttacagattgctttctaaatagctttgagaaattgatcttctctttatcatactcaa

SEQ ID NO: 1305 - DNA, 3000 bp, Unknown
  misc_feature (1)..( 3000): cDNA_ID_1034141_gDNA_ID_1620385_Annot_ID_155404 3000 nt of promoter + ATG
caatcccatctccgtgcatagcaccaagcatcgccgcaagacggatattactaacaccacgcaaaacaatatcaagcgccatataaacctcagcatacttccgtccaagcttctccggagtaacttcaactccacgacaagcagtaacaataacactaacagcttgattcacaatatgaatacactcaaatacattgatcgaattatcatgatccgcgacagtaacaccaaggatatagatcgagttcactaatctataaactacacgatacttgctctcaacaccaacaataacctgtccattagaagcagcgagtggatcatcacctacaaactccgccgccgtggcatcgtcaggatccgcaacggaggaagaagaagaagaagaagaagaagcttgattctgtttctgattcgattgttgctgatgctgctgcttcgaggacgctaatgcttgacgcatttgacgaaaatacgagagagcgattaaggctcttgctggtggaaaccattctctagtttggagcaaaatgtcggatccatttgctggttgcagagctagggctaaacacgacatgatcccgattcgaaattgatctcgaagcttctactaatggtgactattcaatctcaatggttagattgaaacatctgatgaagaaatcgatcagatctgagaactgagaagaatcgtcggagaagaaaaggagaaagagaaatgagatcttcgttgtttctttcgaaaacgacgtcgtttgtttcattactcgtatcctacctgcatggacctaatgcgatggtttgaaaataagcccaatagtagacgtttattcttaacttattgggcctaatgtcaaggtaagaagcccaataatatgataaaacgatgtcgtttaacgcgattaggtctttttaaattttgtagcgcttataacttttgcgatttttttttaattggtagcttttggcggtgaaatgcaaaatgggaaaattaagccggagaatctcctccgacgatcgccgacgaatcgtaaactaaccacaggctgtgaaatcctcgacggatgtcttcgcggcggaatttcctgcgattctttaaccgaaatcgttgcggagagtggctgcggaaagacacagctctgccttcagctttcgctctgtacccaacttccgatttcacacggcggactcaacggttcttctctttatctccattcagagttcccatttccgtttcgtcgtctccatcagctctcgcacacgtttcatcaatcaaaccctagtatttacgcgaattacaatgataatccttgtgatcatgtgtttgtacaaaatgtccattctgtagaccacctgttcgacataatgcctaggatagatgggtttgttgggaattcgaaaactaggtttccgttgaagttgattgtgcttgattctgtagcggcattgtttagatcggagtttgataatactccgtctgatcttaagaagagatcttctttgtttttcaagatatctgggaaattgaagcagttggctagcaagtttgatttggctattgtgattacgaatcaggttacggatttggttgaaacttctgatgggttaagtgggctgaggattgggaatttgaggtatttgtattcgtctggaagacgagttgttccttctttaggcttggcttgggctaattgtgtgaattccagattttttatttcacgaagtgatggtagtattgttaaagatagaagtgaaaaggacgagaattgttcaagttctgtgtccagaagtgctaagagacggcttgacatagtgttttcaccttatttgcctgggagttcttgcgagttcatgatcacacgagaggggatttgtgcggttcaagcgtaggtgaactcgggtgctatgtaggatagtttttgttcgaagcatcaccggattttttggagtatttgttcattagccattatttatgtacattgcagaaggatccggagatgggttgcagcaaagccaggtttattttttcggattcctcctcttggttagatgtgatatgtgcttgtttttagtttataagcattctatgttcaattattcataataaagctttttaaaagattcctgttagctcctaagtctactgcaagcttctcactttgttctctgattctcttttctttgcatcattgaatttgcacgaagtcgaaaatttcccacttggttgctatcttcaaatcgtttcatttgttgagtaaattgctgatgtgatctttatatctggccgtaatatctttatgaataggtagtgttgatcatcctggtggatatggtttttgtatttattttcacttgaactctgtagctaatttctcgattctaaccagaaaatgactgaaaccacaaaatatgatgatgcatgccttcataagtgccataagtaattaatctagttaacatacttcattgtcctattggtaagcaaatggagttaaaacagattacttgtagctaaaagatctttaacacttcgattgttttctatttttccgtggttattcagtggcagaggaatcaactgcagttcgagaggatcaattcagcctctgatgtatacaagaatgagagattccgcctaaggctgttgctaaaaacaaccattgaatcatctgaaggacacgacggagctctacaagaggaaaaattttttggccgttgttggtctttggattaacaaaagctctgtatacgaatcttcacttttattttgtatagaagaagactaaacatatttagttccaatgtataagtttcaacatctcttattagcactcttcactatgagcaaaacttctactctctatgtgaaccggcccatttacaagatacggcccatgaaccttttgttatacgtcatagtgacatcactctccagcgtaaaaactaacttccgactgaaactggattcggttcgtcgttatcggtatcgaatcaacaatg

SEQ ID NO: 1306 - DNA, 3000 bp, Unknown
  misc_feature (1)..( 3000): cDNA_ID_2133826_gDNA_ID_1620385_Annot_ID_155421 3000 nt of promoter + ATG
acatttgttttccactttgctgcttactaatatgcaatgcaagttcctagctgatcatcatttttcatatgcaagagtatcttcatctatctaattttgtcatttgcggtaaaggttctaatgcgaaaatttgatgtgtgttatatcttaggtcatagctcttcgggggtcttaccatggagatactttaggagcaatggaagcacaagcaccatcaccttatacaggctttctccagcagccgtggtagggaaccttttcatttgtttgccatttctggagaattttgtttccaacattcatcttctgatttaaccattcttggatcatttgcatctcctgcactaattcatcatttgcatagcaacaaacccttagtgttgcttagatgggttgtcatcccttagggataaatcagccctttttcacatcttcccaaattgtcttgagcaagcattctttatcatgttattcagcttgtcctttagttaggctcaaatctatttttggattgtaggtatactggaagaggcttgtttctggatcctcctactgtctttctctccaatggatcctggaatatctccctccctgaaagtttttctgaaatagccccagaatatggaagtaaatagcatcctttcccatctctctgatatcctccggtacatttcctttagttgcatgatttagtattcccaaactcttacagccttcaccagccgtgatgagatttttgacaagagtagagacgcatcaactcttgcaagaatatattcggcctatttatcgaagcatttacaagagcattctggagttaggcaatctgcccatgttggagcactgataatagaaccaggtacactcgccagtatgacttcacatagtttacgtatgtaacttaactatattcagtaagtttagcatccttggtttatctagctagattgctatatgcaaactactcttttattaagttggcggttttatctgcagtaattcatggtgctgggggaatgcatatggttgatccgcttttccaacgagttttggtgaatgagtgccggaatagaaaaattccagtcattttcgatgaagtgttcacaggattctggcgtcttggagtagaggtagtaattaatgtaatcttttgatatatttctgttactacattctatttacgttctgctaacaaattaccgtaattttaccaagactactactgaacttctcggttgcaaaccggacatagcgtgctttgccaaattgttgactggtggaatggttcctttggctgtcactcttgccacagatgctgtattcgattcattttctggagattctaaggtaaagtgaaagtagtatcaaaaccatattcaagcatttctgacaccgcttgaagccatctaattttccttacttggttgtagcttaaagccttgcttcatggtcactcatactcagctcatgctatgggttgcgcaacagccgccaaagccatccaatggttcaaagatccagagactaaccacaacatcacttcacaaggaaaaactttaagagaggtattagtacaactaaacatgctcttcatctttatagtatacgcgagtccagattcgtagaccagtatgttgcaatcaataacaaaatcagccattactcttggtatcaattaatcctttaaaatttgcagctgtgggacgaagaactggtgcaacaaatatcatctcactctgcggttcaaagggtggttgtaataggaacccttttcgctctagaactaaaagcagatgcttccaattcagggtaatcttctcaagtaacataatatttgttctcttgaattgtcaccattagacaaaatgtcttgaacacaaactttggtacaatttctctgcgtgtttcaggtatgcttcgttgtatgcaaagtctcttctaataatgcttcgggaagacggtatctttacccggcctcttggaaacgttatctatctcatgtgtggcccttgcacctcgccggaaatttgccgccggttgctcacgaagctctacaaaaggctcggagaattcaatagaacatgaaacccaaaactctctctccagcttattttgttgtcatctctgtatctgttgcatattttaatgacatatggaatctgaattttctattggtaggtagatctatggaattcttttcttttctttttttcccttcacgagatctatcggtttatggaaattagtataaagatatcggacaccaaatttaatgcaagatcagtttcatactaatagacaaaaaagaaaaatattctgtaataattcttttgatgaagtaaaaagttgccttaaagtgtaaagatgagtcctacatggatctacggctgagattcatcggacaaagactaatgaccactgtttctcttagtgggccctagcagacgttagtttttaactaaaaacgacaatcatagcagaccacgataaaataaaaacacgtaaaccttaacacaggtgattaaatcccactacaagcactggagaagctcaatgagtcgccacagttgaccgattaacccaaaactgcgacgactcaaaacaaagagatactatactatcatcaaaactccaattctctattcactactaatcattgttccaattcaacgccggtggcttttaatcggcgagacactctctgatttctcggtctccgattaactggtactttcctcttacttatgtctctctgtcgttgatttggttcttcaattggtcaccgagaagtcttctgtagtctccgacgtgggttttggttttcagattcaatttcttgatttagggtttttgttttcaagtaaagcgagtcattctcgagtttgtttttgtgggttttgattttatagacttttgtgctgtttaagattgaattgtgtagcgtttgtgttttgtagatctaggttttttttggggaggagaatgcaaaggtagatgatg

SEQ ID NO: 1307 - DNA, 3000 bp, Unknown
  misc_feature (1)..( 3000): cDNA_ID_2133845_gDNA_ID_1620385_Annot_ID_155425 3000 nt of promoter + ATG
caacgacaagatcaagaaaagacaaagatttgtaagaaaatgggaagagctccatgctgcgacaaggcaaacgtgaagaaaggaccatggtcaccggaagaagatgtgaagctcaaggattacatcgacaaatatggcactggtggcaactggatcgcactgcctcagaaaattggtaagaattctgaaatgtttaaattctaatcccaaaagtaatcgcttataattttcaatttcgattgattagatcaagttttgttctgactttgagatttgtgtaaattatagggctgaagagatgtggtaagagttgcagactgagatggcttaattacttaagaccaaacatcaaacatggtggtttttctgaggaagaagatagaatcatcttgagtctctacattagcattggaagccggtcggtgatctatctctcttgatttctattaataataagttaattaacacctcttcattaaatatataaatttttttgttatgatttagaggtaatttctgttgaaatttcgacttgagattcttgtctttttaccttttgtctatgaatcttatgctgaaacacatgcaagcccatgtttcttcaagctatggtatctcacatagaatttagggtttatattgtctctttcttcttgttttggtgtctttgtaagaacctttatacatttatatcttttaatcttgaacttggttcgtgattctaaatacatagttttctaaaaaaaactttctattagttttaaccttaatgtgatatatttatgcaggtggtccataattgcagctcagcttcctggaaggactgacaatgatatcaagaattattggaacacaaaactgaagaagaaacttctaggaagacagaaacaaatgaatcgtcaagactccataaccgattctactgagaacaacctcagcaacaataacaacaataagagtcctcagaatctgagcaattcggcactggagaggctccagcttcacatgcagcttcagaatctacagagccctttctctagtttctacaacaaccctatcttgtggcccaagcttcatccattgctccagagcactacaactaatcaaaaccctaagcttgcatctcaagaaagcttccaccctttaggagttaacgttgatcatcagcacaacaataccaagctagctcagataaacaatggagcctcttctctctattcggagaacgtagagcaatcccaaaaccctgctcatgaatttcaacctaatttcggtttttcacaggaccttcgattagataatcataacatggactttatgaacagaggggtttctaaagaactgtttcaagtgggcaacgagtttgagctaacgaacggttcgagttggtggtcagaggaagtggaactagagaggaaaacgacgtcgtcgagttcttgggggtcagcttctgtgcttgatcagacaactgagggaatggttatgcttcaagattacgctcagatgagctaccacagtgtttaataagttatatcatgcatatatataaatgcgtaactatagggatggataatggattattgatggaatatgtattttattacggtcataagcttatagcatgttgatggtgaaaggggctttttcataatttgttttaaaatgtaacgagttgtggataataatgtaaatcgttaattctacttggttttatttcattttggaaaaaataggagacgtaaataaactttgatcgatttttatggtgaatatccacactgtacatacagagtttttattgatcagaattcttttctttaacaaaagaaaacaaaacgttttgatacattttgcaatttagtagctgttactggttacggacttacggtatcattgcccatttcaatattccgaatttccaaagtgtgagttgttaagaaaatcaagatttttatgcttcggtctaaattttgtttccagaaaaaacattgattagttactaaaattgagtttgacctagaaaatggggtctgttcgttttctatttctaaaatcatgggccttcctttttccatttctataggcccatctaaagatgcaactcgtggttgatactagatagtgacttggtatgacaaggaagaaaagtaagctaaaatttgattaatctctattatctatgtcctcaactagaaagtaaaatacttgtgtacatttgaccaaagcgtatagttttagcatataataaaaagccagaggagtattaattaatggtaatcatagattttgtaaattaaagcattagatagaaagtcctttcagggaacattttttggccggctggatttttatattcagtaatctcgaatcaaatatccgataattgctaattaatttttatccctgtaaaactaataaaattgaccaattctatccgcaataaatcaattcatggacgatcaccttttccttgtgccacttgatattaagaaaccaattaagatatcattcaacgccattgatctataaattttcatttcctcttatgaatattaattttattcattacaacttcttgtatgcatgagatgacaaacactttttatttctcaaaaataaacttctcagttatgttttgcgaggaacaaaacaaaattctgtttttaaagtgaatcggatagtttttctttataatcatattgaataattaggataaaatgttcatatagctaagcactcaatcaactatatgaatgatatttaagaagttaatatacacacatagagacaaaaatcatattaaaacccctaattgacaattatcaattaacctaccgtttaaccaaagggaaacataaaagagtggtaaccataatcgaacatggaagccacattgtagttgacatatcctaaaggtccaaattcattaattaattcatgaattcatcacttataaataatcactcaccaaagtcatttcccttcaccacccacaaagcc

SEQ ID NO: 1308 - DNA, 3000 bp, Unknown
  misc_feature (1)..( 3000): cDNA_ID_3061649_gDNA_ID_1620385_Annot_ID_155429 3000 nt of promoter + ATG
ttataccaaaacaaaaagttatcactggactctaatttatcggcccaatatatcggtccttttatttgagttgggctagttacaatatatcggtccttatcacgaagtgcccatccaatacctgcaggttggtttggagatagccatgaaccatcaacgaagcaacaatacgaattagcttgcttaagaattaatttgagctattccattttctttcagactttgcactttctttgttgcttcctgtttatgctttacgtctaatccatccatattcacagcttcgaaccacaatttacagtcaaagcatggctttacttattacctccggtattgcccacttcctattattaaataaaagatcatttctcattttccatatcctcctccagcctatagaagggtttaactttaaatgataggatccctttaaatgatttaaatatttaattgtctttggaaaaaaagagagtcaaaattgcctctgcaacaactaaaaaaaaaactaaaaagggaaacaaatcctcatcgaatacagtgaatatggaaaatggggaatcaatatcaaacaataccattcttggaataattctcggattcatttttgaagaaaaaacaagtaatggcaaattttcccaagttgtgtccccctttttataagaaaagaagactcagcaattgaggtttttagagtgagcaagaaccttgtgtagcaaaaaccttaaatccgtcatctatgggaagtataaactctgtggctgaagctaaaacagaggaagatccttcgacaaatcagggagatggggacgacgaatcacctagaaccctaattgaagatcagagagatgtggaggaatcaaaaaccctaagtgaagatcaagtagatgtgaaggaatccaaaaccctaattgaagatcaaggagatgaggaagaatctaaaaccctagatgaagatttggatgaaacagaggaagagagtggagagtgccctttatgccagttcataaagggaggtgagtgtaaagaagcattcacagaattggagaattgttgcgacgaagcaaagaagaacaatgaagatcacgtaagtaaatgtaaggaggcaagactcatctttaagacttgcatgtatgataaccctgtttactatgagccccttcttgctggtgaggctagagcgatggccaagatgttgagcgagttgttgaacgcggaaaaggaagctattatggctggtgagcctgcagtcattgcgagggcgtttagcgggttgcaagaagagaatgctgagccaattctgcctgctgaagctgcagcgatcgggaaggcgtttcgcgagttggaagctggaaagaagaaggagaaggaagcagagggatccgagggtaatgagagtgatcatcagaatcagaattaggtaaagctttttttatgagcatattgagacttacattgatctgaatgaaaattcaaatttcgttactcttaattttgtttaggtgtgtcttcttatatacaccattggttatgtaatttggatgcatctataaaatactgtcgtaatcaccttcttctacaaaaaactaagaccattttaatatacattttgattttttttaagataagactttgtgcaagagtttttatccaatgatagaatcttaagtgagacttgagtagtacttatgctcaacttttgaaacaagagatagaagtaaaagaaagaagcacattcctttggcacataaaagtcatcagcagtggtcttcaggatcttccgcaatacgcttcaacatgaatagcagccatacggtccatgaagtgatcagtggtaatcactgcaagatgatcttcaacaaaatcttcaatcttcttccagtcacgatcaaacctaagaaacagagagcagtagtatcatcagcacaatcaggtcctgctaaaatcaatataatacttttaaaaaaccacacaagtataaaattattacagttgaagtgcttcaagaagcagatctatttagctaatcaaaaaagatcaattaactcaaggaagcagatcttttttagcttaagttactactgacctaacactatcataaacttccctctcgttcacttatgtatctgccttgacatatcagtttatatccctaaaagccagcaataatattgaaggatctaacactaaggaaaactaaaacatgcattgctcgccaatccaaacagaaactcaccaaatcgtaagtttcgatatcatccaaaccaaacaaattgaatgcctggggagagagagtcttactgaggaaaaatgcttcaattagcccaaatattaaagtcccaatataaggagactttttgttaaatttttagcccgattaaacataacattttttaatcagcatgcaatattttcatttaatgtgctcggttctgtcacggacactgacatgtaatttttcattttcacgggtgagataattttcagacaatattagaatttttttcttccctttgtagttattcgaaattatgttattgttgggaagtaatgaaaaaaaactcaacaaaattcgatttaatacctatccataatattattgatcctaaaaatagaaaaggataattttgctgagtcagaaacgtgatattcgcgacgttgtttccggataaagagtaaacgtacgactgctttaactcacctataaaatcacgaccgtcgatttcatttatgtcaaggggcaaaactgaaaatcacacaaaaacaaacaaaactttgcttacgtcacatcattatctgtgactaattcttaatcatcatcatcatcatcacttacttaaatctaaaaaaatctctgtttgtatatatattatctttgcgatttttatccaaatcttccaaagcttagttttttttttttttcaatttctctcttgcgttttcgattttattacaagaactttgttttgggcttcatccatcgttcaaggttcgttgaaaact

SEQ ID NO: 1309 - DNA, 3000 bp, Unknown
  misc_feature (1)..( 3000): cDNA_ID_3061657_gDNA_ID_1620385_Annot_ID_155424 3000 nt of promoter + ATG
ataatgaaacattggtttgtcttattacagtatatacaccccttttatttaattacctttaatctaacatatctctcaaatcttatctggcttcacattttgaatttgagatttagctggatccagtatttgaacgttttcttcatcaacataaatttttgctcaaatcagtattttcttttcaaatcgatatataaaagctagtaatgatttcaataactagtaagaatataggttcatgttcagtaaaaaacatatataactcacatgatgttaattccagacttccagtattaagctgttagaaattatttgttgaaaatcttggggatatatgatatataaagaattaaagattagctaggaaatgaatcaagaaattgattatttaattcaatttaaagaagcaatacacacctatctaagcttatcctcttatgacaattaaaaatatcacccacactaatcagctcgattataatgtcttaaagattgggttttgtcaaatgcatcgattctagggttttgaaaaaagacaacaagaaacatttgcgttgcttttatttaaagctctgaatttcctggtgtctttaattttttattatattatacagaatatattttattatattgtagggttattaaattatacagaatattagttgctcctttatgaattttgatggtttcctcttgttattttgttgcctagttgggttccttatctcacttgattatttaagtaactaattaatcattttaattaaaaaatatattcttttgtaaatatatgctttaatttttcaaaagatatatttgtgataattcaaggtcaattagtgtaagttgtctggttgttcagatcaattattgtattcaagcttctcctgattatgataaatatagtcttaccaccaatcaatttaatttccacaattagatgtccttggccgcattaataaatcctcgaaactgatatttgcttaagataagaaaagtaaaataaagtattcgtatatataaggttttagcgagctaaatttaatttgatataccgaatcggcaaatcccataaacaacctccgatcaaataaatccttatcaccgttacttgttattgatacaaacttacttacttgatttgacaaaaaaaaaaaaacttacttactttaaaacgtaactcttgcatggttggaaaagccatacaatctttttaagtaatgattgttgaccagattcatgtaaagcaatttgttatataaattatgaccattttaacgacagtatatatatttaacaatgtaattaataaatctacggttaattttgcaaaaagaggcaaaataatttaattagatgaatgacaatttggtagataagaaacttaatgtattatttagttgatagtatttttgagttttgaaactattccatctaatattttggtagatggctatagtaataaaataagatgcaaatcttagttaagaaaatacaaatgtaaacttacatggcgataacacaaatccaattaaaattttgaatttccacagagaaatcatataagttaccataaaaatgataaccctcaaaaacttagatgattgataaagttgctaaagacgaattcacgatcattattatagaggattacagttctaaatatttacagatttattatgtttatatataagtcatgcatctattcctattcaattctattcgaagttgaaaatgcacccatttcgcgtagactatagaatccatatgattaaactatacctagctaaatgcatatatttatggaaaaagagactataagtcaaagaacaagagtttctagaacaaaaatgggagaaaaattaaaaacggcctagacatggaaattgatgcttactttaagatgaagtcaatcttattttgcaaggagtcgtaaccgtatatgtatggtcttctcgatatcgacgttgctccttacgacgcacgcattttcatacataccttcggttattttctttcttctaactgcactttctatagttgaggactgagtatgtttgaacaaagttgttcttttatggttctcgactaattttatgatgggcatatatgtttcgattggtataaatgtacaaggaaatgtcggaattttaataactaaaaaaaactgtgtaacaagagaatccacacatacacattttgtcgtcatcgccgagatttagtatactggccggctcagtgtttatcatttatttttttgttccagtgttcatcatcttgttaacggaaagtaaaaatatttataatttgaagtttatttctttggtcattatacattatgcaagttctgaaaactcacttggtttcttacccaaaatttctatcataagaaagtcagaattttgtatccctttttcattagaaattgaccactttataaacttcagcaaattatccaaattcaagaagtaaattaaaatagctaatgatatttgattggctgtagagggaacatttcaacccaagtcacgacaaatcaagatgatggtttgtttcctgccctttaatttgacctattaattaaaatatataaaagtgataattggacaaatttttcacgcaagtgtttctttacgttaatgattattaaaactgagacaacttttaacctttttcaaaacaaatgatataatttaattagaggtttagaaaactaatccaaaatgcagaaaaagcaaaaaccctagttagaaaaatatacaattagggttgaagttgaattatgagaaagacattaaaacgcggagaggacttcatatagtattttttttaatatttacttttcagttataataatcatcaactaatatcctctttttctcgtctttatatatcatctcatccaagcattagatcatttcatcatcacaccaaacataattaacacttggaagagaacaacaacgacaagatcaagaaaagacaaagatttgtaagaaa

SEQ ID NO: 1310 - DNA, 3000 bp, Unknown
  misc_feature (1)..( 3000): cDNA_ID_2133797_gDNA_ID_1620385_Annot_ID_155414 3000 nt of promoter + ATG
tacatatgtggttgacatgtccgtcttatattttaaaaacatgtcggtccatttcactaaaataaaaaaaaacgaatatttcgacttactaaccttttgtggtctgcttcggttttattacttgtcaaataaaattctagccgattggttaaagaaccttattggtcaaacagaaccttattatattgatcaaatttaaaatttattatataaatgaaacaaatttgtaaatctaaatgatataaataactttaaactatacgcgtttgtttatatgtacgttgggcgactacgtacgtaagctggcataattcattcatacaattacaaaataaaaaaaaaacatcgttagtgttagactaccacgtaggtaatgggactccacgaacctctctaatgcaattttttcaaaaaatctccctatataaaacaccaatcctcgatcatattcaaaccatctgaaaacaattacttttaagttttaaccaacaacaaaaatggcggcttttacaaccaaacagtctctgttgttgttgtctcttctgctcttgatcagcctctccgcaggaagtttctacgacaatttcgatatcacttggggaaatggtcgtgccaatatagtagagagtggacagcttttgacttgcactctcgacaaaatctccggttcaggttttcaatcaaagaaggagtatttgttcggaaagatcgatatgaagatgaaactagtcgccggaaactcagcaggaaccgtcactgcttactacgtacgtaaaaatttatctatctccactacttcatttttttgtggcattgattgtttgaatctgatattaagaatgttttcacagctttcatctaaaggtgagacatgggatgaaatcgacttcgagttcttgggtaatgttaccggacagccttatgtacttcatacaaatgtgttcaccggaggcaaaggtaaccgtgaaatgcagttctatctctggtttgatcccactgctgatttccacacctacaccgtcctgtggaatcctctcaacatcatgtaagtatttgatcagtccaatacactattgaaaacatcattaagcgctaattcttactttattgttgttctcttattttactttgtgctttgtttttttgttggatctcaaaagctttctcgtggatggaatcccaatccgagtgttcaagaacaacgaggctaatggcgtggcctacccgaagagccagccaatgaagatttattcaagtctttgggaagctgatgattgggctacacaaggcgggaaagtcaagacagattggaccaatgctccattcagcgcttcctacaaaagtttcaacgatgtggactgctgcagccggacctcgttgttgaattgggtaacatgtaatgcgaatagcaactcgtggatgtggactacccttaactcaaatcagtatggacagatgaagtgggtgcaagatgattatatgatctataactattgtacggattttaagaggttccctcaaggtttgcctacggaatgcaatctcaactgatcatgttaccgagaaaactgaagcacttgacacaattttgtttctttctttgttttccttttcacctcaatatttgttgattcatttcccatattggttagctgattatttgttttgtaatctttataatttggttacgattgattcatagcaaaaactgttggaataaaatgtgatctgaaccactttaaataaacatgagaacagagttttttcgccataacacgaaagaaagaaaaacagagttctaggttccgaaaacagagtaaaaaacagagttggttggtttcgcagaaaaagttaaggtgttcatggccagttgctgtgtttgaattctccgccgttttcttgggagaaaagataatggaattaagcttaaataaatagcaattgaaaccgttgaccaaatctctctggaggaaggtgacagtctgacagataccgttatgatgtgtatggatgaatgcaaaataacaacgaaacgcaagaagacagaaacagtagagatagatgtgaatgcatgcatgggaatggacaagatgggaagaacaaagaagcttgtgctttcctgttgtggttgaaagtttttgttgtagatttcggtttttctttagatgttgcaaatttgaaaatggtataaatacttaacaatgatacccaaaaaaacgaaaaaccaaaaaaaaacatggaaggtaggtatctctgatatatgtttagaccctaatttgaagctgaagaaatgtatgaatggctaactctgacccaaatttattcagtaataaacttttgactgttttgactatgattgactgagatttttatccacctgaaatgaatattcatgtttttattttaattttgttatgcaaatgatgggagagattcgaagaataattcatgtagttgccttataaattatacgtgacaattcttatatgtatgtggctaacatgtccgccctcaatttcagaaacatgtcggtccattttaccaaaacctaaacaaatatttcaagtttttttgtttgcaattgtacaagttaacgaaaaatgctacttgatcgcttttataagcatttttaactcaaaattataatctgaaacaatcttataaattgagccaaattgcatgaccaaataaagaagacaaaattttgctgaaacgattaaaagtttctaaaacattacctacatgtataatttatatgtgaatttaacgactttatacataatttatatgtaagctgacataattcatttgtttataataactaaaatcgcctagtgtaacacgaccatgtcgatgatggaactccacgaacctctctaatgcactcactattaaaaaatatctctctctatataaacaccaaactccagtcatttcaaacatcagaaaacaattagacaacaacaacaacaacgacaacagcaacaacagcaaaaaatg

SEQ ID NO: 1311 - DNA, 3000 bp, Unknown
  misc_feature (1)..( 3000): cDNA_ID_2133809_gDNA_ID_1620385_Annot_ID_155417 3000 nt of promoter + ATG
ctagtaacaagttttgtggctgcaaaaagcaaaagcaaaatcagattagccacaaaattagttagaaaaacagaggaaacagagttttgcaaaagttgttgtcttctattaccttaagatctctatgataaactcctctgttatgacaataatcaacagcatcaatcaattgttggaaaagttttctagcatctgattctttcattttctgtcttccaagtctgtctgaaagctgaccacctgaaacgtattccataactatacagatctttgtcttggttccaatcacctgtgaaaaatgtaaaatttcactcagaataaaaaaaacagtaacttgatgagacagagagacatcagacatcagaggcaaaaccctttaaatgatttaattgtctttggaaaaaaaaaagagagtcaaatctgcaacaagtaaaaaaaaaactaaaaagggaaaaaaaatcctcatcaaatacagtgaagatggaaaatggggaatcaagactctcaagagtctttttggaattaatttttggaattttttttttccttcgccctagagccgccgtcgaccaccatcccggatagcacaattggaggatgatttggccacagttataaaatccgtactctttagacgctggagcttcttcttcattctcttttgcgattgggtatgagagttttagcgtttattgtaagattaggtgaatgaaaagatgattggagatacgagagctatgattgaatgatgtgggtgtagcgatatgtgatgattggagatcgatctaggaggggaagagtttaaaagcctgaaattttggaattggaggctcttgttcatgggctatcatctctctgggacgtcgtcgacggcgaggacaaagaccaaaaaaaaaaaaattaaaagaaaaacttgtcaggtgtcgaaccctggtgtcatgtgtagaagtggaaatagttaacctctggaccacatatatatcattgtataaaccgtaaaacatctaatatatattcaaatggttaaatttaacgacgttaaatggctacgttacttcccttagcgactattaacgtgagtttgattctatcaataatttatatattaagtattttattatttgagatatttttttccaacaaaaaaatattgggtattaaacgtccaaattatatttattttgagtctcttttaggatttttcccttaaagtttgtgagacatcaaaaaaaccaatgtcattgtcttgtctcaaacattactaatatgagttcttaccagtgttttcacgcctgacctagacttactggttaacccacaatccgaactttttttcggtttgggtttagtactagaaaccggtaacttcaaactgggaaaattcgtcattaatctgctaaccggttgaactggtcagatataggttgtaaaaaaaatcattgagcaacttcatcgccggagatgacgatattctaacatacaaactgcgaaattttaacaatcgtaataaggccattcctataactctataagagaatcaagactaacctttaagagcaagtcaactagacgagacgaagcgccaatgaccaattttttttgtttttgaaacctttcacctaagcggacggaagtttcgtgggctttatttaaataggcccataacgatatattgttttacgtatagtctttaatatctcctgttaatctttcctcacccaaaacttaagaaatgtgtctctcatcatattaaaattgggattttcaccgcggtcatgaaattatttcgaaatccatatccgtaaatttcaattatttaaaagatagaggattataacccccgaaattagcaaatatattataatgatacaaaaagaaattcctttacatatcaaatccaaaacaacaaaacttttcgtaaagaaaaatatctacaaaaaaacatttaagagaattgaagtaaaagaaaatgaaatcaaatgctgaattctagactttgcgtaagagttgggactgctcatcacaggatctagccatttggacaaaagaagcttcctgaccacgaccgtaaccaaccaaccaagttgaatgtattagctgtctccactacgacaattaaacatttgagtcagtcaatttcatcattttaccaactactaccatatccactctttaacgtggcatcttccttcttatccccgtttcaaattttgttttcatcaaagcttttttataataaaacaaaatcataaaatacaatgttgatccttatcctattttctttagcaccttaaccaatctaaatttgttaagtgtcagtcaatcaaaaaaaaaaaaaaactcaaatatgagaccacaaaaattactcaaagttcaatttcattttttaaaaattactacctagtgaataataacactcaagagtaataacaaaagaactacaaaattggaaaaccactgaataatgtcagaaaatcgtataaatacttttagataaaaaaaatctcaaaagttttatcatattttaattaactttttaaaaaccaacactttccccctttttttggtttataacagaataatttggttctattagactaaaactctacctctgtcaaggtcggtccaagccggtggtaaagaatccaactctcaaatccaactttttctgaggaaaaaactcccaaatccaattaaatctgaaaccaaaaaaataaaagtaataattaattactaaaaaaaggtaacattactaaacaaaaaccgcgtgatttccaaagccaataaataaaacacaggcttttactacaagatggcccaatcaccagctgttgcctcaaagacgcggcttcttctttcgccatacgaaccttcctctatacgaaccgcctcttaaaaatcttcttcactcacttactatatatacattcctccataaaccctcaaaaaccacaaaccaatctaactcaatacaagaatatctacaatctctagaaaatg

SEQ ID NO: 1312 - DNA, 546 bp, Unknown
  misc_feature (1)..( 546): cDNA_ID_3061695_gDNA_ID_1620386_Annot_ID_155439 3000 nt of promoter + ATG
gatctcttaccaataaaagtttctgaatgggatttggtattgaactgtgtccttaaatccgggttttagttcaaccacgagtttaactacataaacgatttccggtcagcctggtcctgacgggccaccaattttcaaaacattgacgaaagcaagcccaataacatcaaatataattaacaaattttagtttgaatacggttactgttttggaaattgatacattccgatcttggactaatctataatccatgggctggctattttgcagtttcccgtaaataaaattatgaaaacatgattgatttctcgttggtagaccatgacatcacaggacacgtcaacattccaagtataaaggacaaaactgtccatttagattccaccacgtgtcccgataacgtttccgtctgtatctctctcttccgtcttctactcttcttcttcttcttcttcttccactcacaatctatcgagctaaaacactgaagcagacattagcgttgagaaaaaaaaaaaagtaagaacgagagagagaaagccatg

SEQ ID NO: 1313 - DNA, 3000 bp, Unknown
  misc_feature (1)..( 3000): cDNA_ID_2133710_gDNA_ID_1620386_Annot_ID_155445 3000 nt of promoter + ATG
gcctctcatctgctaaatcattcatatcaagtcttgtcaacttgttttttgaaccaacttgctcattaaagtaattcccacctaaacttctgtattaagcagacccttaaaaacagtgatgcaagatttaacatcactttcaccatttattacatggtaacaatgagacaaaggcatttacttttggaattgatgattattggaacaaatcttgcaatgatttgcatataacttgaataataccttttgatcaaatcttaacaatgaaatttggtctccaaaaagactaaaaactagcagtcaaaagtgttttgttgagatttatgcctataattagaatattatatgctagttggtatggttgagtgttacaagaatctacttgctacaaagtgacaatccaggagctgttcatagtacatagtaccaacattatacaagggactagttatggataagtcattgcttttgagacatagtaccaacatatgtaacatgggtcacaaaggactagttatggataagtaccaaaattttctccactatctatgttcatgaacatatgtagcatctgtgtatagatgcaaaatcaagagctcaaataaactacagagtatatacacacacaaaaaaacttatcaatgtgaattcttggaaatgaaggtaatgccaaatcattggagatgacgttaacaacatgacctcacttgggataataatcctgataatcatttgattgtagccacatagaaagcagcaaactaaatgacaattatgatttaagagcaaagatagtgacagtgtaaattaagtccactcttctttgaccttaaggtaataatatatatatggatgaggtgatactaatagagtgattacacatacaagtggtcttgcttcttctatggttttaaaactgcaaataaagatttgcttcgcaggagagatagcgccatcacctcttctaagaagttaactagtggtgacggtatctctcctacgtagcaatccttatatatgcatcttaatacggagagatcaaggtatttcagttgttcaataatcaccctctaacaaagatgcatcttaatattcataaactattctctttctacttacatagtaacaccataaaaacaatgaaactgctccgtagaggaccttggtttgagcctctagatcgtcttctcttacctaaaatgataatctgttccaagataggttcttgctatttgctcaaatatgttttggtcttttgaatgttagctcagcaaggagctcacatgattagcagcacatcctcagcctgaaagtttcaagaaaagctttatcaatttaagagttgtgtacgtttgcagaattctcacaagtttggtttgattctcacccacaagaaaaaaatgtcttttcttttactttcgatatgtttctttgcctttgacaagggacatataaaaatgttaagacgaaaaggttgacaaatctttgaaaactatccacatcatgaactcaagatatctcattccattagaagcaaaaaaaatatcaagtcaatgagaccagctcacgactactctagaatcttcattaagcagaacaaggaaaatctataggtctaattaaacctttttttaatatctcgggttaacaccaaatttggttcaaactcgacaagtcattgttcaaaacacagcatccaaaaagataaaaagccaaatcttatcaccagaagtccaccactaattggtatataatgtttttttttgtatgtagaaatagtgttgaagaaagagcttcatgctatttgatatctataatatctcatttcttgtaacaaatgaactccacacggaatgaagctttttacatatagaaagaacatataaatgtgtccaatatctaatttggtccacgtatcaatttgcaagatcacatgcttacgagacctcaaatatttggtggatatataagataatttcccacatgttttacgaaccatcccgtaatgagtatgaattatccggtctagcaatccattcgatagatttactagttgaaacttgaaagtagggttttgctcacttgtatcctttattcgtagtttaactataatgcacatatggaagaattgagccacaattctcaatgaatttagcgagggtgagaaatgtcaattcaatgtacattctatgtcaattcaatgaaaacaaatgaagaaaagagacatgaaatatgtttccaaattcttacttagaagaattagaatcaaataatacaatatctacatatgccatgagagacatatggaaaaccatgttttcggatgataaacttccaaattgatttgatatatactataaaccggcaaataaacaaattgaggttaaaatataacaaaccggtccggtctgatcgaacggctgatgtcataaaacgtggggaatattcgattaaaataacaaagactccgttacggtcgtaaataagtggtgtgagaaccgaaagtcaaaaacacgtcaatattggtgggggggacgaccgtgcacgtgaccacacaggaactaaacccggacgtattgcgcgaaaattaaaccggatttgataatcggcgactcgtccggcaacccttgttttgttttcgtctcggcggatcgatttttcttcgtctgggtttggttgtctttttattttcctcttccttggccaaagaaaatcttatcgtagctgtgaaaaccctagtttctaatcatctcaattctctcattaacctatcaatttcgatagggtttgatcaagtatccgatttcatggtttgtattttccgtttaatagtctttaaaggtcttgtcttttggaatttcaagggttttcgtttcagtaactccttcttttttttctgttaatttagatcggttgctgtatggagactaattgctggagtttaggttcgtgtgttttgaactgagcttttggttcttgtttgtgtctggtgttgaagac

SEQ ID NO: 1314 - DNA, 3000 bp, Unknown
  misc_feature (1)..( 3000): cDNA_ID_2133718_gDNA_ID_1620386_Annot_ID_155447 3000 nt of promoter + ATG
gggacttctcacaatataatcaaattagatgtcttttctaaaattgtacaaaatcgactttcttagtaaaatattattttagttaggaaattaagaaacatgaaaatgagatacgatccactctttctttttagtactaattaaaaaaagataatctttgactaaaagttatgatcagcagacagaagaatatggtaatcatatcattaagaataagagattacacgtttcgaattatggtgcaacatcagaataaacaagatatatatttctaatcagaagtactaaagaaaaaaagtgagaatattaagctagttttagaaggagtatgttgcatgaaaaatgtaagaaaaacaataaagaaggtgggggccaaagaggcagcaaatatcaagggggtctttgttagttgttgggactcagtcactaactcacaacttctgaagaagagactcattctttctccttctcccatcccatcatcctttttgttttcttcttttcttattcttttttttcttctccaatgaagttacgaaaggttattactcataatcaaatgtttttaaaagtagataattaagtaagttgcgaaattgtgaaaggaatatacaaaacataatatgatactttgatcaggttatatgaattagtagcaaactaatattatatgagcaaaaatacatgttactagattttaacccgcggtacaccgcggacacagttcatttttaaaaattaatatatataaaaatttgtaaattattttatagtttaccattgttactaagtaacgtcctgccaaacccgtcctgccaaacccgtccacaaaaaaaaactatttattttattaatgttgatcttatttataatatgtttatgaatcattgtcaaaatattttagtcgttgcgggacgttgtacccacacatttttcgccaattggttaatatatgttcattcttaaaatttcgaattacaaaatatgacgaaattttttttgagatttttttaaactttatatattatataatgatgttaattatttttgatagattaaactttttataaattcaaatattaataatgttttatgaagtttaaatatacaaataataatatttaaaaaattaatattttttgccttttaggtaaatgatataataactctaaaagcaaaatttaaaagatttaaatctttaaataaatattttcatgcctaaataattaatgtcagtagcatgacattgtaaataagttcaaatacatgatttgtttatttaaacaaaaaatatttagtaagaacaatatttatttaaacaaaaaattttgttaataaaatacgtttatgctaattttaagggattgatgtgaagtttgtttggattaaatttgattgataatgtgattgacaatttaaattaaaaatttaaagtaaaattaattattttgaaaaaaagatttaatgctaatggcattgggttgtaaataagttcaactctaagatttatttgctaaaatgactgcaaaaatgtatatataaatgttttcaaattatgaagcaatcatttggaccatcaaatatattttatttatttttactaaacccatttgaagatatttatccaataagtagtaagtatttgagtagttttattttactgaaagagtcggtgtggttattgaagtataaattttatattacagaccgctgaaagttttttttagttgattaggtttttaaacacagacagtactttagttaatcaataacaaaatgctgattttcatattgtttgtctcagaaaaagagagaaaaagtgcttttgttacaaaatcgaaaggagcctactcttctgtctttagccggttggttggctcttaacaacgcaatgaaaaagcattttttctaataaatcgaaaacaaataaaaattcataacataaaaaaagaaagaacaaagaaagattccaaagagatactgtttcctttgtaagagtatgcaaagaaaaagctaatcaatttgcggtttttattcctcacaactcacacaagttaaagaaaattatggtgtgaatgagaaaaacaaagggttacgtcaatttcgtaataccataaatccaatagatgcatataaactttgatggttcattttgagtgaatagtctagtatgaataattaaacgattgattcatcgatggtttgacgtatttaaaaaacagttgattttgaagaaaacaatctagacaatggattgaattagtcttattagcacctaattaaacttttaacatttcttctttcaacaaaaaggacgaaaatcaaaaacggtaataattagcaaaaaagtgaaaacttttattttgtgtaaacgtgtgtatattgacacaaatatagtttttatatataaaatttcatgtgaataaataagtctttattgggaaacaaaaacaaaaaagagagaagaagaggaagaagaagaagaaggagaaagggagagtgtaggtgtgggttctgttctgtcttggctttgtctcccccgcttatctctccctctctttctctctctctctctctttccactaaattgttttttttttgctctttaaaaagtatatttttttccaatctgcaaattttagtctatgtctgttccttgtgctccctcttctcagtacctgcaaatggaggaagaagaatccttctctgaaacccttgttctcatttgattcctccttcctctctcttcttctctctctgtctctgattcgttattccacacttatgactcatctttcccgtcaatagctaagtttgcctcttctttgtgaaatttagctgaaaaaggagaggaattccgaattctgtcacttcaaagctcgaattttgcaaactttcctttgatgggttttacttgttttgttgtaatctgattaaaaatagaaactttttgttttcttcttgtctccttttgctcttaaaagagaagctttttcaatg

SEQ ID NO: 1315 - DNA, 3000 bp, Unknown
  misc_feature (1)..( 3000): cDNA_ID_1013674_gDNA_ID_1620386_Annot_ID_155457 3000 nt of promoter + ATG
atcctgtagcaacaacagatcgatgctaacactcaaatcacacgatgcatatcaagaattaatgaagaccaaaaattaagagatcatttattaccttgaaaacttggctgacactgaaatctcctatcttcactgtaccgctactagtaaccagcaaattgtcgggtttaatgtccccgtgaataacatcctgtttttttccccatagaaacagtttgaagacagcattaggtgatgaaccatgaagtgagagaagcacgctaaacaatgaagatcatacatgagcatgaagatacatcagtccagtaacaatatcccgcaaatactttctagcagttttctctccgagagcacccggcggtccagaaccgtcatacacccattttccatcaacgtattcaagaactaggagaagccagaaagacaggcattataagattaaaggctctttccacagagagtatatatcaaaacagtagaaaagagaaaggagattaagtacccatgtaaaaatgatcagtttcagggtcatctatcacctcaatgaggttaacgatgttaggatgctccaaaattttcataatcataacctgtaagttataggataaatgagcataaacataacttctctaaaatgaaaccaatagaaatgctgttcagcaatgcaaaaaaactaaggatacctcacgaagaacatcactcatagcagtctctgacggtgccacccttagccttaataaatgcgacttgtgaaatgcctggaaatccaagtattaaatcataatatgtcaaagtaacttgcataatttgcaccataattaaggatcagatcatcgtaatatcagctaaacaaaaaagaaaaaggtttcacgaggtaatgagggaaagaaagaagagcttaccttgatagcataatactggccgtctaaagtgcttcgatataaaacctgttgtgaatgataaacataatgttatggaatccaaaacccggaatacttatggaggatacacttaaaggattggatagtattgagtaaataagattcccacttaccactttaccatagctaccggatccaattttacacacgcgaacatactcattgattgtcttgtcaccattttcatcctaaatatcaaaaaacaacaaaattggtatagacacgccatgggatattcaaagaagcaataatctgagagacaggcaccagaagtcacttacctctccacgtataagttcattagtttctctcactggaatgtgtctgcagattaatccattatctaatctatatttcaaaatttcctcagatcgtttagagcggctcttctgctctacttcttcttcatcttcttcttcttctcctcttgcagtgctagttacatcactatcacaggaatgtgtatcatcatcgtagggcttaggcgattgttggtttctactaccagaactgccaaagcatccaaagcaaccgatggtacgggcaaacaaaaaactatcacgaaacatgatctccttctcaaaaataaaataaaaaaacaaattgctcctcaaatgtatgatgaaatataaaatcctcaagttaactgaggaacctgcacacaaaaaaaaaagtgacatcaacattaagcatccaaataattaaacacaagaacctctgtagaaatcgaaatcttaccccgcgataaaaggggtttcgagggcttcaagcccggagaacttgactattccaaaggatgccattcagcgagatgaataagacaacttgagacatcataaccactgcaatcgaaacacgacatgtctaagactgaaaccttataaataagttatattccttcttcacgagcagaaaatcgttgaatgcatagccccaattgttaatagctacacagcttcaacaaccgccaataaattcaagttgaactacaatgcttctgcgaaaaaagaaaaggtcaaattctcatcaaattcaaaagcttgtgtagataagtcaatcacattgtgggtattatgattcaggcgtaaaggtgtaaactttttcaatccaaatagtcaactctaagcaaagaaacaaagacggagagaagaacaataaaattctacagcaaacttaagaacccccaagaaggtggcttcaaaatcacataaatcacaaaccaaaattttgaaaattgaaaaaaaaaaacctaatttcgaaatcggatgcaatggaaatttcatgagaagattcggaacataaactgaaggtaagagcgagaatcatacattaaagctggttgtgaattcgatcggagcagaggaagacaacaagatcgcaaaggaaagagctctctcaacgtcgtgcgtgagagatttagacacaccaaaaaaaaaagagagagcttcgaagcctttgatcgagattctctcccccttctgtttttttttttttggggtttatattttttgttttgtcaattacttttataaaaagtagttttatattaaatcatcaccagctaatgtgacaaaacatgctataaactaaattcagtggttagaaaacaataaaattactactaataaaaaaaaacacattatgagtttttgaaaacctacctttactataagtttttttttgtgtgtatatataatattatatcatcatctttaaaattttgtaaaatagattacaatttttcctagagaatttgaattataatcacataaaagcttaataagtgtatatttttgttttgttagcataattgtttatggctttttaattgaatttgttcacaatagttattaataccgtgatatctttatatttaaaaatgttattataagaaaatatctgaatagaaatccaaatcgtgggcaaagaaagaaacacaaaacaaaatcgtcgatggctgttacaaaaaggcttttgtgagtgtcccaattccattcacaaagttttagtgtttaataatatctgacactctctttctttgaccgtcgccgccgcaatg

SEQ ID NO: 1316 - DNA, 3000 bp, Unknown
  misc_feature (1)..( 3000): cDNA_ID_2993456_gDNA_ID_1620386_Annot_ID_155462 3000 nt of promoter + ATG
ttgattctttctccctaacaatgtgggtcttcgagcttggcctctcatgtatgggtaagtcgtacataagtgcaacacacacactttattttgtatgggtaaattcatgattcatgtacctgccataagtgcaaaactgtgtatgatttaagccctacattaccaggaggtggcttaagtcaatatatgtatcatataggattatgtgtgatttgacataatagcatttcagagaaatcttaacataatatatacatgatttggttctaaacttataaattataagacatgctaaaagaagcttattatggtacatttaaacataatcctataaccacaacaaaaaaggataataatgaacctacaatgatgtagagcgagcgagattgcctaccaatatgcttttgctttgcccatttgtgtcggcaaattctggttggtttggatcactttggtatgatgctactttcacgtaatcagtaggtttggccattcagatataaaaacatccatatctgaatacttgatttagttcatttttcttttcatgcatagccggaaatatatcgttaatagattttttgtaaactaaatagaaatttgtttctacagtgataaaataaattttctttaagcttcatgaaattttcaaaaaattattcaatattttagatgttgtacgcttgctactgtagagtattattttgtgtccataactattttaacaatattataaatgagtgagaatacgaatggagagaaacgaaaatcttcaatagataaagattggctggttttgaattctagtcaaaaattagctttattgctgagtgattactcctacaatggttttaaaagcagagattcttcgtaagaagcaaaatatgtaaacgaaagtcacttttattttgggcatcgttctaaagccaaattcaaataaaatatcgacatttctccttcctttgaaatcagcatttacaaaaacgtttgtagaaacacacaaaacatgactaattttgttttcaaaggctatatatgtttgtggctattcattatcaaagatatataagcggtcaccaaaagaattttgcaggtcgaaatgtacttcatatatcataaatgattaaaagtgataactaatcatttttactagcctgaattgaagattattgcaagaaaactttttgtgcaagggaatactaaatttggtaatcttttttatatataataaattaactcgccgttaaaataaaaataaaaaataactcagtaaatttgtattagagagagctatttcagcttggagtatatattgacatggattaatgaaaacaaaagggtaaaagaattgtcaaacgacagcatatttatcattcaagtactcatcgtatagaataattatataacgtattatctgcgccacctaactaagcacaaacttcacgcatgatcgtgatgtatgaaaattccgatctctaagtactaattaacatcaaacaagcttttgttaaacctaatgcatcactagcaactttaatgttataaatatcataatttcttacataaaatactaatatgattcatgccaaaagttatctaattcatatatcatgcgcttggaataatataaatattttcacaacacactttcgtgattgttacgaacatagatcaaacagaaaattcaacatcaaacaaagaaagaatattgaccaaagaaaattgagtatttttggaaaataaatttggtaggaagataagtgggtgaacaaaaatgaagtagatataaattacaaagtgatttaacaatgacataaatgaagtaatatcactaagaatgtttttgcaatattaaaaaaaaaaactttggatattataggaattaggttaatccgcctaataaatgtttggtccaagtccaactaatccaaaactatgttaaattgtaatttaaatttgatacatcaaaacctgtttttggaaattaacctttttcgtcaaaacaagtttctttttggaaaccgttacacggttctggtgattaatagacatgggaactagaatccaaaatgcaggtgttacatcaaacttaagtgatatcaaaaaaagcaaatttcaaaaagagaagaaaaccactaaatcactatgatagtacacatgtcacacattcacaactatgtccaaaatataaattacataatttcgttcatcttatcaaattctgccgcgccgcatcatataacacgcagcatacactatagtgccttttcccaaaaacatactatagtttatttataactagattacatttgataatttgtgataaatattgtgtcaaattggtaggattatgttaatgatattgcttagtagaaaacagttgtatctttttagccttttaggcaagaagatgatgaaaatatgagagaattgagcggtaggcccatctctcttctgttcataaatgagaatcatgctttactctctctccctttttctcattcttcttcttcttccccatttacagcccaattccactatcttcctcatcatcataaattcataatactattgcactaatctcgagaagataaagagacaacaaacacctctctatctctctctttcttttttctttcttccgtttcaaagtttcttccttttgggcgggttttaaggaaattttggaatttctctctttttggagacgtttctttaatttctgggcttcttctagttgtgggttttgttttctacttgtagctactgtgtcacgcttttctctagcgaatactttgatgcttcttcatgactctttaacaagattattctgagcttttcctctggccttctaattattaaagtcttcctttttatctattgttaaggtttggcttcgttgtctcttcctcttacctctgctttttggttcagagtatttgaattttggggaatattaaaaattgcctgatactgaaatcaatctcttgctgtctagtg

SEQ ID NO: 1317 - DNA, 3000 bp, Unknown
  misc_feature (1)..( 3000): cDNA_ID_2133747_gDNA_ID_1620386_Annot_ID_155458 3000 nt of promoter + ATG
agctggctcgggaccagcacttgtttctccaacagatacaatagtcttactactgcttgaagaagctccttgctcaatctctttcgtcatctttatgaaataactgtgcctgcaaaaaaaatgaaaccggaaagagtaaaaacagaccatatagatcattgctgcaaatatcaaaagatcggggaaaatgttaatcaattaccatcgagtgtctgcagtaagctcgggatgaaaagcagttgctaacaagtttccttgcttcacagcaacaatgacttttgtttcaggaagagcatcttcctgatttatccccaaaaaatgaaaccaacaagaagggattcatacatgtgctcacaaaagagtaatcgtttcatgaaaattagtgcaaaattaagcaaacctcttgaatttgtacggtggagcttgaatacaagaccttgtttgatgggacgggataatccgccaggacttcgacatcaggacctacatcaagaacagctggagcacgtatgaacactcccctgtatgtctctggcccaccttcttgagatgttagttgaggtactaagatatcagcttcaaaactttgaatctacacatcaaaaacaaattcgagaacaatctaagattttcacaacatcttatttgatactaagagtgaatgagaatccatatgaaattactcccattgattcatgaaaagaccgagttttatatatcagtacaccacaactcatgctaatataagcagtttctttttccacatattgcaagtcaagattgatttaaatatgtgtttacacattttcttaacatgaacccggaatcttggtaagagacataacctggctaccgaagaagttcctatgtacggtgcaatcaaggccaccaactaattcctgacctccctctttctgacctaaaatttcaacatttactcaagtttctaaattttccgcaacaggaagatgaattcaagtactcaccaactgctctgtctgccaagaatataagacctgcgcatgtcccccaaacaggtttccccatcttaacaaactcacgtagagccggaaacttcaaaagagcaacaaatgaaagaaaattagaacagagaagagacattttacactattcttcgtcctcaccactaaaactgtaaaaacaaccaaatctaaacaaggagtttggtaaagataaaagtaaatgatagctctccctttcctacacttatcacagcttccattaaagacagaaaatatcatccataagatcaacgagtagtttggtccacaatgtttaaaggtttcagatacaaaacattacttcatgtacttgaaggctaactaatcccaaagttccttcattttcaatctcaaagctaattactttcaacagtactaactgaattattcaggtataagagacgttttgactgaaattctggagaattttggtgaataacgccagattcgtgtcaaaacacacataaaaaaggaacctttaactagtttcttcaagtgggtcctcgcaaacaataactttagattctagagagagaggagcggaccaagttatgatactcggcgagtttggccatggtggtgctctcgccgccaggaatgataagagaagaaacggtgagaagctggtcagccttcctaatctcgacgccttggacaccgagccgccgcagagccgcgatgtgctcattgaaagaaccttgcaaagctaaaactccgacggtcattgcggcggcgacggtcaaagaaagagagtgtcagatattattaaacactaaaactttgtgaatggaattgggacactcacaaaagcctttttgtaacagccatcgacgattttgttttgtgtttctttctttgcccacgatttggatttctattcagatattttcttataataacatttttaaatataaagatatcacggtattaataactattgtgaacaaattcaattaaaaagccataaacaattatgctaacaaaacaaaaatatacacttattaagcttttatgtgattataattcaaattctctaggaaaaattgtaatctattttacaaaattttaaagatgatgatataatattatatatacacacaaaaaaaaacttatagtaaaggtaggttttcaaaaactcataatgtgtttttttttattagtagtaattttattgttttctaaccactgaatttagtttatagcatgttttgtcacattagctggtgatgatttaatataaaactactttttataaaagtaattgacaaaacaaaaaatataaaccccaaaaaaaaaaaaacagaagggggagagaatctcgatcaaaggcttcgaagctctctcttttttttttggtgtgtctaaatctctcacgcacgacgttgagagagctctttcctttgcgatcttgttgtcttcctctgctccgatcgaattcacaaccagctttaatgtatgattctcgctcttaccttcagtttatgttccgaatcttctcatgaaatttccattgcatccgatttcgaaattaggtttttttttttcaattttcaaaattttggtttgtgatttatgtgattttgaagccaccttcttgggggttcttaagtttgctgtagaattttattgttcttctctccgtctttgtttctttgcttagagttgactatttggattgaaaaagtttacacctttacgcctgaatcataatacccacaatgtgattgacttatctacacaagcttttgaatttgatgagaatttgaccttttcttttttcgcagaagcattgtagttcaacttgaatttattggcggttgttgaagctgtgtagctattaacaattggggctatgcattcaacgattttctgctcgtgaagaaggaatataacttatttataaggtttcagtcttagacatgtcgtgtttcgattgcagtggttatgatgtctcaagttgtcttattcatctcgctga

SEQ ID NO: 1318 - DNA, 3000 bp, Unknown
  misc_feature (1)..( 3000): cDNA_ID_2990960_gDNA_ID_1620386_Annot_ID_155456 3000 nt of promoter + ATG
tctgacactctctttctttgaccgtcgccgccgcaatgaccgtcggagttttagctttgcaaggttctttcaatgagcacatcgcggctctgcggcggctcggtgtccaaggcgtcgagattaggaaggctgaccagcttctcaccgtttcttctcttatcattcctggcggcgagagcaccaccatggccaaactcgccgagtatcataacttggtccgctcctctctctctagaatctaaagttattgtttgcgaggacccacttgaagaaactagttaaaggttccttttttatgtgtgttttgacacgaatctggcgttattcaccaaaattctccagaatttcagtcaaaacgtctcttatacctgaataattcagttagtactgttgaaagtaattagctttgagattgaaaatgaaggaactttgggattagttagccttcaagtacatgaagtaatgttttgtatctgaaacctttaaacattgtggaccaaactactcgttgatcttatggatgatattttctgtctttaatggaagctgtgataagtgtaggaaagggagagctatcatttacttttatctttaccaaactccttgtttagatttggttgtttttacagttttagtggtgaggacgaagaatagtgtaaaatgtctcttctctgttctaattttctttcatttgttgctcttttgaagtttccggctctacgtgagtttgttaagatggggaaacctgtttgggggacatgcgcaggtcttatattcttggcagacagagcagttggtgagtacttgaattcatcttcctgttgcggaaaatttagaaacttgagtaaatgttgaaattttaggtcagaaagagggaggtcaggaattagttggtggccttgattgcaccgtacataggaacttcttcggtagccaggttatgtctcttaccaagattccgggttcatgttaagaaaatgtgtaaacacatatttaaatcaatcttgacttgcaatatgtggaaaaagaaactgcttatattagcatgagttgtggtgtactgatatataaaactcggtcttttcatgaatcaatgggagtaatttcatatggattctcattcactcttagtatcaaataagatgttgtgaaaatcttagattgttctcgaatttgtttttgatgtgtagattcaaagttttgaagctgatatcttagtacctcaactaacatctcaagaaggtgggccagagacatacaggggagtgttcatacgtgctccagctgttcttgatgtaggtcctgatgtcgaagtcctggcggattatcccgtcccatcaaacaaggtcttgtattcaagctccaccgtacaaattcaagaggtttgcttaattttgcactaattttcatgaaacgattactcttttgtgagcacatgtatgaatcccttcttgttggtttcattttttggggataaatcaggaagatgctcttcctgaaacaaaagtcattgttgctgtgaagcaaggaaacttgttagcaactgcttttcatcccgagcttactgcagacactcgatggtaattgattaacattttccccgatcttttgatatttgcagcaatgatctatatggtctgtttttactctttccggtttcattttttttgcaggcacagttatttcataaagatgacgaaagagattgagcaaggagcttcttcaagcagtagtaagactattgtatctgttggagaaacaagtgctggtcccgagccagctaagcctgatcttcctatatttcaataactgaacagagagaagatacacacttcttaaaataaaaaccagagaaagtgtcagattctttatctttctaaagatgttttggaaaaattgcaagctagtttgcaatttgcactcaagaaagtttcacaagactctttaatggattcatgtacttgtttcttgatacaactttatatatacagttgaatctcaaacttttttgctgattcaatttggtctatgtcttgtgaaatgtgaaaggtcgtttggccaagaattaagctttagataactgtcagcgtttataggcagaacagaacatgctctgaaagtataactcggtagggttttggttcaatggtttagaagctaacccggtttatagtaaaccagtcagctgactttgacgcgtttgacttttcattgctttctcgaaagggtgcaatcttgtagtagtgggcggctttgggccaatgaaagtcaagaaaagttacttaaaatgcacacatttacagatatgttaagacatgagggctttcttcttcatttaaggcatcctcacgttctagatactcgtttccttgcacataaagccatcaagaattaattttgtttttcttcagaaaatagagaaaattttcaaatttgtatatatagtgtatagaaagatatacagaccggatttttcaaatttattgtatcgataaccaaaattttcacccttttttattattttttgtcaactaaatgaatactaacttcaccctgttttctcatagtaaattgctaatataattcaactgggaacaaatgaagcaagtatgaatatgatttgatcatgaggcattaagaactaggtaaaaatttgtgaactgatattatatgtatggttgtgtttaaattaaacaactcttttctagctaaaagacttgatgttgaagcttcatcaagctagatttttgttaagaaatcaatggagacgacttgagatgaactcaaagagtcggcttctttcttaagatgaagcaagggatattatcatatggggttttaataagtcaactcaattctttgcccattctatataatcccttcttctgcaacaacatctcatcacaccaaaaaacacagaaacattttgagaaaccaaagaagaagaagaagaagaagaacaagcagaagctaaagaagaagacttgaacttgagagatg

SEQ ID NO: 1319 - DNA, 3000 bp, Unknown
  misc_feature (1)..( 3000): cDNA_ID_2133700_gDNA_ID_1620386_Annot_ID_155440 3000 nt of promoter + ATG
aaggacaaaactgtccatttagattccaccacgtgtcccgataacgtttccgtctgtatctctctcttccgtcttctactcttcttcttcttcttcttcttccactcacaatctatcgagctaaaacactgaagcagacattagcgttgagaaaaaaaaaaaagtaagaacgagagagagaaagccatgtctgcgaaaacaatcctatcatcagtagttttggtggttctcgtcgccgcatcagcagcggctaatatcggattcgatgagtcaaacccgatccgaatggtctccgatggtctccgggaggtagaagaatctgtttcccagatcttaggtcaatctcgtcacgttctctctttcgctcgcttcactcaccggtaagtctcgtcctttcaccacccgtgctttctccgttgacttttgatcttagcttttgatcatcgtttgttggtgatgaagatatggtaaaaagtatcagaacgtggaggagatgaagcttcgattctcgattttcaaggagaatcttgatttgatcagatccaccaacaagaaaggcttatcttacaaactcggtgttaatcgtaagtttttttttttatctttcttctcctgagtttgtacttaaggaagtaaacgtatgtataaaagacactgtgggaaaacgtggaaactaacttttgttctgtcttggaatcttccaagttaatatttttaaattttgatttttttctttcgttcacgtgattcaagattgttattgggactctagactttacagagtttatgagtctatgaactctgtgtgagagactagtttgtgtcaaaaacagtgttctgcttctttaagatttagctgtcctgagttgaagattggttctcgttcctacttccttgtagagttgtagggatctaatctttatttgtcctagaactgacactgcaatggtttgatgaataatgatttacctaaatattgctaattgtgtcttgaatctatacagaatttgctgatttgacatggcaagagtttcaaaggaccaagcttggtgctgctcagaactgctctgccactttaaagggcagccacaaggtcacagaagcagctcttcctgaaacagtaagtccaggactcaatcttgctgcactgaactatgtcaaccaccatcccgttctgtttttcagctctaagagaacgtgtttagctgcagacctttttaaaaatttggttctgagttctcaaattgtgtaactgcagaaagactggagagaagatggtatcgttagtccggtcaaagatcagggaggttgtggatcttgctggacattcaggtaaaagtaaaaccaatgattaagatactctctttaatttttggtgggatcttttgatgtcaaattgaaggtcgagattgtatgtcatatgattgttttttgtactgcagcacaactggagctcttgaggcagcttaccatcaggcatttggaaaaggaatttctctctctgagcaacagcttgtggattgtgctggagctttcaataactatggttgcaatggtggccttccttctcaagcctttgaatacatcaaatccaacggtggcctcgacacagagaaagcttatccttataccggtaaagatgaaacctgcaaattttcagctgaaaacgttggtgtacaagtcctcaactcagtcaacattactctggtaagcatcttttatggattttgaatttcacttgcatgagaatatacattctgtaatgatgattgaaacaacaacaacaacagggtgctgaagatgaactgaagcatgcggttggattggtacggccagtaagcatagcatttgaggttatacactcgttccggctttacaagagtggagtttacactgatagtcactgtggaagtactccaatggtgagactttcttctttaaactgttaaaaagactttcattggttcacataaaatcttcttaggaacttagcttagtgttcggtttccttaatgtggcaatataggatgtgaaccacgcggttttggccgttggttatggagttgaagacggtgtaccatattggcttattaagaactcatggggagcggattggggcgacaaaggttacttcaagatggagatggggaagaacatgtgtggtaagttctttaataattatgaaaccatcacaccattctcaaattctcacagttggtctttctctatctattgttgattcgttcttgaattgcaggtattgctacatgtgcatcataccccgttgtggcttgagatgatcagcgaatgtggttggtcaattatcaaattacgaaatgttcacgtatttattggattaagacattacgtaaaagttgggacttgggaatgcatatggtttatgcttgttgtaacataaaaaggtctgttaatatgtacaaaataaagccaaaactatagacgacaaatttataatattttcatgttaaatttatgaacataaattgatttagatcaaagtagtttcgttcttgatcctaagtcaatttgtctaacatatagcttttactttgaatcttgatccttgagtcattttgtataacatacagcttacaagttatgactttattttgttttggtaattggtattctaaacgaaaatgaaatctaataacgtgattaatagtggtcacatggatatctcataaatctctatccaattgtgtgattaagaacatgcaaaactgcaaataaagtataaaaaatcatttacacaaaacttcatctagtttttggacatcaaattcacaaaaagcagcatataacactacaataattgatttcacttttattttatttgtttgtttacctttctaagttcaaatataaattctatgattagtttattataattacaatttttattttttttactctgatttgaattttttacatggacacgaaagaagaagaagaccacatgttggttccgaataaaac

SEQ ID NO: 1320 - DNA, 3000 bp, Unknown
  misc_feature (1)..( 3000): cDNA_ID_3061685_gDNA_ID_1620386_Annot_ID_155443 3000 nt of promoter + ATG
ataaacaaccaggacttgatcattccttgctcaaaaaccacacaatccaggtatatatatatatggtttcagaaattcgtctgctacatacattttagatttttaaaaatgtgagttttgaatctggctattgtttttgttaagatgaaaccatcattatcaagacatgagctaaagaatcaaactagcaacaacaaaacatataagaaggacatagaatgtccatatggaactattcctgtattgagaaacacaaaagaattcaacaccaaagcccaactcttggctgccaagtatttcaatccgttatcagctgatagccctggaacacatgtacgcattcacttttctgttaataccttagatctaattatatattacaagtgttcatgtatattggtagatcgctggggtaaagcaacacggtggtccatatcatggtatagaagctaagtttaatgcatataacctaaacattggagaagatcaagcctcatatagtcaaatgtatttaggcagtggacattatggcgaagtcaatttcatttcaacggggatgatggtacgttttacattttattgttcttttttttccttaaaatctattttacgttatgggtagtcttacagtagtgcaagtctttttaacagataaatccaggcatttttggtgacggacgtctttggacatatggattttggatggtaagcatgtgaacatattatatatgctgaaatcattaaccaaataatatgtaaatattacatatgattttgatagggtaaaggtggaaaaggatgttataacatggcatgtccagggtttgttcaagtatcgaatgtggttcccttagtcaaacccatgtaccttaagccaggggagcctgcatcgttgcaatgggccatccatcaagtaagtttttaattttctacacttcgtttgttttttaataatatgttttgcagattttttgtttgtttcaattattttttaaagtttctaggcaatattttcatgtcattctcacttagtagtgaaggatttatgattcttaaaactaatcattaatacaatcaaatcagtgatatcagactatatatagcctttttggtccaaacactttgattagcacatgattttactatgattttttttttaataaatgaattttgttttgtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgatgtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatagttgatggttgatgtatttttgttgattctgatgtttcgatttttgtttttgttttgacagct

SEQ ID NO: 1321 - DNA, 3000 bp, Unknown
  misc_feature (1)..( 3000): cDNA_ID_2133509_gDNA_ID_1620387_Annot_ID_155480 3000 nt of promoter + ATG
aatatttatatatttttatactgaaatgtaaatatctttatatatttatcctttttgttttaatataaatatttctatttatagtaacttatttctacatgcaacatttcaaaatatctttttaaattaaatatttatatgttgatttctatatatgtgatgccattctgacaaataaaaatattaatagaatccaattttaccgtaattgacatatttgtgagataattttgtttggatacgttttgcctaattctcaaatatatatggctgagaagcttaaaagatatatttacaaaattcttctacctctttgctatctctccggagagcttccacgaaattaccccggtggcagaagtgacggtggcaatagatgtggaagccaccgctggtcaccgtaacggtggtaacagtggcgatggaaagaaaaagtgtgtgtgttcaccgtcgaagcatccaagatcgttcaagtgtaggtatcatcaacatgaatatcaatggcttccttcatcttctttttcatcccttcacaaataacatatcatcaattcatcatgtaaacaacaaatatagttatatattattattattcatggttattttgattcgttaagtatttcaatcaaagtagaaattgtgttgtggttcttcgtattgctcatcaactacattagctcatatctatgttttatcaaattcccctgttgggaaatctttatttgcagggaatgaaagcttggttggtgtttgtggactcgctgtcgcatcttgtttggacatgctgttttctaaaacacttgaagttcccttgcgagacatttctgtcccttatcgttctagcacccatacattggtagcagaagatattgtagtgaagactgccttatcattaaagaacgccctcttgttggcgtggaatgaagactctttggttttgcaattgttcttagactcccagttcattgtaatgactgcattttggtagtagaagaaggaaagtaaagtctgctgcaaatgtacaacaatacgtgtatatgggtaatgagtatggtgtgtgaaaagggacgtagaagcaaagagcatggtgtgtgattgaacaaaaaacaatgtttcgttattgcaaccaaatttttattaaatgaaaactggaaaactaaaaaaaatcatctatcaatgaatttccaaatttgtggcatctttccacatgtcttcagccatagattttctccacatatttgtgttttctctgtcttgtttttgtgcttcgagaggttcctcattatcaatttcattggtgttcattgcattaccttcattgttaactacgtcaccttcatttcccacttcatcagggaagtcggcttcatctgatcgacattctttacgaagaaagttatgcaacgctgcacatgttaagactaatccagcttgtttcttgtaagaaaaaggaggagcagatttaaaaatagcaaaccgagatttaaagattccaaatatcctttctattacgtttctcaaagaaacatgacgaagattgaataactcatgtggagtttcaggatcgcgcctttgaccagcaaattcctgaagatgatatctaactccgcgaaatggagctaagaaattgagacgatttgcaaatccacaatcaaccagatagaattttcctgaaaatttagataatatatgttactataagacatatgatctataaataaatttgtaattgttctaccttatagtactcggaaattgtttgttcttttacttaatgcatcacttaacactcttgaatcgtgagccgaaccctcccatccactcagaacatagataaactccagatcaaagttacatataactaaaacattttgagatattgttccttcaagctttgagagatttggttagctctaagtccactatccatgttgcatatccccaagcaaagctactcatttccatattagctttacgagatgtatctctttccatattagtccaataacgcatgagtttaaaagaatttataaagtatctaaacgaataacaccagaattcaatattctattaaattccatcacattcattcgttcaataccccccttaattttggactcaatttcagtatttgccacattatatcttaattgggcaaaaactaaaaatctaaaatttttacgatattgtttctacaatcaggtccaacgtaacattgtatatttatatgtatgaaaggcctggacaaaaaaatatggcgaccgaataaccgaaaaaaaaaccaaaccaaaaatattgaaccgcatttaaatggaagttcataaaataagcaaatggttagtgaaatcccctatccaaactaacagaaacgaaaagaaccaaacatttaaccaaaatacccaaaaataatacacaaaaccataattataaactcaaaatattaattacgtttagaaatcaaacaatcaatactttatataagcagcatatccaaatgttttaagttatatttgtcaaaatcaaagaatcttttaaaaaattgaaccaaattatacttttctttctaattttttccctttttgtattttttccgattaatttcacttctattcggttcatttcggttattctggctaaaaatccaaactaaaccaaatttaataaaataaccgaatcgacccgaattgtaatcctaaaatatctgaatggttattatattgccatatccgatcagaacttaccgaaccgaaacggaacggttattgtaatctttgcagccaaaaaaaagaacagaactactttcgattacgtcattcatcgtatgtgcatacgtatcatcagagatagagagagagagatctttcttttcttcttcaacaagtccaatggataataataaatttgttcttacatactaatctttacggttctgtctaaattgaagaatttttttatcacaaattctcagatttcttgatcttcagattaaccgaatcaatg

SEQ ID NO: 1322 - DNA, 3000 bp, Unknown
  misc_feature (1)..( 3000): cDNA_ID_3061740_gDNA_ID_1620387_Annot_ID_155485 3000 nt of promoter + ATG
tcctaaaaatagaaaagaaagctcatgttatgatcaacaagaaattggacttcataacattcttagttgctaaacaaatcataaacagatacctaacataaggagaatgtatcactgtcaagactggtataaagtcgtaactcatgagaaacgtctattatatgagatatatgttattgaggagaaagagtagcaggggcaagttaccttcaaatcagaagaaaaattcgtaacctgcttttcataaccagctttcttcagatggaaattcatccattttagcaaaactttttcaggagccaatcccatgagctcctctgcatcctgcatcgtcaagaacattttgtaatgtttcaatatcatgaaaacaaatcttcatggaaagcgctgaacaactcaaatatatttacctgagtgtcgtccaccagttgaaaaagcgaaggagttttcttaaaattgagatcagccaacatttggatctgatattttgcaccaagaacaccaaatttgtcaggagttagtaagttttttaacaagtcaacattaaacaaaatgaaaccatcatataaattcctataaactatcaatgaaaaagcttaaaggtggtacctttataatctgagatatcaacccaagtacgagatatggctgcaagaaaataagaagaaggaggaggaccaattaaaattgataaatcaagcaaacagaggaacaatagatatatgttttcattgtaattactcactcttccttcagctatgtcctgtgttccaatgttgaccactgtgcagccaatagctttggcagaattgagacctaaagtaaggttctcattcctctcccatgggttaagcgttttctttgtgttgatagctcgttcgtcgatggtcccaggaacagcaacatttataagcttactgcaaaaaagtgacaaagatgactactaagaaacttcaaaacaaacagtaaacaccaaggacgaaagtaaccaaagacataccacaaaagaacaccatctttaacaagatcaaagaaagcatttgttgcgggatcaataggaagatagctcttcaagaaaggatcatctctcaagtaattattaacatgcgaaacataagaagccttctcggattcattgatcgcatggtgcaccgttgtagtactggttttgaggaatgaagaagcaccttttgaccctcctgatttctcaactcctcgtgcttgcacacttaaaaaggcctatcaaacatgtcaccataaaccatgtaaaaaaaatgaccttcctagtttctattctaaaccttcagactcatcatcataagtacaaaaactcacccgaagaaagaactcaaaatcgacttcatcatcagcattgggataagacttgtccaatacagatttgatctcatcctcatcaatggtaccgttaaaagctttcaacttttcgaaaacaggtggtaaatctccgacagtgaaacgtcctaattgagttttgttcgaaacaaactaaaatgtacaaaaaaaaatgaaaactttcaacacagaggtaatgtaatgatacacctgaatcaaaaagaatgcgatctagatataccttagatttaagggtacgcaattccacttgtgtaaattggctctgtaaccaaggatcagagacaagaacaccaacgtaactagacattttttctaatcgatttctccgcagaatcaagacaaaacaaatccctgcaacataaaaatgtctttaatcaaacaggaaccagaaaatttgtaagaaaaaagaccaaactttttgacccacaagatcaaaaatggcaattcgataaacaaacacgcaaagaaacgattttgagataattatggcgttgatgcatcgatccgatgtaatgggaagaagaaaaaagagatgatcagaatcgaaatattgaaaagatgataatagaccttagagcagattgagagattgaatgtggttcgtgttcatattctctttatcaggataaagttttgatctttgaagcttaaaaagagatctgtttcgaaataatgaatttcgtgttgagtttttcgagcgcacgacctgcgatgaaatggaatgatttgacagagagagaagaaggtgagggtttctatttggcatttatttaattttgttatttaattttaatcatttttatctttcttattaacattgaacaaatcgttgaaattacaagaaagataaaaatgaaatctttcaacgattgataacattgataatcgttgaaagatttcatcgttaaaagaatataagaaagataaaaaataattattaacattgaacaaattgttgaaataattagatttaatcgttgtaaaaacacattggtgtttaagaaaaattcgaataaattctcgtaaaactaaacttatacattatattcttttatataactatataaaggatgatattaatctaactattttaatataaaataaacataaatataaataatatagttaaagataattataaataacttaaactttaatattaataatattagaccatcatttttgctatgctgcaattttatttttttataatatatttttatatatataaatttgaaatatttaatcatccactcatttaatgagtactacttttagtgttacagctttttttaataatattctcaataatgtatcattcacaatttttaaataatcatttgttagttttgaattataaacgcgtcataaactaattttgtagatgttaatgttagaattataggcagcctcctcctctttgccaagtgttgctctgatctcggcaaactacgtctcgcgtacacaaaaccaaaaatcgcaccaagataaacaacgctttactcaaaaacagacttagaatggtaaaaatcaacaaacctatcagctcaaatctgacaactgaatgacaaagggctaccaaagaaagtgtcaattgtgtggcgtgtttggtcacatcgccaaacg

SEQ ID NO: 1323 - DNA, 3000 bp, Unknown
  misc_feature (1)..( 3000): cDNA_ID_1456622_gDNA_ID_1620387_Annot_ID_155492 3000 nt of promoter + ATG
tttttatatttagaatttaacaagatgtatgattatatttattggttataaagatgtatgattatactattattttaagttaatcttagaaaaaaaagtggtgtactatttattttaatcacagaattgggaagttcaatttagaaaaaaactgaaaatgtgaagaagataatatacaataaatttagaaactttaattgaatttagattaacaagtacactcatatctcagttggcatgttttttatggattcttttctaagagttttttgatccggtcaaaaacttcttgcatttcatatagccctataaaatcctatgtttaatccgaccactaacccaattcacgatcaataaatgatcgtcggttcagtctggcccttgatcccgttcccgtagatatttttttctttttggaaaattagttattagtttttcaaaaattaacacatgatatccagattttatcgaactatagccaactaatccggagataagtatcttggttaacacatgatatctaaattaaacctacgtaccacatgaacacaattcatttcccttccgatatttcatattttccatataatataaaaagggtaatactaaaaaatcaacaaactaaaactaattagtttttttttttggttaaatgaattagttccacaattaatgtttagatttgttatttgtatagattagcaaattagttatggttaaatgaattagttacacaattaatgtttagacttgtagataagcaaattagttatggttactcaaatcagttccacaaaaaaatgtttagttttgtatcttaccacatcttgttgtcggtttggttagagagggacctttacatctaacctgtattttttgggcttcttctctttctcaacccattaaacacagaattcttctctttctcaacccattaaacacagaacaagatatgtctcgagagagttatcttaattaattcaactagatgagtatccatgctacgcgtgggcttttgttttaaaagttgttatagcaattctctgttgatagtttttgttgttggttatgttcatttttttatgagcatttgttttaaaaattgttgaaatatctatattggtagttttgttgttaattatgtttatatgttttttagtaaagttagatctacttatatagttataaaactagattttaacctgcggtataccgcggaaacaatttattttttaaagttagtatatataaaagtttacaaattgtatctatctataaaataattttattttatagtttacaaatgttattaaataacgtcctgctaaacccgtcctgtaaaaaaaaaaccatttattttattaatgttgatcttatttatgatatgcttatgaatcattgtctaaatattttgtaattttgtagtaattaaatgctatcagattatatctctgcgctttgatgattataatcgaattgttatagttatggagaaaatcaatatcaaaaatgataattttatagtaattaaatgatattaaatattttggaagtattattttagtaaataatcgtgtagttaatgtggagagattttgggaagattgttaaatgtcaaatatttaattcgaagattttatttttaattatcaaaaacaaacattaaaatccagtggcagccattgtaaataagtcccaactacaggatttatttcacaaaatggctgcaaaaatgtatatatagattagattcatcttggctccagatgacaattaaacatttcttgcaagtgaaactataaactaaaattaaattgtcatcgtggaagagattttggtagagagatcacattgtaaccaaaatatttttcattacttgtctcatgtgtactaccttgaaaatgaaccagaaatatcatgtaatcgtcccaatgttaaaacttttaacacacatttcaattcttaaaatagagcaaaggtttgtagaagagactgtaagatcctcatgactattatagccgcttttgcccacataaaaaaaagaatttttggtgagcgatagatttaatcaatcacataactctcacaacatctagtttgtgctataatcgttgcatggttatgcttaaacttgtgtcatcccaatcatttggtcccggtataccagcttctcatacttgtcatcatcaacataatgattcacactgtaaatgataggtgagatatagatttagatgatatattttcaagatgttaggaacttattgaccacaagattgggcccactaacagaattcaggatatgcataacttattgtatatatgatatataacttcattgacaaagctctattaggttcaaatatttactctttgttttgaagatcaaagagcaagtcaagcatgtaccgttactaaaataaaaatttaatcatataataaaattatagtaaaaatattaatattttttttgtttgagaaactatttgggtttctctttgatggagatgctctttgactatatattttcggttaaattttgccaatttttttttaattttttaatatgctatttataattattttttccaaatacacgtattttttctttaagtaatgaggtgtcagaaggatgaagagagttcaccttctttcatatgattagtctccaaaagctttaatttactgaaagccttaacacaccaatactaagcctacaggctttagtaaagcccaaatcaatacaataaaaatcctaaattaataaacaaagagtcttcttcttcttctaaatcccaacggaaaaagaagaagaatagagttttcgcttaatctctactcaatacgttgaatttgtgaaagcggagatctacaaagcgtaaaagagttcttctgggtttcttctttctccgatcgatctgctagacgatgacgatgagtttccttctataaaaccagtaactacgagatttgatttataacaatcatgaaactctggtc

SEQ ID NO: 1324 - DNA, 3000 bp, Unknown
  misc_feature (1)..( 3000): cDNA_ID_2133561_gDNA_ID_1620387_Annot_ID_155494 3000 nt of promoter + ATG
gcagtattaatcttcctaagtggatcttccatagcaaccgctctatttaataacctccataaaaaaaaaaaaaatttggaacaatttgtagattccgtaactattgcgaattagtaaatgatatttttttctaacaacattctcaacaatgcatcatacacataattcataaacaatgtttgtgttaaaccaatttaatattaaaataaatatagtaatagtacaattaaatatgttaaattaaataataaatatatcattaacctataaattagaagttgaagagcttacattaattattctatagacacatgacaaataataaaataatgatgtgtcaattatatggagagagttgatcaactttcgtatatataatttgtttgcatgtggctttttattattgtaaattaatttgttgacaacatcggcctatggcttcatacggaaaataatttagtaaatataaatacagatgaaattaaacaattactgcctaaaaacatgtcttttgactggagcaaactaatttctttacctcacaggtgatctgtttttcaggttgacttggactaagttttcttgagttcatttatgggtcaccaaaccctatcgagagaacaaagtcttgcactgagaggtaatatgtttgaatgcatatagacggcagcattgacacgtacggtactgcacgcgtttcttagtcgaatcaccaccttttgtcttttggtttattttgtcaaaacctttgttttagttttttaattggtgtgaagcgatcgttattttcggtgaagaagaacttttcttccctacgtttgaatctttacattacaaataagggtttggtgaagcgttgactctcaaggtcttttaacttattctatacaagatttttactattctttttgatttgtaatgtgaatttttaagtattatgtaatgcggatgagaagtatagtgatttggctatattttttttttttaatataatgttaagttatattcaacaaaaaaatatagtttttataattagtgaggtttggtaattggcttaaattacgtaaatatattgggatatggagatttaagtatattatttacatttaactttatcttagattagaaaatctcatctctatataaaaaaatataatttataattttatttttatgaaagtctattataattcttcctaaacacttatgtattctttattctcatcaaatttatcaaaatatgtttaaaaatgaataatgatttgaggaaatttattttaaaagaaagcctttattaaaaaaagtgagtcatatacatatataagagaaggtacaaaaaaaaagattatttagcttaacgtgaagttaaaccttctagaatgctttttttgggtgggtctcaaactctcaatggtgggatcatattaatcttcatggccacggtgtttttgcgtatatttgacggcgtcgtttcgtacacttcgtgtttggtccatacgaaagtgctttccatcttccttgggacattttctcctattatcatgtgtgtaaatgtctccttttcgatttagtcacttgtcccaaaagttttgaagaaaataacatcatttgtgtttcttttttagtgttctctttaaaatgattgaactgtctaatagattaattttcgatttaataaaattaactgatcgccaaaagcaaagaactatcaatttacgtgattggaaattacgttaaaggagactgactcatttcaactattttcattttggaatatattacagagaactaaagaccacatgtgaacgcatagagtattgcgagagatttgactatctttttctccaaatctttagtttttgtcaaagaaacataaaatcatatactaatgtaatctttatttaatttaccctccagaaaatcagtagacagacatgtgaatgtgattatgtcgtgattactaactaatctacctaatccaccgtaattatatactaattaaaactgtattactgtttaacatttctcttttgtgtttcttttctttgagaatataattgaccgcgtcaacatttcatttgttcttttcataaccttgaagatttgtcatattaacgattaaaaaatctaatatagaattgtgtagtacgtataagacttcttattgcatatagaacttcccaccattagtacataacaaatattaaataggtagagctattaaaacgtttctaaaactaacattaatcagaatcaaacatttacaatattttagaaactcatgcaatacaaagtgagccgccccatgtggttttaaatattaaccttaatgtccttataccgattacaaccttaaaaatgtcacaagttgtaacatataaaaagaaaaaaatgttaaaaaaaatcccaaactttaaaatttgagacaatttagtcttgaatttcacaaaagacaaataaatcgtaaaatttttgttgagtttcgaaataaatgacaaatttattgttgttatttgagttatgtgattaaatatgttaacaaaaactttttacggcgttaatgtctcgtttatttactctgttaaaccaaaacgacgtcgtttacttcaaaattaaatcatcttaaatttaaaaattcgtgatttttttgacatttttttctatatagaactgatttcttctcttttatttattctataacgtagtgacttttgttttactaaaaaagaagttttttaaaaaactttatcatattataattatgttattaaataaattaaataaaaaaaaactttaaatttgacaaatttgagtgttacgcttacgtcatattgtgaaaaagagaaaggtacaaaatgggcaaaaatagtcaacaaagaacagcttctccgactttcgtagcctttaaaaaagcatccgcgtttgcttttctataaatatcttcgaaaccccattactctcaaatccaaccaacctttcaaaacagaacacgaagacatg

SEQ ID NO: 1325 - DNA, 3000 bp, Unknown
  misc_feature (1)..( 3000): cDNA_ID_3061722_gDNA_ID_1620387_Annot_ID_155501 3000 nt of promoter + ATG
gtataatgcgcgtgtgggaggtagagagaggagagtatctgtacagtattagggagagagtaggagaagttgacgccattgttgccgatgatagacatgtggcggttgcgtcagcttcatcaacggctcagagtattatacatctatgggatttcggtgcactgtagcgtaccagattaataattttttttttttaacttgaagaaaaagaaactatttttctctgaaaaagcgaaaccctaaacctaggtgtatatgtagggtttctgattataaattaaattgggaaagtgacggagggaagatggtgacaggagggtgagatttacaagggagattgattctttctacagagtttgaccaaaaaagtaagttactgtttttgtctaaaaccaaacaaagtggactttttcttgttgttcttgtttttttccttgtgtttagggctctctcaattctgactttgtacgagatgtcttttttttttcttctacttgtaattcttcactttactggagtttattattttgtataatgggttttaaatacattttgtgtaaaaaatatattttacaggaggtgtagacagaaacaagatcaaaatcgaaagaatggtatagaaatatgaatcatgagatctagatgtgatttgagcatatcccaattttaggatatattggagtgaattgataagtaaaatgttcaacaagttattcataaacaataacataagaaaagagcataattggacacacccaatatacaaacaaaacggctaatctcattgaacaaacaagatgataaagagtgaaaatcaaaattttccaagtttgaaatagcgttagaagcaagttcgagaagaccaaacacacgccaattcaagaaaaagttgcactctacataaaatttgagatggtaaccatatattgtgactttaaatcatagttcaaaacttggattctcacaagaatgagtcacgttgtacctaccggtccctaaaaaaccatcacataagaacacaaacagttaggatctaaaacatgttatttagaaacgaattcgtaaggacagttctcaaagagagggaaatatcaatttgatatttatgtatatgaaattacaagatgtttgatataatgccacgtttattttgtcttttaaacagattcatgtgtttgaattttcacatctattatcttaattaagtccacaaggctttgtattggaatttgcagggacaaatcaacttatgcaaataatatgactcttgagagaccattgatgcatgtttcattattagcgaatgtgccagtcttttaagtttcaggtatgcggatttgattgtatgatttctagtgtttttcatgttttttttttgttatatataatgtctaatgggctatttctagatagagcatatacaaaatcgcaaaaacccaatccacaaacttcaatacaataaacaaagcagctcaaaactaaagccatctcaaatttacaaaccgaatttaactaaccaagattgaaaaccctaatctcaatcaaaaaacatgatcgagccgccgtccaaaactgcagattctcgctgaaataggacagccaaacgagatggtgatccaaaatttgttgccatgccgccactgtagagttgttttgagaaggaggaagagagccgatctcgtttttgttgaagagatccttgctcagtcatgaaagagagaaaatagtagggaatagaaaacagagaccttcgacgttggcttcgctttgccggatcaaatatacctcccccatcgacaaagatctcgtggaaccgccacaattttcggtctcagatctatctacttgtctctctcgttcttcgccgtagatctcccttttctactctgcatcgctacaccgcatgtggagctcttaccgttggtatcaggcggaagcttctcccctccacatctccttgattttagtcggattgctttgcctgaaaaatgcagcatgttacagatgacgaactatgagcttttgggtcctcatcttattttttttttttctcaaacaataattttcattcacttaagcctaaaaaaagggaagttcatacaaattagaactaagatagtacaagaaaatgaagatagaggcttcatgagttttgcaaagaggtgttcacttttaaaaaagtttacaaggtttgaaaaatctgttgaggctttggcggattcgaccatgaagacgggcttcgcgaaatcctcgaccaacgtgtggtcataaacggctattgcaaacaatgcatatgagcctttgaaaaggtgctccacgggagaaaataaagggtagatcataacgccgctctttgccaagctttcacagatttgcaacttatccgtatacttgaagataccttgaaggagcttggtaattggcgggtaaggaggtagagagttgaagaagcttcggtaaccaccgctccgtggagatgggatcataatggcgttcttcttcactcttttggacattgccaaaggtttgggatgatagtctcaaatagggttcgaaacaaaattaacaaatgacctcgacaaaagtatctatcaaaacagcctaaaagaactgttactctgttagcgtggagtccacgaccagccaaaacaaagttaaagggtgctataggggttgtaattgacagaaacataacaatacggatcatgggcatcaagactctaaaacacttcaaaagtggagttagcccaaagctttttgagatcagatttgtaacataaaaccaacgagctaacctatttgccaaactttgtgggagagaaaaccaaaaccaaacaatgaccatcacaactaatctcggaaggtagctactctccaaagacgagaaagaaatcaaaacgtttgggtttgctagagtgaaataaagacctaacctgggccaaacaagatgtgggcttaacctaaaaaaactgttcatgggcttcgaggacttgaaaaatg

SEQ ID NO: 1326 - DNA, 3000 bp, Unknown
  misc_feature (1)..( 3000): cDNA_ID_2133573_gDNA_ID_1620387_Annot_ID_155498 3000 nt of promoter + ATG
tcaaaaataccaaaaaagatcgattaaatgaaaataaattgttatttaggcagagccgtacttcatgtaggaaaaagacatttgtcttaggtcatacaaaaataaacaaataaaatgccacatttatttctgaattactcagtatttatttttatttagcgttttaagacttttgttttggaaagaaaactcatcaataacatttatggaaaattttgtttgtttttcctttacattaactactaaatcttgtttgtactgaaattgtttcttaaatgagcaatatatatatatatatatatatatatatatatatatatatatatattatttttcttaacattcaaaaaaaatctcaaaaatagaatgtgtgagactacaattttagaatatgtcttaagcctctattgactttggcacgatactgtataagggtttagatattggagtcaaacaaaaaaaaatcaaatcaaatatttcatccaactctaactaaataggcatgactaatgcaaacacaatttaataaaagttatagggtcatctttgtctttgcttcgttggtcatcttgagaacacggtaagatcacctcaaaatatacaattttggtcaatttcatgtattatgtctggtttcaatttgggtgtagacacaatactacaatagcgattccattacaaacactttaacgaaaaaatcaactttattttcttcaatttatttaatttaagcacatatatatatatatatatatatataaatcctggttttctatcctactatattatttgggaagtacattttaaatataaccttattttttgtaagtaattacatatgtatgccattagaaataaaattttaaagagtaaattaattcatttctttaaaaattaaaaagtcaatttaattaattaaatttaactcaaaaacgaaatacattattaatttccaaaaaagtaaccaattaaaatcaacaaattagatttgatatctaaattatcatattaattttttattaattattatagttcacctctcatctttatatgattttatttttgcaaaaaaataatatcatcgttataaaaaaataattagagtttttttcgcatatgccacaatttaaatttaaaaaaaacaaatataaactgttcaatacatgaaaaaatactataacgggtcaaaagtagatttaaaaaaaaattttactgagtactgtgttataatttgaatatttatattcaatttcatacatattattttaaaatttataattttatatactaaaataattaataacatattagattttttaatgtgtatgatgtgattcaatttttaatacaagttggaaaatcctagaattgacgggtttaaatcaatattaatacaagatggtatagtacaggtgaaactctaaaattaacaatcaaaatacaagtatataattttaaacattaaacaatataaataatatcaacaaaacatatacaactagcagtttactatacatttaaaatcaaataaaataatatcatatatttgtaatcaactttacaataaaagtttttagtttaactaaaatataagcctacctgctgtataatgcaagttaaaattataaataagcagattaccatcacgatggatgtaccttctcacatacacacctatcaaaaacttaaaacctttcaaaacctcttggtatattcaaattaggattcttcattcatagaatcattattccaagggttttgggatgtcttatgaaatgattttggcagaagaggatgtaaatttttttgaataaaaggtattcaacaaaacatatgttttattgggattttttagataattaaatcagagaatagggctgggcatatgagtaacccattcgagttcgggtagaacccgttcgggtttgggattaatgggtatatgatttactacctaatagaataattctaaatattcggttcgggtcgggtccagttgggtttgggtcagtttggataaaaagtttcaggccctaaaaatactcaaaaaaatagaaacgagtattttgtatgtagatagtgcgtctctaaacaaaaaaaacttttaaatttattaagttttaataaatttaattatatttgaatatattttactaaattttgacaaatataacaaataattttgataaacataacaaacataacaaagtatacaatgtaatttatacaaaatattaatgcccgtgctatacagcacgggttatgatctagtcctaatatattttcaaagtcaaatacaattttaaacagaacttcttacataaaaataatcagaatcataaatgtaactgggagacaaagatacataaactgataaaaagaaataagatgtacatatagaatcaaatcaatacccacttctcgtaaaacccactcatcgttatattttatacaagataagataagacttaagagtagatgttaaactatgctaatgaagcaatttaaaaacaccaaaaagaccaaacaaaaaacaaataacaatgagtaggttttaggagaagcatgtattgattcttggtatagttgagtttatttatattttcattagccaatcactttttctaatttaactaaaaatgttataataccttccccacctagatgatgagataatcatggacccaaaaacctcagtttttaaaaatgtttattcaccaaaagacaaaaacaataataataatcaaaagtagagtaaaagaagagagaagtgacattctttttctttagctcataatttctctaacaaatgcttcttttatccaaactctgatcattgagtccagttgggtaatgagagacaccagctgggtttcttttgtttaagctcacaaacatctaaaacagagaaagctttgtcatttttctttaccctgaaaccatgaaagaagataaagctttgtcctttttctcttttccgtttctttactctcaacaatg

SEQ ID NO: 1327 - DNA, 3000 bp, Unknown
  misc_feature (1)..( 3000): cDNA_ID_3061732_gDNA_ID_1620387_Annot_ID_155493 3000 nt of promoter + ATG
tgtgaagatatgtctaaggtttgtgttatcattgctgcaggtgctcctgtacattgcttttgctttggtactgatatttcctttcgatattttctacttgtcaagtcgatattttctgctgagaacattatggaggatagcttttccactgcaggtaaagtgatagacagctgttgattaaaattaaacttgcaattggcgaatttctaggttttgcttaatagctggtttataagtgttatgcttgatcagtgacgtttgtgtttgttcaaactcttacattactttggtatctttgtataaattcattcatttaggcataaatatctgatcctgtttcttttgtttcacagccaattacatttccagacttctttttggcagatattctgacctccatggtaaaggtattaaatttcaaccagttctctgagagatcttcctaacttctaataattatgtggttaggaatatattgatagcaggaggcttagtataacttgtgccttttttattggccaactactgctctttagcattttattttgtgctgataactataatgccgctgatacttgattctcattcaagatttgacatcggtaactatatgcaggtcttttccgacttagagcggtccgtttgccggatggtgcatagacaggtaattgattcatttttttgtgacatccaatgtagattagaaatatcttatgctggaggaactagttccatttatttcctttgatctctggaatatatggatagctctgtagctaccaaaatttatcctccaagactgaaaaacagcgggatatgatttatttagccaaattttcgctatcctagttttgctgatgaaccaatggaaatcctggttgtctgtctaacatgcacgggtctcataccgtgttgtctgttgtgaaatgatggaatatatgagattaaaatggactttcaggtcgctacaattgcttggtttgaagctgacgctgtctgtggcagtcatcaaattgcaatcccattggttcttgttttcccctacatttgccgtcttttgcaatgtcttcgacaatacaaagatacaaaggaaaaatcatctctattaaatggtaaaagcctaaccttctagcattaatgttaaattttcccacactatgaagaaagatgttcttttcctaccatcaatcttatagttgatctgtgattttttcagctctgaagtattctacagcagtacccgtgatcttcctttctgcgcttaaatatcacgtgatgcccgagagctggacatcattttaccgaccgctctggcttttctcaagtgtcatcaactcactgtactctttctactgggatgtaactcgggattgggacttgaggtaataggttgaaactgcatcttcctatccactaagcagtatttgcatatcataatcacataacttctctctgttgtgcagcggtttcactaagatattcaagtttagccgtccaagtaccatatcaaacttattatatggccgacaatgggtgagattcagtttccaatgaaaccgccatagtgttttcttcgtattgtgatgtctgaacctgtcaagtattgttgcaggtatatttctgggtgatagggagcaatctggtgctaagatgcgcgtggacatacaaattatcagcacatttgaggcacaactacataacggtgttcacaatgacagcgatggagatgttgagacgatttcaatgggtatttttcagagtagagaatgagtggaacaagatcactaaatcacatccaatgggtgagatttcacttgaagaagataaactacttggttctactacacctcatgatgtttagcatccaactatttttgtttatttcctctaatcctatgcaaaattctggttttcctattcggactctagacacttttagattatacacaatttttcatgaattgaaccaaatttaatgaatgacatattaataggaaaaaatattttcatactgtttaactgagacatcagattatatacggagatctgctataattaacctacaaatttttgtaaaattacctaacaaaaaaataatatagaccttctaagaacattttccccccatatatggtgttaaatttaataattctaagaagaagaaaaatctgagaattagggattgaagtttaatttagggatttatttgtcgttttggtcacaaacatagagccgataacggaggataacgtcggctaatgggtctgttaaacgatttaacgacattggacctgctcaacggaaagatcatgttttaaatattggtcaacgataagttgatgttttaaatgggttactatgaagttgacttattgaatgaccactttttgaaagttaagggattaaacaacatttttctctcattttagaatgtgtgtacaacatttatatcaaatttaaaaataataatattgaattttaacagtaaatgaatgttctcatttttcacatttcattctctatttttattatttttacactcatcctcactttcctctccctgtctcataatcccaataattatgttacgatatttttactctataatttgagttttgcattattgttcggttgttaaataaagtggatgggtttaagtgcttaatcacactttttaatataataggctgttacacctaatcgtgagagtaaataattgaaggcgaacaatggaatttatccctaccaccatttgttattaaacaaaaatattataaaattatatgtaaagaaaataaaatatagctagatattgataaagagagtagcactaataatgaaaagcaaattccaagttgcccacttgcaaatcaatctttcacacaaataaaaacaaagcccataacgtttcctctcttcaaagtgcctatatcatcaacacaagaaacaaccaaaagagactaaactaaactcctaaaactcaagatcaaagacaaagag

SEQ ID NO: 1328 - DNA, 3000 bp, Unknown
  misc_feature (1)..( 3000): cDNA_ID_2133537_gDNA_ID_1620387_Annot_ID_155487 3000 nt of promoter + ATG
gattatagaatccgttgtaattaccattctctagaattaatatttctttgtaaacactatatattcctctatacattttaagggtgattggattagacttttaaaacttacgaagtttttgaatgttttcaatgcttttttcaatcaatttattttgtctttcatatattttaaagcttttgaagtttcttttttattttttactcctgttttcatatatttttataagtggggtatatgtgaccttagaaataaataaataaaaagcttatactagttttcttcttttcttcttcccaatatttatataaactctcataacattcacaaataaattaatttttgaaaaattttaattgatttgtaaccgatttttttttgttcttttaagatccattttcccatatatttgatagttatttaaaatcgtaatttttatagtcacaatctttaccaagagtataaaatttatgcagttaaagtctttatagcaaaagtttctacagcgaaagttcttaccgtcaaaatctttacaacaacaattaacagtcgttatcaatcctcccctctattggtaatatacaattaattatcattctctagagagaatagccaaaaaaaactcaaagatagaagagaagagacatgatagaacatagagaaaagatggtggtcaagaagaaaaggaaagaaaagagacaaggagaggaaacatcggagaaaactaagagaaggaagctcgacgatcaaaaacttcaaaaaatagctaaaaaaaatagttaaaattttctattttaaaaactctttgcttttttcaggtttctcgaaatttgtatctgagagagtcccttacctacgcttttgagagagtctagttatttttttccattttaaacatttaggtgctatattcttacaccccacattcaagcattcgatttcaaaatccaatctacgttaagtaatattatatgtcagttcaaatccattaaaaactcaaatccaataacgtcctcttagcaacatttgtatgtgggttattcacataaagcgtctttattaacagatagaatatccttaaatattagtttgaaatactatggatattcttcatgtatctagaagaatcccataacatattgtatctagaagactttcaatatctttcacggtattagagcgcagctctttctaaatcgcttcttttctgattaaatctttttcttttctctttctcgtcctctattctcttcctgttttctccaaattctttcaatggccgacgcagtcaatccctctaacaagatctatggagtctctaacatcaagtctcacatctctgtgatttttgatattgaaaaaaaacaactaagatacgtggagagaactttttctcacccactgtctcagctttgacgttctcggacacatcgacgacactctcctcccagccgatgacaatgatctcgtgtggcagaaacgtgatgggattgtaaagctttggcttcatggtaccctcaccccaaagcagtttcaaggctcattcatttccggatcgacgtcacgtgatatctggttatagatttttgttaaataagccaaattattcagactgttaaatggtttgattaaaccgataatttttccgttagataacttaacaattcagcgatgtaacttatttagtaaaatcaacaaaaaaaattaggttgaattacattgattttgtttcttttatttaagaaggagtgaacccaagaattgttcttttaatatattattagtaattgaactgaaaatgttgaatttctaaacaataataagaaggagataatatacaataaaattagaaatttaattcaattgagatcaaaaagttcgtttacatctgagtttcctgctttttgatggatattttttcttatggttttgatccgatcaaaaaccttattatatttcatatgaatttgtaagttcattcggaccatcaatcctgttcacgaacaaatcaagtttgaccatcgatgacgactttcattccggcattagtccatggaattgttttcttttctttttaacaaaatcagtaattatattagttattattttaaaaatttagcacattatattgagatatcgaaacgctataaatcttttttggtcaacatttggaccacaactggccgacccattagccaattcactacaaattgtagggagcgggacttgatctctagtgtgatggtgcctgtcttcagtggacttatctctattaatcccgaaataaataaacctcataataaatttttttatgaaagcctaccatagttaatttatggcactctacgcgtgcttgattattttttgttttctttaggatatttcatatttcccatataatataaaaatattaaaaaaatcatcaaactaaattagttatggtttttttaactaattaccaaattagttatggctacacgaatgagttccacaaaaaatgtttggatttgtagcttaccagattatgttgtcggtttggttagagatagagcattgcatctaacctgtgttttttttgtggcttttcccattaaaaagaaaacgatatgtctcgagagagttgcctttaattaattcaattcctctgctttcatatacagtactacaaaagcctaaccacatgcatttcctatatattgcctcttcgagaacaaaatgttattcactccaaatacaaaggaaaacagaaacgtagccaaaaaaaaaaaaaaaagaagacaatgataaagtctatcttactatgtttcttcttccttttccctctccttttaaccctctttaagaagcttttaccttcgaaatggaagcttcctcccggacctacaggtcttccgatcatcggaaacttgcaccaagcttggaagattgcttcatagttcttttcacaagctctctttagaacatggaccagtgatgcttctccgtttcggggtcgtcccg

SEQ ID NO: 1329 - DNA, 3000 bp, Unknown
  misc_feature (1)..( 3000): cDNA_ID_2133515_gDNA_ID_1620387_Annot_ID_155482 3000 nt of promoter + ATG
gaagaaagatgtttccgcctctggattaacagtcttggcacagccacttatgtcaataatgtttttgaggatcttaggaatgggtgagctatggagttttgtttgaggacgttttatttttgtatctgctttaatctaaacctcattttattcaggtgggttcttcttgaagttctcgacaaagtttcacctggctcggtcaactggaaacacgcaaataaacctcccataaaaatgccattcaaaaaggttgagaactgcaatgaagttataaagattgggaaggaactgcgcttttcccttgtcaatgtagctgggaatgacattgtgcaaggaaataagaaacttcttctcggtgagttctcctaaaagtcacactgataagattatgcaatttcatataacagactcacataactgttagtattgttttgttctgtcttttctcttcttgaaagatgcatctgctatagtaagttcattctaattggtagcagtatataatttcttgtaccatcattgattctgcagcatttttgtggcaactaatgagatatacaatgctccaacttctgaggaacttgagatcacactcgcaaggtaaagaaattacagatgcagatattcttaactgggcgaataggaaagtgaagagaggtggccgaactagtcaggctgatagcttcagggtaagtgttaaccaagtacggatgtgattcatggagactcatcttcagaaacctaatagtttgatggttgcttttttctgatattaggacaagaatctgtctagtggaatgttctttctggaacttcttagtgcggtagagccaagagttgtcaactggagcctcgttaccaatggagaaacaggtaaaaactatgatgttacaacttcattgctgggtccttattctccggtgttaagtcatatttttgattgtctgtaccgtttttgtttgtttgtaattggcacttaaacagaggaggataagaagttgaatgccacatacatcatcagtgttgcacgaaagcttggatgttccatattcttgttgcctgaagatatcatagaggtagagacatatatatggtattgaaacagacttgagtgcttcttcggtttttctgagtcagtaaacttgtgtggtggatacaggtgaaccagaagatgatgcttatcttggcagccagcatcatgtactggagcctccaacaacaatcagacacagagtctactgtctcagaagacgccactgatgatggcgacgcaaactctgtagcgggtgaaatctccaatttgtccattgatggagcttccgagtccagtcccactgtccaagatcaagaattgctgacgaaggcagacaatgatgaggatgaggttgatggtgagaataataaagatgcatgacgcgtttgaatgtttattttgatcgttgttttttggtttattgcgtgaagttttgattggcacaaaggaaacacaaagaaagaagaacaaggtttgatatgtatacaaacaaagagggttttggtacacaagttttacattgtgtacgtaaacctcatttttgaattgttaaagttctactttattttattttgtttattggaccttttttttttcatttccaatttcatttttgtttatcaccggtctaaactcgaaattgtataattgtttaggcagaaaacaataacatttagtttacaatgtgtacacacaatatagaatttttatataaaaaaattgcaattgttcaaattgtcataatctcgaatttttttcattagttcattcttttatcttcataaacataatgtttagctatatttctctaaggcttattattattttggtcgaattctctttcggactaatttaatttacccaccaaatatttttatttttttttgagaactacaaattttgtgacattagctatatagtttaggccaccaaatttacctttatttactcatattatattttatacgaatttaccacattactgaaaggcttaaagcttctattatttgaaataagaaaaatagtaaatatagaaaatacaatgctgcttcatacttctccaaatctgttcataacacataataacaaaaacaataatgataaatattaatacttaaaaagagtcataatattgtatatgatacatacatataagcatcacaaaaagcagctctatgagccatattaaaattttaaatgaagattaagcttgcgataaacttactttgatattcgacagaaacacaactgattttgcagaaatatcattttggtggatttggttttgattctagacatttattgccacatttttcaggacatttttttttgtttagaaagattggattaagaaggcacagtgcaaagcatgtagtatagcaaataggaaaagttggttttacagtgattggagtagttgctatttcccttgattcaaccattagggttccaatcatcaacatcaccaccacaaatacacccattcttttgttctccattttatatgagtacaaatagttcttccttttttttttttcttgagaggatgaaatattatagaaggttatggaaaatgtttgtttattgtgaatgttattggagtacaatatgacttacttatatagagattgtggtatttaatttatattaggttagaatattcttaatcaacaacaaatttgtttagttttttggttaaatgagttgtcattgatttaatagggtttataaaagctactaattaataaccaaagagaatcaaagctgaacctttttgtataaaaacatgtgtttttctcttctgaatgtgaatgttagtgatattactaaggcatgcatgctttagatagagttacctttttttgtatgatttagatagagttacttcatatagagattgtgtaattttgtgtattagttatgaatttaatattctcatatttcaccaacaaatcagctgcaacatg

SEQ ID NO: 1330 - DNA, 3000 bp, Unknown
  misc_feature (1)..( 3000): cDNA_ID_2133523_gDNA_ID_1620387_Annot_ID_155484 3000 nt of promoter + ATG
tggatttgaactgacatataatattacttaacgtagattggattttgaaatcgaatgcttgaatgtggggtgtaagaatatagcacctaaatgtttaaaatggaaaaaaataactagactctctcaaaagcgtaggtaagggactctctcagatacaaatttcgagaaacctgaaaaaagcaaagagtttttaaaatagaaaattttaactattttttttagctattttttgaagtttttgatcgtcgagcttccttctcttagttttctccgatgtttcctctccttgtctcttttctttccttttcttcttgaccaccatcttttctctatgttctatcatgtctcttctcttctatctttgagttttttttggctattctctctagagaatgataattaattgtatattaccaatagaggggaggattgataacgactgttaattgttgttgtaaagattttgacggtaagaactttcgctgtagaaacttttgctataaagactttaactgcataaattttatactcttggtaaagattgtgactataaaaattacgattttaaataactatcaaatatatgggaaaatggatcttaaaagaacaaaaaaaaatcggttacaaatcaattaaaatttttcaaaaattaatttatttgtgaatgttatgagagtttatataaatattgggaagaagaaaagaagaaaactagtataagctttttatttatttatttctaaggtcacatataccccacttataaaaatatatgaaaacaggagtaaaaaataaaaaagaaacttcaaaagctttaaaatatatgaaagacaaaataaattgattgaaaaaagcattgaaaacattcaaaaacttcgtaagttttaaaagtctaatccaatcacccttaaaatgtatagaggaatatatagtgtttacaaagaaatattaattctagagaatggtaattacaacggattctataatcgaatcaataaaacattctaatcataatggaggatctttgaatattcttgacaccccccctcaagatggaggtgcaagggcaacgccaatattgtctcgaaagttaaggaatcttgctcttggtaacggtttagttaatgcgtcaacaagatgatcgttggtgttgtcatgaacaacgcgcaaaactccattctgaatctgccctcgaataaaatggtagtctacatccgagaatccatgtagagttagctcattctttgctgcaaagaagataccatgagtagtactcccgaccaagtaacagagaacccgtttggcagattgaagatgatcagttgtaggtttgtgcataaattatgagagatgagagttttggcaatatttggaacacattaagcattgtttaaagtcaggtttcgagtagtagagggtagggaaagtgaccagtatgcgtaattggaatacccgaaccatctccgatgagaacagattcatcagcaaagtaaggatgatgcaaggctaggttgtgaagatcactgtttaagcgatgtgttgcgccattgtctagaagccacatattggtggatgcggggatattgcagcgagatttgctcgtgagtgccacagacagaaaggtgacgggagtagacattgttgtgggttggtttgttgctgatgaagttgaggacatcgtttggcgatgtgaccaaacacgccacacaattgacactttctttggtagccctttgtcattcagttgtcagatttgagctgataggtttgttgatttttaccattctaagtctgtttttgagtaaagcgttgtttatcttggtgcgatttttggttttgtgtacgcgagacgtagtttgccgagatcagagcaacacttggcaaagaggaggaggctgcctataattctaacattaacatctacaaaattagtttatgacgcgtttataattcaaaactaacaaatgattatttaaaaattgtgaatgatacattattgagaatattattaaaaaaagctgtaacactaaaagtagtactcattaaatgagtggatgattaaatatttcaaatttatatatataaaaatatattataaaaaaataaaattgcagcatagcaaaaatgatggtctaatattattaatattaaagtttaagttatttataattatctttaactatattatttatatttatgtttattttatattaaaatagttagattaatatcatcctttatatagttatataaaagaatataatgtataagtttagttttacgagaatttattcgaatttttcttaaacaccaatgtgtttttacaacgattaaatctaattatttcaacaatttgttcaatgttaataattattttttatctttcttatattcttttaacgatgaaatctttcaacgattatcaatgttatcaatcgttgaaagatttcatttttatctttcttgtaatttcaacgatttgttcaatgttaataagaaagataaaaatgattaaaattaaataacaaaattaaataaatgccaaatagaaaccctcaccttcttctctctctgtcaaatcattccatttcatcgcaggtcgtgcgctcgaaaaactcaacacgaaattcattatttcgaaacagatctctttttaagcttcaaagatcaaaactttatcctgataaagagaatatgaacacgaaccacattcaatctctcaatctgctctaaggtctattatcatcttttcaatatttcgattctgatcatctcttttttcttcttcccattacatcggatcgatgcatcaacgccataattatctcaaaatcgtttctttgcgtgtttgtttatcgaattgccatttttgatcttgtgggtcaaaaagtttggtcttttttcttacaaattttctggttcctgtttgattaaagacatttttatgttgcagggatttgttttgtcttgattctgcggagaaatcgattagaaaaaatg

SEQ ID NO: 1331 - DNA, 3000 bp, Unknown
  misc_feature (1)..( 3000): cDNA_ID_2134315_gDNA_ID_1620388_Annot_ID_155512 3000 nt of promoter + ATG
catttcattcgccaaaaatataaaatccaaaagtgtcacaacaaatgtcaaatacaataaacggtggtatttaagaagaaaaataaatctaaaaatgagtcacatttgaaataacattttgtttatataaatggcctcactcccatcaatcggtttctttctctctttatttcatcctctttgtttacttttgaagaatgttcaattctttcatcattctcttgtagaaacttttataattattttacttttcttttctactttattttgtttacgtctcgtgtacttccagatttaacaatttcctctaaattcatgtattttacatatacaagcaaaattgagtattattgctctgttacaaattttgaataccgaggaattctacattttattttgcttttttttttttttaacaacaggaattctactttaagtataactcagttcatacaaaacccacagaaaaatgaaaaattgaaggatgttcattcaataatagatattctaaagtcagaaacctacaatttgaagtataatatttttaaatctcttaagtcagaatttttgtttatgacatcaacaaaaaaatattctaaatctctaatacactcatacatatattgcaaaatataatttcttgatcacatttcatgtaatagaaattcagttgggggtaaaaccgtcatttgagaaaaggctaaacataccatactgttgttgcgaaaaagacacgcgtggccaaaaaacactaacaaaagagaaatgtaacgacgcatgcctctatacattttcttttcattattgcactctacttgttgttttttaaaacatcccaaaatttttaggatcgttgatcgtttataggacgagtttgtaaaacgtataatcgttctaattgagatattatcggttcttccactacatcacgtagaaaaagaagttgattttggacttctaattaaccacacttacaaagtgattatattcgaaccaatgcagttgcaaactatgatgcaacgggtaaagaattaacgatatataatagaaatgaatgtgtgtgatttcaaaatatagtatagcattaagctcactcacgtacgtacggagtctttaagatatgtatgcataagcgataatttaggtgattagttgggaaataatgaattcctttttggaactttatggatcatcgaataaatgtgagatatttaattcacccaaccttaatgatgaaaagtgaatctataatggcaagcaaccatcatgatacaaaccttatatgcccttaagtcaatttctacagctataactttatatatatagcattgacaaaagataatttatttttttcattgtgttactgtgtttttagtaaagaaaagaaaaaatatcataagaaatagacatcgtgaccccaaaaaaaatacgtataagcaaaaggcatagcttggatttcctagtagtatcaaataaataaatgagacaaaatatttctagtagaacgggattacgggaccatgtgtttgagatattttatgaaaatcaatagaaatagtaaatagaaaaatatgagaatataacttgtgttcataatatgatgatgtatatacaagattaacatgtaaattaaagaatgaagagacctagctcgacacattatttttagtagagcagaaccaggtgattgagataattcatgttcataattatgaattcacgagtaaataaactcgtaaatatcaagaatgtaagaaaaacgattttttttttcttcttcttatagtagtctaatagttgaaagatttatcatgtaagcgtagaatttaatgttgaaattatctcactacgatttgaatcatgctgagaattaagctaatgcttaggatggaatgttgtagtctatcgtataaaataactttattttagactacgataaaattaaaatcataaaactctcaactccaatcctaatctaatcaagtttttctaaggttggtagacaatagtagattttcagtgatcgtaagtattacttggcatatatataaacgaactgaaaaataagtcccaatgtaatatcatttcactaaaagtaataaagagatgcacgcgtatatatctatacgtatgaatggtctgatgaaaggataaaaaaagaatggtgtaataaatttgttataaaatcttgaatcttttaggcgcgagattgttgttcgaaaaaaaaaaaccgtaattcatatatatgtaaaaacttatatacgcacacatatatgtagtgggcatgagagttagtggagagacagaggattttagctttattggatcctgtgagtgactgggataaatacagtccactttcgcttattgtgtatctatgtacttgtacatctgcatgcgtatacattccattgaacattcaatttgtatgcaaaaggttttttaaaaagaataccatagtggaaaaaaaagaattttaatgaggagaagaaattaaaggacaaagaaaagatactagcaaatctaattaatcggtttttaatatgagtggcattgtgtgatttggtttctgattttacccaatacttgtatgatggcaaaacaaaaacaaaatctacaattatagtatatacgttttattttggttcataattaataaaggtaacaaacagaaaaaagtactagtatacgaagtacagtaatttgaaaaaagtaagaaaagtaaaagaagagtggaaaatggattgagttttttttttctctttgcttttgttttcttccccacacaaaaaccataatgccttaaccaacaaaagccagaccattagacgcactccacaatcatcaccttcatcatgacttcttcttctcttctcttcttccatcttcttcttcttcaaacccttaaatccaccattgtcaacactaacacctttctcaacaatatcaccacacttcctcaaacaacttcactttaatttctttctaaaagctacgatg

SEQ ID NO: 1332 - DNA, 3000 bp, Unknown
  misc_feature (1)..( 3000): cDNA_ID_2134337_gDNA_ID_1620388_Annot_ID_155519 3000 nt of promoter + ATG
ctaacttttgggtactgatttatgtatttctatgctcaaatgccaaatcatctaaattcgtatttaaacctgcttagggacttgacaattctcatagcacaaactgttttttttatgaatgtgggttggtttcaggtagctgatgcggaattggtgaaatctgacaagtttccggtagtggtgagtacttggcctttccttgaagctgttagagctgcttggagagcagttgataatgggagctctgcagtggaagctgttgttgaaggttgttctgcttgtgaagaacttcgttgtgacggtacaggtcggctttttggtccgataatttgaatttacttctttaatgttactacttctgaaagtgagagttttctttgttggtattgatagttgggcctggaggaagtccggatgagaatggtgagaccatgattgatgctttagtcatggatggggtaacaaatcatcagtaccctccgttttataaagccccatttgcattaagatcttgaagaatgactcttcatttgggttattctaaggacattcttaggtgactatggaggttggagctgttgctgcaatgcggtatgttaaagacggtataagagctgcacatctagtgatgaaatactctcaacacacgttgcttgccggagaaggagcatcagcatttgcaatctccatgggtctccccggacccatgaacctaagctcccctgaatctgtaaagaagtggtcggactggaaagagaatcagtgtcaacccaatttcaggaagaatgtagtccccgcaaatgactgtggaccttacaagccaaacaatagtgctatgaatgtttttgtagacaaaagcactgaatcttgcgagatgggggcgattgagtataaacctcctcttgttggtcctcacaatcacgatacgatatcgatggctgtcattgacagagtaagatgggtttagttatattctctatacatttttgttgcaaggacgagagaaactgagtgtgctctttcaatagatggggcatatagctgttgggacatcgaccaatggagccacatataaaattcctggaaggtaatgccattaaaaccgagcattatctctgacctaaaccgaacctatctatctcacatgcctcctgaatcctgattgttcaaaatgtgcaaggaatatgctcaaaatggatttccatgtgttatcaatatagattacttaatccatatttcatgtaaagatttaaaaaactttcaaaccttgattgttaaaaacagggttggtgatgggcctatcgtcggttcatcagcctacgctgatgatgaagtaggtggatgtggtgcaactggagatggtgacaccatgatgcgcttcctcccttggtaattacccaatctccttgaacaattttgtgttttgtttctatctcaatgcattctaccgacctagacaggtctttctcagtggtcaccaatgaatcttgccttatttttgcggcgctaaaattgaatattgagcatgtaaaagtgaaagggttattatgttttatcatgtgttaaagcaaacttcttcttcttggttggggttttagttaccaagttgtggagagcatgagacaaggaatgaaaccagaagaagctgctaaagatgcaatctcgagaatcgcaaggaagtttccagatttcgtgggagcagttgtggctgttgacaagaacggatctcacgcaggagcttgctatggctggacgtttcagtactcagtccaaaaccctgacatgaacgatgttcaagtctttacagttcttccatgaaacaggtaaattatatctactattagtcctatagaattagtaatttattttgttggcatcaaatatagactacttatgtacttatcttatcaagttaaatctcttgaaatttggttataggatcataggattgaaggtgtctaaaagtgattgtagtaacaacaatgaaacggcaagaagttcatgtctggaaatacggaatggcaagctcgtttggagtattctaaaatattgttttgcttttataaaaaaaaaggattttcggatttgtctgaattgatcagacaaagagactagatgatttttttttttttctgtaaacatgaacatagttgactttctgtaattttagtgattgagaatataacagtttttttgtgaaaacacgagcacataaaattaggagaattccttggtatatcctcgacgactctatatctagctatttaattattaaagaatgataggaaaaatataatatacaaagttatataacttttgtttctattattataaagtttagtaagaaaattgtataaaagagaagacgtgacaaaaacgaggagcaagtcatgcagccaactaaatcctaagtttagacataatttcaagcttcatcctaaatatgtaatcatatgctaacagtgaatcaaagcgaaaacaattctcaagcctttattgaatatttatttgtttgacttcgttttttaaagcgaaaactgcaacctgagggatatacctacgtagatcctaaagaaataaaacagagaaagtctgtattattgtttcaatgtatgaagaaaaagtattaaaattttatcaaagaaaagaaaaaaataaaatgatttagtgagctgactatgtatataatgaggttgtggcggcaacaacgtgcttgcttgtgtcctaatccttctctctccgtcaataatttcatctcaagaaaatgtcctaagatcaccaaaccaaaccaaacttagggttcttctttgttctctgcttcaacagaactacagggtaagctctgttatgtctgaagctccattagtctgttatatttacatctaaattcttctcaattagccctcaaaaactccatctcagactcttatttctgcaaattttacatttccatcttcttgcaggagtttgaaactctgtttttaagtttcagattaaaca

SEQ ID NO: 1333 - DNA, 3000 bp, Unknown
  misc_feature (1)..( 3000): cDNA_ID_2134354_gDNA_ID_1620388_Annot_ID_155523 3000 nt of promoter + ATG
ataccagtaggtcataaacttatacaattggttgagaacttggcaggggaataaaaacacacaagttttcaataatagcgaacaaaaacaactcataagtccacattgatacaactaattaaaacatgtttcagatctctctatatcatttacttcatctccatcacataccatctacacatctctctgtatctctactgtaaacaaataaagtttcaattattcatacactttttcttattccattttgtattctcacacctaaagattccaactttaaatctcttgcttaatactcaaaatccaatttccttgtctacaaaagaaaaaccaaaaaatccaacactattccatgagatgagaaaatcccatttggtaaaactgatacttgcagtatctctaccaacaacattcttgatcatgatcgccatcatcataatcttcatcttctgtagaagaacaacaacagagaccaatgaagttcaatacgacgtcgaatctccttacgagaaacaagaattttccgataacggatccgaaacagaggaggagcttatcatcttcaacggtggagaagatctaacgatctgcgatatactcgatgctccaggagaagtcatcggaaaatcaagctacggtacattatacaaagcgacgttacaaagaagtgggaaagttagagttcttaggttccttcgacctttatgtgctgtgaattcagattctaaggagtttaatggcgtcattgagtcacttgggtttgttcgacatgataatctcgttcctctgttagggttttacgttggcaacagaggagagaagcttatgattcatcccttcttcggtagttccgggaatctttctgcgttcatcaaatgtaagtctctgttttctactctgttttttttctctcgagaaaatgcgaggaagctgaaaaagattaaaaggaacaaacttttttaattttcggaccaaaagagatgtcttgagttctctttttagctgtcttgattcgtggaatctcctagattcttgttttctgggaaacaaacagagtcttgagttctcgttttcccgggtaaatggtaaaaagtttttaacgcacttatcgttacctatataagatgtctctgtttttgaaatatctatatcgaagatttcttcgtcagatggaatcatattggtaactgtagtcgatccataagaaatcgtcttatcttttacattttcataaatcgtaacatggaattgtttttttttatctctgacaaacaaaaaagtaagtttgtttattttgttctaggatcaccattattgatctaacttttgtcggtaactacttttttttgtcacttcccacttagtttgctcattatataagacaaaatctttatagatctcgttcctttaaaatctgtagagcatcaacatcagcattaatttttctaatcaatattcaataggttgtcttaaaaacagagcatagttttggcaggtggagatgttgacgcacacaaatggagcaacattttgagtatcaccattggaatagcaaaagctcttgatcatctccatacaggaatgcagaaaccgattgttcacggaaatctgaagtcgaaaaatgttctactagacaagagttttaggcctagagtctctgatttcggcttgcatttgcttttgaaccttgcagctgggcaagaggttctagaagcttcagctgcagagggttacaaagcgcctgagttgatcaagatgaaggaagtaagcaaggagagtgatgtatatagtttcggtgtgatcatgcttgagttagtctctggtaaagagccgacaaacaagaatccaacgggatctgtacttgatcgtaataggttgtcggatttgtaccgtcctgagattattaggagatgtctgaaggatggaaatggtgtgaccgaagagtgtgtcctcgagtactttcagcttgcaatgtcttgttgctctccatcgcctactcttaggccgagcttcaagcaagtattgaggaagcttgaagagatcaggaaatgatgcattagcaaacttgactaatttgtggaagagacataggaagagaaagattcaaacaatcagaaacctttttgcaagattgattcaatgcgtagggcggataagagagtcttcataggatgatacaatacatataacaagttctagcttgtggaagttcacagagaagtagttagtctgattatctacagaagtaactgaagatggatcaaggttttgcttaggaaggacttttagaacagagttattggagaataactgagaaaagagccaacaagagactcgaagaactttgtaaggcctctagtaatcatagaacatcatctttttgaatgtaaattgtctttgcagttgtatctttatagccttgctcggtctgtgcagatatgattcttgagttgtatacctgaaatctccaagaggctctctctctctttctttctctatatatatatggttcttgttcttgaaggagaactttgcagttttaagcaaagtatcatgaactaatcttgtggtgtttgttataaccacagattctacactttttacgctgcacttttctccatcaatacattcagtgttttgtatatattatccttctggggatggtattgatccccagagcaaaacttgtggattttcccgggaaaatattcaacaacaactaccgaactaaaacacactgaaaaaagtaccagatttaaacggcacggagtgttataattcttattacgaacgtcatggtgttatactccttctttttcaaatcggtttattcttttttccgttaagtttgatttgaaccggaattgatcggtttaatccggattgaacaagcctagtcttcttcgttttggtgatctctctctctcctatgaattgaattccacagagagattctaaaaatctttcaatcccacagattcggatttgtactccatactc

SEQ ID NO: 1334 - DNA, 3000 bp, Unknown
  misc_feature (1)..( 3000): cDNA_ID_2134378_gDNA_ID_1620388_Annot_ID_155529 3000 nt of promoter + ATG
taatttgttgtgtttgagaaagaatatacaataatagtaacttaagatttggtttttccttggggttaagttggtttacctgccaaactagcccttaagttttcatcacattcgtatttctcttaagctttacaagaatttctattagtctgaatataaatatagatgtcaggatatcttaacatttcgcaccaaaaaaaaagatatcttaacaaagtactgaagaaaatatatagtataataattgaagtgaaatcatacaattgagttagaaactagctagcaaaaattactttaaattattgcaattagtaattgttttattttagatgtttcatgaaacatattttttctttttccacgaaatttcttttagttgacgttcgtgaatcatcactttatttggaacaagataatagtattttttgcttgaagtcttaacatgcagtttattaaattcgccaaaaaacacctaccattataaaactttatcgtatattaatagaattgtccatagttagcatttaattaactttatgttcgacgaatgggacgaaaccgatgaactctcaatcataagttagcatttaattaacgaaaatgcgactgagagaaagccacgtaagagagttgcgaggctgaacttaaaattcgtgctattcacgttagagagataatgaacaacacgttgtcaacattctatttaagcagatttttgttatcacaagatctctctcgcttctgtctttttcacttgcttgacttccccttccattatcttttcttctgtactttgtatgaacggtgcttattttacttaccttattcatattagttgagaccacattaatttaaaacccaaaaagaaaaacatacaattccaaaatttggagtataatctcctcgtccaatagttggctgatagcttaaaaggttatccaccctaacgcaatgttcaaaattttgcctatttccgttttgatttgtttggatgaagaatgttttctatcatttttaatttgattttccaaattagagttcactttggtttggatcaatttaaccctttaagttagagcctagtacactaactaaaactgatgctgagtaaaagacactaaaaaatcattttacgttttactcaaactagttttgatgaatcttacaagaacaaattcaatcgagaacatccaaacaatactatatacctaaaggattgaacacttaaaaagttttatgaacaagaacaagttacataagtagcctcggcttctttatttttcaacgataattgctataatctatcatagataagtggaagcatcctctgctttcggttagaagcaaggcttttacccgtagcagcggattgggtcgttgcagcctttttccgttgattgcttaagaccaaacctccctcctttagacaagtattgctggtgatgttcctcagctctataaaatttcttagccggtaagatctctgtcacaaccttcctgtcaacttgttgctggtgccgctccagtgactcgcgtgctagtttctcttgctccgggttgtagaaatatatccctgaacggtattgggttcccacatcatttccctgatcagataaggatgtactcattaaaacagagaaacaaattcgaacataatgcacgacaagcagataaactaccaaataaatagtgattctgcataagagctggttaagtgctctctaagaaactaccaaaatacacataaggatggttcagtgaccaaagatgacaagaacgatagccaaattcacatccttatcaaagagaagatgtatgagtctctctgttcagtttcaaacataaaacctaaattttgtaccaacagaacatgaaatgaatccaaagtattacatcatccaaaccctagatttcaatctatttagagctcaatatttcaagcaagccctagaaaccctagaaatcttcctcaatcaccaaaatcaaaacttaaaactcacaaaatcagacattctaaagagcaaaactttcgttacctgccgattcaaagtggtgggatcatgcttagaccagaacaaatcaagcagcgactggtaactacactcttttggatcatattgaacacgaacaatctcggcatgattcgtggtacctgaacaaacatctttgtaagaaggatcgtgagtgatcccttgagaataaccaacctctgtttgagtcactcctggaactctctggtacgctaattccacgctccagaaacaaccggcgccgaattgagtaaactggtttcccggcgccggagcttcgtcgtcgattacttgtgcgattggagaaggatccatgttggtttgtctacttgatcctatacctagcttgttaagtatgttcatggagaaattttgtagagagagcgaaacagagaaacagaggaaagtggtgaagaggaaacgtcggctgattctgcggaacattttgtaccaaattctgacaggtataaaattcgcgtttgcgtttacgttttgaataacgataaaaataattttagaaaccagttttggttgacatttcattcaagcagttcaaattgacaatctttaaaatcttttttttttttttttttttaatctttaaaatcttaaaactaagattagttagtttcaagcatgatcaaatcatatgtttataaaatgtcacagaaatagaagaagaaaacaaagaatctaaagaaatggttgtttttgtcactctcaaatggaaaaatgagtgattagattgaacgatttgacaaagtccttatttcgatccaaatgtaccaaaaccataggctctaaattcgcaattcaatccggattcttttttcttctaagaaataaaaaactgtgactaaaatgtaacaaagaaactgattaagctcaaaaaccatcaacatcctaaaaacgtaatttctatagagtttttggaacacacctatcaaaaccaaaaatacttatcaaaatg

SEQ ID NO: 1335 - DNA, 1080 bp, Unknown
  misc_feature (1)..( 1080): cDNA_ID_2134401_gDNA_ID_1620388_Annot_ID_155535 3000 nt of promoter + ATG
ataattgtcttcccccgctgcttctgttgaaccctgaaagtcatatcatctctcgctcgagtaaaagaagtggttgagagataagagaatcatgcaatgcaactgcactcagagatagatggagagagataccaaaacgttattggctaaagtaggcaagaggtcggaggaattaaccacaaaagaagtgctgaagatatttgcggataaagcttttccaaggggcagtttatcaccagtgaaaagtatcgttacgggacaagaacctgtttctctgcataacttgtcagggagatctttgtaggaaaagaaatcggtcttaacggaacggagttcatgttgtggaatctgcaacatcggaggcaacgatggagggtttgggatgggacagataccaccaggcaaagtaacgttgcctccacaattagacatatcagagacacccttcatcaaggcatcaagcacttgttgaatcgccagcagaattaaacagaggaagagtggaaccaggatgagtcgaacattcgtccatatgtgtttcctctgccatttcagggttcaggcaattagatcgttataaaaaaaaatattctaagtaacttgccggaaacggcaatatgaaaacatacctggtaggttaagttcttcctaagtaacgcattggcttgcgtccaaaaacttgctgggctaggattcaccattgatgaagaaagaaagaagcttaggtagtcgcactttgtcgtctcttttttttttcccttgccaatttaagtaatcgtttcttcctttaaacttgcgcttgttttaagtgccaaatatatatatgtggtctccaattaaatgcgaaaaatatgcgaggtctcaattttacacatttttcaagatggggatgaaatgtagtcaatcgaaaaaattggacaaaagctggatagtttttattttctttctaattaatattggtcaatcctttttttgtggggtgtgtgggaactttatagattaaaattttgctttttttttttctaagacaaacaatttacttcgaaaaagaaagatttttttttaaaaaacttgataatg

SEQ ID NO: 1336 - DNA, 3000 bp, Unknown
  misc_feature (1)..( 3000): cDNA_ID_3061759_gDNA_ID_1620388_Annot_ID_155533 3000 nt of promoter + ATG
aaacacaacaaattaatcatatcctcccaatgtttaaaactcaagcttaagagttttttttctcctgcaagctacaatcatttttgatagaaaatttataccttttgatggattcagaaatcagaagtctccttagtccttaaaaaaagaaagtttagtacgctaaaacaaattcaccctaaaactctataaattgcctatatttccattgggttttcccgcttttttcttctcttgtaaatttctataattttccatgttttagaagctaagttagttaatatcaccagaagtcggtttaattaataataaattctcaggccaatggcttaaccatgcgatgatcataatcactagattgttaattcaaaactaatcttgagtattcaaatgaaactacaaaatcaaacataaaatgcgtgatttgtgaactaccacatgataataattttagttgaagagttttaacgtttactagggaatatatttccatccaactatattttttcaaggatatacataaaataagacttttattgtttcgtaaaaaatgcatttagttttaaacaaaaatctaaaatgatacttgtaatgaatggagtagtagaaaataaaaattcaatgcatatagtaatagaatattcacaatcttatttaaaattccttctatataacaccaaaatgacaggcaaaagacaggtacaaaaagcaaaccaaaacatgtaatgtaataaactcatcaaaaacagagctctgtttatcttttcttccgtcattcgaatggctgatcagattgagatccagagaatgaaccaagatcttcaagaaccattggctgagatcatgccaagtgttttaacggcaatgtcgtatctcttgcaaagagtatcggagaccaacgacaacctgagccagaaacagaagccctcaagcttcactggagtaaccaaaccttccatttccatcagaagctatctcgaacggatctttgaatacgcgaattgtagctactcgtgttacatcgtcgcatatatatatttggatcggttcgtgaagaagcagccatttttgcctatcaattcttttaatgtccataggcttataatcacaagtgtcttggtctctgctaaattcatggatgacttgtaagtaaataattctgaggctaattaactttttgaaatttactaatgagttaacattttgtttaattgttaatatctttgtgtaacaattttaggagttacaacaatgaatattatgcaaaagttggaggaataagcagagaagaaatgaacatgcttgagcttgacttcttgttcggaattgggtttgagttaaacgtcaccgtttctactttcaataactattgttgttttctacaaagagagatggcgatgttgatgaagatgaagtctctgtttcttgaaccttcttcattcaaaatctcttctaagacgaaacttgtgatgtatccacacgaggaagactctttatctactcaccacaacaagaagcaactcgctgctgcttgattatatttatgcattgggtcgttatcacgttgtgtgatgtaaaacctttttatatatccgagggttcttgattagtgatgttagcttggaatttgttttgtacatctagagattggtttctttactcgatacaagttgaactaaatgcaaatctgataatatttgttttcatcaaatgatcaaacacataccaaaaacactaaatatacttaatattgataccaaaaaaaagaaagaaaagagatcacacttaagagacatgcagacattataagatacgtcgagcgcataatctatataaaaagcatacaaggcaaaggaagataagttacatttaacagaggaccaaagtccaaacctaataatcttttaatattgcaaacgcttatactcctcccaaaatattatagttgggagaaattaccaaatcaaacgtccttacggatgaatcttactaccatggctcaaagcggcaacttcaccgttgaaaccaccaccaccaccaccgccaccagaccgaccatttccgcttccgtaaccatatccaccaccacgtgctccaccacctccagaaccatatccatacccggtacctgatcccgatccagatccataaccgtatccggatcctcttccccatcctgttggtgatctacctgagcctgccccgtaaccccatccagatcctggagcagagccccaaccccaattgtactcccaattcggcccacggcccgacccactttcgcctggcatgttacctctcgaccatgcaaacggacgtgaaacagaagtctttgcagtgattaaaaagaaaaaaaccaacaagagccctttgatcattttcgatatattcttagggtttattttcttttatgttttacttcaaaatcttgttttgttatgaagttattgtaagaaagcttctgccaccatttataggcaacaacggtccgtaacaagttggtttgatagtgtgagatgggccagacacacccttttgttaagtcgtatctcgaaactaaagaaattttgttaggaaaaaagattaaacaccatttttttataattgtttacttagacataattatcaactgaaaataagcacctaacacctaacaatataattacaagttcaatcatgaagtcactagctacgaacccttttatcatatagatactaattaccatgacttagtgcccaaattttttttactatgattataagattattgttaattataacgatattgccaaaaacgaaatgaaatgtagcctctattatagttggtattaatgtattatacaaaaagtcaaatgaaatgatgactatttgatattattactgatctacttgagtttttttgaagtagaaaacattatccttcaagaaccaatttaagatgcatctcaacgtcaatcccactcacaaattttctagttacgggcctgtgatctgcaaatg

SEQ ID NO: 1337 - DNA, 3000 bp, Unknown
  misc_feature (1)..( 3000): cDNA_ID_2134376_gDNA_ID_1620388_Annot_ID_155528 3000 nt of promoter + ATG
gcaaaataaataaataaaataaaatgaagttgaattgtctgaccgctatgactaaagaagcgaccactcatcaacgccatcggccatagctgttaattatttgttggatccacgaaggagcttacacatcaacttgccaaaatttacacttataattgcaatcaatacaaaggtttcgtcaatataattaaccacactatgctacatatcgtcgaaaattgaaactaatttatccggtaacattttgaagttgtagtttcatatagcctgcagatactgtggtttttgtttaattgcagtcttttgattcactctttgttcgtcgcaaacttgcaatacttatcagattttattttgcctgctaattatctctagttcatatctttcatttcacatattgtgtcgattttttcaaattgatatataatagttgagttccttttttcaaatttgtgtgtgtttacgaaagaagaaaagtaaacgaacgaggccaaaaaaatgtgaaattttttaatacatacaaaaaagatgtgaacaaaaaaagcgaagtaacttggcgtgaggtagagcaacttcactaacaaaggtgtcagttgcatgcatggacaggacaaatactctcttcagtcatgtgtcgtacacgtcgatctcaccactggacccactctttaatacacaatcagattacgttgtaacaaaatttctattactgccaaatgcatttctttggcacgaaagacaaagctcctatttatgccggtatagccgtcgtatccttcatgatcctcaccggtttaacctttgccggtacggccgtggctctaaccgttatgataccggttttggtggttcttagtccgattctcgtaccggcggtaatcacatcgagtttcttggcaacggggttcctagcttctggtagcctcggagcattggggatcgccctcctcatatggctctacaagtaattacttaagttaaagtaactaattaactcttctaatgctttgattgtaccaattgaaatttgttcatacatgcattgaccacatttttattttgtgtgttagttaacattatgtatgtgtgaatgacacttaggaaagaagagtattccagagctactttgcatgcacgaggaggtaggcctgatgggcctaacaagctggcagaaagtggcaagcaatcaggaggagataatccgttgaaggaagacaagccgccagaaagagataagctgccgagaaaagacaagccatccaaggaagacaatctgctgaaaggagataagccggtcgaggaggataaattgccggctgaggaagaaaaaccgccacaaaaagataaaccggcggagggacacaaaccgccacaaaaagataaaccggcggaaggagataaaccggtggaggaagacaaaccgccacaaaaagataaaccggcggaaggagataagcatgtggaagaagatatgcctttaggaggagttgagcatttgtcaatccctgagataccaaaggtactatattagtgatgttcaaattttttcgttaatgattttttcacatttagcaattgccgggaaaagaatttggattagcaagattaaacactgttctgctttaatattcccttcataaattaatggtaggttatggtggtggagcaaaacccaattgtccccaagtgttgcggcccaagtacttgtactaaaaggtgtcacccatttcgattcgccatggatgctaatgctactaaagcacgatctatttttatgaaagaataccaaaaagtcccccgtgtaggagcttttgcatataaatattttacatctcgtgacaaaaaatacgtaaaccattttcatatatgacatttgggacttgggtggttattattttaaagggtacgcttttaccttataaagagttcaaacgaaatttatcattttgaaggtattaaatactataagctaatgtgtttttgtttataaatatgctgctattaatgtactttagaaagcgtaaatttcagttatgaaaaaacacattaaacaggtggaatctctcaatttgtcagattaccatgtttttttattttattttaatatataaaaattgcaatcggaatcttagtcgagattaaataaaaatctaaaactcagaacctactagattttaatttttgatcaaactaatcatattttttaccaccgtagattttgtatgtgtcacacactgactgcaataaacaaataaacaaaaaaggtttccctaaataaggaaacgaggactttgttcctatattgatctaaatttccaagtatccaattagatctcaacgcgtttagattggatcgaattatatcacaaagttatttaaaaaaattatactctgaatttatcgcaaatatatataggagtatatatatgtaaaaactttggaagaaatagaaatatgggtaacttaggaaatatgagatattaactaatatggatgaagataaaagtaagtaaattccagttatattaagattaggattgatattgataaaaatatgggtaacttaggaaagaaaataaaaaaataaaatcgaatatacgatttaatatctctcctaaatatccgggatcaatatccagtacatgtttacctggaaaacaatctaacggctgattttccacgaatcctatcttaagaaaatgttaaccgtcgattatgatcctacgctgattctgctggatttttccttataatgacttgggtaaaaacttccaaataaaacaagataattaaggaaacgctttatctcttaaggaaaataaaaaaatgtaaaaacaccaaggacattcacaaataacagctcacgcatatccgcatatatatatatatatatatatatatatatatcattacacaagagagtttaaggtataaatacaattagcgagatcttgtgattctaattcttgtgataccgaaaacattggtggcgagagagag

SEQ ID NO: 1338 - DNA, 3000 bp, Unknown
  misc_feature (1)..( 3000): cDNA_ID_2134344_gDNA_ID_1620388_Annot_ID_155521 3000 nt of promoter + ATG
cctaccaaacccagcaaaaaatttgccattctgagagttttcagttacttcaagttaatttcgcaattagagttcaaatggttttattttatctctgttttaacagcttgagatcttaagcaaaattcgacatcctcacttagtcctcctactaggggcgtgtcccgaacgcggctgccttgtctacgagtacatggacaacggaagcttagatgaccggttgatgctagtcaacgacacaccaccgatcccttggtttgagcgtttcaggatcgctttagaagtcgcttcagcgcttgtattcctccacaaatccaagcctagaccaatcattcaccgtgacctcaaaccaggaaacatcttgcttgaccacaacttcgtcagcaaactcggcgatgttggtctctcaacaatggttaaccaagacgatgtttcatctagaactatcttcaagcaaaccagtcccgtgggcacgctctgttacattgaccctgagtatcagcgaaccgggattatctcacctaaatcggatgtgtactccctcggagttgtgattctgcagctaataaccgcgaaacccgccatagcgattactcatatggtggaagaagctatcggagacgatgctgaatttatggcaatcttggataagaaagctgggtcttggcccatcagtgatactcgtgagttagccgctttgggactgtgttgtacagaaatgagacgcagagacagaccggatcttaaagatcaaatcatcccggctttggaacggctcaggaaagtcgccgacaaagctcaaaacttgctttcgagaactccgtctggtcctccatctcatttcatttgcccacttttgaaggttcaaaataagccctaaaaccatgattacttgttacacaagaaaccttgtttcctcattgattttaacctaattatatttggtgttggcaacagggagtaatgaacgagccgtgcgtggctgcggatgggtacacgtacgatcgggaagctatagaggaatggctgagacagaaagatacatcaccggtgacgaatcttccattgcctaacaagaaccttattgctaattacactctttactcagcaatcatggagtggaaatctaataaacggtagagagaaacagattccagaaaaattacaatcggttctatcaatgtgtttactctaatatgttttttttttgtgtgtttttctctgttccgaggattcctcatttgtctgatgacatgcacaattacaacaatatatatagagagaaatgtctttcgatataagtttattttgtttctattggtaaaaatgtaactttagtttgaacttccccaaagaaaaattcttggcttatcatccaatccagtaattgatttgtcattctatatagtccaaatataattattaatctctagaatgaatgtagattttggaccatccattagataaaatccttacctattgtcaatttgtcatgtctcaaacacgtccacaagttaaggccaataagttccacatacaaatcaatgataaagttaatactgtacttatcaaaggcataatttgtgtgttttcttctcaataacatccgcatctcagagataactatcacctgttattttgtccaaacattaaatgacctctactctcaacccatttaatgcacataataaatgctaaaaagtacacctgtgtgatccaataaattaataatatttctctgtttcataatactagtatttcataactttaaagaaatttacataagttaatacaagtatgaacaatgaagtatgtcaatgttaaaacagtgaacatatccatccgtacttgttgagttacaaaagcttgatgcttaaagtaccacaaggtcaaggtttaatttgtcttgtctagttgtctatagagcttcgagtattgttgttgcggagagatccaagctgaaagtgaccgggaggtgccgatgtagagaggtctaaaatagaagctttcatatcgatagtttcttccacttatcgaaaagagaaatcctctcctgtaaatcgaaaagaatctttagagttgactaaacttttgtttactttacctattcacataacttgaaatttattagtcaaaagtttagaagaaaaaacaaaaaaattcgcaaaagaaaaacacgataatatagctgaacaagaaaatcaaaaacaaaattgtattttggcagaaaatgaaacctatattcattcataagggaagggaaacagcccaaaaattgaaaagtcaacaaaattgaataaagaacaagttggtagtccgacaaaagcccagttgttctgactttcaacgtcatcaaaactaaggaaactaccggaaaagacatcacatattcacacgaactcttctagacttttttgacattttcatttctctcatcgttttcttttttatcattacttctttgaatctttggttataaccattaaagaattcaactggtatgcgcataaatttccgcataactccattaatataatcaggagaccaattcactggactcaaatttgattcgtcttcttcttctctctctctctccatttgtcaagaagctgttgaatcatcgtcccccacgagttttggaaaaagcttgcaagtcaaatatcaataggtactctatcttcaactctgatgattgatcatagccgttcaattggctaacaagatcttttatcttttgagtattttgttatctaaattataatattatccattaaggtttcaacttgttttgttttgttttgcccagaaaatgtctctgtaacttacatttaattaaacttaaaaaccagaccaattcatgactctctctctcttcttctctctgttttgtctctttaagcacgactagagattaaggaaacaaaagcttgaacctttgtagtcaaaatcatcaggtatatatatcttcaaaaatctctctatagtttcaacaaaaccctg

SEQ ID NO: 1339 - DNA, 3000 bp, Unknown
  misc_feature (1)..( 3000): cDNA_ID_2134333_gDNA_ID_1620388_Annot_ID_155518 3000 nt of promoter + ATG
atttgcaaagggaagaagactttcctattcaaaattcaaagccgactttttttttacctaaacagcaataatatctttttttctctgctccagggggaaattaaaaaagtggaaccttttcatctcctggagcgatcaatttctttttcatcatatcgctgactctcgtcttcgtcgtctttgatcgtatcgaggaattgggtttagttcgattcgatcatcagctatctcaatttttctggggattgttctaaaggtttgatgatcggattgcttttgttctatttgttctttttgattctcgtatatgattgattagagaatataggattagggtttgtgttccttaaaagttatctccttttggcagttaaagacttggtttttattctttgtcaagaaattcattccatggttgacgatgaagtcaaggttttggttttcttttgtgtttcttctgtatcaattgtatatgattagattgaagatgatttcatgtgatgaagttgattacaacggataataccgcttgtgaggttgtatcataatttgctaagaataagtatatatcttcccatttgtttcttgatgcaaacaggtttctagtgacttgtttaaagtggttggtattggataatgccttctctcatctcacagcaatggcaggagaggactagtggattcttttcttcatcaggtttgataatttctatgctaacctcatttcgtttctctctgtgagtgtttatggtggaaagcttactatggagttactgaattaggaacgaagcttagggaagcagggcagactgctggtagttttgtcggggaagttgctaaggatgcgaaagtgaatgttgcagatgttgcagaaagagttgggtcgttgtttaaaagccggtgggcaattcttcagcagcctgcaactagacatgccgtgcaagaacacctcataacagctgctgccacaaccgggacttttgtcaggaagggtataactgagacaaaggaaaaggtttctgttggaaagatcaaagtggaagaggtattctagacacatagcttctcgaagttactcgacaagaatgtatgtatctcgtttcattcttctaacttctgacagctaaattctttgtatccatgttttctctttaggcggccaaaaagactgcacaaaagagcaagaccattttgacggatatcgaaaggtggcaaaaggtatttgactattagagtctgaaatctgattgtatgccgttgatttgagtttggtctctaatatctattctttgtaattctgcagggagttgccagctcagatggtaagttgatcgcaatatatggagagattacagtttaaacgtttgttaatcgaaaattcaatggattctttgatgtggggatacttaattatattaccgttcttgagataactattagtgattgcgtgtctgaaatgctgtgactttctctgtatgacaaatgtttttggcactcagtgtttggtgttgcgattgagatcactgtccagcggcaggagtcaagcaggcctattcctctgatactagttaaatgcgcagattatctcatattaacaggtaataatgtttggaccaatggagcaataacacttttattgctcacaccttctcatatcgagttatcaatgtgatattttcctcttacccaggacttaattcaccgaacttgttcaaggccgaaggagatagaaagttgattcaacaattggtttctgcttacaatcaaggtagcaagatttcttttcgactcttatggctcatggagaaattgtcatttaattgaatcacttgtttggcagatcctagggcgtcaatacctgagggtgtgaatccagttgatgtcgctgcactcttgaaatactatcttgctagccttccgacaccactaactacttttgagctttataatgaaatcaaagatgcacggtcgagcatacacagaatgagacagtcactccagaagctttccaatgtgaattataatacattggagttcataacagcgctattgcttcgtgtgagccagaaatcacttcttaacaaagtgggaataagttgttataacactaatctctgattctagatacttaagatgatccttttttcaggaatcatataagttatctgaatattgggaatcatttgtttgcattttgcagatggattcgcatagcctagctatggaaatggctccagtgatcatgtggcgagaagacaacaggcctgaatcttatcgggaatactggagacgcccgtcaaggagtcctaagaaaagtaacgactttgaaactgctactccatgggacttgctctcaggtaaacacaaaaacacttggctcctatactctttgaagcacagtttcattacgatcattcttctctttcatggttaatggttataaacagatgaaggagaaggtccagatgcatcctcatcaatccctctagatgatatcgcacgagttgattttggagcggtcgaggttgtccagtgcctaattgaacaccacaatgcgattttcactgatgcagccgagactgtatggaggtgaaaccaccacagttaaccaatattgatctggttacaagaacatatgcattttgatctggatgatgattgactagtggtttcagtaaataagatgttgtttcatatttggttcttctgtaacaatttttagactttagaactctgatgattaaaagataagtttttcttataagaaaatcaagaattcggattgtttcccaatcatataaagcaacaaccggatgtgaccgcaattcgttaaaactcttatccaatcgggttatcgaaatcgaaatgaaaccaaaccgatttaaccgaaccgtattgactcatgagcagaccaattgaccttagagtcaaacagagcaaagcagagcagagcacagacatacaaatttccatttttgtagcttcttcgagctcacagcc

SEQ ID NO: 1340 - DNA, 3000 bp, Unknown
  misc_feature (1)..( 3000): cDNA_ID_2104863_gDNA_ID_1620388_Annot_ID_155514 3000 nt of promoter + ATG
tacgtggccgggtttggttggtcttggggtccattaggatggcttgtaccgagtgagatttttccgttggagataagatcggtggcgcagagtgtaactgtggcagtgagttttgtgtttacttttgcggtggctcaaagtgcaccaccgatgttgtgtaagtttcgagctgggattttcttcttttatggagggtggttggtggtaatgacggtagcggtgcagctgtttttgccggagactaagaatgttccaatcgagaaggtggttggactttgggagaagcattggttttggaggagaatgacgagcaagcgtgatatccaagaaaccaccattcttagccattgaaaacaataaaaaaaccagcacctcatgatttgagatgagacgcatcttttgttgccaaaaaaattattgcatataagttttaaaattttcaaagttcaaactaaattaaggatatttttttactattcacgtaacaataatcaaatcacatgatccaagattcgattattgttcaaattattttgtaaatttagccatagtttcattttttcacttatatgtttgtgaaataacgatttgtgtttggaattaaaattaggggtgttttataaatatagtaaaactaggatagtgataatgtaatatattgaacgttaaaggacaaagatgggaaatagaaaataaagttaggaggcagagaagaaatgggggccataagaaaatggcagcattgactcttcatcatcatcatcatcatcgtcatcactcgtgtcttcaagcgtctggacatctgtcacgtcgtctatatcaccgaatattctcgagctttccacgaaatcccgtcaaagatctcaactttcgtctaagtcttgccgatttctcgagtttttctttatctacacgtggcactgtgtttgctgtaagagctctgagtacagtcgcggtagaagagtcgtccgagaagaagatggtgaaagggattagggtttatgagcatggcggtcctgaggtgagtaaaagattcgattttgaagttccgggtcggatttggatcattgaaatcaaattagattgcgattgtgtctgtttctatgtgctcgtgtgattatagttcaaatgatttgagattccctataagcttcagcttttttcaatggctagttttccaggtgaaaggttttggatttgagcttgagtcgaaattgatggttatatacagaatcactgatgtgtatttcaaacgtagctttggttactttgatatctttgatttagagacttgtgatagtttctcgcattctgtttgatcagtgtttttcagtatttatagcggttttgtttatttaattggaaggttctgaaatgggaagatgtggaagtaggggaaccaaaggagggtgagatacgtgtgaagaacaaggctatcgggcttaactttattgatgtttacttcaggaaaggtgtttacaagccagcttctatgcccttcacaccaggtatggacattactagaacctaatgagagaacggaaaagatttttttttcttttctgaactaatggtccatttctgatcataggtatggaggctgttggagaggtggtagctgttgggtcgggattgactggcagaatgatcggtgatctcgttgcttatgctggaaatccgatgggtgcgtatgctgaggaacaaatccttccagcggataaagtggttcctgttccttcatctattgatcctatcgttgcagcatcaatcatgctcaagggtatgactgcacagtttctccttcgccgttgcttcaaggttagttttcattcctatttctaggaagttattaataagaagaccaagagcaggatttgtgtcttcttgcctgttgaacagagtagagttttgttatattggtcgcgtttttcaaagatctattcactatatgactcaagtcctatttgtatttggaaaggtcgaacctgggcacacaatccttgttcatgctgcagctggtggagttgggtctctgttgtgtcaatgggcaaatgcgcttggagccactgtgattggaactgtctcgaccaatgagaaagcggctcaagccaaagaagatggatgccaccatgttattatgtacaagaacgaggattttgtttcccgagtcaatgacattacatcgggtaaaggagtaaatgttgtttatgactctgtgggaaaagacacctttaaggtattgtcacaaagagccagactgtttatgttctttagctggtttttcggatttcttataatgaattttttataaatttccagggatcgttagcatgtttgaagagccgaggatacatggtgagctttggacaatcctcaggatctccagatccgattccattatctgatcttgctccaaagtcgctcttcttgacaagaccttccatgatgcattacaatgaaactcgagatgagctcttggaatgtgcaggagaggttttcgctaatgttacctccggcatcttaaaggctcgtgtgaatcacaagtacccgttgtctcgagtcgctgacgcccacgcagatcttgagaataggatcacctctggctccgttgtgctcttgccatgaaaacatatacaatgatgttagtatctttcaataagggcaatgagattcctttgtgatggaaagaatattaaatgtaccttttggacctgaatgacaatttgagaatacaaggaaacgggacccgttaatgaaacatctaaaatagatggggtaaaaacgtaaatatacagaagtatgagtactattggagatttttcttaaaatattacaaagagccaaatcatcttcctaaaatttgacggaatctataagataattttctccctagggattagggctcacaatctcaaatctctgattcttcgatacgataaattcttcctcgatatagaaaccactgattagatcctaattcgtcgcctagctcaaaagatg

SEQ ID NO: 1341 - DNA, 3000 bp, Unknown
  misc_feature (1)..( 3000): cDNA_ID_2992152_gDNA_ID_1620388_Annot_ID_155517 3000 nt of promoter + ATG
atcttatctccaacggaaaaatctcactcggtacaagccatcctaatggaccccaagaccaaccaaacccggccacgtagacacacaccaaaaccacaaccgcgtaaccatacccttccttgatcacaccgtcgtgaacatcagccaccataacgatcacaccaatggtaacttgcgacacgagcatctgtaaccctccaatcaaaaacagagtctttctaccgattctgtcaacgacaagcatcgacaacaacgtcgacgaggttcccacgattccagtcacgagggtcgacatcaacgaaccactctctccaaacccaacggttctatacaaaaccggtgcgtagaaagcaacaacattgattccagtaacttgctgaaagaaaggtatcaccaaagccatcactaactcaggcctatattttctttgaagcagtttcaaaaacgcgtttgaatctgtatcagaaccagaactcgcttcaacgagatcagtaagctcatcttgaacgtcgttagttccacggacacggcgaagcataagctcggtcttgtgaacatctccggtggtctggatgatactattcggcgtttccgggagaaacagtgatcctaaagtgaggattgaagcaggtattgcagctgtggctaaagagattctccaaccatgtttgatattttgggtttcgtagtttattacatttgcagatagaaatccaattccgatacagagctggaaaccattgctgattgctcctctgtattttgccggcgccatctcggagagatacagaggaaccgactaaaatataaaacaacaaaccagtcaacatacagagaaaattgaaacatcattaatcaacttgtcttttgttacctggttagcgaatccaactcctacgccgagcaagagacgcgcaataatgagcatagcaacgttttgagcagagccaccaagagcagcgccggcgagaaaggacacaccgccaagaaatatagagggcttgcgaccccatgaacgagtcacggacgaagctaacagagtagcgatgagaccggaaacgtatagagaagatgtgaaggatgtaagaagttggctattgaaaaggcagtagtggttattgctattgcctcttcttcttctatcttcttcttggagcttatacacttttgggaaaaatctttttagaaatggccccattgacatcactccacctacatatttatatagttacatgtttgcatttatgtttaggtttagagaaccacaacatttcatttaaatattatgaaaaactaaaatgttttctacttcaaaaatatgatttattctttttgcaaacgcaaacacaaacacaaacaaaaaaaagaaagaacatatatatcctaattagcaagaatatatatgtgaacctgaaaccccgatgtcgtagccgaagatgacaccgcccatggcggccatgacacatgaagccaccacaaaataagtaatcttcccgccagatactgatttagccatggcttcttttcttgcttcttctgctaccatgtttacctagagagacactcaaacacaacacacctactattcaagttcggtaggtgtttttagatcctgtatttttgtatatcaatcatccaaaggttgagtttcaaggtagacgacgaaacttgttggaccattggagtgctttaattgacttgagtgtgggacttatagtttttgtttgtttcggttctggctgatgagatatcgaaagtggacaataaaagacatgtgaagaaagacttttcactgcctaccttcattatcttcctcttttttttttttttttttttttttttttttttttttttttttttttgaaaatcgatagaagaaaaagatggctatacttttttcaacgactgaatgataaagctctttcgatgatattggacataccaagttgcaaactttgattgtttaattccataatactgatattttgttttggaatttgactatgtagaaaaaccatcattttctatatataaatactgatatacatgtggaattaagttggcagaataattactatcaatcatgtaaatttatggaatcatttttacattcactttttataattataattttatagtaaattttattttttgcttttaattttatagtaaaataattttactctatggtcaaaaaacttaaaacattaaggggatgataagctgtgaaattagaagcttaggtcacaaatgagatactaaaagaagatgaaggaccatttttgtgaagagaaaaacttattacacgtggcaccaacagaatatttattaccgtcacagtccgtgacggagagaatatctgtgatttgcaaagggaagaagactttcctattcaaaattcaaagccgactttttttttacctaaacagcaataatatctttttttctctgctccagggggaaattaaaaaagtggaaccttttcatctcctggagcgatcaatttctttttcatcatatcgctgactctcgtcttcgtcgtctttgatcgtatcgaggaattgggtttagttcgattcgatcatcagctatctcaatttttctggggattgttctaaaggtttgatgatcggattgcttttgttctatttgttctttttgattctcgtatatgattgattagagaatataggattagggtttgtgttccttaaaagttatctccttttggcagttaaagacttggtttttattctttgtcaagaaattcattccatggttgacgatgaagtcaaggttttggttttcttttgtgtttcttctgtatcaattgtatatgattagattgaagatgatttcatgtgatgaagttgattacaacggataataccgcttgtgaggttgtatcataatttgctaagaataagtatatatcttcccatttgtttcttgatgcaaacaggtttctagtgacttgtttaaagtggttggtattggata

SEQ ID NO: 1342 - DNA, 3000 bp, Unknown
  misc_feature (1)..( 3000): cDNA_ID_2134327_gDNA_ID_1620388_Annot_ID_155516 3000 nt of promoter + ATG
ttcccaatattcagataacttatatgattcctgaaaaaaggatcatcttaagtatctagaatcagagattagtgttataacaacttattcccactttgttaagaagtgatttctggctcacacgaagcaatagcgctgttatgaactccaatgtattataattcacattggaaagcttctggagtgactgtctcattctgtgtatgctcgaccgtgcatctttgatttcattataaagctcaaaagtagttagtggtgtcggaaggctagcaagatagtatttcaagagtgcagcgacatcaactggattcacaccctcaggtattgacgccctaggatctgccaaacaagtgattcaattaaatgacaatttctccatgagccataagagtcgaaaagaaatcttgctaccttgattgtaagcagaaaccaattgttgaatcaactttctatctccttcggccttgaacaagttcggtgaattaagtcctgggtaagaggaaaatatcacattgataactcgatatgagaaggtgtgagcaataaaagtgttattgctccattggtccaaacattattacctgttaatatgagataatctgcgcatttaactagtatcagaggaataggcctgcttgactcctgccgctggacagtgatctcaatcgcaacaccaaacactgagtgccaaaaacatttgtcatacagagaaagtcacagcatttcagacacgcaatcactaatagttatctcaagaacggtaatataattaagtatccccacatcaaagaatccattgaattttcgattaacaaacgtttaaactgtaatctctccatatattgcgatcaacttaccatctgagctggcaactccctgcagaattacaaagaatagatattagagaccaaactcaaatcaacggcatacaatcagatttcagactctaatagtcaaataccttttgccacctttcgatatccgtcaaaatggtcttgctcttttgtgcagtctttttggccgcctaaagagaaaacatggatacaaagaatttagctgtcagaagttagaagaatgaaacgagatacatacattcttgtcgagtaacttcgagaagctatgtgtctagaatacctcttccactttgatctttccaacagaaaccttttcctttgtctcagttatacccttcctgacaaaagtcccggttgtggcagcagctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaacatg

SEQ ID NO: 1343 - DNA, 3000 bp, Unknown
  misc_feature (1)..( 3000): cDNA_ID_3061793_gDNA_ID_1620389_Annot_ID_155547 3000 nt of promoter + ATG
atctttcgaatacctgaagtcgattcgctgccgtgtttatcagctaagcgaaaaagcgtaagaaatggtagtttaggttgcagcagtaaatcatccggtgtatatattggctccaaaagactcctaaagatctgcaaaatttcctctctttttttattaataacttgagaatcatataccttagaattggaaccaaagacaaaaaccacattaagtagacacagacctcccagagtcttttcacatcataattcacatcaataaaaacagttgcagctattgactctaaagtgtcagcaagaatctttggtgctttcactaatccaccatacggaactggatcatcttctttcctcaccgcctctgcgaaatttttaacctaatattaaatcactcaaatcattcaatgactcgagacagtgacactctgtttctaatgattctagaaaataaaatagcagagacctttttaaatagagaaggattctggagtaaaaggaagtggtggagattgtgattgacggcgatacgagcgaacttctcgttactaacatttgcagttcgcaagtcacgcaactccttgactttgaggttagggtaagtgtggcagatgtaattagtgaaggcgacctcaagaatagagtcgccgaagaactcaagccggtcgaataaaggagatttttgtgtgatagcttccttgagaagagtcttgttcacgaaactgtagttcaagatcttctctactgcttctactgaattcatctccgacgaaaagctgagttagtaggtcatgtcacaagcaggacctgtcctaaatatgcggtgaactattttttaaggttataaacccgtgaccgttgttaacaacatgaatttaaacccttaactttagttttgaaaaattaaacccctaccagtaccacaaacccaataaagactaaagtagcaaaataaaacaaagacattgcttgcggggagagttacactcaccaaggcagtgctttcgtcgattccggttcacaccatgagcaccattgctttgccgaaatcaacgttggatgggttagacaaagtgtctagatcgttcttatggggcagctctgtaactcaaaggaagcagcatcttatttcctggaaaagagtttgtaaacctaggagtgaaggtgggctaggaattaggaaagctcaggatatgaataaagctcttctctctaagctaggatggcgtctaattcaggatcatcatagcttatgggcgagaatcatgagatgtaagtacagagtacaagatgttcgggatggtgcttggactaaagttagaagcgtctgctcatcgacttggagaagtgtagcgttgggtatgagagaggtggtaatcccgggcttaagttgggtgattggagatggtcgggagattctgttttggatggataagtggctaacaaatattcctctagctgagttgttggttcaggagcttccggcgggttggaaaggaatgcgagctagggatctttggagaaatgggatcggttgggatatggcggcgatagctccatatatatcttcttataacagattacaattacaatcggttgttttagatgatataacgggagctagagacagaatatcgtggggggagagtcaagatgggagattcaaagtgagcaccgcctattcttttcttactagagatgaggcgccgagacaagatatgaagagattctttgaccaagtatggaacgtgactgcgcctgagagagtgagactcttcctctggttagtagcacaacaagccattatgacgaatcaagaaaggcatcgtcgacatttgagtaccacgagcatctgtcaagtttgtaagggagcggaagagtctattatccatgttctcagagattgccctgcaatggaaggaatatggctacggcttgtcccggtgagcaaacggcgccttttctttgagaagtctattcttgagtggttgtatgtaaatctgggagaccacggtgaggtgagaggcagtgtttggtccacagtttttgcattggcagcttggtggggttggaaatggcgttgtggaaatgtttttggagaggttggccgctgtcgggatagactacggttcattaaggatttggcaaatgaggtttcagctgctcacttaaagctccccgggaatacgaaggagattgtgcgggtagagcgacaagtctcatggaggaaaccaaatgagggctgggtcaagctgaatacggatggggcgtcgcatgggaatcccggagaggcgactgcaggtggtgcgttgcgggatgaggaaggcaattggattggaggctttgtgcttaatattgggatttgtacagctcctttggcagaactgtggggggtctactatggactttacatagcttgggagaggcgggtcgcgaggttggagctagaggtggactcggagattgtggtggggtttttaacttcagggatcagtgactctcaccccctgtcgttcctagtacgtttgtgctatggcttttttatcaagggactggttagtccgtgtgtcacatgtgtatagggaggctaaccgtctagcggatgggttagcgaactatgctttttctttacctttaggtttctattcttttaatcttccaccggatattgttaatccgattttgttggaagatgccaatggggtctcaaggttacgttttgttcggttatagttcttttttcttttgttatgaataataaagcgggagacttctcccgttttccggccaaaaaaaaaaaaaagaaaacaaagacatttgccttaaactataccgagcctcttcttaaattctaatttgaatacaccctccttagaggccaattgtggttattggcaaatattaatcaactttgaagtttgggtaacaattcaaaacgtaaaaagaaaagaaggactactaaagtgaattaaataccaataagtaataaacgcaaaggatg

SEQ ID NO: 1344 - DNA, 3000 bp, Unknown
  misc_feature (1)..( 3000): cDNA_ID_3061785_gDNA_ID_1620389_Annot_ID_155549 3000 nt of promoter + ATG
cattgtttcagctattcgtataaagcaaaaataaagatttttgtgttctgtgtagtaccttcaagaactcaggaacgagctggaatttatctgcagtagacttgataggagctgaaagcttttccttgtcaatgaaatgatcatcattggtcaagctgtttcaatagaaagagtaacattagacatatatctaaatagttcaattaaaatccaaaatcaatgaagaattaacaaaaaaaaaccatactctaaatcttcttgatcaagtcccatcgctcttaactttgcaattaagctgtcagttatctgaaatccatggagaaatataattaacatcaacacatcataatcacaagagaattaaaccacaaaaacccaaatactgaatcctagttttccacaatttcatcaaaattcaaataaaacccagaatttcccagaaaccagtcgttttgagaattgaagacgaagcattgtgatttacagagaagaaacagtaagagaagtaaacctaacgactctacgagtaccggaaatttgtggaagagattgtgaggggattttcgtgtgatttcaaaaaggagattgaagatgaaaatcgaagaagagaacctgcgattcgaaggagattgaagctggagttgatacagtcgcttcgctggctgaagattttacacagtcgaagtcggttaagggaagaggtttaagagacggcgaaagggttttaaacagtatctttgcgtttattacttttttttttgtcatcctttgcgtttattacttattggtatttaattcactttagtagtccttcttttctttttacgttttgaattgttacccaaacttcaaagttgattaatatttgccaataaccacaattggcctctaaggagggtgtattcaaattagaatttaagaagaggctcggtatagtttaaggcaaatgtctttgttttcttttttttttttttggccggaaaacgggagaagtctcccgctttattattcataacaaaagaaaaaagaactataaccgaacaaaacgtaaccttgagaccccattggcatcttccaacaaaatcggattaacaatatccggtggaagattaaaagaatagaaacctaaaggtaaagaaaaagcatagttcgctaacccatccgctagacggttagcctccctatacacatgtgacacacggactaaccagtcccttgataaaaaagccatagcacaaacgtactaggaacgacagggggtgagagtcactgatccctgaagttaaaaaccccaccacaatctccgagtccacctctagctccaacctcgcgacccgcctctcccaagctatgtaaagtccatagtagaccccccacagttctgccaaaggagctgtacaaatcccaatattaagcacaaagcctccaatccaattgccttcctcatcccgcaacgcaccacctgcagtcgcctctccgggattcccatgcgacgccccatccgtattcagcttgacccagccctcatttggtttcctccatgagacttgtcgctctacccgcacaatctccttcgtattcccggggagctttaagtgagcagctgaaacctcatttgccaaatccttaatgaaccgtagtctatcccgacagcggccaacctctccaaaaacatttccacaacgccatttccaaccccaccaagctgccaatgcaaaaactgtggaccaaacactgcctctcacctcaccgtggtctcccagatttacatacaaccactcaagaatagacttctcaaagaaaaggcgccgtttgctcaccgggacaagccgtagccatattccttccattgcagggcaatctctgagaacatggataatagactcttccgctcccttacaaacttgacagatgctcgtggtactcaaatgtcgacgatgcctttcttgattcgtcataatggcttgttgtgctactaaccagaggaagagtctcactctctcaggcgcagtcacgttccatacttggtcaaagaatctcttcatatcttgtctcggcgcctcatctctagtaagaaaagaataggcggtgctcactttgaatctcccatcttgactctccccccacgatattctgtctctagctcccgttatatcatctaaaacaaccgattgtaattgtaatctgttataagaagatatatatggagctatcgccgccatatcccaaccgatcccatttctccaaagatccctagctcgcattcctttccaacccgccggaagctcctgaaccaacaactcagctagaggaatatttgttagccacttatccatccaaaacagaatctcccgaccatctccaatcacccaacttaagcccgggattaccacctctctcatacccaacgctacacttctccaagtcgatgagcagacgcttctaactttagtccaagcaccatcccgaacatcttgtactctgtacttacatctcatgattctcgcccataagctatgatgatcctgaattagacgccatcctagcttagagagaagagctttattcatatcctgagctttcctaattcctagcccaccttcactcctaggtttacaaactcttttccaggaaataagatgctgcttcctttgagttacagagctgccccataagaacgatctagacactttgtctaacccatccaacgttgatttcggcaaagcaatggtgctcatggtgtgaaccggaatcgacgaaagcactgccttggtgagtgtaactctccccgcaagcaatgtctttgttttattttgctactttagtctttattgggtttgtggtactggtaggggtttaatttttcaaaactaaagttaagggtttaaattcatgttgttaacaacggtcacgggtttataaccttaaaaaatagttcaccgcatatttaggacaggtcctgcttgtgacatgacctactaactcagcttttcgtcggag

SEQ ID NO: 1345 - DNA, 3000 bp, Unknown
  misc_feature (1)..( 3000): cDNA_ID_3061781_gDNA_ID_1620389_Annot_ID_155552 3000 nt of promoter + ATG
gcaaatatttttcttaagttaattagttaatgttttacgaccttttcaacctaaaaaatgaaacacgaactacgaactgactagccctaattctcccaatttgattgaaagactctccctgaaacagagcactttaggctaggtttcctactttgtttctagcaatcgattgcttcgtgggtaggttttcaaaatcaaaacctaatattcactttctttgggaatctcgcgagttaatttacaagatcacatgtctcaatgtatcgtagggtttctgtgttttttttttttttttttctttttcctgttgggaagggtttcttgttttttttgctaagcttattatttttctttctaatttaatttaggatcctttaatttataaagataaaaaaaaattaaattgtttgttatggagtgtttatctaaattagtttataatggtatagataaatatgaaaaaataaagatacttataaatttaaagaagaaaaaaaagaaaaactttaatataatattagatatccacatattattcagattttactaggttttttcgagtttacccactaaacccgaaacctatcggattttttgtgggcatattaaattcgggttcgagtcggattagttatattttgtcaaaaatgtataattgtttgcaaaatgtaaccaaatttaattaattgaaaccatttttattaaaattgaacaacttgtaggttttttccgaccattccaaatcttacacctacccgaaccgaataatcataaaaccccaatggataatagtctcttcttctaccagaaatatccaaatccaaaaaaaatcaaatctgatcaaagtttctaaagcataagcctagacacaacttcaatgaatttcataaattttaagaaattatatttacattgatataatctaattcttttttttaaagcataagcctagacacaacttcaatgaatttcataaattttaagaaattatatttacattgatataatctaattcttttttttaaactactaaaatatacatatttattagtttgaaaaatgaaaaattgaaaaatgagtgtggggcacgtgcctcacctctcctctacctacatctgccccatgttataactctaatctcaatattctctctaaatatttttaaataacgtaattttttttgttgtttactaaataactactacagtatactatgtgatttaaactataaatattgctaacttgtcataaatgttttacacaaacatatatatacttaattctcattcatcttcgatactattgaatattttattataatctttatctatacatctcaccattttatatgtttagttgacatccaaattttggagttattttaacaaaacaaaagaaaaaaacaaaacttttgacaaaatacacaaaaaaaacatatttgaagaaatttttatattttttcaaaagctttagtagataattaaaatttaatttgtgatatatgtatatattgtgatttacgtatatcgcggtcattttgagttaacaactttaaaaaatttactttaaataataaaaattataaagtcgcatttttataacctaggcctatataaaatataataagcttttaatatttattttatctcttgatttctaattcctaataactgtttcctattttctttttctttttctttttttttccgtcgattttctttttgttcttatcacatttcaaaaaacaaatgttaaagatatcaataaagacgattagtgattagcttatgaatttatttatattcttttaatgtgaaaaaagggaaagaagtgaatctggtctcagcttttaatatcacaactctttagaatacttcctatcccctttttcttcttcttccctctttcgttttctcgcgactctctagggttagggtttgttgattttcacgcgttattcttcatcttcttctgcaattcgcaactagagaagctaattccattgaagttaaggtaaagtatccatctttttgtttccctccctcgttcaattactgtcttaaattctcgttgatttcctttatcctctcgatttgggtattcttttttgtccaccgtcaagtgaatctctcaacgaatttttccatcttccggttaatttctatagaaaccctttggatctgtttttttcctgctcaattactaattttctaggtatcgtttcgtgttttgagaaaattttgggattttgatcgaatgtatctaattggtgatgaatttttagcctaatcaagttgttaccacaagttcgattccatgatttgcaattcgtaaaggttcatcctttgcatgattcatgttcatagcttgtagaagatttatcccctttgactctcgttttagactatgtggttatgtttccttgaagccatgtcactagtctcttccccgttgtgcccttccgtgtagctaatttcttattcaaagccaaagttcgaatgcgggtataaaaaacatagctatctactttttctgatgatctcttatcctatctagtgtcgagtatcagacttattaccattgtaaagagatgccccattttggtccgctgcttttgctaggttgcacagattgttataaagtgaagcaaattttggttctttgctgtcattttgctactctgctttacgacactaatcatgaatcagtatctccccctttgtgcccttctgtgtactgttagaaacctcagttgattcctgttcttagagttttctaaatgcttataagattatctgttattcaaagatacggttttaatgcaattacaaagatcatagcttcgtttgttggggaatcgatctggtttttcttatgttctctttaattgtcctttctagtgttgagtttcaggcttattattatttgtaaagtgatgcacattttggttctctgcttttgttaggtggggataatttttggttttagaagatactaatg

SEQ ID NO: 1346 - DNA, 3000 bp, Unknown
  misc_feature (1)..( 3000): cDNA_ID_2134423_gDNA_ID_1620389_Annot_ID_155550 3000 nt of promoter + ATG
tttgatatcatctaatcacttattgtatttttgtttgcaaatccatattgttgggatatgttacatatcatatgtatatgaaccatcgtttttttttttttttttttctttttttgcggcgtataaatatttttattaaacttatttcaacttttgaaaacattttgcatgcataatggattcaagtttacttagatttgtttattatattgtaaaacgtttctttttaataatatgcatttgtgtgtgtgcatgcagtggcatgcatttgagtacgtggtagtatgtgcaggaaaatatggcgatgtaccaagaacccccacgtttccggtgaagaaaggaccggagatattcaaagggaaagtgttgcattccatggattactccaagttgcagaaagaaaaagcttctcaactcctccatggcaagaaagtggccgtgattggtttcaagaaatcagccattgatttggcgttagagtctgcattagctaatcaaggtataatatatatatatatattttttttttacaggtaagtctttgattagtcaatcatgtaatatgattaaaatctcaaaaatattttgaactaaataatatatttaaaattttcaggaaaagaagggaaaacatgcacaatggtggtgagaacaccacattgggtgatcccacattattgggtttggggtctaccattcttcttgttctactcaactagagcttctcaattcattcatgagaggcctaaccaaagctagtttagaactctctttactataatcttctctcttctggttcgtcctcttcaaacactcaatttcgtctcctatatataatttgcatgcaatcatgcaaactttctaattgttttcaaacaatgtatttgacaaacatagcgtgccacagtttccaaattcatcgaatcatatgttttgtggaagcttccgttagagaaatatggtcttaaaccggaccatgcattcgaggaggactatgcttcttgtcaaatggcgctcgtgccagagaaattctttgaagaagcggataagggaatgatccgtttcaaaaggacaacaaattggtggttttatgatgaagggattgagtttgaggatggcactaccctagaagctgatgttgtgatacttgcgacaggatatgatggcatgaagaagctcaaagccattgtccctgaaccttttcgatcatggcttgagtttccttggggtatcatgcctttatacaggtacgtacacttttttaatacacttttttttttatatagtaaacttgttctagactattccgaaatgttgtgctaatttgatactgtaacaaaatatacatgtcttttgttcttgtaaaaggcttatatatttaagaaaacatgtgttacaattcaaaaaattctaaagtttcattttatgtaaaaattgcatacacctaaagatatggttaaaacgataataatatatagttttacaatatttttctaggccgaaaaaaaattatatggctcatacgattgtggccttacgggtttataagactatatatttacatagaattttcaaaagaattgttaatagataacgattatataataatcgttgcttatataaaattggaccgttgcttatataataacgatgctaatttactaaaattttcaggggaacaatccatccgttgataccaaacatgggtttcatcggatatgttcaaagcagctctaatttgaaatcatcagaattacattcaaggtggctcagtcagctcttggacggtaaattcacattaccgagcaaagaaaagatgttggatcaattccttaaagaaatgcacgttatgagaagatcaagcagattcttcaaaaatcattgcttctccactttcagcattcaacatgccgatgatttgtctaaagacatgaatctcaagccttagcgtaattcaaaaagataatctacttcattaaaataactaaataagtgatagatataggattgtcttttcatcctcagattaataatgcacaagaccctttctcatcctaatttgtttttatatgtttaagtttattgtatcgtttgcttttaaataaatgaaataattgttttctcctttttcctcctctatgatggttatatgagaagtgcattggaggttgtttccaaaatcgtatttcaatgccatcaagatgctatgaaatacgcacaacacagcgcatcataatcatattaaaatcttacccacgtttatatgcgtttgtgagttggcagcaaaagcttaatgcagaaaagtaaacgtgacaccaaattatacgtagagaaaaccttttcattgtgaagagtaaaatttacaggacaatagtccactaaaaatcctctatcagcaatatactcaagtttcaactacgttcttcctattcccaccgaacctatccagagactaattaaggttccaaagaacaatctcgaaacaagaaaacactacaaagagttttatggaaatcatgttgttctgcaatttttttttatatgaatgtaaaatttatttaccaaaaataagacggttttacaataaatacaacataaagctgagaaatttgaatgtacaatagaactacactaaaacagaagaggatgagttaacgacaatacttttttatgcattaacctacaaatactacaatttgttctgtaatctccaatacaagaaaacactataaatccgatgcataactaaaaatttattatgcggattaacacgattttattagaataaaaatccgattttttttaaaaaaaaccatagaaatggatcgctaaccattcaaagagttaaacgagtgacagggaccaaaagtctgaaattcggaatagtcccgtaaagttgtgtactttatttttatgctaatcccaataatcattttatcattggacacgatttttgtatactagtgttgtgtatgaaccagcagaaaaaagagagccatg

SEQ ID NO: 1347 - DNA, 3000 bp, Unknown
  misc_feature (1)..( 3000): cDNA_ID_3061789_gDNA_ID_1620389_Annot_ID_155548 3000 nt of promoter + ATG
ttgatgaataatcttttcgatgggcatacattctgagagcttctgtatcgcttcctcagcagcaagcaactttgcggtatctatacgtttagcacaaccggaagctataaacatatcatccatatatacctgagcaatattttttctgctgccaccatctttcgaatacctgaagtcgatttgcttgccgtgtttatcagccaaacgaaaaagcataagaaatggttgtttaagttgcatccgtaaatcatccagtgtatatattggctccaaaagaaccctgaagatctgcaaaatttccattctttctacaataaattgagtcatataacttcgtattgtttacaaatatctagtgaaagaaacacaaccaacctccaagagtcgttgtacgttatatttcacatcaatataaacagctccagctacaccagctagaagattaacgagaattttgggggctttcacaactctgtatggatcatcttctttgcccatcaactctatgaaatctgtagtctaagagatagacaaaagatgatgagtgtatcataacaacagagatgttctcagttcacaagaaatgaactttaaaaatataccattttttctggctttgggacactgcctataaaggattggtaaatgccttttttgacggcgacacaagcatatttgtcatgacatgtattcgcatctcgcaacacagacaaatccttgggttcgagcatagggtaagtgaggtataagtgtttcgtaaaggcgagagaaagagccgactcaccaacgaacataagcccctggaataaaggtgaattattgtgtgtaagcagttctttcagaagagtcttgttcacgaaactgtaattcaagatcttctccactgcttccactgaagaatccatctctgagctgaagagcaatggattattcttctcatctaaacttttcggcttttgtaaattacttatgacaagactcactagagaagattccaaggctcttatcatgtggtaggctaaggagttttctgcttgctttttctttgatttaatatctcccttcatgtgaaaggttccttctatatttggtatctcaatctttactgaacaaacaaatttgggctcattttttggtcctttttcttcctgaacactggaaaagtaacaaaagtgttcaaattaatatgacacattcgtgcttgttgagccacacaaagtaaaacatagctatctaacattgatcttacaagtatagttttttcgagcatatatgtgactgctctacctaagattgtaacagtgtaaccacggattcgcaaacacagtatccttttctgagactataagactctagactactcaaagatatttgtttgactatgaatcatggttcttgttaagtagtaagtactacttagcaaagaaaaatgtaggaataagatatacctgaaaatcggccttggccacttatttttggtgcaaatctcaatcaactcccctctcccatttacgggttccacatgtagactatccttatcaacaaccatttgttttgtagtcatttcataggttaaagggtttccagaggaaccagtctgtatttggagctttctcgtatagcaaatctcaaacaacttccctttcacatcttcaggttcaacattcggactatcctcatcaataaccacctcttcttgtgacatttcatcagttaaagagttctcagaaacagtggacagagaaaataattcagtggagcaaatctcaaacgacttccctttcacatcttcaaggtccacatctagacaatctttattcctaatcttttcaataggcatacattctgatctgacaactttcgtatcgcttcctcagcagcaaacaacttagcggcatctatactttagcacatccagaagctaaaaatataccatcaagatatacctcagcaatatttttgttgatgtcgtcatctttcgaatacctgaagtcgattcgctgccgtgtttatcagctaagcgaaaaagcgtaagaaatggtagtttaggttgcagcagtaaatcatccggtgtatatattggctccaaaagactcctaaagatctgcaaaatttcctctctttttttattaataacttgagaatcatataccttagaattggaaccaaagacaaaaaccacattaagtagacacagacctcccagagtcttttcacatcataattcacatcaataaaaacagttgcagctattgactctaaagtgtcagcaagaatctttggtgctttcactaatccaccatacggaactggatcatcttctttcctcaccgcctctgcgaaatttttaacctaatattaaatcactcaaatcattcaatgactcgagacagtgacactctgtttctaatgattctagaaaataaaatagcagagacctttttaaatagagaaggattctggagtaaaaggaagtggtggagattgtgattgacggcgatacgagcgaacttctcgttactaacatttgcagttcgcaagtcacgcaactccttgactttgaggttagggtaagtgtggcagatgtaattagtgaaggcgacctcaagaatagagtcgccgaagaactcaagccggtcgaataaaggagatttttgtgtgatagcttccttgagaagagtcttgttcacgaaactgtagttcaagatcttctctactgcttctactgaattcatctccgacgaaaagctgagttagtaggtcatgtcacaagcaggacctgtcctaaatatgcggtgaactattttttaaggttataaacccgtgaccgttgttaacaacatgaatttaaacccttaactttagttttgaaaaattaaacccctaccagtaccacaaacccaataaagactaaagtagcaaaataaaacaaagacattgcttgcggggagagttacactcaccaaggcagtgctttcgtcgattccggttcacaccatg

SEQ ID NO: 1348 - DNA, 3000 bp, Unknown
  misc_feature (1)..( 3000): cDNA_ID_2134652_gDNA_ID_1620390_Annot_ID_155564 3000 nt of promoter + ATG
aaaaagtaaaaaccgaggatctcgtcgaagtcatagggtttacgtcaacaaaataagataacaagattaggggttaggtaaaaaaaactatttgattataaggtttagccactctctcctattgagttctaggcgacatggtgggagttttattgagcgaaagaaatggatctcaaaagagacactgttcttctatatcttccgatgatggaaggaagcgagttgataagacccgctcagcgatgctgacggatcttgatattctcgactgtcccatttgctaccaagcattgaagattcctgtcttccaggttttgtttgtttctccttctttctgaatgaatggtttcaactttcttttaaactttgcattatgaagagtataataattttggagtaaatatagaagtagagtatccctagttcatgtttggatttgtagttattgaaaatatatatgtgggtagatagttttgcaaggacgagtttatatcctctctacgttgttactgtgacagcttttaatgaaaattcattggtttaatatttttagtgtggaaatgggcatttggcctgttcttcttgctgtcccaaattgaggaataaatgtcctgcatgtgctttgcctgttggacacattcgctgtagagcaatggagagagttcttgaatcagtcttggtcccatgccgatacgcagatttaggttgcaccaagacaatctattatgggagagaatcaacccatgagaagatatgcaacttctctccatgctcctgccctgtacaaggttgcaattatactggctcatacaaggatctatacgagcactatgatcttactcacagtacaggtagcacggcttatagtttcaatggcgtttcctatatagccgcgatgatgttcatcagcgataagatactaattgaaagggtatatgagaagaaactattgtttgtagtgcagtgttttgaggagccgtgtggtgtttatgtatctgtaagctgcattgcaccatctgctccagaagtaggagagttctcatatggtctcttgtacactacttgggaaggagtcactatgacttaccaatcaccaaaggtgaaaaaggttcttaaagtgagctcccaaagacctaaagatagtttcatgttgatccctcacagtttgttatgtggtccattgttagggatgatgctttgcatcaatgagttgaagcaaatgtaagaaggttggtgtaagtctgttttcgttaagtagccttttttttaagttttaacctgatgaactaagatcagaagttgcttttaggctttgagttaacatttaacaaggttttagtttagagttgattttgtaggctcaaaaatcagagtcactgagccacctatcattttcttctccttatctattgaagaatctatgtagcatatttagtttcttgatgctgctcccgtcacagtcgatttcaacgccatgaaattttcaccgaactctttcactactcaaagtcttgcataggcatggtaaaaaaaaaaagtcctgcataggcatggttaaaaatagccttaacgttttcaccgaactctttgattgttgaaagccttgcgtagacttgggaagatgaatgtgtggttatctttaaccaccaaattcatctcgagaatggttttcataagggacttgttttctatttagttcatgaactaaatcagaaactttttttttttttaaagtcatgaccacatcaaacacaccatcgcaacattatcttgccatttttgtacaacggaatagaacagaataaaaattatgtctatccttataaaagttcaaaaccactaatggttcatttttggaagaaacatgtattgagattaataattggttgagtgctcattgagtaatcatttttctagtaacttttaaaaagacaaatcgacataattgatttcgaaaaatgacacgtgttgaaacaaatgaaacaactttctccttagtcattacttcctctattccatcaagtttgatgttttggattttatatttgttccataaaaattaatgttgtaggttaatttttttcttttttcttagtaaccaatagaaagaggagagatgtagaacttatattattaaattaacagaaaataataaaaataatataaaaattactttttttaatttgtgtgaaaaacccaaaacattattcttctaggaacagaggaagtattattgatgtgacgttctctttgctccactccataaaactcttcgagttccatcaaagtcatgatgtatgcttttgttccttcaagctcttcacaaatagaagactaaaaacataaaaataaacctaattcgtttccaacttttctcaagcctcttatattcttttttgagacatgaagtgttccttacaaaatggatggttcgagaaacactcaatcacaaaagaggcaacgaacacgctcggtaaaggggacatggctagatcttgattttcttgattgtcctatttgctacgagccactcactgttcctttatttcgagttacgttttgattattacatttttagttgaatccatagagtttcctttttatggtcatttagtataagatcgatcatgattttgcaagcttgctttaactttaacatgcagtagcatctcatcttcagttttatacagttttcatatattttgactgcccatgtttcattatcttttaatttgattgctagtatatatatatatagcgcaaattaagaaactttcgagttaataaaagtgacctaaatttgttttcgtatacttcttctatgtaatttgattgctggttttgttaattagcttccatttgtgttcattttcatgtaacatcagaaacatcaaacatttttaaaattgtcttcacagtaaatatcaacgagccatcagaacatattacaacaaaaaaaaactttattgttcgttgtccaatgttttagagagccaaatg

SEQ ID NO: 1349 - DNA, 3000 bp, Unknown
  misc_feature (1)..( 3000): cDNA_ID_3061811_gDNA_ID_1620390_Annot_ID_155587 3000 nt of promoter + ATG
aaaatgtttaacaaaacaaacgtttaaaatatatataatatataaaatctataaaattaaataaccatttcaaaataaaacttttaaattgatttaaattagaaatcttttaataaaaatattattagaacaagaaaagaaaaaaataatgtttaattttatcgaactggtatagatggtgggatggagtttagaatattataatgcatggattttataacaattaaataaccatttgaatgaaaaattttaaattaatttgaattatatatcttttcaattataattttattaaaataaaaataacaaaaataaaatgtttaatttcactgaacagggttagatggtagggatcgacagtaatacgagacggtataccacgagtaaaatccattagatttgtttagttttactgaacgagattagatgataggacgagtttgagtcgatactaatacgagacggtggaccactggtgaaatcttagatataacaatcaaaatataattataatatcttaaatactaaagaaaataaattatattaataaaataaatataatttaaatttaaattatttagttataatctagattttaacttaatgaactgtacgttattgttcttatatttttaaacagtaaaaatcaaacatagtaattgtatactaaataatatacagatataagagttgaatattcataaaatataaaacattaactcatatacatttttaatcgactaaacaaattaaatttttattcttaaaagaactaaatagtcccgcagtataccacatattaaaatctagttgtcgaagtatttacccaaatatcattttaaaaattctcactaaaagaaaagtatagatatgtgcagatattgtatcatatatagtacattcttgtcttaaatttatattcgctcagtttcgctgattatattgttttaaaacacttttcttatacaaaatttaatattttttaatagtggaccgtaggataatatgtatgacgtatgagtgtctaaccctaaataatagagggagtatgacaattatatcctcgagattcacatgattttggtaacatccaggaatttaattttattgaactttttttcaatctattggtggtgattcactacctaactaataattttatgtgcaataatattttgctatcgtcactttcagtagatgatactataaaaaagttcacagtgaatcttgacaccataatggacaaatacatttaataaaagtataggaatagtttatcattaaatatcattgaagagtaatagtgtaatacccgataataggcgattttaggcgtcacatgagtatttgttgtttccttttttttttcttttaattttttctgccacgaatttatttccattgggggaaatataatctttacacaacaaataaataaatctttacgaaaagtatagttttgattggtgagaaagagctgaacagctaaacttacagtgaatgagaaagaggaattgagagaaaagaaaatgtgagtttagcgtaaatattttaacttttggtatttaatagagtaatctgttatgctattttttggtattttaaatatatatctttttaacagcaaatcaattatattatattatattataaaaatgttacataaaatcattcaaatataaccattgaatcaaataaataaaattgaacacaattttgatgaataggtggaagtaatcttactttccacacagaagccttacaagcaacacataaaatatgttaagtactctcttcataaacttgtaaaatgttaacattttatagatgaaactttcaaatgtttttcgcataaatttaattaaacaaacacagagatatgctgcttaaaatagttcaaggatcatgttttttgttgtaacatccttggcatcattgtgggttagtgaccatggttttctttctcatataacatgaatagtctgatcggaggacagaaaagacatcatcatcggaccgtgtccttggaaacggaaagttatcgtcggtgaatgagactagcggaaacaaactttataacagattcatcttgagtgaagctaatgcatcgaaagacaaaccataaataaaacgtctccatgattggaggaaattgccggaaacataattgtttccaaccaacaaatgaaatctcaattgagacttcaaaactaactcgcttggatagatgcattatttcttattgatttgagatctgccatcaacactctataaagcaaaaactgcatcgagaacatcgaaggctgatgaacaaaggtctccaatccaagcgagttatagttaaaactggttcggtaaaattatttcaactaatgcatccaatcacacccaaatatatctcttatgtttccccgaagacactataattatggagtatatgtagagcagtcaagctgatcatactcgtcccgcgaagcatattttataaagcttttgtctaggaggtttagaaaaagtttataagtgcttcttggtcccggttttggtttaatgcatctaatttttttgcaggaagctagatatgtattggatgtcgattatgctaaatgaaaaaacgtaaaaccttcttatagaactactaatcctgtcaaagaaaattctacaatttttagctttcggatcgtccgaacctcttctaaaaactagtaatgtagttcgtgtatgaacctatgtggaggatatccttgaactaaagtatcttaagagaaaattactccaacagaaaattaacactatatgttaatagaaattgtaaaatgagttatatatagattattaacactagacgttaatataaattacgaggtggccccagttttttatcccccacgcttccctctcttagtccttatataaacttcttgtcttccaattcttcatacccaaaaacaataaccaattctcctaaagtttgttttctctcgcctctaagaaacaatg

SEQ ID NO: 1350 - DNA, 3000 bp, Unknown
  misc_feature (1)..( 3000): cDNA_ID_3061815_gDNA_ID_1620390_Annot_ID_155586 3000 nt of promoter + ATG
ggtttgattttttttttataaagtttttttttctattacgaagcccatacattttggtcaataattagtttcgttttttttgttccttttttctgttttgcacgatctcaattttgttttgaattatttttataaaaattaaattataaaataccattattaattaacgacaaagaaataccatttgatattcatattttgtagggttccatattgtcacgtttcattgtgtagctatagccagatgttcaactttgatgttgaaagtttgcgtgggattgtatcccatcaatccaaaataaatacccataaatttaaacttaacaaaatacacttcaaattattatcaagaaccatacatgtgtttatctttctctacccgtggattcaccatgaaatgttcatctagaaacaacagttagattaactcaaactgcaattacataatttgagtcgtctttatatatctacgtaaaagacaagtgaaaagaacgatactactctcttggttacaactaattcgggtaatcttaaggttctatctacaatgtaaaatgaatcgacgacaataggaacggcaatgcgctgtaatttgtgctccaaacaaattaatttctgcatctaatgaatgtagacattaataacaaataagattcatttaattattttaccaaaaagtaaagaaggtccactgaatcacgtgaaatggaccattccaaattcttcggaaactttaaatacattactagattgtctcactcacctaatagtaaaatagtatagtggctccacaaaattgccgacactgtattttgttttttcttcttaaaagtattcaacaaatacatcacatacaactattttccgaaaaaatataaaaacaaatactaacttttaaatttggaataattatcataaatcataaacaattttaaaaatatttaaactatgtggttggagtcagaattcaaattttaggtgggaccaatgtttggattgaaaattatagttttgaatgtgatgcaaaaaaaaaaaattaattgaaaaattacgactaatatttgatattttttttcttttttaattaaaaaattaaaatttgggttttcagtcacaatcttctcaaaatcgtaactaagagcatttccaaccctactctattttagagtcaaaatgcaaaaattttctccaaccctactctataattgactcaaaatagaaatttctgcagattgactctatatatagagcaactctattctcaactctattttttatttcaacttttttatttatactttagtccctcaaatttaaacttttttatttaatacatataatcattttacaaacaacaattacaacacatagttttataaacttaacaaacaaacaaatactaaatttaatatatttaagaaccaatgtttaaaacaattatcctttaaagttttcacacagaaattaagaaatatatttaatatattttttaattcttttattggttaaaatgttaaaacagttaaaatctatttggaatttttattaaacatttacattaaaaatctaaaacgataatattaaaaaataaaattttagttatagaacaacgattaaattaaaaccgaaggaatatatcgcacgtaaacagaccttttgacaaaccgcaatttttcaaaacgttaatttagttgactttttggttacctcgtatcgcgttacttagaccatctccaagaagacaccaaatcaccaaatttggtgataattttgctccaacgtgacactataatggacggcataattgttttttggactattcacaaaacaccaaaaatttatattattttatttatatttttgatttagttttatatttaaattgttggttttttaattaaagacaagtatactattaatattttttaatgttttcgtttttgtaatatcaaattttaattaagttaatataaaatgataatgtgcacaaacttttgaaataaatatcacattaattaaaatttaaaatacataataaagcttaattaaacatttaaaacataaaattacaacatttaaaccaaaaaaacataaaaacaaaatgcaattagataaatttaaaagacataaagaaattctattatttaaaatttatcgattgtaattttatattaattaaattaaaattaagcagttctaaatttaattagtatttatcaaactattaaaataactattactaagtattagtatttaataatataataatgaaaattttgtttttagtgtgagatttagtgtttatggttggagatagaaaaaaaatctgaacactaaaacactaaatttggtattaaaatttagagttttggtgttcaatggttggaattgctcctatagatttaattgttacctttttaccatcattgtatgcaaatgttgactttttggttttggagattaccaaaagattcatcgtctactagttcttcgtagataacatagtatatctagaaaactcggaacgaaaattttataaaatgtggataaacgtgaagtcctaaagctagcaaagaaatttggtcaaacgttagtttattaatttctctcaaaatattagctatttagtaatattacccaattatataaggatagacaaatgttacttacccaacaatatttcaaatagatgctttgtttctacttgatgcattgttataatgaagtggccgctcctttttttttattttgtcaaacattataatgaaataatgaagtatgtttttggagaacaaaaatgttgtaaaattaccaataatttgggtagtggagttggtgtacactttaggcttatattccattaacttaatgacgttacttgtaatcattgtccaatcagtgacgtcatatatgattttccttttgttaatcttttcaactgttatgactgggtgaaggaaattatcatcttcgtccctaccaaatttttcagcagcgaaa

SEQ ID NO: 1351 - DNA, 3000 bp, Unknown
  misc_feature (1)..( 3000): cDNA_ID_2134669_gDNA_ID_1620390_Annot_ID_155568 3000 nt of promoter + ATG
tccagaaacaactccactagaataagatcgcaaatacaattgcatatgattttacagcataattatgcctatcactttttctatatggactttagaaacagtatcaagccacgcatgtcttgactaccacctagcagcaccggtgcatcatcgtcttctctaacgactgcagattccaaaggaataccactaacagatcatcatctgtatttggtggggcgacgccacacacaagtgtgcgcatctctctcaactatatcatagacgtgcaacctttttatgtcacgacatccatctatatatactcaagacaaaaccctaagctccaaatattcttgcaatcttttttccttgatctgaaagtatatgagccaccactaaaggaaacatcacgtctccaatagaatcatgccatgtcatcttcattcctcacttgattctttctgcgttcagttctcctgttgtgttacacagcttccacttgtggaacatcagctctgatactttctgttgatactcttgcgtcacacagatgtttcaatgcctttgttgcagtctgtgcgataggttgcatttatgagtttgatgctagcagcttggtcacaagaggagcatcaatatattctcttgatatttcatgtgagcttgattgcttgagtttcaaactaagctaaaaagggggagaatgacgatactagatcatatgagctataactcagccatcaagggggagaatgttagtatattgtgatgttgctgagttgtgtagctgtgacagttggaacgtgaacaatcagtcaaaatcacaacatatgcagtgacagtttggagaaacattctaagttagtattgaagcttgaagatcatcaaagtacaatctacaaaggtgagcttgagttctaaaacgcagtaacaaagggggataatgaaagtatatttgtaactggttgttagactcaagatgctgacacacaatttaagatatgagatgatatagactaaattgttgcaaaagggtttacacaacaagaagaagtggactattttgacacattctctcctgtgcaaaattggcgagttttagacttttacttggtttagcagttgggaagggttggagtacgtcttaaattgatgtcactagtgcttttttgcatagtgacctggaaaaagagatctttatgagtttaccagaagaatacgctccgccaaatggtgcttcattaccatttaatcatgtttgcaggctgcttaaatcaatatatcgtctcaaacaggcttctcgtcagtggtacaagtctttaacgaaggtttattgacgatggttttatccggtctcaagctgacaacactctctttgtcaatgtcactagtaagtctatcattgctatccttgtttatgttgatgatattctcattgtgagaaatgatgatgatgatgttaggtctgttaaggatactcttggagcacattttaaaacaaaagatctaggagaggcaaaattcttcttaggtcttgagattgctagcaattctgagggaatttcggttcgtcaaaggaattactgtctcaatatattagctaactctggtttgttgggtgtaaaccaaaatttgtgcctatggatcctaaggttcctttgactaaagatactggcacatttttggagaatgctagaccatatagagaaattattgagagattgttatacttgtgcatcactaggcctaatataacttttgtagtcaatcgcttaagtcaatttctattttgccctactgatgtacgtacaccttcaagctgctcattaaatcttgaagtacctcaagaacaatccaggtcaaggcttcttctactctgcttcaacagatttttgcttgaatggttttactggtgcagattggggcacttgcattgactcaagaagatgtacttcgggaatatgtgtttttcttggaattccattaatcacatagaagtcacaagacattgtaagtaacagtaataatgaggcaaaatacaggagtatggctatgactaaaaaaaaactcctttggcttatttagatgttaagaaatcttcatatcaagactaatacttcagcctaactcttttgtgacaaaatattaaccacacaccttgtaaataacctaatctttcacgagaagacgaagcatgttgagatagattgtcaatatgtaaaacctttaagaagccattcttcacaagggatcaagtgaagaatgactttcttaaaggtttcacatattgacacatgaaaccaacttggtggcatattgacaaagccccttcatccaggtcttttctactctctcattagtcgtttatcgatttcaagcctttttaatccatcagatgattcggcttgagggggtgtatgaacatatagagtatattagtattaagtctcctatactttagtattataaatactctcttctatcataactttaagattaatgagaaaaacactttaaattaaagtgttaatatgatttctaatcaatatgggggttatcaattttatgttgtatacaagtattaggcaagactgtataccattgttagcaaataagatcttatggtgactctctctctcaaatgaaacgagtagaacgacctgtgtccccctagcaagtttcacatacgaccacatctccacagatttcgaatcacgtctccagtccacataaaaaaaagttaaagactacgttccacctaaaaagaaagttaaagaactcgatccgcatattttcgaatttagtggtttattattggtttactgtaccaaaaacaccattaaccgataaacaaagaaacaaaaccggatttacccaaaaaccaacccgaactaggacccattaaccccgaatatgactcgaacattcccaaattctaaaaacccccaattctagaaatccctaaatcgacaaaacccctagaaatccagattgttcttgagaccacgaaatcgaacg

SEQ ID NO: 1352 - DNA, 3000 bp, Unknown
  misc_feature (1)..( 3000): cDNA_ID_2134823_gDNA_ID_1620390_Annot_ID_155578 3000 nt of promoter + ATG
aaaacaagaaaaagtcagatagatttcatattagtgtggggctaattcacactcaaaaattagtttaaggaaggaggattgccacaatactgtacatatatattgtccaaagaatattatttcttctaatgtgggataattctaatatctccatcaaaataaaaccggtcctgaaattgtaaagactatcggtttaattttttttagcacaattcaatattttagggttttgtgcagagatgtcctacacggagaccgagattagtaaaaagaatttacagtcaatactcaatagttaatggtattggtttgtactagattcgatattttgtgaatgaaaatcgaatataaaaaaactttaacttgccaaattttgcaactttactgtttactcaaaaaaagtgcacattaatactacgaaatcttaaataatacgtaatatgactcttaaacgtatatagttaacgttttcactgtcacatatattaaatttttacgaatttgatggtaacgaaaaacaattatatttcgtattatttttgattttgatgatcaatatacattttggaagtaaagagtaaagttagaaaaagtgacaagttaaatgtttattttttacaaaacccaatattttaattaagaaaacaagatataaacgatggtgggaggtttagtttaaacaccttacctaacgatacctttactttggaaaggtttctaagcgggacataccactagactaatgagagtatgagactatgtactgtacacaaatattgagctgcaaaaatacagtaatctattttgaaactgcaataccaaatttcctttacttaggtttagtagtgcatggctcgactttgaagaaaatacttacaaagggtaaaatatagcagtacaaaacaattgaaatacttactcgtccatgtatgttgcttgatatttttattatctttccattgtcgttttgttattattattgacattgcaaaaaaacagaaaacaaactcattctaatcgttgtccaatcagtatgtcattgaaacaaaccaaaaatgaattatttttttatttaccaatctttttaagttaatcgtcacgaaagaaggagatcaattattaaaggaaaaaatatatatatatatatatagaaggaagatcgatatcacgtggttacgttaggggtggacatgcgggtatgttggtcgggttcggataaaactcgatcgggtatggaatttttggatataaaagtttatgatttagggtaaatctaaattagcggtttatttttagtttagtccaatcatatttgggtatagatttcgaggtctttttttcagaaccgatacccaaattattgggtaaatactcgggttttttggtaaataccgggatttttaaataaaaactttggatttcgagtaaaatttggatattcgaataagatttttgagtattttcaagtctgagtcgaattcggttacaattttttgagtagaaaagtttaaagaaaaattctttcaaatgccttttccatgatgccccttttcaactctacccttttgttttatccattttcatttctaccctctttaaatttttaatgaccattttacctctatttgaaaataattttaggttaataaaatgaaatattaatattttctcgccaaaaaatttcccgccaaaaatttttcgaaaaaaaatttcccgccaaaatttttcgaaaaaatatttttcccatcaaaagtttttttggcaggaaatagatttacaagggattttaaaagggttttaaaagatttacaagggattttaaaagtgttttaaaatatttacaagagattttaaaagggttttaaaatatttacaagggattttaaaagatttacaagagattttaaaagggctttaaaagatttacaaatgattttaaaatatttacagggattttaatgaggtttaaaagatttacaaaggttttttaaagatttttaaaaggtttaaatttgttttaaaacggttttaaaatatttacaagggattttaaagggctttaaaagatttacaaaagtttttaaaatagttcaaagggtttaaaagtgttttaaaagatttgcaaggaggggtttaaaagatttctaagagatttttaaagagtttaaaagagttttaaaagatatacaagagtttttacaagatttttaaagaatttacaagaaaacccttgaaaaactcttgtaaatcttttaaaactcttttaaaatcccttgtaaatattttaaaacccttttaaaatttcttataaatcttttaaaacccttttaaaatctcttgtaaatcttttaaaacccttttaaaatctcttgtaactcttttaaaacccttttaaaatccctcgtaaatctatttccagcaaaaaaaaaatttacaatgatttttaaaagcatttttttggctcagaaaaaaattgttacgaaaaaaaaaattggcgggaaacttttttttttggccggaaaatagtttggcggaaaatttttttttggcggaaaaaataaaatttggcgggaaaatttcagttttcaattacatgttcctactagatgagggtgatttggtcattctgttcaggggaaagagtatttttaaaaatggacaaaataaaaaggtattgttgcaaaagggtagtaaaaaaggggtaattttgcaaatctctaaattcaaaatccaatatggtaaaatctaaaattttggattcgatatcaaatccaatttttcggatactcggttgcagttctttttcccagccctaacgtagcacgtgattcctctgctttggtattttacgtcacaaaggtaaaaacgcaaggaataaccaaaaatgatattttctgtttcttttttgtttaccaatcttttctaacggtaactaaaagaagcagattgattataaataatcaacctcatctacacaaaaaaatattgaatcggaaaaaa

SEQ ID NO: 1353 - DNA, 3000 bp, Unknown
  misc_feature (1)..( 3000): cDNA_ID_2134699_gDNA_ID_1620390_Annot_ID_155576 3000 nt of promoter + ATG
gagattttaaaagggttttaaaagatttataagaaattttaaaagggttttaaaatatttacaagggattttaaaagagttttaaaagatttacaagagtttttcaagggttttcttgtaaattctttaaaaatcttgtaaaaactcttgtatatcttttaaaactcttttaaactctttaaaaatctcttagaaatcttttaaacccctccttgcaaatcttttaaaacacttttaaaccctttgaactattttaaaaacttttgtaaatcttttaaagccctttaaaatcccttgtaaatattttaaaaccgttttaaaacaaatttaaaccttttaaaaatctttaaaaaacctttgtaaatcttttaaacctcattaaaatccctgtaaatattttaaaatcatttgtaaatcttttaaagcccttttaaaatctcttgtaaatcttttaaaatcccttgtaaatattttaaaacccttttaaaatctcttgtaaatattttaaaacacttttaaaatcccttgtaaatcttttaaaacccttttaaaatcccttgtaaatctatttcctgccaaaaaaacttttgatgggaaaaatattttttcgaaaaattttggcgggaaattttttttcgaaaaatttttggcgggaaattttttggcgagaaaatattaatatttcattttattaacctaaaattattttcaaatagaggtaaaatggtcattaaaaatttaaagagggtagaaatgaaaatggataaaacaaaagggtagagttgaaaaggggcatcatggaaaaggcatttgaaagaatttttctttaaacttttctactcaaaaaattgtaaccgaattcgactcagacttgaaaatactcaaaaatcttattcgaatatccaaattttactcgaaatccaaagtttttatttaaaaatcccggtatttaccaaaaaacccgagtatttacccaataatttgggtatcggttctgaaaaaaagacctcgaaatctatacccaaatatgattggactaaactaaaaataaaccgctaatttagatttaccctaaatcataaacttttatatccaaaaattccatacccgatcgagttttatccgaacccgaccaacatacccgcatgtccacccctaacgtaaccacgtgatatcgatcttccttctatatatatatatatatattttttcctttaataattgatctccttctttcgtgacgattaacttaaaaagattggtaaataaaaaaataattcatttttggtttgtttcaatgacatactgattggacaacgattagaatgagtttgttttctgtttttttgcaatgtcaataataataacaaaacgacaatggaaagataataaaaatatcaagcaacatacatggacgagtaagtatttcaattgttttgtactgctatattttaccctttgtaagtattttcttcaaagtcgagccatgcactactaaacctaagtaaaggaaatttggtattgcagtttcaaaatagattactgtatttttgcagctcaatatttgtgtacagtacatagtctcatactctcattagtctagtggtatgtcccgcttagaaacctttccaaagtaaaggtatcgttaggtaaggtgtttaaactaaacctcccaccatcgtttatatcttgttttcttaattaaaatattgggttttgtaaaaaataaacatttaacttgtcactttttctaactttactctttacttccaaaatgtatattgatcatcaaaatcaaaaataatacgaaatataattgtttttcgttaccatcaaattcgtaaaaatttaatatatgtgacagtgaaaacgttaactatatacgtttaagagtcatattacgtattatttaagatttcgtagtattaatgtgcactttttttgagtaaacagtaaagttgcaaaatttggcaagttaaagtttttttatattcgattttcattcacaaaatatcgaatctagtacaaaccaataccattaactattgagtattgactgtaaattctttttactaatctcggtctccgtgtaggacatctctgcacaaaaccctaaaatattgaattgtgctaaaaaaaattaaaccgatagtctttacaatttcaggaccggttttattttgatggagatattagaattatcccacattagaagaaataatattctttggacaatatatatgtacagtattgtggcaatcctccttccttaaactaatttttgagtgtgaattagccccacactaatatgaaatctatctgactttttcttgtttttatttgcatagaaatttatgtagatcttttttctactatactatttcttacgtttttttttttttttttttttttttttttttttaagtatgtttcaaaatggagaagcaaaactgcaaagccataaatgtacaaaattattttcacgccatttttacaaattgttattaatttatcattttttgataaaaatctgaacttataaaagaattttataaattttggagaagtgtatggaaaactgatttttaaaattattttcagaaaacattagaaacttttataattgtaccaaacatcaatacttaacatgtgattgtgaatacagtatttgccaaaacaaaaaaaaacatgtgaatacagtataataatatgtcatttctcctttttatagtggatattaggctattttatacgcatgactaaactttatttacaattcatataatccgtttatgaccaaacttcaaaatcacttttatctatcaaaatcataaaatcatagttttgtcataccacaaagtatcaaaacccggttcaataatcgtaattacctgttcgggttattgaaaccggttcatatcggtttggtttgatttgtatcccgacctaaatctggatcaaaattaaattatcctctttgaaaattagatctgacttatg

SEQ ID NO: 1354 - DNA, 3000 bp, Unknown
  misc_feature (1)..( 3000): cDNA_ID_2045924_gDNA_ID_1620391_Annot_ID_155601 3000 nt of promoter + ATG
tgtgttttatcgagtagttttgataacaaaggcgagttgctggattcttcttggaaattctaatctctggaaagctgacaagagcggatggtaaatcaaattcttgattagcatccagaggatattattattaatacaagataactacgatcagatatttactctttcatggtatatacatttcatttccatgatctcgaaaaccctttaattgaacataaactttattcgactttgcaagaacatcttttcatgataacatttctccctaaatgagaaccaatagattagctttgctaagtgcattggttaagttcttctgacaagtataaacttgaaacatatatgaccatcaaacgtagctcaaagctcgaccccaaaaggtcttgcgttcatacttgctaacgggtcaaatccgcccgccccattgttccgtgactccaacctccaacgacaccgagtaataagatagttccaactaattgacctgaatcttggaacatgttcatgaattctcgacaccaaaaatgttacaaaaagtatccattaaaaagaggaaacgtgttacttctattgaaacaaagaaccaacaaaacaaaaaaaaaactttatgcctactttttgaatctttataagtcaagctaaaataaaaggttgtgaggcacaagcaaagctgagatttgttgtattcgtataggaaacaccaatggaccaaattttataccttgagttttgataacaaaggtaagttgctggcttcttcttggaaatctaatcttgtatgacgattcgggaagctaatcagagcggactgatagaattctatatgactaaataacatagatataagcatatagaataatttccaaaaagcactacaaacttttgatttctaggaaagagtttgtccacatgaaccttgtttgagcttgctcatcttcttctccacctacctttgatgacaagattggcctagtatctgatggtttttggttgatatctaatctttgagctatatactgatgcagcttgatatgaaagatagagatgaaattaatgtattgttgggtcactgtagaggattgtattcgtaatagtattgttaccatgatctatgatgcttttacttctttcaacaactagtttgatgtgcatcttttgttaattaacttagaaaattgtggccatatatcgctagagttggcctgaagaccaaatgtgacgctaatctaaaatacatatattgctaagaaattcgctcaagttcttgggatgatatttgaccaaaacaaactgtgatagatttgggccacaattacaatttttagcctacactaattattggaccaatcataagattggtttggcatttgttaaacataatgtacaaatctaatcaaaatatcctaaaatatcacttaaatcactccaaatctaaatagtaaattccatcaaatctttcaaaatatcaactcccacagtttataaaagaactattaaaattttcatatattgtaattttagctacataactttatataatgagaaatacaatccaaagatatagaactgaaccaaaaaaaacataataaattttagctaaataactttttatttagtaaaagattttttttttttttgggttcagttctatacaataaattaaaataaagaaagaagagttatgttctaccaactatataataaatggtgaatgaagaatcattaaatagaataggtttggtgtccacataacataaaaaaaatccaatacaggatagtatattcttattttatggtttaaaaaataatatttcaaactctctaatatataaaaagaagttttacattgaaaaatccgcaaataagcttaaaacgtgagcctattgacttttacttttttaaaataggcgttatattttgttgtttttatttaaaacatcatgaaactttaacgttttcaattatcgttcaacgaaacgtatattttatttattgtgcgttaagtttttttttgtcaacatatgaatcatatacacaagtaaactaattttgtcactacttaataaagaaaaaaaagttacaaaactaatttgaataaaataagttcattcctttatcagttacaataaaatcaacaaaatttgaataaaattagtcttcacaaaataatactaaatttgatggatttaactatattagccaaaattcaaaaaactctcatagaattttaactactcatatgattaggttggaaatgaagtataatttataacaaatactcatttctaaatgtcttggaaagataagtcaaaatcattatgacattatcagtgactactgactatgaaaatttgatttatcttgctttatgaattcaacgatacagtagacagagtcaatttacacgaattaagtgatagttactgaaatgaaatctaaaagcgaataatgttatatccaaaaataaacagattacattaaaaagaaagtgatgattgattagtaatattaattgcaacaattaagtaaagaaaatcgcgagaaaagaggaacccacgacacattgaaacttgcaaaaaaaaaaaaaactagaaagcgtgcttcgcaatggtcttttctttttcttcttcttctcaatatacactaataaaataaaaataaaaagcttctcttgcaattctctcttccctcataaatagagatgcagtaagactataaatattgaccagtgtcctagagagagaaactcgccgcttttaacactttttttttttctggtttttttttttggttaagcagtaagcactaagcacatatctcgagcacacacacaaggtcagtcaaaaactgcttctttttctgattcatatatatatattgctttgtgggtctttggagcgtgcatgttttttgttcttattgttgatttgtgtgtgttttcattttctgggcaacggctagttattcccacaagttgtagacgacagaagaagatcg

SEQ ID NO: 1355 - DNA, 3000 bp, Unknown
  misc_feature (1)..( 3000): cDNA_ID_1022554_gDNA_ID_1620391_Annot_ID_155613 3000 nt of promoter + ATG
ggggtaaccgtcctgctgctagttgacaatgtggtgattgccttctctttgttatttattatcttatgggaccatattacttagaaagtctctagcttttgttgtttacttaaaccaagcctcttttttattctggatgtttggttttggtttgattcttgatttggttaagtgtctttgtggtgataatgttattgaagttattttatctgtgtttttttctgcagcacaagggagagcacgccttgtaactttgttgaggatatggagatcatggttacaccagggtctagcacgaggtcgatgtgcagagcaaccaaagagtacacaagggaacaagataacgtgatcccgaccactagtgaaatggaggagttctttgcatatgcagagcagcagcaacagaggctattcatggagaagtaagcttattctttattttatttttgtgtcattacgaagagggtgaacaacactcatgtgttttcaataatcttcaggtacaacttcgacattgtgaatgatatccccctcagcggacgttacgaatgggtgcaagtcaaaccatgaagttcaaaaggaaacagctccaaaagacatggtgtgaagttagagaatgtgatggagttaacagactaaccaaacatcagaaatcgtgtaatcttaagtaataatgtggttagagaacaagtttgagagtagcttagggaccttaaaacctcacaccatttgtactactaatcttcttcagatgcttagtgaaattttctcatctgtttctttcaagtgtttgtttttctatctatctctcatgtttattcaaagctatatgtaatgatgatgattgagagggatgtgtgtgaacatgtttaagcttggcatatagtgaaaaaaatgattcagatgcagaagaaagagacccaattgagaggttcacgtgtgaattttggtaggtgtaaaaatctgaatcatatcctttttctttcaactatacaagattggtcccttttcttctcttaccataattatgacgcacgtgaatgtgtgtgtaaatactttgacgtttacattgaaatactgtaatgtaagttcagagttaaaagtacaaacacaaaggtgaattttgtactaattagtaaagagataagagtgttttgaatcttgaatatcaaattattattaacaagaaactgacaaaaagatgagacagtgttcattgagaagatctctgttgttttatctttttttttacatttcttggaaattggcaaaaccagtgtgatgaaactgtgaaatcttatctcgaacccaatcattgttctatgtttttctttaatctctaaaagtgaaaaagtgaatgcatgaaacgttcagatacattcattatattatacatttatacatatggacatggtgtacgtatgtacacgggtgcttgtttgatcacgggctcactgactataaaaatcatgttttttgggacatatagattcgcttacatcaactgtgtgaccaatggggtatctgaattcagcttgttcgatgttttgtttgactcttttaaactatttggtagtaaaaagccaaaaaggaagagcactgattacgaaagcctttttgtctttttgtttcttcttctctagctctctttcgttctccttttgggttagtccttcaaaataaatgtctttaacttgtcatgtatagtttctttctctcgttgaacaccaaccataggccttgcaatgtgagtcaaaacatgcattgaaaaaagaagtgaatttcaacattaaatgctctcgtttaacatgcctatggttccattaagcaaagtacacactctatatatgtcgaaagaactatacagtcggtgttttagccctatagttagatacattcgaactgattacagaaatatcaaatatccagttctaagatcggattaaggcaaatacatttaaactacttctagcgaatgaggttcacatagaaaaactttttaaaatgaatcactaaacaagattcattttctttctaaatagtgtaaagacgagtgatgcatgcaactgctctcctttccgttggtcccttgtcaaaatatacgaccgtgaataattcttcccatcatatttatctgtcggagagttccaacctcaaaacattctccttctcttatcaattctttctaaaatcataaaccaacaaactgggcctatgatcaattattcatattcaatttagcctataactaaaaccacactgctttcgttacactggccttccgacaagtctctttgactgtttttatcttaagcgccatcaagttttaaagaagacaaccccatatctttcctcccatgaatcatcgtgtccatattgctatagttcatgaaaaaactaaatactatcgacaactgaagaaaagatccggatcttgtggaccgagtgaatggttgggcccaattagaatggtctaccctaacatctagccgtctacacgattgatcatacgtctaagagggcgaaaccaccaaacgtttggattttatctaaattgatgtacataaagctaacatgattttagtataaacattataagcatcatggaaatcaataagctaacatgattttagtagaaacattatcagctaacatgaattactaaaaacatttattttattttaaggaaaaacatacaatactaagattttttataacattttttctttgtaacattataaattgttttagtttctacattaattaaatatataaaataaattcatttaaataatataagaaaacggaatctttgattaactgctgattattggccactgattaatttccgaccccatcaatagatgagatcagacatacacaacttaagtagaccaaaaaagcggttggtgtaagatcccaaactcacagattcccaaataatagtaatactcttcctcttctcaactctcaccagtcaccagcagatcatcggagatg

SEQ ID NO: 1356 - DNA, 3000 bp, Unknown
  misc_feature (1)..( 3000): cDNA_ID_3061894_gDNA_ID_1620391_Annot_ID_155619 3000 nt of promoter + ATG
tctcaagtccgtagaattattgtatatttttgtattccccgaaaacactatttgccttattgctttgtggtccaaaatgtttatcagtgagcggcaagtcttgtaaactagtgaataatgcctcgcaaattgtccagattcattgtgttttggcttattattgtatatgccacaaaacgactgagagtgacgatgattcgctacgtttttttttctataataaagtttataattattgatgtggttaccacttagatattaaaatcaattatatccttttcaatgattctaatgacgattggataattaaatttagataatgcttttttgtttgctacttttttcttttgtaatgaagattgaaatgctttgcactagttgggatcgaatctgcttatagtatagtacttatattcccacagtacatccccgacttctttttaatggtatttgcaactgatcatgtgtacaagaatggactgattaatctctgaaacatgaattataatttaagctaagaaaagtaaagaaagtacctaaaatagatagtaaaaccttataaacataaatctagatactactttaactgataaacttttttctgtgaggccattttttctaatggatactaaaatttattatgtgcaattgaataaaatctgaatatcactacaaaagaaaaaaaaaatgaacaatggattgactagtaaaacatttgaatgattagttattcactatatatgtaaaggatgatgtttgtgatggtactatccaaattgacaaaaaaaaaaaatcaaagatatttcgtccaaaataaatttatgcgacgagctgacctaagtaatgacttgtggtccgaatccttttctgtatagtgtcttctgctaattataggcaaagagctgatatacgcttctctttgtctctcttgcgatttctcctttttatcttttcgaatctatcaggttgggccaaactaaaatggaccgagctaaaatattactagactaagccactgttatgttgagttgaaccatctttatttgggtcgagccgttgtcttaatgggccgatgttctaatggaccgttttaccatattagcagcttgtttgacttagttaatctttgtttggccgaattaggcatggaaaacaaaacaagtattacatactaactatcacaaaacatatcgtaaaaaagattatatattttttcatgcagatttttactataaaatttaaaattaaatgtaatgtattaattataattaaactacaataaatagaagttaaaacaaatattagaaaaactgaaaagtattgacttaaaaataatattgtcatttaatttgttcgtcagatactcagatcttgagccatcatgggctgttgaatcttgagccaccttgagtttctaaagctggttgtggcaccatgtgatccacctccccatgatgtcattggaagcaattcgcaatcataaaatggtattattgtctagtttaccattttttgatattttgttttaaaaatgtcatttttactaaaattttacgtatttattatttttaatatttaaaaatatacgtatgtacgatatttttttcgcaaaatacatattgtatattaaatactaaattttaaaaataaatagaactgactaaatccaaatataaaaggtaaaatgcatgttaaatcataattttattatttaaaaatggtaaaaaccacaaattattcaaaaatacataagctatagttgattcttgtccaaatttgtgtacgaatttgcaaactcgaaaattcatatacacataacaacaaaatccttaaacttgtaaatgaatataattgaccgtttttcacaccattaaatcgataagtctaaaaacctttagctgaaaccgaattacgctaaaatatttgaccgagtagtcaagtcggaaatgggcacaagaccatcgaaagatcttcttttacacaccgtaatagtgaatacttacatgcaacataaattatttgacggttaaacccaaattaatactccataaaaagacacaaaatatgtagaaaaagacaaaaagcaatggtaattgtaaaacaacacgttttgctcgttcacctacgtggtaagaagtcaccaagtgatgtggcagtataattttaagctgaaaccgaatttgcttaaatttaaccgagtagtcaactcggaataaatgggtacaagaacagttctttttttatacaccgtaacagtcaatatatatacatcttttaatggttaaaaacctaattaaaactccgtacaaaagacaccaaaaatgtagaaaaagacaaaggcaatggtaaaacaacacgttttgctcgttcacctacgtggtaagaagtctccaaatgacatggcagtataattcttagctgaaaccgaatttcgctaaaatttgacggagtagtcaagtcggcattaatgggtacaagaagatcgaaagttctttttttttacaccgtaatagtcaatatatacatgttttgctcgttcacctttgtggtaagaagtctccaagtgacgtagcagtataagttttagctaaaaccgaatttcactaaaatatgtaaccgagtagtcaagtcagaattgatgggtacaagaacatcgaaagaaccgtaatagtcaatctatacctgcaacataaaaaatatagaatctttagacagttaaagacctaattaatactccgtaaaagacaccaaaaatgtagaaaagacaaaaggcaatggtaaaacaacacgttttgctcgttcacctatacgtggtaagaagtctccaagtgacgtggcagcttctatgaacagagacgaaatattgtccaaattcatttcttacagtaacaaacgtacgcatatttaagatctagtgcagaggttgtctttcccagcctgtcaacagacatctttataattaattattgagaaaagagaaaaacagaggaaaaaaagatg

SEQ ID NO: 1357 - DNA, 3000 bp, Unknown
  misc_feature (1)..( 3000): cDNA_ID_2045869_gDNA_ID_1620391_Annot_ID_155622 3000 nt of promoter + ATG
gttcttttgcccgtatgggcttgggaacagtggagataagagagagtcagataaagagagagaagagaatgagtaaaggtggtgcatgttaatgaaaaggagattgattggtgagaaagaaagagacctttgaattgggaaatgaaacttctttttattttcatatcttgagattagcatttttgggttttgcatcatctctaaatggaactctatttgctattggcttaactgtaatttcctcgcaaatggaactctatttcctttagtgaactttgactattacctttgtctttcattttggcacaccaagaatcacaagattaccttctttgagacacatatttacacatgaattatttcatcatattttaataaaaaaagttggttcttgttactctatttcattttctactttctaataatttaagttacagaaaaactaagtatatttttcctaccaaaaaaaaaaaactaagtatgtttttactaaatactatgcttaagttatataacgatatatcatgtaaacaaagaatgagagttcaagattgtgtttaaattgcgtgaaagaaatcaaataaaaggaaaatctctttcatttatgaattatgatatttggctttattcattagtgcttatctagattcaatcgttttgtagaggttgataaaccgtgtatggaactaatgtttgtataatgaaaagttgtgttcagcccccaaaaaaaaaaaaaaagaaaaaaacatcagtcgaaatcaatatatttgtttaaagaatagaagcagaacactccacaacttgagaagcaaatgggtagtcataaagactgtgatgggtcctgactcctgaccgatcgcaccgcccacattcccttgcaacttgtctcctcatagttggctacttcctctgttcactataccaaaaaaagtaagccaattagttttacgttttatggacttgttgcggcccgtttagctttcatttgttattactaggccggaaacaacccactggcctttacacctctataaaccaccaacgcaagttattttcttttcgacattgaaatttaatatatgttttcatcaatctcaaattcatcacaatgcagtacaagtgaattaactaactacactgtaaatctgtttgggttacataaattgtatagcgtgagctacatacaaattttctttcttttcggtgtatgtatttttgtgttggtttttgttttaggattctcatggcttttgaattgtttctagttatgcttcatgtcaaagcacaatttcatttaggtttgacaaagctagtcatagtcatgaaaaatatagggagtatattaaagtaggattttgctcttctcctattacacaacttgacatgctttttgataatcaatatttataaatagactattttatttaaactactcaacaaaaagacccaatttaattgattattatttaattatgaaaataaaaataggactattatgtttcttttctttaatttttaaaattctgtttctaatttgggctgcttagttgagtagtaatgtagaggactgttttaattaattactgaattttttattttaaaaacaatactattagtaatgtaattttaaaaataaaaaatagtattgtttgcatggaatactttgcctcataatggtttcactttgactattagagaatgggaagaagaactgtttgaagatgttgaactggttcttcttcctctttgtcggagtaatctgaatcgaaatcgacgacaacctccattgaaaaacatatatatatatatgtatagatttaagagaaacctagtaacatatttaatcaattcaatatttgatttattgtttttaaatagataattaaacattttaaaatagaaaaacaaaaccagttcaaaaccttactttatgtaataagttagatacttaataaacaaataaaagaaattaggtttgcaagaaatctaacatgaatggaaggttaggtaggcataaaaatgaaagataagtaaggaggttggtaggaagagtggtggaggatcaaaagagtatggcaaaagagttaattgccaaatgcaacgtcacttctttcactcctcatctaactctcaacactatttttgtatatataatcttgaacaatcggttatctcaacatttgcatattgtctacttttagattttgatatctattggaactcttactagctcattcatccgtcgggtaactttcttgacctctctccatcttatcttttacgagtcttaaagactttacttatctaagaaaatccgttttagtctctcaaaattgatttattagatggtatattctagtcacaacaactattttttggacgagaattttacaaaataattgaaggatacttaactctttcttactaaacaaaacaacttaaatctatatccgatatgaattcttgtgggtaaagaatacaaatcatgtatattatctggatatccaaattattcactaaaattttataaattatctcaaattcttctaaatttgtaaattactcaaattatcaaaatcactaatacccaaaatgagaagaaacatttattgcttaaaagttagattcttcccacgtggcccggtttagttatagttgccgacgattaatttccggtcacatttttaacggcgtgagtttgtatgtggcgtaaaacatgtcaaaatgcgatattttcgtaacgacgttaacttatacaaatacgacaagacaaggttttggcaacgaggccaatcagaccagacttgtgagaactgagaacgatcgatcaaaaatctctcccacgataaaaatgaggaccctgaagctcattgtacttaacgtcttcccctttccagaaaaatcaaccaaacccatttcagtttccccggaaagtttttgtctttcaatcaccattagaattcagctgcaacacaagtgtttgcaacagagagaatcatg

SEQ ID NO: 1358 - DNA, 3000 bp, Unknown
  misc_feature (1)..( 3000): cDNA_ID_1025511_gDNA_ID_1620391_Annot_ID_155621 3000 nt of promoter + ATG
agaatcattgaaaaggatataattgattttaatatctaagtggtaaccacatcaataattataaactttattatagaaaaaaaaacgtagcgaatcatcgtcactctcagtcgttttgtggcatatacaataataagccaaaacacaatgaatctggacaatttgcgaggcattattcactagtttacaagacttgccgctcactgataaacattttggaccacaaagcaataaggcaaatagtgttttcggggaatacaaaaatatacaataattctacggacttgagacttagctataagtcaatattgaatattttatagaaatccgagactagtggagacatcgcatgaattaagacggtttatcagcattattcaagattgatttggtttgcatctaactaacatgattaaaaataagaaccattgattaattcattccttagagtatgggttcatgcttgcatataaatcactcgttcgatttatttcgtattacatctatttattctgtttaggtgcaaagccggtcttaatagaatattgtcttgagaacatacatatataaactgtcattgtttctatctccataaattttgaaatcgatcctaactagttgaataatccctctataccaagaaggcaagaaccgacatttgaattaatttaaccaattatcttccacaattactttctttttgttgtccattgttcttcatttacttttgggttgaatttatgaactcaacaagtcaacaacattttatgaatcatatcaattttgggtacacaatcgtgaagataataacggagaaagcttgctaaagacttaaaagtggtgtttgtgaagcagtctatatggcccactattaaacatatgtgatatcatgcatgagttttggttactcattcaaaagtatgctgaacaattctttttttgttttcaaaaattacgggtatgttagattattttgagttaactaaaaagcatagaagattaaaaaaatgttacattttttatataaaatattacaactacatctagtgccggcttagcacatgtgcttaaggtgctaggacatatggtctagggtccaaaaaaaaaaaaacatgatatgattacataatagcactggatctacaaaatgtttgagccggtcctgactacatcacataatttcatgctaatgtttttgtgtgttcttacgcctaacgtcttctctacacaaaacaaaaacatgatcatgatttagatttggctgaaaacagagttcttgatttgaatttgactggaaaaatgtttcttgatttggttgaaacatgttttcttattcgccttactctcggatacctcgtagctgagaagatatggacattgttctttatagaaataatgtaaagcacgacttccataccttcttgcaaggatctttgataagttcctatcctcattaacatgtgttgcaccttgtttttcgatcctctaagcttccaagtatatgactacaacaacgagattgaatatctaatgatacaaatggtatcttaactatatactttcttttcaattcttctggtaatgtgtatttaacaattaattttgctaatcttggatgtagctttgcacatggattgctacagattagagctgtcacagcgggctgtccatgtccattagcccagtccaataatgtccatttcgatattggacaaatagtgttcatgtccactaaggcacatgtccattaacgcccgtgcccattaatgtccatgtccaaatgggttgtccaataggcataacaaaaccaaattttaacacaatagtatttgcttcagcaagatgcttgaatgtttctttgtaaataatcgctctagagagcattagatgtgtagaattccattttgtgcttactaccaattcttttttctgtttaagtaactcatattagtgagctaagcttttgatatttgcagtttcatgaatacacggtgtcaaaggaccaagcttcatagttcatactatgcataatgcagacaatgaacactatatcaaacaatagtaacagaaatcgaaagagacccatgtcaaaatcactctcaataagcaaaaaacagtaacaaaaaatcatttcgaattgagtaatcaaaaacccagatcgaattgagtaaaaatgacgagaatttgcttacttgaactggattaggaatctcaggaggatccatgatgtgatggagttgagatgttgaaggaactcgccggagaaatcgccggaaagaagaaatcgccaaataagcgtcggggaaatgttttttccccaaatttatttttgcccgaacacttaaacctaatattttttgaccattgggccgcccatgtccatcacgtccagtccgctgatgcccatgtccgttaacgcccatgtccattaatgcctgcttcataatgggcttgtccatgcccggtccattaggcgttggacacgggccactcgtccattttgataactctactacagatcaatcgttcaaagaaataataaaatctcagtagacctatgtttggaagaaacaagaaaatttcatagatccgtataatggatccatgattcaagattagcataattaaattcgaaagtaaattgaccttataactaaagtaaagtgaattaggtggttacagttttttccaatgacattgtaacataatatcttacaaaagccaatattactatttgaaaggtacttccgtactagtaatgtagggatttgagacgtgattatttatccttaatattctaattagattgaaggtttatatattaagttttccatagttaaaagtcaatcttgaaacaaaaagatagtttgagggttctcttgtaaatttcctaaaagtaaaacattaataccctaaaaatcgaaaaatcagaaaaagcttcggagcaagaaaaatcagagaaaattcaaaaacccttcacttgcctcactgttcttcgtc

SEQ ID NO: 1359 - DNA, 3000 bp, Unknown
  misc_feature (1)..( 3000): cDNA_ID_2045887_gDNA_ID_1620391_Annot_ID_155615 3000 nt of promoter + ATG
atgacacatcttctacgaaaatgcactggaaagaatgagtttgggagcacatagtttaaagattggttaattttcacgttggagtcaatttggaaaaatgtaattcctaagctcagtttttctagtacaatatccaaaagtgatacaaaggcagcacgaagagtatcaaaagctagagagaaagattatattttcactaaacctaccagttttcgaaataaaaccaagaaacaaaattaacatcaatgatatgatacgctttctaataatggtctcctaatgtgttgtaagtgggatatattgaaagaattaaagttcatataagatacatatgctcttggacatatatatgatgcagtttagacatagtttataattgaaagtgaaatacaagaaatcctcattagatagtttatgaaatatattgaactttgtaaaaatagtaaacaaaaataaatctaaatttttatttattttgtatttgaaataaaacccaaaaagaagatcttttcatgaaagagaaaaaaagaagtaaaattggttgtaaatttatttctgaatagaaaaaaaaaagaaattgtgccacgcaaaaccttaatgcttgagcttaataaaatgaaccttaatgcttgagcttaataaaatgaaccttaatgcttgagcttaataattggggattatgtggttaatagtatggaccaggaatcttagtcagcaaacactatatggattttctaattatcttaaatggaagtagtaatttatttgtttttgttttttaacataggaaattttgaaatatttaggtccaaattcgtggtttccaaatatctacacttcagatatccaaatttgtggtttaatatatatgtatatccaaactaaatttaattacaaaaaaaaagtggaattttaatatttagtttgccattaaaagattttagatacagtatatggatttttgagaggcatggcactattattcggaatcatagatccaatccggaattctttccgatccgatccagaaaaccggatatccaagataggtgaatccagatccagagaatgaatttacggatacgtataatccgaattataatttgattttaatttataatggtgggatacataccttcatctttgttgcctcgttccagcttgcatttctccgtagtaacatgttgcagatgattccttcctaaaggttttgattggtattttatatttcgcgcggcccaattgtcacatacattttgattatatccgcataataaatgttgttagcaaacaaatgaggattaatattgaaaattgtccctagatcaaaaatttattactgaaatcatacctttctttgcatataccacataaaatgccaatgaatcaaaattcatcacaagaagcaatcatcactagtagctgatgtgtatatgtagacgtctctttagggtttttacaacaatctccatggaattttcgatcaacatgttttattaaatcatattgattttttattattttatgttttaaggtaaataagaaattgtttattttcttctttgtaaactattgtcggatcatatatttatgtgatgtagaagccatgttatcgtgtacaatgcgtgttaaaacttaaaattgtgaaacttttgtatgtaataatgattgattgactaattgattttaaaagatagaaaatatataaattatgggtccacatggtaattttataaagaaaaaatcccggattttttctatttaatcgagaaatatagataatgatatacaaaaattggtgattttttgtgaaatgtcagttgactagaaatttgaaacaattcttatcaatgtatttttaaaaatatcatgtttaatatgtaagtttaatattcattagtgtgcataatgtaagaataattactaatttacataaatattttctcttatatgtgaaagtatttaactactgatttattgatatacaatgaaaaagtatgggctattaactttatatgatttcaataatttttatgattaatatatttgataaaaatgataaataataaatcattattttaaaagaaacatgtatatccaacaaaaaaagccgtgtgtaatacgcgttggttcaaagggtaatttaactatggaaaatagtcctagatttatttttgttaaattgagaaataaaaatcattatataccaaaattgtaaacttagcaattttttggtgcaatttccgttgactcgattttttggaaaaagtctgtcaatttcaaagaaaaaatattatgtttaaatacttaagttgaatatttattcgtgtgcataataataatttatttttcgtataaacattttttattctatgtgaatgtatgtaactagttgtttgttgttacatgttaaaagtatgtactattaagtttatatggtttcaataaaaaaaattcaatactttttatgatgaaattatttgataaaatttaaataaatgaaaattgtttttttaacaacaaaccgatcatattaatgagaatttattttaaaatagaaaagccgtatgcaatacacgttatatttaatagaaaattcgtagtcaaatgatgaatttaattagcagtttaatttttaagaagttaaagatttagtcaaatgatgaatttaaatttattcgacaacaaaaattatcaataaatcaaaaatgtaaaactgacgattattctatgaaaagtgaaaacacaacggaaaatacaaataataatgatgagtttggggttttatttaaaaataataataataataatattgtttttgacaattagataaaaaaggtaaactttttttttcttctcctttgttttattttaaccccacaaaactcgaaaacctttttcccattttctcactttccctcttcttctcctccctcaaagcttttccctctcatttttctctttccgctttcaagcttcttttccctctctcaaaaaatg

SEQ ID NO: 1360 - DNA, 3000 bp, Unknown
  misc_feature (1)..( 3000): cDNA_ID_1011462_gDNA_ID_1620391_Annot_ID_155605 3000 nt of promoter + ATG
gttgaagaatcattgtacatacctcgacaacaaagaattttgtgggatcctcataacagttatggcgtactggaaagcaaaacagtaagtattctaggaacgacatgttttttattcttccataggacttgtcttatatggtttcttcttgtgcttttatttgtgtatgctaagtaaatctgacattcaatcatcaggggacagagagaatccaaggcatgacactacatatgtgtgaattgccccgagcagcatccatagatgggagtgcttttgagcagatggaaaatctcatatttctcaaattcttcaaacacttaaatgatagagagtccaagctgaatatcaattcaaagaatcgtatggtacttccacgcagccttaggctattgcattgggacgcatatccattaacaaccttgcttcccacatttcctctgagtcgtcttgttgaacttcatctgcgttacagcaatctggagaacctgtgggatggaaaaatggtaagctataaacgaaacttgtagtttgcttttcagttttcaactctcagcgtttacaaatttagaatgtcaccaacgccatccaaactgtcctttctgttgtatgatattcagtcgctcttggagttaaggatgctagatgtcactggatctaagaatctgaccaaacttccagatctttcaagggcaacaaagcttgaggagctgattgctaaaggttgcacgaggttggagcaaatcccggaaacaattggtagcttaccttcactgaagaaacttgatgtatcccactgtgatcgcctcatcaatcttcagatgattataggagaattgcctgcccttcaaaaacgtagcccagggctttttcggcaagcttcattgagtttcccagatgctgtagttacactgaactctcttacgagtctagccatccatggcaaattaaatttttggttgtcacatctccgaggaaaggcagaccacctctgctttagttccgagcaatggacccctaacaaatttctgaagcaagtacaaaagacgcctaagctcatgtctgagttttacggatttaaatcactcgacatcatgcagttcatctaccgtaaagacagtgcctctttccagtgttatagcttttcagatttcctctggttaaccgagttaaatctcataaacctaaacatagaaagcatcccagatgacattggccttttgcaggtcctacaaaaactggacctcagcggaaatgatttcacatgcctacccacagatatggaaaatctttctagtatgaaatctctcaggctttgcaactgcctcaaacttcaaacactaccaaaactacctcaactggagacactcaaactttctaactgtatacttctccaaagtccactaggacattcagctgccagaaaagatgagcgtggataccgcttagctgagctttggcttgacaactgcaatgatgtttttgaattgtcatatacgtttagtcattgcaccaatttaacatacttagacctcagcggaaatgatatggtgacgatgcctgtaactatcagattccttaggctgttgaatactctctgcctcaatgactgcaagaaactcaagtcaatggtacagcttccaccaaaccttacatctctctatgcacgtggctgcacttccctggaaattattcaccttcccttggatcattccataaaacacgttgatcttagctactgccccaaattgaatgaagttgcgaatctgatggatcgatttctgagatgtggacgaaaggaagaggtgaactttcttcccttgtgtttctcccttgctcaattcatacatcgattccagttccatatcttttcttttatatttgatcttaataggtgcctcagcgttttgcttgcttatctggaagtagagtgcccatctacttcgactatcaagcaagggaatattccagagaaatcagcatacccccaatatggcatgcctctgagtttgtgggttttgatgcctgtatcataattgcttgtcagagtccttatcacataaagctctcgtcatcttcttatagctgtaaacaggaagataaccagtcctaccgaattgacctcaagcccgatttcgttctcccaccggagagtactcgtagcagcaatgacaaagaggcattctcagcacatcacatgttcatcttccacgttccaagtaacgtagacttcaacgagtttagccttgagccaaaacttgtaatttcagaggagtttcagtctacaccgggcagaataatatcatacggagttcgagtagtactcaaaactgaagaggatgatcgaaactacgacataaactgcggaaacctatccaaaaaaaggaaaacagatatgttgacaatttgaaggataagaacgacgaccaaatcatagatttctttcaaaataaaaacaaatgaccgatgcttcatctccccatgtatattttcctcatcgatcgcccatgatcaggctgtttctcttccaatttttatgagaataactgtggatttttggtttaccatctgcaggcatgcgatcgctttctcttaacttgaaatctctgcaaatgcgtctggaatcgatgttggtcggtgagcggggaatttcgtcgtctataaatccagggaaaatcatagcaaatctgttttgtgcatccatcctctcaagctcaccgaaaaagtttccaaaattatttttcttttttaaactcaacatcactgggattcactgctctcccgtcatcaccgattcggcgattccgttctgttggtcttgtgtatattgaatttagtttctctgaacccatgcgattacggataaggcctaattgattcggcccatcataaaaaaaacaacttattaaagtgacgtaaatacccccaaaaccctaattcaaaagaacacgagaaatatcatcagccgctcaagctctcaccacagtttgagaagcgaaaatg

SEQ ID NO: 1361 - DNA, 3000 bp, Unknown
  misc_feature (1)..( 3000): cDNA_ID_2045893_gDNA_ID_1620391_Annot_ID_155612 3000 nt of promoter + ATG
gacgtaaatgactcttcgtacaaatgcatttagtcggctttgtgtgatgcggacaatggtttgtttgccataattacttaggatagcgagccgcgttttgcatagctagggaattaagccattggtgcctaggttttagcatttatccgcagaaccaaatatttttcaaaattttggttacaaattctaccgcaacatgtccacatgtagacaatcggataatcatctcccaacaacatatactccaattaaatagttgattccaatttcttatatttaaaatcaaatgatataaaaaatgatcattgaatattggtggctagtgccgggttgccgaaataaaatataaacgagtggactgaagaaagttttgacttggaagactacaaaatagacaatattttccgttaaagatagataataaaaagacaatgcttttgtttgtacctaaaagcactaatcaaaatcgaaaggtaataatggaggtgaagaagacatcattctcacataatcatctccgcatcctcagcttttgctattaatattatatttaatataatttgttacgtaaatcatataaattgttcaaaattatttactaatgtgcaattaaaaataaagaaaatagtggaacaaagaacgtgttcattggcaatcttaacaatcgacgagtatgaaaggatgaaagatccacctagtcctagaaaaacaaaagtgttcttaaaatgttatagatgtatctagtccttgattaataatttttttaaaaaaatactttcataatttttagaagatatatattttatcatgcttagtttaacttgtggaatcacacgaatttgttttgttaaatggcagtgagtagttggaactttagttagcataagagaaaaatatttaaataatttgcaatcctcgggagcggtgaggttaacgttaaggttaatgaaatacttagttatatatgaatgtgttaatatgcggtgcagcatagacgtgctccatattttagttttaatgcttattctattttaattaagattaattttgtggacattgggtttccataatttctttgatattttaattaagatttgataaatttgttttgagattttataaacgaggtttacagaactttttaagagtatactctagttctttgttcttagtagtatatagcctatcaatatattctcaaccagtttaaatagatttatttgactttttcaagaatttcaaaactaaaccaataattttgctatttatacttatttctttaatgggatcagttgcctatctttataagtattctatacgtcaatgcatgtatttgcaacgatttattaaggcatgtgaatgtgaatgaagtatgaagaacgtgtgattagggccctacttgattcaagcaataacactaatcgacatcacacaccaagacgtacaaccccaacccaacaaagaacaaactctaaaaattaaaaaataaaaactctgaaattgtctgatttagaataaatatatcgttactatagagggacgattggctttgatagtaatactttttttttgttttcaaaatattaaatttatgaatcaataatttacgatcattaatgagagattgatgactttaaaattatgtttaaaagatttaaataatggatgaatcattatggaaatctttagtcttgaagagtactaagtataggttttttttttttttcttttcggttttgtattccaatgttctttttcaacataagaggcaaatcaactagtttgtcttagaactgcgtttaattgaatttgacaataattgtatttttgattttttttatcatgatattcatattcaaatcaactagttatgcacccttgaaattcactaacatcatatgaggttggatatctcttggtaagttcagaaccgaaccaccacatgtccatatctcctcccgtaaaatcagctatgctatcaatcatattgttttcttcttgtttgagagatagggaggaatatttgggccggaggacagtttattcctcccggaagtcatttcgaatgttaatttgtttttgaaaaacgatgccatggcataatccgagggaaagagtctctcaccttgactaacaacaaacaatctaacttggtccgcgggcaagtggtcgaatcacctaacatatgctcaacagcaatacaacacaaccgatgttccccataacaattgtgaccctatgatggaaaccaaaaattagtcccaacatatataccataaaaatatgtaaattgataaagcagaacctagtgtttggaaaggggctctattctttctaccccaaagacaaaataataaagataataaaaaatgatgacaagagagacaaaagtaaacaaaaaaaaggattttagaaatgtaatagatttccaatatcaacgctcctttttgttcccgctttaacttttcccactcgcaaatcattttacctttggattcaagcctcatgatactttttctttttctcacactttttacactattctctgttttgttgttactcatctcttatcaaacattttaaacttgtcgactttcactcttcactagctaccattgttaacttttggttcttaattcatattttctgctccaactttgtagagaatcttttgttatcccaaagaaaaaggtgcctaaattcacgtttgacaatgttgcttgaaaaaggtttgatcttgaaatttcaaaagagggaaaaaagtaaaggagaaaaatttggagagacaagaagtgagtcaagggacccaacaacaaagacaaagacaaaaactttggattttgccaaatactatgattaatgctcattcaacactactattaccatttccatcatcatcatctctctctctctctctggttttggaaaactgcctgagaaaaaacctagccataaccatcttcttcttctttctcttgttcttgaacataattctgcttc

SEQ ID NO: 1362 - DNA, 3000 bp, Unknown
  misc_feature (1)..( 3000): cDNA_ID_2134579_gDNA_ID_1620392_Annot_ID_155635 3000 nt of promoter + ATG
aattatttataaccattgtttacctttacaaaaagaaattaatatattaaaaataaggataaaatttatgaattaatgcaattgaattagtgtatcttgattttttttgttttatggtttttacatttaggtttattttgtagattttaatttccttttgaatttttatttttaagccttgtagatctttatattttaattatttataaactataaccattatttacctttagaaaaaaaaatcttataagctatgatttatgtctataaacaaatctttggacaatgaatgactacaactaatttttttttttttttttttgacaccacaactaattatgtccacaatatttagatatgtaatctatatataaccctaatttctcatctatcttcttcactgcatgcttctaccatttccggcgaccatgatctccgaagttgaacaaccaaaagagaagagaagtttgagttctgagccaccgtcgttgatgtcactcccatacgaaatcatagagaacattcttgcacgtatctctaaatggagttatcctaatctctctctcgtctccaaaagtttcctttctcttctctcttccccgcaactatacaagacgcgatctgaaatcggaaccaccgagccatgcctctatttctgcttggaatcagctaaccattcatctccacagtggtacactctttggatgaaacctgatgaaaccctcaccggtaccggtactatacatgactattcgttgattccgctaccttcgtcttcaccagtacttcgtacatccacggtagcggttggttcggaaatctacgtaatcggtggacacttcaaccgctcttcctcagttcggatatttgattgtcggagtaacacgtggcgtgacggtcctaacatgacggtagctcgatcggatccagtcgcggttctcatcgaccagagaatatacgtcttgggaggtcgcgagatggacgagtctgacgattggtttgaggtgttcgacatcaagactcagacttggagagccttgcctagttttagggctggccttgagttacgccgctacattgtgtggcccaacagatactttccgcgtcttggtgatagtcaaactgcagtcagattaattaacgtcaaccccaatgctttggaaggaaagctttacgtagcggcacagataaatgactacacttacgagcccaaagatgatacatggaaagttgtaagcaaatcaagtataagaagagtaaaggtttggtgtgtgatagagaatgtaatgtacgcttgccatgacgtctttctgaggtggtatgattacgaggatagacggtggagagagatccagggtttggaagaattgtgttaccaccctacgaggggtttcagtggggcggaaagaatagttaactatggtgggaaacttgtagttatgtggcgtccggtgcaaagcgacggaaaagataaaattgaaatttggtgtgctcagattgcgttagagaagcgcagtaaagatgagatctggggtaagatagagtggattaattctgtgcttacggtccccaagttgtgtgacttgtgctacagttgtgtggttgtttcgatttgatgatttgtaaaatattgtataaacaatattgtgaaatcatccggtctttgttattttttatgtttttgtttttaatggtcttttacttgttttggtgtaacccgtacaagttaatcttggtgtcgctgatatttggtccagtataaccaatttttaaactggtgtatagtattttcttaattatagttttgggaaaataaacttgtcccaaataatgttctaacatgtcacataatttaggtttatttgatagattttaggtatatttttaactatttctaaatattatttctactaatttttttagaaaaaacattaaataaggataaaataaaaataaaaattaattgttttttagtgttaaaaaaaaagaaaaaaaatagtttttttaattactgtgcaaaaactttaaacaacaattatctcgttcagaacaaagagtattaactttaaaatattccaaccttgagttttttctttgactttctcaacaatataccgaaacatctcagatttcttcttatcaaactgttctggtagtcccaaatattttccgccacctccctcattgtgtattctcaggagatttctcattcttcgctttgtgtcaatgacaggaatccaaactttgcggtctttaattggctaagagaggttgtggcttggaaaacaagatttgaggattgtcgcttcacatgggtccgacgaaattccaacatggcagcagacacattagctaaacatgcactaccttcacatacttcttatcatttttctaattttactcctcatgtaatcacagacatactccatcgtgactttgtctctgcagttcaataataagattgatgttgatgaaaaaaaaaaaactattgacttgcgatataactctaaattttatagataaatatgcgatataattattgtcataaaactaatcactttttttttttaatataatttgacaacaaactattacctattttatataagttattaatcttaaaaaaaataaatgttcgtctttaatatatacattttgagattttaaaaatgaattataactataatttaaatttgagaaacagttattttccactaaaccaccactaatcacgtctttgtcataaaaatttgacccaaaacaattaaggaaaataaaatatattagttgccattctgtcacgatcttatcgaaactgtgagatttttttcttttttaggtttttacaaatcattttgaaattcactcttcgccttccccaaaatttcaaaacccgcctcttcacttttcgccttcctctacttatttagcctaaatctctcataaatctggaaaacaacattttctctctaaatctctctctcactcgtttcaacaatg

SEQ ID NO: 1363 - DNA, 3000 bp, Unknown
  misc_feature (1)..( 3000): cDNA_ID_1379170_gDNA_ID_1620392_Annot_ID_155644 3000 nt of promoter + ATG
attttcttcaaaatctctttttagattttctctactataaaaaggtgacaaaaacacaaaaacacaaaaacgaatgacacctatttacaagaatctgcttgtgaataaaaacacaaaacgaacgacgactaagtgctttttaagttaaaattgagctagtctttttcctaagagaaacgaccaaatatcagaaacaaaaccgaagtaggattctacttgtgaaaaagataactaaagcgatgaaaaagtcaaaagtaaaacaaaactcaacatcaaaaagaatagagtagtatatatgcttcatgagccgccccatcctagcatgaggaagatcgagaacctcttcgtccaattcataagcgtataagtgcttgatattgaagacattcgtggtgtgaatatgtggagaagcttcaaacggtatgcattgaaatttaatttctcaacgacctctagcataccaattttctagctaggccttaatcttattgtactcttgagccagaaaacggtctttgggtaagacaatacaccctaacctattacggacactaaattgaacatcatgccaatgtttctttacattttatttgtacttgaccgaagtcattactaaagtgccatgagatcgattgtgtacacgaagcaactcatccttaaaatccaccacactaccatgaaaacaatatgggtatagaagtaaggcaaaatcattcgaacaacaagagatgaaaccataaattatatgtaacagacagaacctgagcttccattgattgtgtgattgcttgcaatttcaacaaatcatattgcctaatgcctgattcgcgacttatttatatggataatacacatagttactcatgtatacaacatcttctataaagattttaaaaatatttccagttacatgataacatgaaaaatgattagttctatggttacatattgtcattcttttgaatgtatgcatctaaccttctagagtcattgtgctccattattgtatctctattaacggttaccatcaaaatttttgcatgtcattttaccttgtaaatttattacaagaataataaaaaccccgattacaattcgaaagaaagtaaatccgacgacccgagtaattgataaaaatttaacccaaaaataaaatcgatggtgccacacgctatgtcttgaaatggttttattaaggttttcttgaaatggatcttgaaaatcttccaagaattgttaaatatgtcatgctatatcatatatgtcatgatcaataaataaatagtgataactgataagtgactacttttgaatgtatgcatctaaccttctagagtcttacattctctttggtgctataaattttatttctcttttgcaacttgtcaaacttatatatcttgctcgttttaagtctagaaaatcagatttttttttttaatttgaaaaaaagagtatgaaaaacgtaattattacttcacctttcaataacgatccaaatttcattccagccatatacatacgattttttatatatttttataaatcaaacgaaatgacgctaagaaaaaatagagtgcacatgttgtagcaatgcaaatgacaacctcgtatgaacaaaacacgtgattcgatcatgaaaagaaaatacttgacatataatatggcgaaggtaagtaaagttgttcaaaatgtcttcaaagtctaactgaatttcatcatcaacatcctcatcattcatcatcattaccaccttcacatggaaatcgattttctatccaaactttcattgaatttttaatatatagttttagatattagtattataaacgaaaaaaaaaaaagatattaatattataatttcttataacggtagacactggaataagacaagaggaccagttgctttaataatataaaaatatactttacaaggttcatgcatgcatacattgttttcacgagatggataacatttgttaaacaaataaaacaaattatatgtaaccatgtgaacttttttctttctaatacttatcctaaataacaacaccaataatagtgacccgtaccgtaagaatagtaaatgtaaaaaaagtcattctttttgttaaaaagaaagaccagtaaaaagtcattctcttcaaaccattcacactgaattattatatttacaatcccattatattagtaaccttacgtattagtaccaaatttataactcgaaactactataaatgaataatcacatagtttcaattatgaattgttatcaaatcaataatcacagtttactaaacaggtaaaatctaaccgttgataatgagataaagaatggacaaaaacatcacgatttaatgtgataagaacaatcttatcacataaacaaaaaaagggacagggagttacaggtgaagtgttcctggtcaaattgaaacttggaaataataaagttcttgaaatagaaaggtttatttttaattgaaaacgatatttgagaatcacacatcttaagttgcctaacaatctacgcatcttcttcttttctctatcctattaagaaaactaaaaatagcattttctgatttaaaatatgatttgatagttgtattagatttaaacgcgaaacctcatgtatatacataataatatatttattagaagtaagataacagattttctttttctttatagtaggtaaaactcttgaatttcaatacaaataattgttctaaagaagaacttgatacgaaaaaattgaccaattattggtcaatatattaaaaagaataaattattttagtgttcttatttctcaaatgaaaactagtatatagagaggagcttcgttgctcaaacactttcctctctcttaaaaacctcaactttcttctctcttctcaaaaacccttccctcttcgtctccaaacaacaacaaacacaacaacaacaaaaatcttacaagaagatcatttttagaaaccctattaggataaaatg

SEQ ID NO: 1364 - DNA, 3000 bp, Unknown
  misc_feature (1)..( 3000): cDNA_ID_3061918_gDNA_ID_1620392_Annot_ID_155650 3000 nt of promoter + ATG
taatggttggaattgtttgtagtgctttgtttcttgtttttccgaccactcgatatggtgttggttgcatgactggttaatttattttcacttttctgttttttggtttgttttagtatctatttcgtattttccttgtaatttagattatctgatttaaactccaatgttctactatttttatctattgtattgttaaataaaatgttgtgttgattctatctagacttgtttgataggaggagtacattatgacgttagtaaaagcttcctcaatgcagtactttttttgttaagatctcaaactatgcaattaattaccaattgagtccgtgatgtagtggaggccaaaaaaaaaaaaaagagtccgcgtgggctttgtcctttttgttgtgtaggcatgtcatgttggcccaaagtcttaatctccacgttgtgttttgtatctattttatttagattagattatgagttctttagatttgagcttatcaacccctgagttgtataagtgttcattgtcttcagtttctgatgaattgataggattaaaaagtgattttttttcataacacgttccttgtttcggcactctttcaaagatatcaacatagtcaagaagacgagaaggtcccttgttcatatcccgcaattctacaaagaaccagcgttatcaaagactaacaagaagaaaagtgacaaaatataagattggaagaaagaagaaaaaagagaagaagaagaaatttcaaatatgtgagggatcgaacaaaccaaaatactagtatttatatggttatgctttgatatcatgtcagaaaattcatcagtatgaaaagaaaattcttaattttattgattagccagtaaaattatctacataaacacataacttgatctacaaattttctataaatacgaagataaaaagtctacccaattagcaataatgaaatggagttttgtttttcctagtaacgatatgaaaatttattcgaatcaatcttgtattgtaatattcgaaatttgatcaccatgttttcattaagcaaaaattctccgttttcaccaagagtcacttaatgaacttagccagcttttacaatatagttcattcaagttcttttttttttttttttacaatatagttcattcaagttctttttttttttttttttacaatatagttcattcaagttcttttttttttttttttttacaatatagttcattcaagttctaattcgagaatgttcaagtcatgtgatatatcaacgagacttgtttttatacgaaaaatgctaattttaataaaacaaaactcaaataacgtttctttagttcggggaaacagtcgaaaaatgataaaatatgtttcctaagaatctttatcagtcgtgcctccaagtggggataatataataaatgtaatgaaaaaactttattatatagtatatatttgtgatttggggtggtctgaaataaaggtactatatacttatccacataattgcactttttcaatgttagacttggcgttcaattacttcttatccacaatattgcactttttccaaatcgacttggcgttcattagtaaccacaacttctaacatcgacttattacagccacgtatctctgatatgttgaagattttatgacaagaatataggcaaaaaagaggaaagaaactgaagatccactatatagtaaatacttgtagcttcatttaaaaaaaagaaagtgatttcaatgttaatttatttttcctacaagtaccaagctaaaactgtaactaaatgactattattatcagcgtaaaaaaacacatactccttttgttttttttttttgattttctagaaaaaaattgtttcaaaaagattgattttttggttttcaatgcaatatttatttagttataattgataaattgtaaacttcaataagaattattgaatatcattggtttagagttattgaaaattataaattacaaagaataatacatttaaaagcaacatttaatatgttttcttaatatttgtgtttttcctaaaaaatcaaagaaaaaagaacacaaggagtatcaatctgtaaaatggatttgtttgaagacaaagattggtttttttggggataaaatactatatttttttagtattttaattttttgttggatcttcttagttctttaaaaatgagaaaattaatgtttatatcatgtaatttgtttctttcataaatatgttttttttttctttctctccaaatctaatcatgatattgttttccatggatatggctattatagaaagctaggaattaaaaagtgtttcaaggttttaaatatgttttttgtttgttactctaaagtttgttttttcttctgaaatttcatttataaacagtaattttttaataaatgtgtgggtaacaaaaaatttattgacatagttagaattagaaaacatgtaaattagaagttaaatggcctttaatcaaccatttttacattaatttaaaaaaattcagacttttaaaataaaaaagttaaaaatgaaaagaaaagtaaaagtaaaaaaaagtgctgaccactgaccagattgaaaaggaaaataaaaagaaagccaaaaagagacgaaaaagagaaaaaaaaaagtccacaaaaacaaaaataaacttgtggctaagaatcctcacgtgtgatgacgtggcactctgggcgaatcaaaaggttgtacaattcgaaagatcacaaacccaaaaagcaaaatctgtaaatcttttttctttctctctcgcaaagacaaaaaagcattcccaattaacaaatctagaaatcaaaactcagacaaccaccgataacaagacagtcgtttctctctctcttttaaacaaataaaaattggaacttttttcctctgtcttctcaaaaagtttccgctttttgctcgctggagaagaaagaaagaaagaagtgaaaaggaatcattacc

SEQ ID NO: 1365 - DNA, 3000 bp, Unknown
  misc_feature (1)..( 3000): cDNA_ID_2105310_gDNA_ID_1620392_Annot_ID_155639 3000 nt of promoter + ATG
ccgttaatcttacaatcagcttcatcagattcaaactcaagctttggagaaaagcctgcatttttagctgtcacatagtaaactctcaacaaagtgttgaaagacatcgaattcgacattcttccacaacatttgacataaccactagcaaactcaacccaactcaatccttctttatcaggcacgaagaacaaatctactaaagatgatcctaaatgctccaacaatttgggaaacaagtctgaaactttttgctctccttcagtagtaattgtatcgtagctcaaaccaaaactttgctgaaacaaagatccaatttttataaccctaagttagattatacacgattctattgaaaacccagattaacggaaatcgaattataccttcaaggattgaaaaggaacagtattggtttgagaatcgacgagtttggagaaggatcgtttaagcagaggaagagctccggttgaagcagcaaggctttcgatttctcgtttctccgatgattctttgtcgtctgtagaagatgaagcacccatagtggtgaagatgatcggagaagatgcaaaaatccgaaattagagggaatgatcagagaaattggagtccatgattagaaattttgtttttgatctttaagaaaataaagagacgtttttgaacagttccatagatgatcttttcacgattcgccacgtaattggagtcaattgtggattgatccggttccggttcgagaaaatattaaaccggactgattagcaaaatgtatttaagccgaataccccaactaatattttcaccaaaagaaaaagtttcaaagctcccactaaatttgtctatttcaaaatattttctagctatttggagtttacattgacattttaactccaaaaaatatttttacaattttggcaaaaaaaaaatgtaatttaaaaaatatgcaattctttgagtttgagagaaaatgtgtttttgcggaaaatagaaaattatattatatatttaggttccatacactgtctaattaatcattgtcttatttgagtttggtcatatttggatacggtgctattgagtttggtcatatttggatacggtgctattgagtttgtatcattagttttgttcatatttggacttcacccatttagatctgaacagctcaattaacatctttagatagatgtgctcaacagaaaaattgagattatgcaatttagtgtttagggtttaggggttaggggttagagaaaaattatttccaattcaaatatcatttgcggggaaatctcagactattttcatgcaaaatatatagaggctaatttgaagagggtgcttgtaacaagacccagagaaggattttagcaactcatgggcaattaatgttgtccgtatgtacaaataaaaacccaatggaccgacttcaaggtcgcagcatgccagcatccaaactcgttcaggttatctagctttacatttgaagcaaagacgatcacttgcgttacgattagttagaatatggttttggtaccataaaaacaagatttatatatagaccataagggtttttactttttttttcttttaagcttcgacgccaatatatacatatgtgtagagaccaaaatttggtcgatgaatatacatcaacgacgacaagatataatatatgataatcttcaatttttgaatttttctagtctttgttaacgtcatgcatggatttttataggaaaataacatctatattgacaaaaattattttaagaaacaggaattcatagaaaactcttctttttaaaacatctgactttattatatcctaaagggacaagtagaaaactctttatttgttatatgtcactattctgttacaaatttttattgtttcaaataaaaattaattgcagaaaaaattcctatggaccaacaacgatggttagtcttagtcagcatgagttctggctattgatcagtgatcaccaccaatcaacgtgtcgccattagtcattaatctgttatgaaagtaaacgtatagaattaatctttatcatcacaacatcattctatatagcaaacctggtgcgggtagaacccgatctttatccgaaatatatatctttaccaaaaaatcgaactgaaaaattcgacatcattcttccatttccagattactaaaattcgaacaaaacaaaccgaaccagtcaaagaaacaaagcttaattattaagaaaacccactatactattttgttatttgtttgtttgttaaagactatactatctatatgttccggtcaatacactaatctctcacgatggatcggtccgtggacttttgttgaatagtgatgtccgtggacttttgttgaatagtgattagtgaatgttcatgttttggatattttaacacttttgtgagacggtcagtgaacttttgttgaatagtggatgttcatgttttggatattttaacactttttcttttcctaaagtattttaacacttattcgattaaccagtccaaagtcggtgcattgtagatgaaaatatcatgcactaatacgagtttccttaataaagaattagagttgaatcaaagtttaacgcctgctaaaacaatattctataatcacattcattataaatgattacacactattaattaggaattagtttgatagaaacgaacaaaagagaaaaaacaaacccaacatgatctgcaatcgtcaacgcgcgaagccagctcatgaccaatcacataacgcggttttcagttttgaattggattacaacgtcgtcgttttgtcaaattacctcaacactctagcccctttcgctgacttcaacatcaccatttgacttctcaatccctctataagttactcacgttctcgtatcactttccatgcatctaaaacaaactctatctactaactcgaaacacacttgcggtcttatctaaaacacaaaccaacaaaaagaaaaaatg

SEQ ID NO: 1366 - DNA, 3000 bp, Unknown
  misc_feature (1)..( 3000): cDNA_ID_1663090_gDNA_ID_1620392_Annot_ID_155640 3000 nt of promoter + ATG
taaaacaaaaaattgtgttgcctttgttaatcctctttacttactcatatctaaatacaaacacaaaatattggcatttaaaacaatcaagacatagttctttgcttatatatgatatattgattgttgtataattagtatatatataaacttacgagagaaaccgaatcacgagccgctaaggccaagatatcagcacaagagacaacaccaggacatgctgcctcgagctgcctcttggcatcgtcaatgacctcaaaaccatggaggttaacgtttgcgccagcggttctttcagagttaggtcccgataaaagcaccgaaccatcacaaccttggacaaagcaatcatggttgtgcattctcagtaacccgggtgcaacctttggatctgaaccaaagtgagatgccacagtggtccgaacaattgtctcggcattagggcacgtagtcgagtagaacccgatcctcgtaccttggccataaacggcgatgagacaactaaggaagactatgaccaaagcaaatgatcggaccaagcccattttttctttttgttggtttgtgttttagataagaccgcaagtgtgtttcgagttagtagatagagtttgttttagatgcatggaaagtgatacgagaacgtgagtaacttatagagggattgagaagtcaaatggtgatgttgaagtcagcgaaaggggctagagtgttgaggtaatttgacaaaacgacgacgttgtaatccaattcaaaactgaaaaccgcgttatgtgattggtcatgagctggcttcgcgcgttgacgattgcagatcatgttgggtttgttttttctcttttgttcgtttctatcaaactaattcctaattaatagtgtgtaatcatttataatgaatgtgattatagaatattgttttagcaggcgttaaactttgattcaactctaattctttattaaggaaactcgtattagtgcatgatattttcatctacaatgcaccgactttggactggttaatcgaataagtgttaaaatactttaggaaaagaaaaagtgttaaaatatccaaaacatgaacatccactattcaacaaaagttcactgaccgtctcacaaaagtgttaaaatatccaaaacatgaacattcactaatcactattcaacaaaagtccacggacatcactattcaacaaaagtccacggaccgatccatcgtgagagattagtgtattgaccggaacatatagatagtatagtctttaacaaacaaacaaataacaaaatagtatagtgggttttcttaataattaagctttgtttctttgactggttcggtttgttttgttcgaattttagtaatctggaaatggaagaatgatgtcgaatttttcagttcgattttttggtaaagatatatatttcggataaagatcgggttctacccgcaccaggtttgctatatagaatgatgttgtgatgataaagattaattctatacgtttactttcataacagattaatgactaatggcgacacgttgattggtggtgatcactgatcaatagccagaactcatgctgactaagactaaccatcgttgttggtccataggaattttttctgcaattaatttttatttgaaacaataaaaatttgtaacagaatagtgacatataacaaataaagagttttctacttgtccctttaggatataataaagtcagatgttttaaaaagaagagttttctatgaattcctgtttcttaaaataatttttgtcaatatagatgttattttcctataaaaatccatgcatgacgttaacaaagactagaaaaattcaaaaattgaagattatcatatattatatcttgtcgtcgttgatgtatattcatcgaccaaattttggtctctacacatatgtatatattggcgtcgaagcttaaaagaaaaaaaaagtaaaaacccttatggtctatatataaatcttgtttttatggtaccaaaaccatattctaactaatcgtaacgcaagtgatcgtctttgcttcaaatgtaaagctagataacctgaacgagtttggatgctggcatgctgcgaccttgaagtcggtccattgggtttttatttgtacatacggacaacattaattgcccatgagttgctaaaatccttctctgggtcttgttacaagcaccctcttcaaattagcctctatatattttgcatgaaaatagtctgagatttccccgcaaatgatatttgaattggaaataatttttctctaacccctaacccctaaaccctaaacactaaattgcataatctcaatttttctgttgagcacatctatctaaagatgttaattgagctgttcagatctaaatgggtgaagtccaaatatgaacaaaactaatgatacaaactcaatagcaccgtatccaaatatgaccaaactcaatagcaccgtatccaaatatgaccaaactcaaataagacaatgattaattagacagtgtatggaacctaaatatataatataattttctattttccgcaaaaacacattttctctcaaactcaaagaattgcatattttttaaattacattttttttttgccaaaattgtaaaaatattttttggagttaaaatgtcaatgtaaactccaaatagctagaaaatattttgaaatagacaaatttagtgggagctttgaaactttttcttttggtgaaaatattagttggggtattcggcttaaatacattttgctaatcagtccggtttaatattttctcgaaccggaaccggatcaatccacaattgactccaattacgtggcgaatcgtgaaaagatcatctatggaactgttcaaaaacgtctctttattttcttaaagatcaaaaacaaaatttctaatcatggactccaatttctctgatcattccctctaatttcggatttttgcatcttctccgatcatcttcaccact

SEQ ID NO: 1367 - DNA, 3000 bp, Unknown
  misc_feature (1)..( 3000): cDNA_ID_2996260_gDNA_ID_1620393_Annot_ID_155667 3000 nt of promoter + ATG
cttttagattttgtttcggcctttcattctaacatcaatttttttcttgatttggtaggcattgacaatacattatctgagttatgcaaacaagatgataatttccgtcgctgttgatccaatgattattgacgctcacaagctatgtgatgaactagaggaatctctcaagaatatgaaacttgctatcttagagaaaggattaccaaatcatgtcaattaagctccaaaacctaaagtaagacgtcagtgataatgtataattgtcaaattaatttgtattatgcaagggcaagctttgttatattatcaccgcaaataaaacattcttcttggttgtattatgccgtcgttatgttaatccgtattaaaaacttagtagtgaatttgtgtcatgttttgttttgttattgttcattcttttaccgcacttgtattatcatcatttgaagatatattaactttggtatcctattacaaatgaacaatctaacttccatatgactagaaaattatttctgcagttttcaataccgaccgatttctatggactcacactccacatgcaatagttatatctgcaacctacaatatatgtgattatgatgaacaacaaccacaaacaataaaatcctacgaacaaaaaaatatttttaggatatataggttctaaatatatactttagattattgttcgttttggcactccatagctaaattttctagatatatctattctctgcctctataccatcaaactcccaaccatttatctatttaagtcttgtttggatgcatttttccttccttctaatttaggagagaattgtcagccgatgtgtatgttagttgcaagatttgacgattaaattgattgaagttttcttttcatgaagttatcttttcatggttgtagtatcactgccttaataccatcaaactcccaaccattgtagatgtccatttaagtatatttggatgattttctccttctttctaagagagaattagttgcatgatttgattgaggttttcttttcatgaagtttccttttctagttatcaaaaagagttttattttcgtggttataatgtcactgtcttgaaaccatcgaactcccaactgttataaatttccatttaagtttttctttggatgcatttctccatgcttctaaattaggagagaattgtgtgatacaatatatttgttactttcatgatttgaaaattaacttgattagagttttcttttcatgttatcaaaaataagtcttattttatttgacgaaaaatcgtagaggacaaacaaaagttttttttttttttttatggttatactatcattgtcttaataccatcaaactttcaaccgtcttagattttcattaagtatggattgaatgcctctctcttttttctaaattaagagagaatgattagacgatatatatttttttttgtcatcagattttatttagagctcaaaaaaaacaattatgaagaaaattgtttacataagtgatatgaagcagttcaatacgaatttttcgtgcctgcctttacatttgcagttcgagaaattaaagataaagaaaatcttgtgaattcttccttatcggtcttgaatttcctccaaataagatgaaaacgttggccattcggttggggaagacaccatcttcaccaggtctgaacagtctgtaaaaaatgctactttttggctatcgacagtaatcatactaatcatacacttcatggcccagagtaaaacttcgacttttgttatatgttagtagacgatatatgttagttgcattatttgaggattatcttgattgaaattttctattcaacatatcaaaagaaaacaaagtttccttctcagtccgggtatttaaaactgatcttaacgaaacaaatcatctaggttctaagaagctatttattatgcagattcgacgatgaaaatctcaagaaatttactaatcaaaataaaacaaatgatacctaagagatgggcgtattagtcggcctcgagcccaaatgcttgctgaagccgggttttgagggcttttaatagtgtttgaaaatgggaatctgctttgagaaatgtgagattcgaaactcatgtcgatattggtaaggaactaaggatcattctcaaccataaccaaatatagtcttccatgtttctttgatttgcttatgttgtcgatggagattttgagaaaactattaatgtagtaaagatagtaacaattttttttttttaaaagatagtaacaatttttttttttaaaaagatagtaaaaactacgaacatcattttacaatagactatagtctatatcgtcgaaatcggatatggtcaatttttagttcgtgtataatttgacctattttccctcgttttcaacaaaaacgacgtcgtacgaacgaaccctaaaatctcgagcagcagagccaaagctagatttgattccctctcttcgatttttaattccttgctcctctgctcgtttctctaccggcgacgtaacctctctgtctctgttctgttccttgcctgctcgaggtacaaagctctctgtttcgtatctgctcttagctctcttctgtctcgagactctcttatctctctctactttgtattatatggtttaatctttacgaatccttggaaccttgccattagtgtttaggttgggaaccaatagataatgctatatggtttaaacttctataagcttttccaggaaattgcaaatactaatcgtcttcgaaaattttgttcttctttagtttcaaatatgaattcagtagagacccttatagagttagctgttgatgggcagaaaagtttcaatcttttagcttcttttttgtttcctgatgtgtttgctcacaaaccatttaggtgtgcatcttcttggaatcagctgactttgcggtcaatcggatttcttgggattgtttggagaaactttggaggtgatg

SEQ ID NO: 1368 - DNA, 3000 bp, Unknown
  misc_feature (1)..( 3000): cDNA_ID_3061954_gDNA_ID_1620393_Annot_ID_155675 3000 nt of promoter + ATG
agacctgtttttctgcaattttaatttttgggactccacgcagcttcctttcttccaccactcacttgcaggaaattaccaaaaagagagggcaaaaaaaaaaactaaaaaagtatactaagtccacgcaactcactttgtaaaacttttacctttaggaagttttgtctaaaatgccataaatccaatttttgctttcaaaatgtgcaaattatgtcatcttgtagactgcataagtttaggaagttatgttatctttaacggtcttcttaaactgtgtcgcattatgcagattcaacaaaaaatgtgtaaaaattatgtcatcttctaggcaattatgttatacctttaggaagttttgtctaaaattgtgtaggcaaaattatttatataataagaaagagttggtggagactaaaagtactaaatttttaggccgtagtccaagagtcgtttcttaagtctttttttttttttttttttgggtcaaaagtcgtttctttagtctttcattagtccaaaaaggactactaaaagtctttaattatccaagccatcaaaggtgactcctttttttgtaactcctagcaaagacacgttaggattactaaactcttttatactttggtaatgtctctctattatcagataaagagtaaggttcaaatagagtcacttctgcaacttttgttcactctttaaggagtaagctaatcacagtttacattttggccatcaaatgttgtgttgaagtgacttatgtagaaaattgaaaggtagtttacgggtgcatgcaatatatttcccggtcctctagaaacatcataaaggtttagaggtttgtaagaaatttcttagtagacttataaaaatgatggtagaatatctagaacctttgtaagctatctttggaggctataaatacatcatcaccccaatcatttgtaatcgaccgaataaaaagcaagtttaaataaaagaagacagtgatgatcatgattcttgagtcaatcctttgctattttcttaccacttttgatatttttaaccttgagaaatatatgcttgcattaaaaaaaaatgtgataagatacataatacagataatattatgaacaacgcatctctgaacctcttctctaaatcttcacttggccgcgacttctgtgactcctcgtatatcaaaggtcttcactttgttgaaatcattattcactgatgaagaaatgacatctggtccatacaactcgttgacattcggttcaacatcgttgctgcctacatgtgatgagctccaatatgaataggacttgctttcttgcataggaggcctcttcttgtcttttccatcttctctttttttaaccggctctagcaatctctctgctttcaggggtttgtttcctttcttgctctgcttcttcttgaaaaacatgaatttgaaacaactaagacatcttatagacattttcgtgggggagggtgtacaaacaagcacaaattgtacagaaaatatttgatttcttaaagatgtttaaatcttcagtgttgagagaaggagacatgagtgttttagctgatttaaatcttaaagatttgatttcttaaagatgtttaaatctttgacttatcaagatttgagtgaaggcagaattgacccatgcagcttcctttctttcaccactcacttgctaggaaactacaaaaatagaaaaagaaaactcacggcaaccaaaaacgcgaactcctagagggtttcgaagactttgaaatttgtatcagacatcaaatgaaatctttaacttcttttacctcaatcagcatcactaatcttcatagttgttaccaacgagctgttggcccaatggtaaatctcctaggtagatgtgctgattcgaggtgggagggatattttctccaaaaatagataaatttaattaggtatgggtcccgcctctaaaaaaaatgtagaatctttggatttgaacttccacatattcaaacaaaaaaataaaatcttcacagttgttcactgatattgtaaacataagatttataaagtttttgttaaaccaagataattgtttcatcttcatgtgttaacaaacatgtgggctatctcctctgtttaaggcccattagttgatcttcatttggccttgtctacttcctctgttcatggctctatacaaatcctgaaatcagggcatttacattttcccttttgacagaatccgaaagcgaccatgagttagatagcgattctccagtttactcatttgatacactgctaagaaaataaaactggatatagccatatttagtgtcatatcttatctctgtttgagtcaaggaaccatccaaaatcaatccacaccaaacacataacgccattaggaatttaggatcaggcttgtccattttcaaaatcctgttaaaagaacaaactaaaaaaaaagaaagtgtttagagattagacacgtcgtcgtttcacacgcgtaaactcgtggatgatggaagaaagttaaaagctcgtgtttcgaaagcaagggtttttggaccagtcgtcactttaccggatttttgttttggtgctcgacgactctgattcgaaatctctctctctcggaaaagctgaatctggatcatcaaagtaagtctccatcgttacttttatctcttcgtgaagattctttaatcccatttatttgttcatatttgcaatcttcgaaaattcctgaagctaaacaaaaatgggatatagcgacaaagcactgaaattggacttgatcaacagtgtttctctgtaattagagcgaaatttggaaaaaagatgacatttttctatgatttgcgatgtctgattcattcattcccacatgtttaggttctcttgtgtaaagtttgttcctttcttatgtcttcttatccaatttttgcaggtatcattttaaagtttgatcatttcttctttgggtatatagggtagtattcaaaatg

SEQ ID NO: 1369 - DNA, 3000 bp, Unknown
  misc_feature (1)..( 3000): cDNA_ID_2134555_gDNA_ID_1620393_Annot_ID_155686 3000 nt of promoter + ATG
cgttccgacctactgtactgtcatgatacgaggtatatttttgttatatataaaaacaacgataacctttagaagtcattaaaagaacaatgactaataggtctttattttgttgggcttacttaattttgagttgtgacaactatactttccagcccatttgttttttcattagaaaaatgttttgctactttgcattttacaaacccacaatgaaaaagaaggtagctggatcatgtgtttttttttctacaagtctgttgaaaggtggttcaaggaaaccgtagtccactaactatccttagttagttttgagttcactcaacctgagtcttcatttgcaaaaattgactatcaataaccgactccgattataacaaagttcaagcatttcaaatggccttattgaaagggcgaaacaatttcctgtcatcctggtctaataaaatccttaattatataaccaaaaagcgatatattgtctcaatgttgttgctaattattttctttctaggatgtagcctgtccttttgtatagataaatgtggttaagaaatttaagttggggaggtcatctattagttaagtaggaaaaatgtaagatcacgagcaagcacgatggatcttttttttccttatttggaaaaatcaggacgtcaaaagtatatatttgactaaagctggaagcacgaatccaaagataaatatcttgaattgaaaagtcctgaagaagttaatataaagataagttttaaagttctgtaggattattgaaaatggggaattttgttgaagtcgtcgtcagattaaagaagacatggaagctacgttccaactacttggtttaattagctaataaataaaattattaaaaaaatgtatcaccattattgtcatgtaagtcatgttcacattcactttcctttcgcaccataaaataatgtgacttgacccatagctttgcttgacttgtacatatgtgaccccttactcaatatagtactaatacctatacaatatttaacaatttgctaataacaagaacaaaatacatgtgggcaacgtttcacagatcagatcaaagtcacgtgcgaaagtttatatatatatatatatatatatatatatatatatatatctcttatgtgttgatatctatcaatttacattaaccacccgcagaagaagatagggttgttaaattgatgggtagatagaacttaacattctttacaaactttgtaatttgttgtatagtttcatgaatggtgttaattcatggcctgaaaataccatcgatgtatacaatctgataaggataaattgttttggattgaccatctattagttttaaaatatgattgtataacttggattggttagctttcagattatactatatattcaaaacaagcttttgtacgtatattatatcattttatccgcttaaaatgtaattactaatttttctttcatataagattcaagtttacctaaagaaaaaggattcaagattaccagttatcttttgcaaagcttattaattataaattcttaaaattttagattaaattaaaatatggaccgagtagccaacgaatgaatctcacatcacggcatagttgactagttgttgttagtatataatataatcaacattgctgcttcgttctgacgtcaatctgctgaatcagccccttcaacaaaaactacgtcatggggctgacgtcgagtgtccgacgaaactaatgccgttttcattggtgcattagtcgccactcgccagctacatcgcaattatttctctctttaagcgttgaaaaattgtctagatcttacttgttaatgttattctattacctaataattatcttttgtctggtctaaatacttacatttttatttaaaatctgaaccaaaactcaccaaaaaattagataattttaccattaaagatatccacgactagtggagtattttcattacaaaaaaatgaattgatcatatcatatgtgttcgaagcttattatattgagcaaaaaaacattatttgtacacgtttcatctttgatgaggtaaacattgcgatggacgtgtaaaatatgttatactttttttttttgtgaacatccaatctattacatacatttgtttttttttgtcatatgaacgtaaaatatattattttcaaaactctatattattagttaccgtataaattataattaaaaccacctatcaaaatattaaataaaaaatatttaacgatatacaatcaacaaaattaagcaaacaaatttattcttaaatttcatctgctatatattttcaaaaaaaaaataaaaaaaattgcgacacatattgaaatggaaagattacaaaagaaaattttaaaatcattgctaatttggggtttatcatagctcatatctctctctaatatatctgactttgtagaacacagttttctattagattcctcctatcttgaaaccttttagtgttctgaaaggagtagtttttaatttttaatctttaattattaagcgaaccgcgtagattagtgtaataagagaaacagataaattctgaaacaattaaaaacagattgtatataattaagtgagccgcgtactgggaaaggtatataaaataaactctgtttcctatacatcatgacagatcatatgctaatgtcaacacctaatctatctttttgtctctctttatttagattcacgcatataagtctagcagagcacatgtcctatatcgaaattataatttatcattggcttcttaaaatataacctagtgtatgtaaattatatttggtaaacccaaattggcaaagtcatttgggaacgtgtatgtacgactagtcctataaattctgatctccctatccgttcaaaagtttatagcacagagaagagacttgagaaaaagaaaacaaacaagaaacacatacacacacacacaagttcactatactctatg

SEQ ID NO: 1370 - DNA, 3000 bp, Unknown
  misc_feature (1)..( 3000): cDNA_ID_2134512_gDNA_ID_1620393_Annot_ID_155674 3000 nt of promoter + ATG
aacttatgaactttaacccatttgtttaataagtagcaaatagtccaacaattttatttagagtacattattataaagaaaatcacattacataacattaattaaaaatatatatttacgatacaattgtagacatataattctcccacaaatgatcaattaatgcattccgaagtgagaaatgagtttctttatccttaatttttctgaatcgagcgagataaaagttgtttttgcattttagtttaattggattaaaataaaagaaataatttgtttagaacaaaataaatactttgttattatttgaaggatcattttgtaaataagaaagttcaccttcaaaaaatgaagatgttaatagtataccttcaaatatgaagatacactgttcaattcttcattttgaagataaaaatgaagtaccattagagaagaattcttcatttttcacttcaaaatgaaggaaaaggtgaaaaatgaagcatcattggagatggtcttagctaggtcggctgattaattggctatcggcccgtccttcttcttgctacctaatatgtgacatattgtggctttttgttttactcctttaagtcatctagaatttgtttatatatcaaaagatatgcgaacagttatagatggattagtttgcttatactaaatatttttgtatagaacatcaaattgcatatgctttttattataaatataagtcttcctacacaatttcgctctctcaccaacaaaatggatgttgaaccggctggcctacttccttgcgagaagaaattcaatgcattttttacttacgttgtgttttgaaaagacatgatgattatgtaaataatgtttttgtttattacatatgtaaattaacatattttataatttgttttttaaaaatgtataaatggaaggccaattaaagtccttgagtatcaatacatgaaaaaattgctacatacatattttctgacaattttaacttttcctagaaatacataccaaatcacaaacccgagctcatttctattttatttgttcttcattttgaatgtacactgatgtttgtccccaaaaaaaatgtacactgataaaataatttaatagaatgattcaggatgtcaacgcgtcatcaaaagttcaagactactggaccaaatggtccaacaccaaccttatcgtaatttatctataggtgtgttttcaaatggataaaagattaaaagacatacatgatccagatagatgaaagcaaatgataagacttaatataaataataaagaatcgtactgattttttgtttgtaatgtgaaatagaatggctcgcaactcaaagtgtcagactctatctatgcaaaaaatgtcaaagacacgcagcttgtttatataccattcatattgccaaacttttggaccaaaatatttttattaagatcatataaacacaaagagccaacccactgtgatcggtgtgataaaatcccaactacttggagcaacatgtagtttacattattaagctgaaactctaaagatcatggaaatatatcaatcatatcactgtagggtaagtccaaaaatagaggtacgtacgaactacgaagacaacataacgttttagtttctaccaaactttattgactaagtacttttttttttaattgactaagtacttcatatagaagtgcaccgattattgcaaacccttattaatggacggcaaagaagagaaaatgacgacagcttccagcttcctaactcctaattgcatatatggactatggtaggtgtccttctcgtcagatcacatgtttgggaagattaatcattggataaacttaaaagaattgaattatgattagaagttatctgaacatttacttttgaaaataatatattacctaacaaactagtattattttggctaacgtcctatagattgtgtttcgaatagttttggaccttttggtaatagaaaaccaagtaaatgaagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 1371 - DNA, 3000 bp, Unknown
  misc_feature (1)..( 3000): cDNA_ID_3062012_gDNA_ID_1620394_Annot_ID_155694 3000 nt of promoter + ATG
acagttggtgatttgcaacagataaggaaagtgcacgtaagctaatgaacggtaaattcaaattctccaaacaggagataaaaagtgtgggtaaccgcttgcaccacagttactcaacattacaaagagtttcaccttccagcattgcgattcactaattaaatttggtaaaattgataagaatgcaaaatcctgcaaatggttgaaccctatcatgatatattctacaaaactagatacatacttaaaggctgctaactaagaattagatccaagtacatcaaaaacaatctaaagatccaatttagatgcgtcatttcgcctaacaagaagagaacaacattcactcacaagtctatcctcttagaagcatgaaccgtagaacattgccctctattatcatcagcacacaagtttctagactctgtttctttgcttttccccttcttaagctgagaacattcttgctcctggaacaatcaaagataatttcaacactatatatacatgaaaatggaaactccaatgaactaaaaaactcaaagatatgaatataccacatccagcaattgcttcgagacacgttccagctccttctgtttaatcaaataccacaaagaacaatatgagaaactacatctttgtgatcacagagaacgcaataataaaacgaaaccctaacctttaagcgatcaatttcgagatctttctcactatcacagcgacgattcgaagtagtcggagagataggtttagcagcagtaacaacagtagagttagagtaatccattaacgcgtcattgaaaccgcttactactctttgagagagttctctcggcggagaatagcttaagaaaggatcaggaacttgaatttgtttccgttgttgtcccgctgaggattgtaactgcatagggtgagataaagacgatgaaatcttcgtcgatggcggaggagccggtagaaacgttggaagatacggaggaggtagggggcgatacatatcggcttttttcagggtggtttcgattgaatcgatggcgaggagaaattcgtcgttaaattcttcatcatttccactcattctctttctctctatcgctcgaatgactgatagcgagtgagtgggaaaagaggcgaaatcgaaatacccatttagtgagcagtacgcctgacacgaattcggatatccggaacaattgtgatatttgttattcgattggttttaacggaatatctgattttgtgatttactttaattcaaaaaaatttggatatctgaatttttatgtgatattttcgaatatccattttgatactgacatattgtacatgtaaatattaaacaagactgtaaactatataacaatatcagatattcaaatttttcatttaacatgctttcaaaataaattttaaatagcaaacataaccgttgttgttatcaccggtcatcaagttgttgttatcaccggttatcaaaatgttatctaattaattccaaaacataacctaatagattaaattgtcattgatcaaaacataacataaaagaaaaatgagcaaataaacatcttaacatgaaaacataaggtaacaacaatatacaaactatttatgatatctatatttacggatccatcgtaaataatcatctttcgctttaaagtttttgatggagcagtcggtaaaacttaggatccaaaaaactttttgtactattactattatttatggttaaaattctctttttcttattaacttgatttctttatgtgttttatattatttttataaataattgaaaatcatttttaaaatttgcaatattttattaatattgtaaaataccgtcataataaaaattattatggtaaaccataaataagattatttagtaatcaaatgacattgatctaatatttatatttttcttttctgaaaaaaactttctggttcgtttctgttccggttttcaaaactctgtccggtcatgtggaatgctaaattacaaatccaccttattataatttaaattacataaataccccttaaaactcacatatttatactttggtcccggtagttctcttttctttttaaattaaaggattatctgcttagcaaaaaagaagaagagaaaaggcaatgttttgaaacccgacccggacgatgaaccggactaccttctgggtcaccgggtcaccgggtcaaccgggttggaccacgggttaattagttaaaatttatttaataaatttaatattaatagaaaatttagagtattttataataaaaaaatttgtagtatttataaatataaaacaaaaataatcatatcatatttaatcaaatataaaattatattatatttaacaaaatataaaatcatttacacccaaatatatatatatatatatagaaaaaatcaaacaataataataaagtggttaaaaatttgaaatccaataaatgtctaacaccgtaacaaatatattaggagatcatcaatgacataaataaattaataaaacatcgtgaattaaaacaactaatctcggttgtctctctcaccattcgattcaattttaaggcggtattgtaaagtcttcaacaaaatctaaaacatcaaatgaatttaagaactgaaaaaacttctaaaaataattgaataaagtctaaaatcccatattttattgtaaaatcaagagaactttttaaaacccacacccggccggttcaaccggttcaccgggtcacgggttaattgcgagtttttgtgggttttttcggttttgaacttgttgggttttagcactaaacccaaaccggaaaagtgttcgggttacgggttaaccggtcggaccggacggttcgggtcgggcgtgaaaacactgagaaaagggttttttaggattctttaaacgcagagctgagctgagttacataagatcgagagaattcgcaaactcgtttcttcattcgtcttcgtctttcgcc

SEQ ID NO: 1372 - DNA, 3000 bp, Unknown
  misc_feature (1)..( 3000): cDNA_ID_2134782_gDNA_ID_1620394_Annot_ID_155704 3000 nt of promoter + ATG
aattgtcaagattaatatcttagatgataaaaatgactaattatcaagaattctgaaaaaacttttaaaatttttaaaaaatgagataatgaaatttaatgtacatgaatgaacccaaacaacatttaccattggaggaccgacttggttatatatgaaggtgctagaagagatgtgaagatgattttgtatctctctattttttatgttcttatatctgtaatgttcttgatttatgttgtcactttatcttcgtttaatgtctaagagggtttgggcctaggtctcttaatcccctccaatagtccatggtccaggttctttttaaacttcggcaaatttataattatatgaaattctaaacattttatttttagagtttttattctttcgtttgtgtcagaaaaagatctctccatttggagtaaaatttccaattgtttcaagctcaccgaactttcattccgggaccttaatccacgccggctgttgttaatgttttatgtataatttgattaaaaaaaactttgaccaaagaaaaaatgaaagagtcgacaaaaaataaaaataaaatgaaagaaagcattaactagaaaatacaatattatatacggaaccatgatttgtttacgttgaaggtggttatatttcaacacagacaacagtatatatatataggataattatgtttactaatggtcttataagacaacataggacgacatatacaacattttattattagttacacaccaacttcattacgggaacggagccaatttctgcatctcagtttcgattatgtcaaccgctaatccttttccgtgatgaacccaataatcagccatcgaatttttcttctccggtcccataattccaactcgagacgtcttcaaagattccgtcgagattccatactcatcgtcacgtttcttcaatagccctggcttgatctttcccatattcacgtcttgtggtgacatcataagtgatggtgcaccaagtggcaatttatcccctgaaattaccaaaacataacttaaattttttttctgaaattaccgtctactaaaaaagcaagaaaaatcaattcctactagatttttctatatgtatgcaaaatatggattaataaaaatatataaagaagtattaattaccgcgatcggtctgccaagtgcaccaaaacttcccataagttttggcaatattttcaagctctgtcttagctacaagctcagggacccttggagttactagaaggcctgtttggatctacaacaacaacaacaacaattctagtcaaaccataaatctacataataaaccatttgaaatgaggataaagtgcttaattaaaggttataaaaataaaaagtaacctcatagtcatgagagtgccaaagcttttgctcctccggatcaagactctcaaataacctctccgacacaatatactcgatccctggcaggtttaaacacgaaacatgataaaaatacatctcttcaaaaattatacgcatgcatacttcgagttcaaaattactttgtttgtcaaaaaatgtttgagaaaatacacatatagatacagaccgatgagatggggtttagaggagtcgcaatcgtaaacagcacattgaagaaagtcttggttgagtcgatgaacatagaagttgacttcaatctgacggctaggatcgtgaccataacaagcgaaagaacacaaatggagactcatctgtttgatcggtttcaacgattgcatcatcgccgctcctttatccatcaccaccgtcttcatcgtctttggatctcccggaggtaagttctctgatccgtcacgtgccggatacgctcctggacgctcatcgctcgacgccattttgattttcaacacacaaaaacgatcaaccacgtactattatacaaattttatgtatcttttctttcttttgtgtgttattataaatatgggatgtgattgtgtttggtgtcattgctgcatgagcaaaatgtgacgtggatgatttgagaaggacacgtcattgcgttgtttgtggttatgtggcgagaaatattgagattgagctttgtggatgacacgtggatatgttaatgatggtgattacctttggccacttggcacttataattgagattcttgaatttggttggactctgtataatcttcatagaaaaaaaaaagatcgttatagtctttttcaaaaaaaatctatatacgggccgggttttatgatttatctaagtttcgatttttttcatgtcaagtcaagttttatttcattattaaaatattaattgaactatcaaaatctatttttttttccttctccacatcaaaatgtgttaagttatgacatccaagcaacataattaaagcggttcgctttgatataaattaaatttttgtgaactttatttattgttttttagataaagttttatagatgttatgtaggactttgttttgttttgtttcaagtcgtttcactccaatacaatagttttgaatatgaattatgaacactttgacaatattttgtcacattaaatttacaactacaaatagaatttatgtaattaaaaattagaaactattaagaactcatatcatatattagatcattttgtctgttctttgaacaccttttatgattcacaatttatataataagataaatatatatatatatataatatttgtctattctgtgttatatatagaattttgtttcttaatttaggaaatgaatctcgagattaatatagaattcccaacggtaataatacaacgtaaactccgtgtaggtccaaactttaaaaaaaaaaaaaaactgcttccgaatcaagctttgcttcggattccgaacctaaaataaacacatgaccgttacaccgatcctaatttaaatacaacatcatcactctcctctctctcccaaaaatctcgcaaactctaatctctctctttcttcttca

SEQ ID NO: 1373 - DNA, 3000 bp, Unknown
  misc_feature (1)..( 3000): cDNA_ID_2134792_gDNA_ID_1620394_Annot_ID_155707 3000 nt of promoter + ATG
ggagtgatggtgaatttaatatagactatatagcccaaagtatttttataggtcaattggtaatagttaggtattatgagtctagatcaaaactaatatcgtgaggtcaggtcagaatgatccaccttgaccgtttgttgttatattttttagaaaaagactttgaaacgattggcttattattacctgattattagttctcttatgttttggtagttattttagggttttacggttattgataatgatacttttgtattgcttatatggtgattatttagaaactgatttaactacatttgtttatatctttgggtcccaaaaaaaaagacggtaattgtccttattaggaaaagagataacagtgatttaaatagatcaggttaaaaagaataagcaaaccacccaaaatgaataagctaatcatcactaaatgtggtcacgtgacaatgtcattgaccatcgtaccatcattaatatcgtccgcagttttatagtaatttttctgttatgttactttcttaatgtttattgtttctaacaaaaatttgaaactagtcggatttcttgtttcttacaaatttgattattctatttcgtttttttggttctttgaaattttcttgttttccatcattgatttttaatttttagcatagagatagaaatcacccgtttgataaaataacaattgaacaaataggtattcagctgtgattcaaacacggtccactcgatcatttgctgagcctaacattaataaggttgaaccttgtcaattttttttttctttttggtaataagtaccttatatcagttgtatatgggtaattaaaaaatattccataaattgagtaggttcttactgcttgttggtgaaaggctaatatgattgtatcattttcattttccaacttctgtggagtacaaaagattcgactaagttgacacttgacacttaagtttgtcaataaccaatcattgattggcaatcaatcatattataagattcactcgatttggggagaacggaacgctagaagacatggtgaacaaccatcgccaccggaaaaactggtcaagatgattgacaaaaatgtttgaaaccggttgaatacgattcggagtggagggacaaacaagttagtgggaggcattcagttttggtttacatcatggcaaaattaagaaaatttcattttaatagaaacaatgttgtaaagagtgtgcattgaattgtaaaacaaatcggttaccgctttttttgaatataatttacaactattaaaaataaaaatcaatcgtattataagaaatataaaattaaaagctacttgagaatcccatgatataaaaacaataaaaatgataattctttcttttcgtcttacttaaaaaagagtttttattgtaatttgattgagaaatacaaaagtggaatacagttttgatacacgaagtcgccaaatatcaaatctttccgtaaactaaaagttgacagaagataaatatatcctcgaaaactcaattcaaacaagaaaagctaaatagaaataatgaagtcaacataataaacaaataattctaaagatttattagacttgccaatcaatctcccttgaaccataatgatcaaaggcaaaccactaaacacatcaagctaaacctcctatagcaaattaacactccctcactaagcaagtaaacctagactcttgtttcaccaataaagaatcaagacgagtccaattcctcacacttctaccaaaaacagtgatgtcaagtcaactaaaaagtaaaaagaatgatacaattaaattattattggttttgaatataagaagtatatagttatataaaattttagaaaatagaaatttttaaatagacattcactaaaatttcaatgaaaaatctaaaattagaataccaattttctagaaagaaaaaatattctataataagaaagtaaaaaaattatttatgtattattaccatctaaatataatgcataatagacaatacaaattgcatagtgcccatttttctgtttttgtattgttgatgcacaattgtacaacatcacccatcacatcatcacttaacaacgataatacaaacaatgaaacagctcaattcaaaggtgcaaactctttgctctccttttatcaaaattaaaaacaaccaaacaatttttttagaaaaataatttttattttaaaatatgttattattaaaatctttttcacttcccggaaacggacaaaccgctttattggcaatgtgctctgcttcttctccattgcctctgtgttcgtgtccgtaaaacagatctcaaaatacaaaaacccatcaaaccttctctctcaagattccctctctgtctctctctctatatatctaaacagtgaaaaataaacctctctctacactctgaaaacagcgtttatctttgctttttcctgccaaaaaggcccaaaaaacatcactttctccagagaaacctctcaggttctacatgtgaatgtttggtaaatacagaaagaaagaaaaaaggagagacatctgcgacttctttcatatacggtgtcgttctcatttctctatttattcccccacttgcaaatctttgaaacggacccttcagttttttttgtttgttttctggtctctagtttgaatcttttctaaaaagaaacagagccttttgagattttagcactctgtgtttctttcaaatggtttcgtgtactagaagaagcacatagcttacatttttacttaaattttgggttatttcgaagagttttctgattggcaagttcagtgaatcttgggggaaattagggctattaccaaagttggtgaaatcagtttcaaatttggaaacttcagagatttctcaaaggaaaatgagatacagcttgatttggttcttctatagatacttagacaagagtctaacgaagaaaacagagcacttgtgatcatatattcatg

SEQ ID NO: 1374 - DNA, 3000 bp, Unknown
  misc_feature (1)..( 3000): cDNA_ID_3061996_gDNA_ID_1620394_Annot_ID_155713 3000 nt of promoter + ATG
agttttgaaatctcgaggatgatgtttagtttcctaatctggggaatgattttgtctaattgatgatctcttgttcgattctctaaccttgtttgtgctgaatctacaggctttaaccatcttcgttgattgtagaagtaaagtgggcataaaaatgaagactttgttgggttttgatgtgtcaaagcttctctaatgctactgtatctcaaagattttagagaattcatatcttttttactgtgaatttcgggaaaaaggaaacatttttcgaacatcgatcaccattttagagagaaagcggcggagagagagcgagaacgacaaacgagtttagagagggttcggtttttaaggctggtcgaaccaaacggtttttacctgaaccgaaccgaaatttatcaaaccgaatttgaatggtattttgttgacgtggcatcaaatcatacattattatcgggcggcgaagcttaggactcttgtttaggtatttgcgttaactgatcaaatgattcaaattacatctgcaaaacattatttataggtgtagaaaacactagtttaatcacttcaataataataattcactaggagaaaaaagaaattgcttctctaataataaaattgttcaaattataataattttagtttaatctccaaatcatttacgtaacaacatgagagagagagagaggaagagagaagagaagtgggtaccgagatagattcaaacacttgatctcaagtttctgtggtaactcaacgatttggacgagatgtgatctaatggttaatttaattgctcgagttattattcaatacacttaactattaaattagtcaaaacatctataattccctaaagcgaaatcaaaaatataaaacttaacaaacaagtttaaaagaaaaaaattgtaatttactgtataaaaaaatgttttatttgatatttagaaaaaataaataatacaatatttattttattatttaattttcataaatgattgaaagatgctaacactataaatttaaaaatatcttttattttaattacaaaactaatatttgtaagttttgttcaaattatttcatgcacctacgaaaaatggtggatccacgtgactttacaaaataatatatggttcaaaatctttaaatatatgaaaaaacaatcacattagcaaaacattaacttaaaaatgataaaaatactatatgacaatatgacatggacgaattgtgtgcatacacaacctaaccaatattcagaaaataattctatatttttaatgatgtcgtaagcagtggctttggtgaattatgccatagaccgtctttgccactttgataccatttcgaatttagtttggatcatcttatcgttcacatttttgctttatgatatatttgcgcttttattactatttcatagtataattttacccacattctaaatgatatgtatgagagattttacaatgatttgagatcagtagcagaaatgcaaacatactaacataggtaatataaaaaactcaagaaagcattagatccaagatcaattatatccaaactcaaaactaaaaagaccaagctgtttaagaccaatacataagtaatttaaacaagaatttgtaaaatttactctactgaattacaaggtaaattattttagttagtttgtaattctaccgtttgaagaggatagttgttacgcacttgcaaaaaaggataccttttacacacttgccaaaaacgttgtgtattgggataccgaaaattatggtatctcaaaacacgttgaccccgttacgattaaggcggttggtgaccctaatgaactttttctcggtaccttcagttactttgattctacctatatcgactctacctcagtcatttcaggtaaaaaaatttaatattatatttctagaaaaatgttctttaatattatacttatagaatcttacgtgagatgactttggtgtggatattgtagatgaaaagcaagcaagtgacgttattatcaaatcaaagatcatttcttgggcgaaggatagtcctgaagttgcaaatgaactattaattgcaggatataaagggtatcggtatgtacaagacctactaaaaactcaaggacataatgtttttttgggatagatctctgaaaattcgtcgcggaattatttcatgttaaaatggtatgagaatggaagcgattagcagaggaatgaggaccattaacacatgaaggaattatatgtcctaattgcaacgaaaaagtgtaaaatgaggctaaacaagatttatggagaaagggtaaaatgactaaatcagccgtgcatgagcacataagcattatattgcatgttttaagagtcttgaagcttgaagactttgctattactcgaaatgttatcaaaaattaattaaaacttgataattattttagtcgcaagataattattttttgttattgttacaaaaatcatcaccattcaaatattgtgtcacaccatttattccatactaacccaacttattactaacccaatatcgttcatacgagcattagtcttgagcattattgactttttcaatggtgaaataaagataaatcaagccgttgatcggaataccatatcagattcaagagtgtgctgttgtaccattgttctcgtagaaccgattacagaggatctaatctcactaacactgtcaaaagtcagatataaaaacaaaaaaaagtcttacagaacagaagacaaggaaacaatcgtttgacaacttcgaggattttcccgcttccatttgctataatcgtcaatttctttatttgtcttcttcttcttcttcttcatctcgattcaatttaatgccaaaaaaaacttatctttttaatgtatttataatgtttcaaatggtctgccctagaagaaagggcatacaaatgataactaacattgaagtctagagaattcttatactttttctacgatg

SEQ ID NO: 1375 - DNA, 3000 bp, Unknown
  misc_feature (1)..( 3000): cDNA_ID_3061984_gDNA_ID_1620394_Annot_ID_155716 3000 nt of promoter + ATG
aatttatatgtaattaatacacaaatgtcttgacgtaatctagacttttgttgtaggagatctaataccaaaagaactttttttgtttgtcaactaaacaccaatatcataacaatgaaatataaacaggaatatgggggttattatatgtttttcttagacaactacaagcacaatcaaccgcatgcatttggatatatattttgactaaaactcttaaaagtttaagtaatttaactaaagaattatgtaaccaccagttttcaattttgagtggtgaaattgttttccggtggttatcaagtcatccaatctacaagttttattaatttttttgtatggaaaacaatttaagtttctaaagatgtaataattttgaaaacccggttttttgcatattttggatataagatttaagtctaaacttcgagtttatgtattaaaaacaataaataatgtcttgataaaatatgcttccacataatccgatccaaccgatctccttggtggatgtaccatatactccggcgtatatttagacactggcttatgtccattaatacattaaactatagtctttctccggcggacatttctttaattcattaaatttgcaaatgtttgaatctttcaaaatagtaacacactaacaccccaaatagagtttaatattcatatcattcaacgcaactttgaattttcgtggtttctcatgggaatgttttggacatctatataactacatacttatcaatataatcaagctttacgcagctaatgtaattaaaaagttagtcctaatgaaataatgtaataaaaaagttaatcctattgaaataagttaaatgtaaattttgatattcaataaccgaaatgttagatcaaaacagtagactcgaataaatctttttattcaaaaagtacactgttgttttgtttgattcaactacaccattatttacttttcaaccaaccccatcaacaaataaccgatggtaataaatataagcatttactacaagacatacgtaaattttttaaaacacgttttatttataatttaaggatatgcaaaattacacctaggatacaacatcgaatgaaaatagataatttaataaattttgttaaaagatagggtccacgtttctatttcgcatcatctgcatcaaactaccacacaaagtcatcgcaccaaccatatacctctttgcttacttcacttgagtttcaaacccataaacaacaacaacagaaaatatatactgccaattaaagtagcattttcatctccatcgtaatgttataaatacacaaattgttgcatatatatgacaacgttgatattcatctgtattttgatttttgcactttaatatcacatgcaattattttcagaaaaaaatatcacatgcaatcctaaaatagtgtcatattaagaatttagttaatccaatataatgattctttgttgataaatgtttttagttaatttctcttatatactgtttctttacttgtattatggtttgaatgtgactgaagttttaaacacgtctcttgtatataatgacaagctagtagtcttacctcaaactgtaaatcaatttccacagtttacaccgatttttttttttcattttcatactaatggacaattatatagtactagtagtataatgattgatgcatgtctttcgtaatattagactaaattcaatatattgcctatctgagattatccttttttgaagtatacagattgtccatgattgaaaaaaaaggaattgcatgatttatcttttgatttattggataccaatcatgtacttatcatcattatctttacgaggtacttttttctttgcctctcttttcttttgaaaaagtgaaaagtaagaaatataaatactaaagaaaaatagtttatcaattatccgaatcactaaaattagttgattcactaagtttaatcttatataatctgaatatatatatatatatatatatatatttctttgttttgatgcatatagtgtcaatttatcacaaagtaaattaattcaatgagttcaaataattaaaattgtttatttcctatataaactttagttataactttcacttttacaaaagaaaaataaaaagtaccgtataaagataatgatgataataaaacatgattacagaatcctattttcctaaagatagatgattcagtgaagttcttttatatatttctacagctaatgttcatgcattaattttgatattggtgtttactgtttacaatagtggaattcgacgatataggttataaatggatgttgcggttactgcgaactaatttatcagcggtttaatctactttatttttaagatggacaataaacataaaccgttgttgattcaaattatttcaatataaaaatatctatgattagtctatttgtaatcatttgaatccgtagaataaatgaatagtggaaatcttttcacttcaatagttgatcaaaagtttattaatatttattgctgtaaaaacaatcccaattaatatcttttagtaaagatgcaattaaaaaaaaattgattgctattttgagtaatgcgatatagacaaaaaataaattgttaaatatattttaaaggcataagtatattttgtatttttgaaatcttacataactaatttaaagaagagagaatttgtcttagtaaaatattatttgccatcacttcactagatttaatcgagctacaagtttacaacaatttgacttttagtttttgcatcataatccacgtcatcgttggcatattatcaaccgtatgtaatgtatctccccctctctcttctctcttttctgataaacctcaccagctcctctcaaattctgcaacaactaaaccctctctctctctctctctatctttctctcttcaccatttctttatcttccatggaagaacagtcttcaacaacaaactaaaaacatg

SEQ ID NO: 1376 - DNA, 3000 bp, Unknown
  misc_feature (1)..( 3000): cDNA_ID_2134940_gDNA_ID_1620394_Annot_ID_155712 3000 nt of promoter + ATG
aaagatctttcttttattgtgtaaaaaggttttgacttaatccatatttttgggttattgtagtggctgcgttaatgtcagtgaagaacaagatgaaagatgagaaagaggttttgtctggttgggatattaactctgttgatccttgtacttggaacatggttggttgttcttctgaaggttttgtggtttctctgtgagtatcttttgcacaccacttgttcgactaaatgtctctgagaaacgtttctttgctgagtttattgaaatctttaatgcagagagatggctagtaaaggattatcagggatactatctactagtattggggaattaactcatcttcatactttgtgagttaaatgaatttgtggttaatcttggaattcaagtatgtgttgttgtaactaatggggttacttgttattattgtaggttacttcagaataatcagttaactggtccgattccttctgagttaggccaactctctgagcttgaaacgcttgatttatcggggaatcggtttagtggtgaaatcccagcttctttagggttcttaactcacttaaactacttgtgagtttgatgcaaagattcttgatttacttaatgttgcaattgttattttcttacaaggttaagtcttgtaggcggcttagcaggaatcttttatctgggcaagtccctcacctcgtcgctggcctctcaggtctttctttcttgtatgtcttactctacctaacattacagctccaggaaatttctatttcgtataatgtttcttagactaatgtttttttatttatgaaaaacttgaatagggatctatctttcaacaatctaagcggaccaactccgaatatatcagcaaaagattacaggtaagatatgcgaaaaatgcatgattattagccgttgcaacttatgtgaaagcttcttgataaacttttctgttttaggattgtaggaaatgcatttctttgtggtccagcttcccaagagctttgctcagatgctacacctgtgagaaatggtatgttgcttcgaaaattctttgcaaaactttatttaaaacatggtttcgtttatttaactagctgcaatcgatctgcagcgacgggtttgtctgaaaaggacaatagcaaacatcacagcttagtgctctcttttgcatttggcattgttgttgcctttatcatctccctaatgtttctcttcttctgggtgctttggcatcgatcacgtctctcaagatcacacggtacatatctaatagtctctctctgtctgtcatatacaatatatgtcaagactttgctaaaatctgcattactttttatggatttcttagtgcagcaagactacgaatttgaaatcggccatctgaaaaggttcagttttcgcgaaatacaaaccgcaacaagcaattttagtccaaagaacattttgggacaaggagggtttgggatggtttataaagggtatctcccaaatggaactgtggtggcagttaaaagattgaaagatccgatttatacaggagaagttcagtttcaaaccgaagtagagatgattggcttagctgttcaccgtaaccttttacgcctctttggattctgtatgaccccggaagagagaatgcttgtgtatccgtacatgccaaatggaagcgtagctgatcgtctgagaggttttcaattaacacatttcttgttttgttattctttcgatatataacgcgaaaagttccttataagattacatgtttcagacaattatggagaaaagccgtctctagattggaatcggaggataagcattgcactcggcgcagctcgaggacttgtttacttgcacgagcaatgcaatccaaagattattcacagagacgtcaaagctgcaaatattctacttgatgagagctttgaagcaatagttggcgattttggtctagcaaagcttttagaccagagagattcacatgtcactaccgcagtccgaggaaccattggacacatcgctcccgagtacctttccactggacagtcctcagagaaaaccgatgttttcggattcggagtactaatccttgaactcataacaggtcataagatgattgatcaaggcaatggtcaagttcgaaaaggaatgatattgagctgggtaagtaaaaaaattctatgagtcatttactcaacttagactgaacccataaggacaaaacttaaatctaaaccattggtttttgtaggtaaggacattgaaagcagagaagagatttgcagagatggtggacagagatttgaagggagagtttgatgatttggtgttggaggaagtagtggaattggctttgctttgtacacagccacatccgaatctaagaccgaggatgtctcaagtgttgaaggtactagaaggtttagtggaacagtgtgaaggagggtatgaagctagagctccaagtgtctctaggaactacagtaatggtcatgaagagcagtcctttattattgaagccattgagctctctggaccacgatgatagacttcatagtgtcttaactagtcttcttgattttgttgtcattgtcatggcattaactgtaaaaatttgttttctcaataactcttatttattctgttcttccaaaaataaatgaagatttgcgtttccacagtctcataaaaaattatctatcgttaattttaaaactcatacataataaagtgattcggcgaatgaaagactatttgccttatgtaactaagaaggccaaatatatgcttaagattatgcttttcttatgggctttataatattggcccattaaaccattttaataaatcaaaggggtaatttcgtcattgcgttaattcaagaaaccctaagtaccgacccatataagttctctcactttgcactcgacgcagttttgggctttgcaaactctacactgcttcgtctcttagctcgacattgatctccttaaaatg

SEQ ID NO: 1377 - DNA, 3000 bp, Unknown
  misc_feature (1)..( 3000): cDNA_ID_2134785_gDNA_ID_1620394_Annot_ID_155705 3000 nt of promoter + ATG
atgtaggactttgttttgttttgtttcaagtcgtttcactccaatacaatagttttgaatatgaattatgaacactttgacaatattttgtcacattaaatttacaactacaaatagaatttatgtaattaaaaattagaaactattaagaactcatatcatatattagatcattttgtctgttctttgaacaccttttatgattcacaatttatataataagataaatatatatatatatataatatttgtctattctgtgttatatatagaattttgtttcttaatttaggaaatgaatctcgagattaatatagaattcccaacggtaataatacaacgtaaactccgtgtaggtccaaactttaaaaaaaaaaaaaaactgcttccgaatcaagctttgcttcggattccgaacctaaaataaacacatgaccgttacaccgatcctaatttaaatacaacatcatcactctcctctctctcccaaaaatctcgcaaactctaatctctctctttcttcttcaatggcgacgaaactcatactcaagaaaacgacaaaatccatcagccgtcaccaacgtaactacctccgccgtcaccggaaatctcagatcggatgctcaccgtctccggccacaaccaccgtaatcgccaccatcaacaaatcgatctacagatgtcatcgaacttttctctgtttgttttctcgtcacgcaacaaaaggattcaaaatcctcaaacctcgcgaagattttcagaattctccgtattcattgtttcacgaaagatctggtaaatcattcgacgagacgaagaagacgatcgtgttagatctagacgaaactcttgttcattcatcaatggagaaaccagaagtaccgtatgatttcgtcgtgaatcccaaaatcgacggtcagatcttaacgtttttcgtgatcaaacggccaggagtcgacgagtttttgaagaagatcggagaaaagtaccagatcgttgttttcacggcgggattgagagagtacgcgtcgttagtgctcgataaattggatccagagcggcgcgtgatatcgcgtagcttttacagagacgcgtgtagcgaaattgatgggaggttagtgaaggatttagggtttgtgatgagagatttgaggcgcgtggtgattgttgatgataatccgaactcgtacgcgcttcaaccggagaatgcgtttccgattaaaccgttttctgatgatttggaagatgttgagttgaagaaacttggtgagtttttgtatggtgattgtgtcaagtttgaagatatgagagttgctttgaaggagtttgttggaagagatgaatgatttttggttaatttcggtttagttgattttacttgtattaagaggatttgattaagtagacaatgatgaacaatagctttgtttgttcgatctgtctttgtgtaaaacatcctcgtgataagcaatttgttaatttgtttgattagtgtttttctttgtgattgaatcaatgggtttttaatgaagattttgaatttgaacagtggactgagtttgacaagatcgagaactttttgtgtgggtagagttaaattatgggcctttattgggctttttgttcaatggtgtgtttacatatcaaaacttttaagttgtttttgtttactaataagccatattatgaaacagtagttttgaataattacaaagaaaacaaaaaaagatcaatcaatatattttaaatatttttttggatcactttagaagcggaatgtcaaagctttatcattgcaatacaaaagttatggataagaggttacatgaaattgacttttgaaggagactgcaaaaatctagtcaatagcttgaatggaggcagctcaagatttgatttggttaactggacctatgaaagaagagcatgggagagaatatttgagcaattgacaattggacactaggagcaacaaatcaaacctgcagacattttagcgaagaaacaacaaacagaagtttcagacttcatatctcattttcatattccttcttgtatatccaatgagttgcactcagattacattgatccaagttaatgaaagttgatttttttttttaaactacagtaaattctctagaaattccattaatatataattactaaattatggagagattttactaatttttttaatttcttacaaaattatatctgaaagcaggtttcaatataatcaatatttttctaaaaccaattataaaaagaaaattaattatgaagtttagaaaacaatacaaactttttgatatagtaaaaattttaaaaatgaattgtaccaaaaaataatccaaatataagaaaaatgaacaacattagagtcataatttcattaaaatattttatatataattatagtaatctatatatgacatatatatataaataaattactatcatatatatatatattgataagtttatacaattattaatttatgataaatgataaggctatattttaacataacattttcaaaaatttattatcttattgttttatcgatttgtgtcaattctacattggttccaacttgcatcggaagaattttttaatttatatagattattaatttatcgagtattaatttatagaaattttactataccatgatttgaggacaacaatgtttatttttaatatccatttaaagttttaattattataatacttggcttttgggacatattcttagagatctttaagatatgtatattgtaaaatcttaacatatgttgaaagctcaattatataatattactatatgtcaaattattttgagactacataatgcatatctaataattgtgtttacaataatcctatataaatagaggttgatgagcaagcgactaagttgcaatcacatttcgtttggatcatctatcaccaactttcaaactttcaattttttttatagtttcctagtttttggaaaa

SEQ ID NO: 1378 - DNA, 3000 bp, Unknown
  misc_feature (1)..( 3000): cDNA_ID_2134766_gDNA_ID_1620394_Annot_ID_155700 3000 nt of promoter + ATG
ttggagtataagagatttcattcgaccatactcatttgtccttatcttaaaatactttatttcgtttttgtcttcatccaagaatcaccatatcttattatccattttttttgggttcagctagcaagtagcatcccttcgatagactgaggagaaaaaataaacaattatctggctcttaccgaatctaagattttggccattttctcccctttttcttttgtgcaaaccattacaatatctatggatagatcttcatatttcacatgtatgatatatgaatgattccactgcaataagttatcaaactaagagacggcaatgtttttttttcttaattcatttcactgcaatgacgttattttattgttgttggtgagatatcccggctgcgagtttgaagactcttgtatagatgatttgaagacactaaaatatttcttctcatttcattaatttgataatattttaatagtgtgttaaaaataaaatatatatacagtatactccttctgttttataaagattgtcgctgtattttcaatgcacaattttgaataaaaatccatttttaatcctatttctttagtgtattaataagagagataattttgtttagtatattattaattaaggggtataatctaactttttaatagttttcttaatagtttttgtgaaaaatatagaatgatatttttttgtgaatcaaagaaaatataaatatatatttaagtattgtgaacctaaacccgactaattaatctcaagattcgggacgagacgattgataatattataagactgcaaaaactatccctcgaaagaagctattgataatatagtagaacatgaaatatatcatccctaacaaaaaaaaaagcttgaaactaacttcttgcgctaaccactatctcacaacacctttggtaatccttacagttttgttactgaaatgaaattatgtcctttaatctgaatttgatgttttaacacgatactaataacaattaacaaaactgagtggtggggacattctataaacttgtttgcaatcttagtttgaccaatataattgacatattttgtgcttgtatatatgtttgtattgtacaaggacttgccaaagcctatatgccaaggtcccaaaaccaaagcctaagacccatgctcgagcatgtcattccttgttttacttggagttggaacttaattcatacatattgtatgtatgtgtagtatgatctaatttgaaaaatatttttaataattcacgttacagaataatttaaatttttacaaagtaattgtataaagaaatttaaatagaaagtctgtttcattacaatattattttattgtagtatttaaaatgaaaaatacgataacatttggtagtatttaaaaaactggtcatcaagtttttaacatttcagaatagcgactcagctattataggaatgttgaatccataaaagtggtgccagtctgagcataacatagacggatgaagaaaatcggaacgtgataatatttttcttatatcttagaaaataagaaaagatatgtggtatgcgtttgtcaatataattagtaagagaaacctttatatcttaaaagcatactttgaagtttcctctatttcagaaactaatatttttctaagtaaataatagaattcgttttcctttaagacttgggcatgttacgttttttgaagatgttaacaagatatttttggatgcctcttatgataagaacatccactttgtatggctgattgagttttgcaactaatagtattctctttgaaaaaaaatatttctcattattatttttcaaaataatatatcatttttttttttttggtaagtatcaaatttcctatgatatgtattcattttgaatacatcaacttcttattattgtaagccaaaaatgtaaaatttgatcacctatatttaatcgacatattagtgatatttaataaattacttgcacccatatttttttttttgacatctttgaatcgataatatccgatctataaccaatctctataatacgggataatacggcttaatggaattgaactctgataggaaaggtgtaatcaaaatggagttaaccacttaactaaaactacatccctgaccatatttttatttatttaaaagtgttctctccattaaacaaaggagaaactcttatacagtggaccaacaatcgataagaaaaacgactgaaacaattaatacaacataaaaatcgtgagctaaatattgtttttgcaggaatatcatattacgaaactagtcgtaagaatatagcggtatcaacaacatattatatgtaaatttacatttagggataacataacgattatcgacgatattaacacaaaccaaaagactccaaattcaggtcatttgtatacattttctacaacaatattttcttagtttgatcaaaaaaatattcaacacttgtgtaaagtttagtaacaatgtgaaaacgaggcttaaattggattggataagagtaaacgataatgtttgggttgggccaagttgttaatagtggaagatatagccatatagggatggcccaatttagtttatgaacttatgacttcccaaaagttgcaaatctttctttagattggtccaatttattgatattatagaattacctcacaaaaagaatataatgttgactatacaataggataatattttattttatacatacattttgaacattatttctatatacacaattataatttgcactgaacaagaagaaacagaaaactagtactaactgacataattaaataaaagtgagccggatcgtaattaaactttaaaccgggaaatttgataaccgggaagatatccacgtcagcagcacgataacaccgccatcgctttccttaatttaccttttctctctcgacaaagatattgactaaaagtcaaacagtcgttaccggaatca

SEQ ID NO: 1379 - DNA, 3000 bp, Unknown
  misc_feature (1)..( 3000): cDNA_ID_3062008_gDNA_ID_1620394_Annot_ID_155697 3000 nt of promoter + ATG
gagtacatcaaaaccgataaaaacccgaaggcttttatcaaaccggggaaaacggtttacaaataccaagcagctccttccatgaccgggttttctagccgcggcccaaacgttgtagaccccaacattctaaaggtaattttttcttttttctgttaacttcaaaaccaaaccaaaatgactcataaccgaaattaaccggttttattcgtttgcggttttaacagccggatataaccgccccaggactgtacatactggctgcatggagcggagcagattcaccgagcaaaatgtcagtagatcaaagagttgcaggttataacatctactcaggaacttcaatgtcttgtcctcatgtcgctggtgcaattgctcttctcaaagccattcatcccaaatggagtagcgctgctataagatcagctcttatgaccactggtaaacaaaacaaactatggtttttttttgttggttcggtttagctaaaccaaaatcttttaaataaagtctttttgatatttgtttaattttattttttttggttagcttggatgactaacgacaagaagaaaccgatccaagacactactggtttaccagcaaacccatttgcacttgggtcaggacatttcagaccaacaaaagctgcagatcccggtttagtctatgatgcatcataccgagcttaccttctctatggctgctcggttaacatcaccaatattgacccgacattcaaatgtcctagtaaaattccgcccggttataatcacaattacccgtcaatcgcggtcccgaatctcaagaagacggtgaccgttaaaagaacagttacaaatgttggaactggtaactcaacaagcacatacttattcagcgttaaaccgccatcgggtatttcggttaaggctataccgaatatattgtcctttaaccggattggtcagaagcagcggtttaaaatcgttattaaaccactgaagaaccaggtgatgaatgcgactgaaaagggtcaataccaatttggatggtttagttggacagataaagtccatgttgtgaggagtccaattgctgtttccttagcttgattgttgtttgcttatttgggatggttttattagtcggtttggatgttatagaggtcaaagtgaaagaaatagaaaatatttttctgatcactctatagactctccttatgtcatcgttgttacttgtgaagatggtagaaggaaaaaaaaaaagatggtagaagaacttgtggactcatggtcatgggcttggtttgagtcaaacaagaagccataccactatgattacttgtaatttaacaatcaaaattaatatataaaaatgccaagaaatagtgatgctaatcacgatgggtatcaacaaaagtttcatacagaagaagtgatgcaaatttcctcataatttagattcatatcaaatatttttcaacaatttggatacaattagcagaaatttttgcgtgcgttttcaatgtatgcattttgagaacatattacacgattatcactcttaactatttactatttactattcacaaaagaaacataaagacgaacgatagcgttgttatgtttttgtttcaatctgttatactaggtgtaactagactcgtcgacaaagaagaattttaagatgggctttaggccttgccaaacaacaaagggactaatcgtaaatcctctccttgttcgcttaaaaaaatcaggaaaaatatcattaaaatttattgaaaatgttgatttacatcttcaattcttaacgaaacaaaatgaatatcaaatttatgttgtctttctaaataaataccaaaattttgttgatttggccatattaaacatgatgttaaatagttaatagaccttgttaacatagttaaactttcaattagcagatccgttaattgaaaacaatatcattctactaataataaaatgctatcgttttatcgtaactgctaataaaattccaagtttcaaattatatgaagatttagggtaattgagtttgctcgatctaagattgaatttaggaatttctttcagtcgttaacacaaaacgatgtcgattttatgttataggaaatattgttgttttcaattaacatgcatgttaacagaaaataaactctcttaacgagatatgtttaaccctttaaaatcacgttctctatgaccatgtcaacaaaattttagtatttatttgaaaagtcaataaaaatttaatatttgttttgcttctttgaaattgagaatttaaattaatgtttctataaattgggaattttaatgacatgtttcccttgaaaaaaaaccaggtatgagacagtgagactggaccggaaccacaaaaccaacatgttagtggtatgtattcctacgttagtttttttaactagctagcattgaaccggactcaaaccaaaaatcaaaaccgaaccaaaccagaagtacatcaagtcgctctggaaatcaagtaatcaccaatttacttttgagtgcaattaaaattatgaatttgaagatttttcatgcaagtatattaacgataaaattatatatcccattaaacccatatctagattctcgtaacaaactaaaattttcttttatttattaaatatacctaaatgcgaaatgtatagaatattcctacacgcatatataactcatgtataccccccaatctattagggtaaatagatttttgtagatcatgttaataatttaagacgatgaaagcatcgtaaaatgatctgttttcgaagcagcaatctgtgtaataattcgataaaattatttttacactagcatatatcctttttttctcaaaaatcctataatttggttggaccatttttaaatttgatgctctctgtcgaatgtaagtagccaatcaaacatctataaatcattaaggttatgacattcggccaaaccaaaacaaaacaaaaaaactaaggccatg

SEQ ID NO: 1380 - DNA, 3000 bp, Unknown
  misc_feature (1)..( 3000): cDNA_ID_2134760_gDNA_ID_1620394_Annot_ID_155698 3000 nt of promoter + ATG
agttacagtaaaaaaatcagagctattctctgcttgaaaattagctgtcgtctaactctaattcttgttctatcttatatgatcacctcccaaaatggaagaagataatatataaatcagtttcagattatctaaatataaaaaaaaactctgaattctgttatgagagactgagagttgtcatagcaaacaaaaaacgggcaggagagattatattttcccaagaaaacagaaggcatatgatgaaacagaatctcccaatcaaatgcttagctactttttcgtagccaactatgtacgtcgatgcctctcaattatttttccccactttttattcaatttattcgaccgagtaggacttacaatactcttatattcagttgttataacataacgcttatacattagattatctacggcaggacattgtatatttaaaatttccaacttgacaaaacagttatcaaaatattctaatatttaaaaaatcgaaaacactaataaaataatataactttttgacaaaaaaataatattattttggttttcgaatcattttaaaaatatagtgtttaccgtatcaatgttgtatatacaactatacaattgccagcgtataaaaacttgtatagcgaaaatgcagtacgatttatcacagtacaacataaatacggttatgcatactgtactgtattttagaacattaattattaattaacccaaaataggtttttctagacgatggtcctgttcgtttgcctgtcgctggcgactgaaaccagcgacagcgactaaaagttgttcgtttgcttgtcgctggttcagcgaccaaaagtagcgacagtcgccaacgaccagcgaccgcaatttttggtcgctgaaatttttagcgatcagttactggtttcagcgattagtcgactgtttttggtcgctggatcagcgacatgcaaacgaacaacttagcgatcaaaaaatataaattaaagaataattaaaaataattaaattaaacagaattaaattaaattaaacttaaataaatgtctttctgcactctgaacggttgtgtcttttaatcgcaactttccgtaaaaaatattgacgattgttttttctcgcttgtgtcttttattgcaaccttcctatattgtaattttctagtcaaaatatttacggttattttttccggttagttatatatatactattgaataactacgaaatttataatatgcatcatttggagttagatttgttttaaagaaattattatataaacaaatttataatatttttctctgcgatatcacgacgggtttgagttctagtttaattaaaataatttttattaaattaagttaaaataaattaaattcaaataacataaactaattatagtcaaattaaatttgataaaactaaaataaataaatatattaatttatttttctcatggtgtaggatatatatgatttacattttgattttaaaatataaattagcaccaaaataattatttttaaaaaaatatatagcgactgtttatagcgacagtcaaacgaacaacacagcgacaattattagcgattgtcgctgtaattggtcgctgagtccagcgacagataaacgaacaatgtatgtagtcgctggttgctgtcgctggtcgctggatccagcgacagagaaacgaacagggccgatgtaaataacttaaaataagaaaattttcttgaaatattggtaatgcctcaaggcccgcgactatcaccgatcttgttcgctcccacatctatctttagtagtttggttcatgaactctttctcaataaatgatcagtgctattcaaaaaaaatagagactatcttttcgtatcaccataatatctatataaaagaaaataaacatactgaaaatgtaaaaaaccaatagagaatgtgacacgtttatgaacttttagagaattttattctttttattctttcgtatcaccataatattactccaattttgtttgtgggagactcgaatccgaattttgggggtcactagagcaggggtgctaccatcatttttaatgattcctatgcattaaaatttgtttgaacatttaactcaggatcaattgaaccccttcttcgaaccccttcttctttaagaattagtgggtctgccactccaatcaactcattcgaggaagacaacattctcttggaaagcaagactattatctccaacggtattaaacgaaaaaacgctctacatttatatagattttatatcgtatataactctttaactgttattgtttgtaggttttatatgtcttcttaataaatcggtcctttgatggccggatcattattttagaaaattttaacgatttatcgataattttgcaaattaccgtaatatttttttttgtgttttatactcattcacatattactaaaagataacttctaagtaagttcattcttcaatttctccaattcaaccatgattaactgtggatatatagtaactgtgggtatattttgatagatatcgttttgtttttcttggtcaacctgatatagttaaatcaaattattataggcctctccacgtacatatcattttaattatttcagaaatgggagtatcacaattatgttattttctaaatgtaatccgcgactgtaagtacataaaacaaaatataaccttaatcagtatgtaatttaccgaaacaagtttttcaaaatatgatatgttataaataaaaatagatttcttaccatttgtaacggttctagtggtcaacatgaagctgtagtttgcaagacgtatccagtcattagatcaacacgattaattagttaggatagttttttaatttctatatatacgttttgatttgttgctctttaactattataaatagcccatcaaacccctacaacggattagggctataacattccaccaaacacaaaagatacaagtttaagaccatg

SEQ ID NO: 1381 - DNA, 3000 bp, Unknown
  misc_feature (1)..( 3000): cDNA_ID_2134849_gDNA_ID_1620395_Annot_ID_155729 3000 nt of promoter + ATG
attctacaacacctgggatggtcgatagagaagtggaatgagctatacaaggaccttcctagcaggcagatcaaggtcgaagttccagatagaacagcggttgtgaccacaagcgaagaaaccgaggctctgagacctatggggattcaagatgctattaattctgaaatcaagaagtactcgcgtggcagagcttttataaggccatcgggtacagaagatgtggtgagagtatatgcagaggcttccactcaagaagatgctgattctttggctaattctgtggctcagctcgtcaaaagcttccttggttcaagctaaagaaccatctgaatttctgcaagagtatgttaatgggagatttttttaattttcttgttcacctcttagcttttacatcttttgtgtaacccgaatgacaagttttcttctcagcttcttttgatttacttcgtttctcttctagctcttctgcttctttctcctcaacgtaaacctgtaaatgctttactttcctgaaaagaatcagcaacgccattactcttttttattaatgaagctctaagaacagaatgtttcttctcctgaaattgtgtaagggaaagatagttgttaaggaatcagtagcagctactttatagtaagatcataacaatggtgtacttgaagaaacgttatgccgtaatctttggcttaagagggaacatagctcatgccttttgttttcctgtcctatctctaatcaacttggtctccgacagtgacttcacaacaaacctaccacagaatcttcttttacttacaactttcatgtgagatcctatttgtgggtatgataaaagaacaacttaaccagtgacagggacttgttgttatgttgttgagaaacttcaggtccccactttaagttgttattaaatccatttagaccaaagagattagagaataggatcatcactgaacatggagaagagagaaacttgctggcttttattattgacaatagcatatgtcatatctaaaaaacattgagaagacagtcccttgtgaattgcatatgaagtttgtagtttaatgtcccacacactccaataattatgtcatcaaaacaaatttcattaatgcatctttccaaatggtaaagacaaagccatgttctctgttttagtatgtccaacgcgtcaaaaccacaagtttcaatgattttttcagagaaatttcaactccttagttgatcttgctatatatatactcacataactcactctttcaatcatcaaccaacaacaagaaatccaataacttgaatcttttcatacatcttcagaagcttcaaaaagaattcaaacattttaaacaaaaaaacaatagatatggctttcgtgagaagtctattgggagcaaagaagattctaagccgctccaccggagcaggatctgcggcaccaaaagggtttcttgcggtgtacgtaggagagagccagaagaagagatatttggtgcctgtctcatatttaaaccagccttcatttcaagctcttctcagtaaatccgaagaagagtttggatttgatcatccgatgggaggcttaacgatcccttgtcccgaagataccttcatcaatgtgacttctcggctccaatgatgatgatccaacattttttccttcagttagaaatagacttattcattgtaaatagatgagccctttttcctctttcttcttgaaagagttgttctaaaagtgtagaaagtgaaatacaaaattgatgttatatacaaacttcatgtcaatacttttttgattgatcattgaaaaagaaagacaacaccaaattcaccaatcaaaaactactctaattatagtttcatgttgattaaatataaataagtggaacatctaacatccggatccgtggcgcaatggtagcgcgtctgactccagatcagaaggttgcgtgttcgattcacgtcgggttcaatcccccgaactttactccggaaataccttttttttgtaacttcttatttccatttttgctctcttcgcttatgcttcgtttcatccggtttaaccaggaggctactctggtttggtaatctaattactctaaaccgaaagtccttagtactggttcgaaatctgaaatctaaaccagttgactcacaaccagtgaaatcaacgatcaagggccaagcctatcttcaattcatactcgccagtttttgtgcctaaaggttttttcaaaggataaacaaaggcctaaataattttgctaccacttgaacattaattcgttctcaattatgtaatatttaatcatttatcttgttaattattcttaagtgattttacttaatactagcctagaaacaatttcaaactttcaaattcaatctcacgggaagcatagggtcacatctatatctagttaaagactaacatttaaaacaaaatttgaatataatagtaaccaaaaataggaaacgaaaattagcatagagattccaacttttgttacatttttattcctagatataaacatcatcacattttctttataaattacattgacacgtaacgctttaactatggtttagatgtggaatacatgcaggttacatcttccgcactatctcatacaatcaatgtatctgttctgagacttttagaaatgtgaatctgttttgtgtaagattaaaaagtaaataaaattatataatttaaagtaaaaattggctgtaaaccagtaacaatagttaattcttgagacttaaagagtaaatgaagttgttagtcgctgtcattgtagtaaatcaagttactaaaactggcaaactactttgctttttgcgtgtctttgaagtcacaaaacagagctcctctatttagtattattgggaagaaaacaaatagaaagagaattagtgagtcataaatcagagagcgagagaaaagtggtgagacatagagtgggaggttaacgaaagagagaacg

SEQ ID NO: 1382 - DNA, 3000 bp, Unknown
  misc_feature (1)..( 3000): cDNA_ID_2134893_gDNA_ID_1620395_Annot_ID_155743 3000 nt of promoter + ATG
atttgactaccagaaatataggctaagcaagaatcttaatggacaagctaacagcagtttaaacaagacaagtaagcttagttattcattactcagatacaaaaatattttaatctaaagattcattcttttttcatactattttccttcaagtaaactaaaagcaacctggtttaggtgtgatgaccatggtagaagaaaacccccctgaagtagacgaaagtcacagtgagagtttaagcattggaccacagccgagcatgtaaggatatgcctatttgcttacatattctaccttagtagattctcaaaaatgacctatatttgtgcacgcaggaacttacccataagtgatgcccttcaaatgcaaatagaggtccagagacggctacacgagcaacttgaggtatctatcatatactgtactctgtgcattcaccatgttcaaagcagctatcagtgttggaattttcggttcctatatttgttctaacaagaccaatcaagatgagtctggtttcattaattctcatggaaaaaaataggaacaatttacagaactatactcaaaattgtagaaacacatagatcagtgaaaatcataagtatagagtatcaatagaggcgagatgaactatatagaaacagagaacagagcatttagttacgatttcattaaaaatattttaaaactgagccaggtacagcgacatttgcagctcaggatagaggctcaaggaaagtacctgcaatcgattctggagaaagcacaagagactcttggaagacagaacctaggtgcagctgggattgaagcaacaaaagctcaactctcagaattagtatctaaagtatcagcagactatccagactctagtttcctcgaaccgaaagaactgcagaatctacaccatcaacagatgcaaaaaacgtatccacctaactcctccctggacagttgcctaacctcaagtgaaggaactcagaaagccccaaagatgcttgacaacagactgggattaagaacatatattggagattcaacttcagagcagaaagagataatggaagagccattcttccatagaatggagctcacatgggcagaagaagaaagcctcagagagaatcacaacaggccatatctttcaacaatggttaacaacgcagaaccgagaatctcgtcttcaagaagaagtcctggaagattgtcaataggagtgggattacatgaacacagaggaaggagtagcaacaacagtgagtatacagaagaaagattcaacgagaataatgaagattgcaagcttgaaacacacacaagaacagctctagatcttaacacacacgacgaaaactatggcacaacgcgtcctaaacagtttgatttaaatggtttcagctggaattgagaagaacaaataagctttagaagagtgcaacaacctttttatgataatcacacaggaaatgaaaagcctttgatttcctttgttagcttgagggattcgtctaaaaattgaattattagtcgaactcaaaagagacatcttgtgcaacaatgtacaacactattaatttgcgtagttatgatctcatcatataaatacagataaatttactaacttcatggaagatactgaaattcttgagagaaggacgtaaagctccgtgctttttaacaaagcaagaacatacccatagatgtgtaagcattcacaacgttgcaaatcgaagaaaaaccggaaagtgagaaacgaatggccccgtcgaacgacgagagattggggattgtccgacgccttttttcaaaccgggtcggttcgcatagatctgggtcgggttaaactggttttatccgaattcgggcaagaggaccccatctgttacctcaaagagtgacaatgtcatgtttcgtccctgaaattttagtaggcgcttattttcacccattatagttttctttggaccacttaaccaaacattgcaattttgtttattttatcgttaaatacacatctcaaatttttttttcttttttttttatagaaaaaaacttttgatttcatataattaagtttaatactgtagaaaaaaacaaaaaaaaaccattaaactaattaattacaatctactgataaatttttaaagtaaaaatataatcgttttattttatatgaatgaaaaatagtcggttaactacatttgcgtgtactaaaatgctgataaatttatataaaattaaaatatatctcgtatatatttataatgtatgacatacatataggtgatatatctaatttcagtaaaataagtcaaactgttatatattaataaggtatatttaagtttagatttactaaacgatgtcaacatataaaaatcattgagtacgagattttaaatttatttttctataaaaataaaaaaaaactttaacaaataataatataaagtatatttaatttgtccggtataaaattaccgttataataaaaaataaccagaatgcgtctcgcgccataaattcaaatattctttaaattgttttacattactttccatttttgtgttttctttttatacttgaaatatctacttcaataactttaatttaattttgataaccaaattattatagaccttcacatttgggaaaaaggagtaaaaatagggggtaagaatcagaaagtagtaaaagtatgaggggcaaatcggcgaataaaaagcccggtaactcttttactatgggccgtcaatgtcaaactcgaaactctcgttctgatttctgtaatcaaatccacaaaagatccaatcaaaattcattcacccatcatcgttagttacacatcatcgtcttcttcctctcgctccctctgatagcgaaaccctaaaatactctcagctgctactttccgtaaccaaatcccgacgaattaaccctttttttttttggggggataaaatcatcggagtctcttctctggttcggctgtgatg

SEQ ID NO: 1383 - DNA, 3000 bp, Unknown
  misc_feature (1)..( 3000): cDNA_ID_1534189_gDNA_ID_1620395_Annot_ID_155747 3000 nt of promoter + ATG
gtactgactaaaacgactttccaatttaatctgagtcggcaatgtgtagattattactgtacaaatatctttaatataaaaatttgtcgcatgttaatatttccagaagattacaggctggaaaatcgatgtattctctcaactctttttttttcttcttaactttttaaatgcgtacaataacaatatgcatcaatatttctattagtactattattcttgttaaattattatgtaatgttcttttaaaccgttaaagttttatacttacataactatatatgaagctctagtaaacaatgaccaatgatcataaatatttaaactagagactagactagaccgtgctatataatactagcgagtaaagacaattatacagttaatttggttggagattaggtgtcataattccaaaaaaaaaaaaaaaaaaaattggtatgatgatttgttcacataagaagaaaataacattctaaagattttctaattattagaaaacaaaaagaaatgttttcttaatttcggaatttacagatactttgtgatagacaaattttaggtgtctgcttttttacttttgtatctactaagaaacaactacatttttgctttgtctactaggaaataacggattgtgacgaatctacgattactgagtcagagagtgtcaacgcgccaaactcatccaaaagatcagtaagttacatatgaacgtagtagtgacattgacaaaatccgatgtatccacatttagtttcattgtcagctcataaattaattagagtaactagttattttctcgtattgattgtttagttgtaatagtgggcaatagttctcggttatttacacagaaaaagtcagacgaagtattaaatacttagaatacatagccgcacttttctattttgatgatatatgtatgtgacctaattttcgttttgttttttgacgtcgttatatatgacctaataattataagttctacaagagtagagtactccgatatattggtattgcaactaaaataatatatgctactaatttgcatatatatgtaaaatctatgcttttttgttggaaattcctttatgtttttttagtcaagcgcttggtgacttgactagtcaatatatattcaccgacttgggaaaaatcaggttaattccaacttaatctatacttacttcacggatttcgagcaatcatactaataattatatcacgtgtagtgttactattatgcgacttgcaaaaagttacgaattttgtgtgatatttgggttttgagagaataattaaacacacagaaaatgaaaggatccagattaagttactctgctaccaattaattaaataagttaattatatcactatcgtctttcttcggcttcactgaaaaggctaaaacaaacaccacataaaaagaccacagccttttcaagtaggagcggtgctaatcaattaatataatactcagctaattatacattctctaattaaatactagaaaacatatactttataattaaccgtagtatttctcgactttgagaacactatagaataaatgaataaaacggataattattgaagataaatatgaaactcaatttttttttgggggtctaatgttaaattatgaaactcatgattaatagctaaatacagaaaagaggagatttcttagggctttctttctataggataataaccaaattaaaaacaagaacaatctttaatcacgggtccaccacatcaaaagctatattgtataaccctctttagtgaaattattttcaacacgtttttggtttgatatggtatttattttccaagagttctttccccacagtttttaatacggtatttaaaaccagctaagctatagcatgaaaacaaatcaacatataattaatgcaatcaacattatgtatatatataatatatttagtcgaattattgttagctaaattagttagagagacgctagtttcacaccttcaatacaaatttgagtaccaagtatttcttaagggataatttaaaaatctcaacagtttgttaaatgtattatcaatgactaagtttgagctaaaaagtacatattaatcgaatttattacttgtaaaaatataatgaaaaaaatcgaattgttgtctaagtgaaacttgttcaacaattcaggaagttgcttggagcgtacgtatctttcaaaatcaccaaaaagaaggaaaaaagaagaaggaaaaaaacaaacaataaatagatttatcttttagttaattacaaagaaagctcatatccatctcctctatttaaaagccattttttccaccctttcaatacttttatttctctgctttaactgcccaaaagattctctcccagctagctttctcaattcatttttctttcttcatcttcttcttgtgtgatctctctttccaaataagcttatcattcttacaaaaatatttctgggtttctgatattgttcttgttctcttgaatctttattacttgaaaaacatataaagtgatggcggttgtggttgaagaaggtgtggtgttgaatcatggaggtgaagagcttgtggatttgccacctggtttcaggtttcatccaacagacgaagagatcataacatgttaccttaaggagaaggttttaaacagccgattcacggctgtggccatgggagaagctgatctcaacaagtgtgagccttgggatttgccaagtaagtagtagtcaattttccataaaccaaaacaaaatttcaatttttctttgaccattcatgtgtaaacacaaaggctatagcttcttgattaagatttatcaattcttgatgtctaacttgtttttgaaccaaattttcaaacttcgaagccaaacaaatttcaatcttctttgaccatttcaacacacaaaaggcttcttgatcaagattctgatttttgtttttggttggtatagagagggcaaagatg

SEQ ID NO: 1384 - DNA, 3000 bp, Unknown
  misc_feature (1)..( 3000): cDNA_ID_2134913_gDNA_ID_1620395_Annot_ID_155750 3000 nt of promoter + ATG
caactaaaaacaacaaaacaacaaaacataccacaagaaaaacataatcaatgttaagttatattatatatggttcaacttttctttctcaatcttgacaaaattgaccatacgtattttcccttagagcatctacaacaatgggatccatattttacaataaaaaatttacaaatagacatttgaactagatttatatttgacattgtccaatgatgggatccaaatatagaggatctaaaattttaaatgtttgaaaaatgtgtctaaggtatgtgtgtttgtgtgtccaaagaagcgtccaaaagagtgactaaatgtccaaaaatagatctgtatctaaggttttttcttcaattttgatttaatttttagatctttgatgtttaggacatcctattccaacaaaatctgaagaccgacgctaaaaaccctaaacagacttatatttcatatgtgtaggtgacagtgacagaccgtattcctcaaaacgtggaaagattcttccgtttgtgagattcgatctaatatttctttaaaaatatatatattactacaatatgttcagaagaagaagaatcctctacaatcaattcatacaaaaatataggaaatcaaatagcaatatcgttttttttttttcatcttttatagattgactaaatagagcaagaaaactagcaaacttccttttttgttgatatatactacgtacaaaagataagttcttatcataaaagtttgttgaaacatgtttacctcttctactctagggtttggatttagagtttagatacaagctttatttcatatatttctcaagaaaatattaatatctcattatattttcatacattatatgaataatacgtactgtcttcctcggaaaaaaaaggaaaccattattgttatctatgaaaaaagtaacatgcgaagagctgcaaagctcctcataaaaaacttgaataatctttaattaaataaacaagaaaacattgagactctcagatccttgacttataatgtgtatactaataaagatataagaatacgggagaatcttcaaacgaaacacaacgaaataaaatgatgatgagtaacgtaactacctttagaaaaaaaaaaaaaaaaaagaagtcatcgttttccataatcatcatatttttgagggatattcaccaaacagaatcatggtcctttaaggtggcagagacgttggttttgattgccaatggaagaatactccctcatggtccaaccactcgttttgctctcatcaccttcaacgtagaacctgagattcctcttcttcccgatcacttcaccggttttcttcgacacgacatcttttaactctccagtggctttccaacctttaactttgcgatttgtccttttcacgaaataaaaccactcgttaggttcaaagatatcattctctgtgtgattaagccgccacggctctttggcgtagatgttgtccctgtcttctaacaaatatatcgtgtttggttggtggaagccaagctttggtagaagataatcgagtatgagttcttcttctgaaggattaaatctaaagcaaccaagctcttcctcttcatcgtaaaattcttcagtcatcggcatcatcttcttcttctgaaatttcctcgagtcaaatgagagagaattaattatgaacctcctctaatgaggtttatataaagtggagtatgattgagaaccgactattgaatattatctaatttggattagttttggatatatataaatatacaaaaaggaaagtttacaagtttttcatgttatttttataaaaataaatccaataggcacagggctataccaaacgaataataatgatgtcaaaaaaataaacgaataatagttaataatttttcaaaaaactaaagacatttattttgtggcccaataattccaaacacatcaatttgaaaaaaaaaattatgtagaggagatacaaaaggaaaacaaaaaaatttgtatggtttcgcactgggctgggcctatctagagtccaatagtcagcaatggtttggttaacctttctttcttaaccttggctaaacagaccacaagtttgggttctaaggttagataacaataaaatctcagggccgacccctgatacttatgctcataagcatatcctaattcttttagctaatatcgtttaacgaatttatgctaataataacatgcgatctcattacttgaatatcaagaaatgcaacaaactctctctttttcgtcccaagagggggtcttggcctcttgggtatactttctgcagaaccataaattatgtttctcgtttaggttctgtcctttttttttctttttttataatatcttgactatataccagcctatgtatatcatttttttttactctaatatatactggaaaaaggaaagaaaaaaggtttttgtttgtgctcaattcctataagttaatttttacatgtatctgttctcaatagtgtctacattcatttgatcattataatttgtacactagtacactaaaaaggaaaaagaaaaaaagcagtatagactttccatagtcagagctcaccaaaaaggaaccatggtcatttgaggtggcagagaatatggaaatgaactcattacatattttgtacaacaaacccattttggaattaaacaggccctctatgttaatcagagcataaggatttcatctttttctctacaaacttttcaattatctttttctaagagttacaaaagtatatttgttttctatataaatttgggatagtctatctacatttctacaaaattcagctaaccgttaggtgagtcactcatagtcatacatatcttccttctatataaaaaaagaatattagttttgagtggactgataaatatattcttttcaacaagaagaaaacaatcttcttaaacccaaacgttcaagaaaaagaaaaaaaaacgatacttacgatg

SEQ ID NO: 1385 - DNA, 3000 bp, Unknown
  misc_feature (1)..( 3000): cDNA_ID_2134897_gDNA_ID_1620395_Annot_ID_155744 3000 nt of promoter + ATG
ggtggatgtttttgcttatccaaagttttatctacggaagaatcttacttctccatgttttccaaagggtttcaaacaacttttgaaataaatgtttaaaacgaatcttaaagaaagtaaacgaaccaagagaatgtataaaactgaaaaaaagaaaaacaagaatggatactactaccaactacttgcaactagacaatcaactctttataatgatccgacttgtcgaataatttagccagcatttgcgtttgcgtccagtcgcagtgccctcgattttttatagtttcataatattcaaaccaatataacaaaactgctacatgattcggttggatgcagacaacactgccttgtggtgaacacaaaactcctacaatgattctcctaatcttttgttgtgcttataagaatcacaattcattaaaatatccacaaaaatcgagactaagtaaaaggggaaagaaatagacccgaatagtctctttttttttttgggttcgggttgtgatgaacaaaaaagattcttgagttgagaatgcgactcaccaagctttctttagttttggattctcatattctcattctctagaatctcatgaacgaacccacttattaccctccattttctctccaaacgaatataattccgcggtcatttcccgcttcctcctgttttatgtatccaatcctctctcattcaatcaagcgaatcacaatcccacgtgttgaattatgctccctatggaagatcaaacactgattaaagttagtaaacaagaacaagaatctgtcaaagggaaatgaacgtacaaggaagaacattttgtctgtatcactcttttctttcactgaagaaggggaaagactacataattaagcacaaactagtataacaattgtgaccaagataacatatcgtttaagctctagttctgaagaaaaacacagtagtccaaaatctggaacagaacctgctacaaaaagcatacacaaaatttgatcttttctgaaactacatttgatatagaacagaggattatctatctgacaaaagagaagccaatcaaaagagttcaacataaattgtttgcttcgtctaatttacttttgatggtatacaaatagagttttcaaacttgcagcacacaatatgaagcctctctttgtggaagcatattcccactcacatgccaatcaactatttaggcaatatgctcaaatacttttaactgaaggttatgaaaaaggttcttcaccaaacagaataaagtgttaatgagaaatcagaaccatgagatttcaccaaaaaaagattgaaaaatgcaaagatatcattcaaggaacataagatttgtttttttgacattttcctttcaaacaatagaccatatttctacctagtttttttttttaaggcacctatcaaactcattaagatatgtgagactctatactagatagtggatatattctcaattgcacatagagaagccataatttcagcatttggcaatcacgacttgtatatttatatatctttatctctcaacttattctatatagctgtatatcatataggagagtatctctacacttaatcagtcagtagaaatataatagtgaagtccaaatcaaactcgcatccaacaccataatatgaatgatgataaaatttagagccgtactcaccactaaagtagattcaaggaagtacactgtaagaaaccagccaaacattagatgcatatatgcttcacgaacttatacatatatacatgtaaatatgtacatgtatgcacacataaacacacaaacaatacatacaaatatgcactgaagacatgttatgttgcattcagaacagacaggaaaggttacacacatacatagattaacacatgcatggatgagccaaatatgttgtgccaatcaaagagtgtaagatatggaccccccactaatttttatactatttagagagaataggtactaaacttgttgaaggagacagcaagaaatattctacattcgctttctcaattatctttcaagaaaaatcaatgttgaaacataaactttcaccccccttgcattatgcatatcacaaacctgggtattctacgctatataataatacaaacataatcactatattttcttgaaacatggccaaataaaccattattgattttggtcaaaacctaacttaaagttttaatagatttaagatgtatgtagagactgaaaaaatgactttcaagtcggaacaaaaacaatacagacaagtggaaagcattgagaatatacctcaagagatagagaggttggagctgtggactttgaaaaaattgaggaataaggaaaaagaatgaattcccctgcccaagtagaaaagttgtcaaaaagatttggagaataagatactttcatataccagaatggtgaaggaatgcgcatatgatgcattaattgtggatcaattctcgtatctaatgcaaggctttaattgcactgaaaagttgtagtccagaggaatcaaaactagaaaaaataatgtaagcacacaaggtacagtttaaacgataagaacacaaataacaaagcaacgattggaccagttattcatattccataccttagttatcatcctctaatttgcctttttgccattcaactttctatataaagcaaagttgcaaagactttttactcttgagagaccccggcctgagaaaaagagcataaataaggaaagcagcaaagacatcttcccaagttggtggagttgcaaaccatagtgtatctctgaactgagagtagcaggttgcaattaaaaactaaagattgtgtcaggtaaaagaaaaacatttggtctttgcactcattattaatgcagtattgctaggtgggataagcttacctttttattttgaagacagacttatgtattaccacaaccagcaccaaggaaagagcatcctctcttcatcgagaatg

SEQ ID NO: 1386 - DNA, 3000 bp, Unknown
  misc_feature (1)..( 3000): cDNA_ID_2134889_gDNA_ID_1620395_Annot_ID_155742 3000 nt of promoter + ATG
aagcagttttcttcacaacagcaaaatcctcttttacagcaggtagcatattcaatatggaataatcacatgcttaatagtattcaaaacattccatcatattaagagattatcttttctaatctgtttctcagagctcttccatctctcctcatggaagcttgggaatcggagttcaggcaccaggttttaatgtcatgagttctgcctccttacagcagcaatcaaatgccatgagtcaacaattgggtcagcaaccttctgttgcaggtacattcactgtttaggtttagctctgtggtttatgatatgattgttgatagacactatttctgggtttagcaactaacatctttggcaaaatattatccaagttttatataattgattaaagtaaactttgttaaggggtttaacatcttggcaattacttaaatactagatttgttggagcctcagtttttggattcgagtatagaaagtacagataaaaatatcagcaaaataaagggctttgtctttgatgtttgtgcagatgtagaccatgtcagaaatgatgatcaatcccagcaaaacttacctgatgattcagcttccatagcagcttcaaaagctattcaaagtgaggatgactctaaagttctatttgatactccggtaagcaggaatagttctgtgctctcatttattacttgttggtaactttttgatatacgctttccaccagatagattttaaagcggataaaaaacttctgtctttgttagtgttggtgagtgttgtgatttgtcattccttcgcttaaaattctcatatgcaattcaatagtgaatgtggtttatggatatacataatgacagctgtattctattaaaccaagcaactaactaagggtggcctctgatccttcatgtgttttctgttttatcttcagtcgggaatgcccagctacatgttggatccagtacaagtatctagcggtcctgatttctctcctggacaacctatacaaccgggtcaatcttcaagtagcctcggggtcattggacggagaagtaactctgagttaggagccattggtgacccttcagctgtagggccaatgcatgatcaaatgcacaatctccagatgcttgaagctgctttttacaaacgtcctcaaccctcagattcagaacgtcctagaccctattctccggtacatcattcttctgaattctacttaaataatatccgcttaaatctcatattgcctatgattttgaacagaggaacccagcaatcacacctcaaacatttccccaaacacaagcaccaatcataaacaaccctttgctctgggaacggttaggcagcgatgcttatggaaccgatactttgttctttgcgttctactatcagcaggtaccaaaatctcaatgctctgttccatcttttatttatcttcttttccccggttcacgtcaaccttatcgactttttttccctgtgtttgtgtagaactcataccagcaatatcttgctgcaaaagagctgaagaaacagtcatggagataccacaggaagttcaacacttggtttcagagacataaagagccaaagattgcaaccgatgaatatgaacaaggagcctacgtttacttcgatttccaaaccccgaaagacgagaatcaagaaggaggatggtatgatttcattcatgttttccgattacacattgttcttcttctttggagatggtaatcgtaatgttttttcttaaatgtctgtgtaggtgccaaaggatcaaaaacgagttcacatttgaatacagttatcttgaagatgaactcgtcgtatagaatagagagagatgcatgtttgtatatactctcgagcaagtgtgttattatttcctgcgactatttgtactcttcttttcaataaactaattacttttagtttcaacaagttgaaattcttcgttaacgactcttaaagacaataaaagccagagtatcatcatgaaatctttaatgcttagattattccaaaagccgatttttttaacaaacggaaaaggaaaaaaaaacaaacggggctgttcatcagagatctaggaacttttgtttataaattttttttaacatttccaagatataaaatacctttttttggtacaccattttgtacaaatttctaaaaaatcccaagtcatcattctctaatggttgagaaaacaccaatgactttggaagattattccaagaatgaagaattgcattaatatcatctcctgccaaccaaatactaaacgaggcttgttgaacatgtaatgttgaactattcccaatatatttattgaaatatagtccaattattttttcttaaatgtctagtacagaaatgtgcatgtaccgaagattaagcagtgtcggttaaataaaactgaaaaaagaaggaaaaaaaagaagaagaaagagttatgacttgtaacaatgtgactatgagtatggggcttgtttagcggatcggtgaaatttggttattacaagcacgtggagagtgtcgttttcgggatttgacctgaagaacggcatcgtttctcgtgccaatcaggcaatcccttagaccccaagcaattcactttgccttttgcttaatgtaataaagaccgaccaaagaaaaatatgtacatagattaataacctcatatcatatgaatatgacctccatagatccacattgttgtactcttatgtcatgatatatcacttcttctctgtatcttactagttacttcagaaacaagacaaaatttactcgtattattcttttgtctcctttttttttatgtttcaaaacttctcttcgattgttctcatagcttaaaccaacaatacaacaaccagttttttactcgtgcaaagcgaatctaaaacattaccgataacttatcaaaatcccaaaacttgatcagttttttctacaagcggcaaaaaacagaatacatccaaaatg

SEQ ID NO: 1387 - DNA, 3000 bp, Unknown
  misc_feature (1)..( 3000): cDNA_ID_3062041_gDNA_ID_1620395_Annot_ID_155732 3000 nt of promoter + ATG
cccccttgcagaaataaaatgacttgaattacttgtcagattgtttagatttgccagtaatcaatccgtcttttacactgatcagtaaagtttttggcttaatgagttagttttacaaagacaggacaaataattcaatatgacagaaatgatgctatgtgtgttcattgtctcttattcttgcacgctttgctagaggctactttttagtttatttggtgagcatcaaatgtagattagttaggttattatgctgtataacccttttagccttatgaaattgtttcatgagtagcttatcctctaaaatactaaatgttttcatcatttctttcccatttttggtccatgttaattgatatcatgaatttttttgttcatattgcagtgtgttttctaggtatggtatccatagcttgccttcaatcctgatggtgaatcaaacaatgaagatgcgataccatggtccaaaggatcttgcatccctgattcagttttacaaggaaacaacaggtgagagtatgcttcatgaaaagccagactgtgtctctgtttgtactttctggttttgttttctactgtatctgaatatattagctcacaacttattaaaatcctttgaagaaaatcagttaaacttttttatatctgtgtctttccaggtcttaaacctgtccagtatatggatgaaggtgaaccaacaagcttggacactgatggaaacctgatcacatggctacacaacgggtcatctatcagagaaatagcagaaagagagccatatatggtacttgcactaatgtttctgtctttgaaactggcaattttgatcttccccatcatgggatcacggttgaaaacgttatgggcattgtatgttccgcatctgagcttgggaatacttggtgagactagccaactgtttggccgtgccctacacatgatcgatgtgaggagactatggataaaactgagactcaccaaaacaaggaacttccaagaaagagcaaagaacgcacttgcatcagtctcactaggaaaatcttcatcacaatcagcctaaaagggtgatttagaaatccttcactgtcaatgagcttagtttagattactttactttactgtctgtgagagatcctttgactgacatgtttctatacctttggagttccactgtctctgtatgtaaatcctgttttgcttcttttgtgaatattttttcttcttcttttgaatattcatgttcttggtccacttcgttgtgcttacgttttgtctatattgattatggatggtttggttttaattggtgttagagatggacacttgggtcgtgtatgtgaaagaaacttgtccaacttgtggatcactctggttcacatgttttgaagtttcgttttcctgtcgcttttgcgtatgtgtctgacagttgaatctctctatttagatattttcaacttaggaatctgcttttatttgattctatcgtttattacagttataagatttagcttcaagcgtaaactgactaataaaccataaaatcaaaatcaaagaagcaaccttcaatgtttaaagtgtagggaacaaagtagcacaagaggtgaaagaaaaaaaaaagtagagcaaagcaaaaacaaacggaatcgttaacaattactatatgttatgaatgattttttttctttgtagacttaagagtttcttaaatttgcaattgaattctgtatgctaagtgcctaagttcaatgattattgctttttgttcatccgcatttgaattttttttaatggatttgcaactgataatctaaaagctaccaaataacctaatattagtgtttttgaataattgcctttgtattttacaagtattgatttagttgattttcgacgaaaagctttcctcaaattttttaatattatcacctatattctcattacgtaaaggatcatatcaaggatgataagaaattataataagaaaaataaatgattctaggtgtttattaaatgactccctctttctacacttgttaaatgaaaacgtagttgctttttcctggaataacactaataattccgagcaagcaacctccactactactatcttttatcatttttatccctagaaagggactttaaacttgtaacttgtataacacatcacatcatcttctttttttcttcctttcgttttgtggttaatttggtaatttactttcgatgcaataaacaagccgaaaatatgaaaaacgttcatctgttaattagtaccaagtttatacttgaagcttgaatatagttatctacaccaataatttttgtattattttacaagaaatttaaatacccgcttaggtagacgtcttaatccataacttatagaaacttaaaaaacttggtacgaaagattcttcttaatcatcagctaactaaatcttgtttttatcactaaatattttattagcaatcaaatattgtggaaaatgaattagcgtgttaaccaatgggtttggttataggaaatataaaatatcaaaggagagaagggaccttgtcaaagaagacaatcgatacttcttaacgtgggtcctaaaatggcaacatcttttttttgtcatttcatgtgtgtagataagctctaatttcttacctcaccaatggttatatgaatataaaaatgatttctgtaaacaattctgttgaaattatgtaattatcattatatattaaatcactaatcaacactttatactttttaacagtgacaacactaaatgcgtccatttaagagtttcgcttttccgtctcttcttcttctttgatcatctatttaaggatctagagaaaccacttcgcaacgatgagggagataggtcactcctcaaaattaccaaacacaaattagctccaataattgcaacaaatcactctcacccaaacaaaacttttcaaaagccctaatccgagaaatcattcgacaacaacacgaaggag

SEQ ID NO: 1388 - DNA, 3000 bp, Unknown
  misc_feature (1)..( 3000): cDNA_ID_2134870_gDNA_ID_1620395_Annot_ID_155736 3000 nt of promoter + ATG
ggttctaaacagctcgtgatttgtaaccctactttgaaacgattcttccctttacctgagcctcaaggcaccggtgacgaatacaacgtaggagggtttctgggatatgaaccgatagagggtaaatacaaagcattgtgcattgtcagaggatggaacactcaagttcttacattggaaattcaagaatcatggagagtaaccaaacctggctatacacattggcctactaaagatactggacgatgcattaatggagttatctactataaagctattatatttgatagggttccaaggcatgttatatttggctttgatctcagatatgaagagtttacacatattgagtttccgatgcgtaattatgaccgctttcttatggtatcttatgagggaaggttggctttgataagttccactagctctgttgttgaaatctggagtttggaggatgcagggaatcgaaaatggtcgtatgaacagtttcatttatgtcttcctcccaacacaagtctgaagggtgttattgatgctggtgagcttatttacacaggatttagtttgaatagatcgttctgtgttgtgtattttgatcctaagaaaaacaatatcagagaaaccaagtttcaaggaattgcggataaccagatttggcaacctgatagacttggatttgatcttgtgaatgacttttatgtattaccaaatcacattgagagtttcatctcgttttaagagatttcatctttttgcatggaatgacactatatatttctgaagtgttcttcagatctttttttgtatccactgattgattgatcccactggagatcccaatatgttttaatgatgatactacatattctagagacttaatagaaactttataaaactatacatggagagactgtaatatgtgtttttgagattgaacctacgattcctctgttctgtttctagcaatttccatgtgatccttttctcaaaaatagaaaagagacttttgtcctaaagttaaacaagtacagaagaagtacttgaaatcttcactcagacgattagagcttagagcatacgaagattagccttagttacttgcagtatgaattcaacattttgagacatggatctctgtaaaattgaccaatatagtggttttattatggtaccttatgagaaaagattagcctggatagccacaaattcattgatattggaggacttggctaaatttgggcgctattagtctattactaatgctagtgaatttattgtgtcatgaactttgatattattagcagttttaagagccctcaggacaataacatttggtaatgaatgtaataacatcccttacatattagtgttataacactatctagtttactctcaatttggatgtgagagaccaataatcataattcataacaactgattttgagaagggttctgttttgttttccaaagaatgacacatagctaattatatatgcaagtttatgattctctgatagattcttcttgttatgattatccgttcacattgaagggctttgtcataatttgatttttctttagtttgaatatatcgtaagtcctaaacatgcatgtcttattaaacaatgtgggctctgctctgaagactattgcctacatttatgctatctactcaatcccttaggagttatggcatttagtttccagctgatgatatgtagaacattcataagcgagctcaagattctacaatacgtgtataaaagatgaagcctaagctactactaggctgcatcggtcaaaacacacaagccttgtctttttgtttctttttcttacaaaaactttgtctcctacagtgacttcaccaccaacaccatcactgacaaacactaataatgaaagaccaaattcgtatcacagaaagataagactgaaaaatcaaaatgtttcaatagcattagcctccagaagaaataacaacagtcgttgtacttgtatcctagctaaaagcaaaatgtaattgatttattgcgaattaaactctatcttgttacaaactttaacaaaagttttaatattttgaattccgtacatgtaaatggaagcatattaattgggaaaacaaaagaaacatagtggataagattgtttacaagtcaacacacaccaatttagaaaaatcaaagaaatcccgatttgatgcgaacatgacgacgcaaccatatctctccaaatcaaaagattatgtgtgtcacattccccactaatttcacttatatctagcataagatgccatataatatacatgtagtatgtaacgttttgagaatgttcttattcggcgagattatttttctgacaatacatagcacaatgtttagttttcccaaactatataattggaaaattttccaatgacatctcaaatatgtcgacatatccaaccgtaattccgtaaataggaacaaaaacatccaaagaatttaagtctagttgatctcaaattttaggcaagttgcaaataaacacaagtatattttagttgaattatacaactaaactcaaaagtacatgttgttccagaaattaaacagatagacagttagttggtaaagatttaattagttgattcaaaaaagaaaaaaatttctcgagttatcttaaagtatgtttgtcttaacttatcaaaattatatctaaaacccacttaaaggcttaaaccatgattattgtgtcttgtctttttttgtaattaaattacttaatcagctccaccgtaatcagctggacctccactgaatcttacccaaacatatcgatcacgtgcctgtgtataaataaatacatacacacttaacaagttacaatcagactgacaccaatcttcctctttaacagtcgttttattacagcgttctgatcaaaactccagtgaaagttcaaagtacacagagagaaacaaaaaaagaagaagaagaagttgaagaagaagaagcc

SEQ ID NO: 1389 - DNA, 3000 bp, Unknown
  misc_feature (1)..( 3000): cDNA_ID_2134876_gDNA_ID_1620395_Annot_ID_155738 3000 nt of promoter + ATG
tgcattgtttacatcagtgttatttgaatcaagctgaaacatcttcctcttcaacagaggagaaaaagacaattgaatagtgttttttagagacttgcacattaggccaataactcaacactaatcacttccagctgaactttaggttgagactaaaaaaccgggttcaagtaaggctaacttcccgcataacctttgctacatcctctgggaaaacagggtttatgtaacaacctgtgccaatctcaaacccacctaccccagaaagctgaggtacaatctgtaagaaccagtgcgtataaggtaattgtgattctgtaaccttgagtggagaagtatggatcatatagttatacggtggatcgttaagttgctttgctatcttctgaagcatgagtttcagaagtcctccaaggtcaacagcctgataatcatcaaaacaaagtgagtcaggtgatcatctaaccaaaccataaatggaacatagtagatcagtaaaaggtaaccttaacgtcatcgagatgatggaagtgggaagaatgatctttcggaataatccaaatctcaaagggatacgtagcagcaaaaggagcaacagaaacaaaatgagacgactcatcgatcacaaaatgttttgatttagcttcacagagacaacatttcccagtctcctcgaaataatctttagtaccatcaaggcgtgaagaaaccgttggaggaacaactggtagagccatcatttgactgtgggagtgactcattgatgctccagccgacgcaccttggttcttgaaaaccttcaacatacgaaaacaaacgtagcagatgaatgtaactatgcaagcaacacaaaatatccacacataacacaagtattgacggctaaacaatgtataaattcacactaatagagctactacattgggatctatggataatgcttacctggatgtaattgatggaatcatgttgcgcaatctgattgatcctcttcttataagcgatcaagatatcgccgatacccaccggatcgatatcggagagctgaatcgaatgaacaggggattcgatcactacgtcgtggaatccgaatccgactattgtccgacttgttcccgtctcaggttgggtcgattgggtctcgagattcctactaagagccgggtacagattctcgatgacccggagtttccaattcgggtcatgatctggcacacgaaataactccggggcacactcttgctcacgaccgatgcaaaatgggcatgaggaaggtttgggattagggttctggggagatttggatttgaaatcagtcggtctcttggctctggcgggagagaatatgacccagcggttagttaccggatctttcctgagctcaggggactgattctcgactgagtcaccgtcgccgccgccgcgatcagaggcatggctcggtgacgtcatctttctctccttcttttgtgtgctctgtagctgcgacacttgtgcaatttcgttaccgttggcgttggacagaaatttagcaatgggcaattccggtttaaattgaaccggaaaactcgaaccgatttgtttcgatctaagattcgaatttatcggtgtaatccaaaccgaagagggttcatattgtattcacatgcctaaacaatcgagattttacactataatcctctttataataagatttgtacaagacaaaggatgtggattttacattaagcccttatacacgtgcgccttactggaacaacatacaagtcccattgtatacgtacgaacgtattaaattagtatattaacaaatttaaattcatgcgagcaaaacgaagcaagcagcaatattaagaccataaacattcgagaagtctacaagctttttattttttcaaaatatagatttattcataaattaaagcaatgaaaataaaataaaaatctaccaaatatttgccagaaattttgctaaagttgatcaatccatccaaagaaaaaaagaaaattttggaccgaaaaaaaaaaaaagaattcatccccaaatctgcacctcctctcatcttcttcatctccttcaatcttcattatttataacctaaaacgactgaatctttctctctctttatctccattttctaggtgtgcttatcacagctagaaagttcttacatttaaatcgccctagttggagaaagccgtcggtttctcattttgaaatttccaaggagatctgaaagttttaattttttggatcgatttcatcgttatcatactccgatcatcatttctgttcaagggttaatcgtaaatcgttcatcgggtataatgtttttgacatctcgttttttattctgtggtggttgttgtgttttgatgctttgtttcatatatttctcttttgattatctggaaagatcttgtttttgggtgatgatggagcgtgtttttgtatcaaactgtcgcttggttacactattcttttgaatctatatgtttctgtgaagatgagaatctgtattgatggtttctgattggtatcttgagtagtgaatcgactttcttcacagattcttttgatgtgttggtcatcatcatcatcatcatcgaagagcctttgatggcgttttctcgagagtaacgatgattttgttactcttgaaccaaagttgatgagtgtatggtctgaatttggttgcagatgactgtgattttgattgtttttatctgtttgattggaaagtgattttgatggaaagacaatgctttaagtgcaagccaatgtttcttgtattctttttgattgtatttttacttgctaacacaacggattggtgtcttttcttttggattgtgaaggaaatgcaaatgaaattggttgggttcacctttttatcaactaaatacgtactctctgctacctctctttatactgcaggttagttaaagaggtttactgaaagcaaaatactttcttactctttgtatggagtaagaatg

SEQ ID NO: 1390 - DNA, 3000 bp, Unknown
  misc_feature (1)..( 3000): cDNA_ID_2134853_gDNA_ID_1620395_Annot_ID_155730 3000 nt of promoter + ATG
cacatcgatcatgtgtagggcacggccaaacagttggctagtctcaccaagtattcccaagctcagatgcggaacatacaatgcccataacgttttcaaccgtgatcccatgatggggaagatcaaaattgccagtttcaaagacagaaacattagtgcaagtaccatatatggctctctttctgctatttctctgatagatgacccgttgtgtagccatgtgatcaggtttccatcagtgtccaagcttgttggttcaccttcatccatatactggacaggtttaagacctggaaagacacagatataaaaaagtttaactgattttcttcaaaggattttaataagttgtgagctaatatattcagatacagtagaaaacaaaaccagaaagtacaaacagagacacagtctggcttttcatgaagcatactctcacctgttgtttccttgtaaaactgaatcagggatgcaagatcctttggaccatggtatcgcatcttcattgtttgattcaccatcaggattgaaggcaagctatggataccatacctagaaaacacactgcaatatgaacaaaaaaattcatgatatcaattaacatggaccaaaaatgggaaagaaatgatgaaaacatttagtattttagaggataagctactcatgaaacaatttcataaggctaaaagggttatacagcataataacctaactaatctacatttgatgctcaccaaataaactaaaaagtagcctctagcaaagcgtgcaagaataagagacaatgaacacacatagcatcatttctgtcatattgaattatttgtcctgtctttgtaaaactaactcattaagccaaaaactttactgatcagtgtaaaagacggattgattactggcaaatctaaacaatctgacaagtaattcaagtcattttatttctgcaagggggatatcaacacccaggatttgttgtgaatggttcaattgatccatggcctcactatatcagataagatgtaaatagaataatctaagtattctaagtaagttcttacgatggtaaagcctgagattgctcaacaatcaggtgcgttatgtgaggaaacattgaactcagaacatcaaactttgggcgtactgcacgtgaaaacgggcaccgtgaggtataaaatagtatggatatataggcatttccatggtttgcatccatgagtttgtctagcaagtctccatctacctacattaacaagaacacaaattaagatacttgagttacaaaaacaggcaccctatatagaagcacccacacatatttaatttctttgcaataacatctttgctgcatttcaacattagaaattgaagctaatacattgcaggtgacatgatgagattctgttggtagcttaccactgttgacacaaataaaaggaattcattgcagaacttaagtagaaaagagagatcccacatatcggagaaacaagcatgatcgtgacaaatacatcattagttatacacttttccaaccaaaacaatccaaccatttaagtagattatttcatcataaactaatatattgactggaaacaaacatattaccaccagctttctttttacagtaagggactctatatccattgaacattcctcaaaattctaactgcaggtaaactactaccacgttcaaaaaacctctgagacctcaagaaacattggagcaaaggtaaaacatcagtgaagttaagctacaagcctataccgttctcattaagctttgcatagtgaaaaccacaaccaaaagctgaaaaaaagagacttgttgtcacgaccacaacactctaaagtgatatcatgccaaataagcaaaagagggctcgaatcgatccttacaaatcacattatggaagagttatcatctgaattttcaagagatgatatttaagcaaattcttccactttaaaggcacaccaaacgcatgcctaatccaatcgaagataaaaatattcgttttgctataacaatgatgacgtacctcgataggagggcttggatacaaagaacgaggacatttttgctcgatcacggatcggaacacctcgaattcgtgattgcaaacgtcaacgtaagcaaacccagaaggtaagcatgatccagctattgcagagacgaggaatattgaaacccacaaattcattaattaaggatcctaaatctacggcgaaacagaaaaatacagataaagtttcccaaattcgctaagagaatcaccagaaactttttacaatttacaaaatcaaaaacaagagattagataaaagttaaaggtgaaatcgaataacaaaaacacgaaatcaaaccaaagggaaacgtaagattgagcacgagagagcttaaagaacacaactttaagagaaaaactacacgaaacaatcacaaatatagatttggagaaaatctcagatccatgaaaaagtttttattgtcacttgtttttgcagaaacattacattacagatggagaacgccaaaaatcgattcttttttttaattttcttttttgacaaatcgcattcgtcacacattccttttttttttaattttctccactacaccactaatcttgccgtgataggtgcatgtgtatgtgtttaagacatatctcttttgttccggttggattagtttatgtaataaccaacaactatacttaatacattttgtccacttttgaattttctgtttcttattttgtttactgtaaaaaagaatgaaaatcattgagatattaaaactaactaatcactaaggcccatttagtagacccaataaggcccatatgctattttttttctccagaatttgacctttatgtatttgaccgagtggaaaagtaatacagttcttttcttctctcctcctctttcttcttcctgattggaattttagggcttttgaaagcacgaacgcgtgaagctctaatcgagaaaaaaatg

SEQ ID NO: 1391 - DNA, 3000 bp, Unknown
  misc_feature (1)..( 3000): cDNA_ID_2109094_gDNA_ID_1620396_Annot_ID_155768 3000 nt of promoter + ATG
gatattagttaaaaatatatacatatatacatatatacataccaagttaaatatatcaaaatatccaaaatgtaaaatttgacttatggtccgcatgttaaagcaaggatgttgcaagattcgacaaaacatcgtgtaatgaacagaagaattgaaattagtttgaatactgaattgatctctttggatcaagatgagtttttttttctcactccagtttcaatcatgactaatcatacaaaatatttagttattcgacatactcttttttggtaaattaatgattatcctacatactctaatgactaatgggtttaaccaaaaatttgcgccttgaaatcttcagattatgattaaaaaaattattttcctgaaacaaaataaaaaccagatgttgagtgacaattctgaataactgcatacaagtaagccaccaaaaaaaatgagataacaactatgccacacccatttcatattgcttataaccatctttttgagtaaacctttaattactagcacacaatattgaaaatggtgatgaactatacgtttgttgtgactgtactactccaacaaaaacgaacgcattagattcgtgaaattgttggtgtgtccaccttcaggcgcatcccacttttggtagccttttagccgtgaaagcaagatcttgaacaaatgcgaagataacttgaacattattagtccattgatcgatccaacggtagatagctcttctgtaaaaaatgggaatgtccaacttacttttgattggtttatatctttctactttcaaaagattataagtggactggtatattctttggaatataccaagttcattctctttcgacctttctttcctctcgtacgtgcttcaatcatttctcttaattttgactaattttatttggtcagtaattttgaactgattcaatttctctcctctgacggccaatgcaaggtcccactaaacatacaattagagcgaggcgtcataattgtgttaacttaagtgtttgattggtttgtttataataaaaatataatgatcatgtgggttttgttttgcaatttctcattaatatgaagagcctgcatgaaaattcgataaaatgggacaaaaggcatccaaacaactaatccctttgggacttgatgtgtgatgcctcgagtccatctatgttaccagtagaagtgaaataaactatgcaacaagtaatgcaagtatatattcattatggtctaatcatgatatattcttttcgacacacgtacatatattgttggttaaataaatatgaaggtttatccttcaaccaagtgaatatgttgtctataaaacttggtaggaatcatgaaggtttattcttacatacatcatcccttttcaaaatatgtttaaagcttctaatgcaattttggctcactttctatcaatctatatatgaaaggttaatccttcaaccaatacgttgtatactatttttggtaggaatcatgaaggtttattctcacttacaacatgccttttcatttttttaagtttctaatgacattctgtctcacactttctatcaactttctttaatttggtcttaaactcgattacctatgtttattttagggtaatatgccaattagaattctatttgaatataaaaccatgattaaaaagacatttagaaaggagtagaaaagggctaaggaatggataaattaatgatggtataaacacgaaaacgattcaagcggctgaaatgtcaattatttgtttaacttgcaataatgatgctttagttacgatttttcgcaaagctaagcaacctagtaaatgatatttatgtatttaaaatttacaaccaaacagaatttggaaagctataaatacatcaaacaattcctttttttggtaaattatatatatatatatatatatataagatgaatattgcgtgttatccattacctaaacttaagcaactataaccaatttaacaaaaaggaaaagaaaaagcaaactatataaaagatgaatgctatataactatataagctatgttggtgttgtaactctgaatccattaaaagattttctcttaaaattgataatgttaaattaaccaagaaaatcaagtttttcatacgttagcaatgtcactgaaagaaacatgacccaaaaaaaggagtgaaggtaagtgtacacaagtagcatttaaagagtcgggccataaactctcgttttttagtctgtgacatgggccattcattacctaaggtttatgtttgggctacttcacagcctgaaccaagtatccttccatcaccataaatcgttgacatgaaatataggaattcgtatatgaggcatttgtgttttctttcatattttagaggcaaaatacaaactaatttttttttagagaaacgttaaaaagaagtcgccatatattatttttcctcgtttaacatttttttttgaaaaaattgaataaatgccacatgtcatcattttattgcacaagtgacttgtgtttaaaagtgcaaggaattttcaacataatatatttttaggttgaattgtcaaaaaatgcaacatgtcacgatttaattgcatatctgacttgtcctctacatagtataaaatgatattgttgatgaaacttaaatcataaatacttcaggctaaaaataatcctcacactaatttcactttcatagcagaaaaagaaaaaagaaagaattatttactacttttttttttttcattttacgacgacgttcataaacagaaccagtggcactctcgtaaatatcttcatcagttccttgaagcataatttgtgaaattttcttttaataattttcatctccgccgtattaatacaagctctctgaacgcactctacgacgagcctaacgtctttctccgatcgccggttagcagattcaagcgagatacgagatccgacgagcagatcttctgcttaatctgtaaacatg

SEQ ID NO: 1392 - DNA, 3000 bp, Unknown
  misc_feature (1)..( 3000): cDNA_ID_2135009_gDNA_ID_1620396_Annot_ID_155783 3000 nt of promoter + ATG
cttatgaatctctcatttgtgttagctcgcgacccacgagcctcaaacctataatatttactgttgtagcttgcatcccaagaaacctataatattactcattaatcaaataataaggttttaagcatggactaatgatttctctcttgcctgaatctttctgtgattcttcatcagttgcttcacgcggctgaggttgctcatccatagccagaaccggtagaattggctggatgctggaggtcgcggttttcttgaaaacagtgccatcatcaatgtctggatcttcaattctcaaggcggaatctgagttccatctcttgaaatgccttgaagatgagttcttcttcttcacgttctctaaatcgaacaatttcggcttgtacttttcatgttctttctcactcgctttcaccatttccatgattttcttaaatctaaggagaggttctctgtttttgaatctctctgttttctcctcttgaaacaaagaggagtttttaggcgggagagacataatgaaagaaacaaaacaagagaaaaaacagagttgtttgatgtgtatgtaaagaagaattaagaaaaaaaaacttgttaaaacacaagaacgaaaccgtgtggtataataataacactcgactgcaaaggcaaatccagaatagctttttgagattgacttctgtttgatgctttgttttttttcctccttttgcctcattagattcctaactaactaaccgatttgttgtccaaactttcctcgatttttatcatttacagttatgtaaacaaatttaggattataagatgctgtgcttacatttagaaaaaaaaaaaacataaaatttgaactttttcactttactatttttaaattgtatcacggaatatttgtacacttaatcgaatttgaatgtttgactgtttaagagataaattttgaactttttagctttatatgtaatattatagtttttataagtaatttagtactaaattactttagatttttataattctaattcaattatttgatgtaataatctttttgtctatagtttcgttatatctctcttaattaatcccataagccgtttatcttcattaaccactcatataatcccaaaataatacaacatcttacaattttattggaaacaagatctgttaacagaaaaagaaaaaaagaacagcttcttcctacacagacaaagctactttgaggttaaaagaaaaggaaatgaaacatggatgtggtttagaagaaactaaagagtggcgcctttgaagatgaggaagttgagagtccccaaatgaaaatagatgaaagttcctttagaatgtgtgaagaaacacccaaaattggttcccacgacacattgccatccacttccatatctctcatcgaactcctgatttttttaaaaaaaataacaccaacttttatatatgatttttagctagaaaagaacaagaaacaagactactaaccttcttgatgtgagcagcgatggatatagaatcaaagacatcaaaaagatcgagagattgagaagcaatcttcattgcttgcatttgcatcttcacaggcatgtctgtctcttccaccttcgctttcccttccaacatctttttactcaaagactcaaaatttctatattaaaacaaaaatagagaagataactcgtaaggagaagataaaaatgaattgtacgtcacgttttggacaggttttagggagagaatctccacatgttctgcctctgtcgttttctcttttcttcctgagtttaaggaactgtattattaccttgcagatatctagataagaaaatcttgcttattcttcttcgttcttcttatctttaacttttgttttggtcacaatttttgaagagagtacatagtaagtctgaagtcataaatggatcggctatgttgtgagtttgataactacgataagagcagtaagaaaatagggtgagctgatgagtcatcagagtagtaggaatgatgtgtctgacgtgtgtccacgtcgttttcagacctctgattgataggataacgatggagaggctcatatatatcaaattctgattttgggagttctgaaacctgcatgtgatcagaataatgcgtctctgtttcttgtttgttgctaaatgggccgaccaaactaaggcccaaccctttaagtcatacatttttgatttgaaataagaatactttatagcaactaggaccaacaaaaatgaaattatcattcctaataatgttttcttacaatttggttatataatttggcacacaaagcgaatctcatgcacatttgtcattgatgttgctagtaataagcccatacccttcaataagacttcttgccgctattcgtgattcccatatctaatggattattgattattgcactttgcaactcaatgcgcacataagacgagggtgatttgtcttgaacaaacaagctcaaacaccatgtagtactttaatatagatttttgttgatatgttcgtattgcattgcatgtaataacacgattttgaaacaaatatttagtcaaactatagtagcatgactttaaaagaaattattaaagatgtgttaattaaatcataactctaagttatgatggtttagtggttaaaaagttcgtgtgcaagaaccaacctgaattcaataatggttgactattgaataatttttgcagtaattagattttttttttacaaaaattttagaaaataatttatttgttctgtttttggaaaccaaatgatttcatcatatttattatttactggtcaatattcaaaacaaaaagatttgtttaatcaaaagtttccattaatgattacttaagctcccgccgtaaaacatggtgagatttagaatcagaaacactcctccgatctttctcttcatttctgaacgatcacttcttcctccgcttttcaaaatccgaccaaaacccagtaacaatcatg

SEQ ID NO: 1393 - DNA, 3000 bp, Unknown
  misc_feature (1)..( 3000): cDNA_ID_2135001_gDNA_ID_1620396_Annot_ID_155781 3000 nt of promoter + ATG
ttggtgcaagagaaacaatatgaagtattatcaaatgaaacttgtgagggatatgaagagaagattgaaggaaaccctcgagaaacttcaaataaaaatatatttcaagaggaatgatatggatgttgttaagaaatcgattatatcatggttttttctcaactctacaacacttgaaagagatggtttttataaaacacgaaagcatgtgaggatagaagttgatccaacttctgtgcttaacgaggtaagttcttaaatactaacaaagtttgtgaactaaatcaacagtttagttgattaaatttttttcttttgttttacctggttcaaaagcctaagagcatttcaatggagagagttctcattttgttataaattaaaagaatatttatgactctagacatttatggagagaggtttagtttttggtcataatggtcataatgtgttctcgtccctccactttttcctcataccttatggttcaaggccatatttgttttgataataaatgtttagtatgttaaaacgtttttatgactaacattttattaaacactattttctcttaattgaatttattagtagtttcctcacactttatgaatttattattagttttaattttaaattgtcttttaaaattcaatatcgtatatttacgttttttggtggagtagatcaaattagcatggatatacaagcaactctatgagatcacatttacaagcaactctctcaagatgtaattgaagtttgaaggacaatttaatgtatcaaaaactattaaataaaattagtttttactttaaaatagaccaaaaaattgtttggtgataagatttatattaagaaacttttattaataccatcattataaacaaaaattgatatgataataataataataataatcaaaactgctgaaaataggttgcaaaacgtggcttatatataaaacagttcccaaattgaatcgaatttaatagtttattattttttaaaagtgtgtataccctacaagatttggtatcaataaacattgttattatatgtttcaaaaaaattcttaatgtttcaaaaatttgtttaaccttctctaaggccgaagtaagttaacgatttgcaaccaggcccatttatgtcacatataatggcccataaattcacttcaatcctaaaaataaaaatctaaccttcataatgggcaaaataaattacgatcgtattcaggcccacaaatacaaacaaaggcccatgcttttaagtacaaccctagaattagaaaacgttgatataaataagctgtcataaaattgagcttcttcttctctgaagccgtatcctagggttttctttgcacactactcgctccaatggtgatctctcctcttcctctttcgtcgattgaccatgaaaaccatctctgatattattattgtggaactttttgagtattgcagggaaagggaacagggagtttcggtaagaggaggaacaagagtcacacactctgtgtgagatgtggtcgtcgtagtttccacatccagaagagtcgttgctcggcttgtgcttacccagctgctcgcaagaggacttgtaagaactctcttcattgttttaaaaaaacattctctgaagatgcgtttcattttctcgatctagatttgcttttgtgtgttaatattcattctccatgatcgtgcttgagtctgatatgcatttggaccaatttgtatattcgttctctaacagaagaagcttatctatgtagctcgattgacatgtctattagttttgtttattatagcttgaaatgtttaaactttatcagttctttaatgtctttgcttcaattgattggttggaatttgagggattatctatgttcatttctgtctctgagctcaattcttgtctctttggttaacagacaactggagtgtgaaggccatcaggaggaagactactggtaccggaaggatgaggtatctccgtaatgttcctcgtcggttcaagactggattcagagaaggtaatgtatcttagtcttaagtttgttttctcttccagtcgaaatgtggttttgatggcacatttcttgtctttacataggtactgaagccaagccaaggagcaaggcatcagcttcatcagcttaaagagccagttcgagtagtctctcaggaaggactaaagcttagcattttttgcattcaactagttgaagattacttttcatgtggatctcatacattatgttatgtgggttttgtttcttttgttattcacttataaagttttgaacttggtttaaatatcatcttacatttgcaaccttaacaagccttcttcataggtttcattagagtcctagttttgattgaatgatatctttgaagttcgcgtaaaccaacctcaaacaagcctttcaaattacattctttgaagtcctggttttgattgaaccaaatcgtagtctattgaacaacctaaaaaacattgatttcaattgaccactgaagctctttaacacaataaatagcatccctgggactgcgactataataaaagttaaaaaaatgttgtcaagggtataattggaactttcaaaatagtcggagaactaaaagtttggtcttaatcggaaaaacatagaaacaccgtttcctcctccgcttcttcgtctttccgtcgtccactgtctctctctctctctcgcgacgcagatttcgattcgtcgaatattttagctaatcctctctcttaatctctttgaacatttttccccaaattcgccgcagtgaatactttctcttcccgtaaatctccaaaaatcgagttttttttattacttctcaattgaatttgcttcttccgattgatctcttaattgattcgcttgtgggttggatttgaatcctctcttactttccaaaggtcataccttttcacagatctatctttgaaattgtgaagaagaagaagaagaagacg

SEQ ID NO: 1394 - DNA, 3000 bp, Unknown
  misc_feature (1)..( 3000): cDNA_ID_3062079_gDNA_ID_1620396_Annot_ID_155790 3000 nt of promoter + ATG
aaatgtcttactagtatttaatcagtcatcgctctattaatttggttattcattatcataaagctggaggagtaaatttagttatgtcgttatcaccagtcctatattgatttgtgtttaatgcggtttcaaatggttagttcgtgtttaaaattgttgatctgtctcagctccatgcctaatcaagaaactatggttcagctctctgtttcttgtatgaaccttacctgtcataaatagcaacaaaaaagtgcagtaattggatttatttgaggatggagggattatcaaaatgagatggaattattacctgttatgattccagtctcgatttgatgaacttttggagacagtctctgaaagtttcaagcactgccctttcctgctccatgtatatatctgtttcattgacacttgtcttggtcttacattgggaatcctcttctccattgtattgaacatctatcagttcgatcaatcttccacgtgattgtatttcttcttccacattacgactctcagactcacttgacagctcaatggcttccttatcatcaggctttgtaaatatcctgttctggtcctctaagtgagattttaaaggaagtatgttgatgaagccaaaggaatagtagatccagtaaagtgtagattttgtaagagactacagatatacctgcagttgttgtagcagattctgacgctgcaacgagaagtgagcataaatctcccaagtccggaagaagtgtagaggtgtatcccatgagggaccttttctttctagtagcacaatgaaaattcagttaaaatatttatgattatgaggtgaaggaagatgaactatcattttaggaaatgcaaaatcgaacctgtaaggaagtttaggagagcaagacataggggaacccagagcattttgaatggaattgtcaggtatcgaaaataacggagctggacaagaattccactgctattccggacagaaaaatgagttttatggagataaacccaaaagtgcatatatgttatgaagcaagtagtatatttcacttgcctcagttagctctcggtctcttctcctccggtatacttgtggggaattgtgagcagaaaatgcaggaggctggaacgcttcactaacattcttgcagttgatgcatttacagttgtctgagcacagaagattagcctgaaagcactcacagtacttcttcaaacacctggttcttttacatttgcagcctctcgaaagcagtccaggtttagtatcaggtgcagccttacactacaatacaaaacacagaacatcccagatacttacaaatgaaaaaggatgtgaaatatacctctttgaagcttaacctacaaaagtgataggtgtcaagaacatacctgattatcagttaggctacctaaagccttttcactgaaggcatttgggttgcgacctagtacattcaccatagctgcttctctagcatcacatttctcagagttgttatgacaatcaacacaatcacagtctgtacataccactcctgatgcaaaacagtcacagtacctaataaccaagcgtcaaacaaatatccaataatgcatcaatctacagcagataatagaaatctcactattcaacattatactcaaatctctatcagcttaacactaagtaattcttggatcctgaaatgaacttacaactttaaacatttggactgcttgcatcgacatcctttgtgtttcctcgaagtaatgccttcttcatctgtcttatcctttgcttctgaatgctctctgcttcaaaatcaagaccagtggagatcagagagtagattttggattgaaattactcaaacgagaagcatctctagtgaaaattggcagagaaactggaacaataccgagaaatcggaggaaaaagaggaagttctttaacaggagattctcggaagacgggagatacctccaatttggtgaaaacgagcttcctagggtctttctctgtcgcgattttgccggaatctgcgtttcctgtcatatcggtccttgacacattatagtcgccacacaagttagttcctcaatttggcgaaccgattagagcatgaacggtgaggaatcctcagagaagcgtcgattcatagatcagatcagatcagtgtatcggagagtcgccatggctgacagatatcagaacaaaaatggaatgctggatcctaattcggaacgatgaatgattgtctctctctcgattttttttttggccagctccaaggggttttctaagaaacaaaaaggttctgtgaacaacgcgaaggtattcaaaagcgagagagagtgatcttggagggaatgatgatgtgttgatgacgaagatggagttggattaaagaaatctaatttcatgattaataatttaatataacaaaattagtcttctccaatgctcaaaccggagacctaagatgtacactccctttaaaaggtactgataaaaaaaaagttattaattgcatgttggcattaaatagaatcttcctctagagttcaaaacttcacaataataaaatcaatgcatatcaaagcatatgtataagatgttagctaaccacaattgttattcatcaacggtcaggatcacatcactcaaaatgcaatattcagatggtctttaattttgtgtaaatatacttagaaagaaattcacaacacaaataaatgagaaaaagcaaatcagtaattaaccttaaaaaaatgcctaataaagcgtcattaaagaataacccattatcgcctgtcactcacttttaatcatcaaaacacgccacgtgccaaactctccactgaatcaaagtcgccaaacgcttcagtcgctatttcatgatcgacacgaaggctctcttttggcgattgcaaccaccacctaagaagaacggctacgtaatttgactgtacgacttgcgaaaaaagtcgaaaccttttaacgaaccagacctaaaa

SEQ ID NO: 1395 - DNA, 3000 bp, Unknown
  misc_feature (1)..( 3000): cDNA_ID_2135289_gDNA_ID_1620396_Annot_ID_155787 3000 nt of promoter + ATG
ttgaggagcaatcctctctttgtgaatggggcagcgaatgtctcaaagaacttgctctacaagtaacgaaagtagaagagaatctcttctcagaatagtgtttgattgaagtagaaaagtcaagttaggttatgagatgaagaaacctgaagaggattgtaaggagaaggagcatcagagccgtatacgtcccattgacctgttgtgttacccaaatcttctaagtcaaagtagacacttttgtctccatacttagccaccacaccattagccctattacacatgaacacaacaacctcaagctaatttaatcacaaacaagagatgaaattatcagaatttaatcctttttaagctaattaatcatcactatatctatcgtttaaaacacacttcagccagcaaaaatctattaatatattttgaatttatagtgtggttatagtggcattttgatcctaattaatgaataaatgaaaagttttagttaccggatggatttgggtttaaagctcaggcgggaaggcttgatggagagcttagctccggcgagtgagctgccgccgagtccttttatggcggcggatggtttcacagcggcgacggttgcaagagacgccatgagcttcgatcactattcttttgttgtgtgtggtgagtgggaattttgtgtaggaaataatagcctttggtcacaatgagtcgagttttgatcttcttctgacacgtggcaactgatttcctcccggggattttcttacgccacttggaaaatgccacgtggaatctagtaggataaggttatctcaaggttttaactaaaatatttcgtgtcttcttattttgttatagggccccttctttatgattttgttttggaaaaaaccccaatagttttttaggtttactaaaaactccagccagtggcaagttccctgaatcacgttatagatagatttgtgaatcaccaccacttttaatttgagctctgatcttaggagttaggtgtcgacaaaatatataaaaaaatcacaacataaatagttaattttaacccatccaaaaagaaaagttcgattaccgttgtgtctcatttggcttcgactagtgctaatatttacatatgtgaatgtagagaggaaaggcaatagtcatggccaggtgattccatctgtaacatattcacaatttaacataattggcagtgtagtgtgatttttaggataatccaacactaacaattacttgttatatataatcgatccacatattctatactgcgtaattcgttactatcattgacaccttaaatggacaaaatcacactaaaaggttttttgcaaaccatttttgaaagtctaaaaatagtttaaagtatctctagaatttgaaataaaataaaaattcgttttgcagtagttatttagaggttttgaatgatttttctataaaaagtaaattgaagtagtgaattttttttttttttttttttttgagcaacgttttgaagtagtgaatcaagattcattttgtaatgaatctcgtataaaaaagaggagaagtggggtcatcaaaacatgtttgagaggacaagattccacgagagtgtggggatctaattgacgacccctaagaaatgggagaggcaacaaagagagaagaaaatagacgtctttctaattggagtttgtcacgtgacggaatcttattggaatccacaaaccaaagtcactaggctctgtccttttccaacacatgaagagaaaatctcggagattccaaacttgtggagagaaagatgcgactggccaacaataaataaacatatttagacacaaaatcctgcggtaaataattaacaattgctaatgcctaatgcataggatcctgctaactgctagcaaatgcgtgtcgcagctactttacaacttctcttaaaaacatattactatattagaatcgaactatacattgggaatgagtataccactaatccactaacatttgtctaagctatttccaagaaagaggtttctatagactccgatgcatatgaggaaatgtttcggtgcatatgataggaaaaatcataaccgatacatttgagtaaagaaaaatattacgtaagatttactataaaaataggaaaattgtgatatacctgtcgagttggacccaaataatcgacaagatagactttacacataatattgagctatgtgtattgacgtatataatctatcttctaataacgtagattagcacaaaattgacgagataaacataaggaaaacgggaaaagaagagaagttgtttaaacaaaaagggaaattgcaagccaacttgaaacttttaatttatttagttcacaagttgtgagaaacagttatttctcccaaaccacattttatcaatataataagacaaataaaagaatgcataacaattaacaaccaatagttatcgctcccttcatgcatgttatagacctgacgtggaattcaacataaacagctaactgcaagttcccaagactactttgttttgtttcatttgagatagtatgtcatagcaaaaaaaattgcatattacaaaatgtagtgcagatttcttgaaattatgaaaagcattacagtttaataacgtttcatcttggtcgaatcaaatcaaagaaagaaaatggtaaaacaaatcccaaattggttaaatattaacctgaaaagggaaatgttgacaaaataactgaaaagtaaagaaaaatatacggaaagtatattcttccttcatatgaaaaaaaaaactaaacaaaacaaataaaatcagatggggtaattaaaaaatgtttttaaaaattaagaggtaaatcaataaataagaaaatgtgggtctctccttgctcgtaaaaggcctatataatgacctaatgcgactcttctttcttccatcattctcggtttaactgtgaaacacataaataaaacaaagagaaagagagagaat

SEQ ID NO: 1396 - DNA, 3000 bp, Unknown
  misc_feature (1)..( 3000): cDNA_ID_3062099_gDNA_ID_1620396_Annot_ID_155771 3000 nt of promoter + ATG
ctcaaaatggagattgatatggaggaagatattgatgatgaatcaaaagaagataaataagatttttgatcatcgtgttcgttatgatcctttcacttattccctaaacttcgagaatgatggaactatcgcatatcatgaagatcctgatgtgtcttctaagtctttttctgctagatttgttgtgtcttctaaagttttcaaacttaattatagttgagcttctttcttgtactcaattttagattcaagtgtttatacatttcaactagcactatactatgtgtgtaagaaatggaacagtgtagtaatttttcagcttctacttttttttctttttgttattcatattagataaatcaaatcttagaaagatgaaacatcatctttttcatgatccacattgccaacagcgtcaagtatagatgagtaagtgatggcatcatactcaaagcctttatctttcatctctctcatcattcttgcagcctcctcaaacattccagcatgtgcaaagcatccaagaagagtattataagtgacaccatcaggcttaataccagaatgctttatagtttcaaacatttctatagcccgtctcggcacacctgttctagcaaatccattgaggatgatattatgcgagtttatatcggccctgcaaccgttttcttccatctttctaagcaaggaattagcttcgttgatcataccagcctttaccattcctgacatgagggcgttgtaggcataaacatcgggaccacttccttggttcttcatctcattgaagagatctacagcttcgctgagcttcccgcatttcccaaaatgtttgatcatcacagcgtatactcgagaacttacattgccgaagttttcttttagttccttaaatagctcattcgctgcttcatatcttttcgcctttccaagagcgtttatgaggctgcaatacgctgcaggacaaggtggaaaacctttctcatccatctcctcaagcagcaacagagctttctctactctattcgttttacaataaccatctataaggattgagtaagtgaattcactaggggaaacactgtctgctttcatcttatcaaaccaagagcttacttccgaaacatgtgcttttgactcaaacagagctttaatcacggtattgtatgagacaacagtgggtgtacatctccacattcccatctcactgaagacatttgtcaactcctccactcgacccactttgcctaaaatgttcatcagattgtttaagaacacaacatcaggagtcaatccatctctaagcatgtctttatagaagccatatgcttcatctaccctcccagctttgccaagtccctttatcagttccgtgtacgtataaactgttggtgaacaacctgctcgtttcatctcctcgaaaagatctaaagctttctcaactttacccaccttaaagtaaattcccaacaacgtggtgtatattttctctgtaggctgcatacagttatccttcatttcatcaaacaaccttatcgcagaatcattacgacctagtttttcatacgaggatataagcgcagagtaagtaatcgtgtctggaaaacagtcaccttcgttacacatctcagtataaacctcatggactttctcgtgctgtccttcttgcatcaacattagaatcaccgagttgtaagtgctcgaagtgggtttacacttgcgtccttttgcctgataaaaaaccgataaagctttactaaccatcttagctcgccccaatgctttcacaagctcagagagtactgctggactaacgctaacatatgtgttacggaccacttcttgtatcgttctatacatttcaccataaagcctagcttcttcaaggcagcgtattaaggtcatgtaagtggagcaatcatgctgaaagtttcttcttttaccagcccatttgaaaaactgaatcttgacatttatctcaacgtctatctcaagaatcgaacgaactaatcgatgatcaactttcagtttaagcacctcaagagctttctcagcatcaggtccccatttgaagattttcactatcctaatgaatctctcatccaacatccgcactgacggatcctttctagataatttccacttctcttgaggcttctcagattcctcatgattcggaacactaaacatttgaacaatctcattctctgcaaattcatggataaaacaaaatgttcaaatcaaaaccttttctcgttttcttacttcaaaggaatcgactttaaaccttttttgcaaatcccattactcctaaaaccctaaacaatcaagacatttcgcttatcgacgaagagggagaggaaacaaatagtgcagattacctgtttgtttaaatctctgagagagatgaggtagacttgagatgcttcgcttcgcagaaccggatcgagcagatacatacatcatctttataaaacgggattcacatgtaacaattctccggtggcgacaaattccgacgtctatttgaagtcgccgtcggtggttttagacagaacggctgagaaaaacagagagaaattttagggtcagacagacgcacgtgaggttcacgtgttttcttaaaccaggcgaacccagagattgaggataacgaagcaggggaagtctaagctggcgagttttgattggtaagttatgtacacaaagcaccgaactattccaaaattgcagatatgccattgccctcctaaacaaaaaaaagtttcagtctttgatacccaatttcgtaggatttgtagatattttcttcagtaatcgaaggatataactctgagatttgtgtaagcattcttctttgagattttccgaggtcacaagtcagtacacaaaggaagttccttttttgggttttggggtctgctttgtgtcagtgattttaggattgcttcatttgccacacatttccaatctcttaagtagttggcggcgaagatg

SEQ ID NO: 1397 - DNA, 3000 bp, Unknown
  misc_feature (1)..( 3000): cDNA_ID_2134983_gDNA_ID_1620396_Annot_ID_155773 3000 nt of promoter + ATG
tgtcttcagtgagatgggaatgtggagatgtacacccactgttgtctcatacaataccgtgattaaagctctgtttgagtcaaaagcacatgtttcggaagtaagctcttggtttgataagatgaaagcagacagtgtttcccctagtgaattcacttactcaatccttatagatggttattgtaaaacgaatagagtagagaaagctctgttgctgcttgaggagatggatgagaaaggttttccaccttgtcctgcagcgtattgcagcctcataaacgctcttggaaaggcgaaaagatatgaagcagcgaatgagctatttaaggaactaaaagaaaacttcggcaatgtaagttctcgagtatacgctgtgatgatcaaacattttgggaaatgcgggaagctcagcgaagctgtagatctcttcaatgagatgaagaaccaaggaagtggtcccgatgtttatgcctacaacgccctcatgtcaggaatggtaaaggctggtatgatcaacgaagctaattccttgcttagaaagatggaagaaaacggttgcagggccgatataaactcgcataatatcatcctcaatggatttgctagaacaggtgtgccgagacgggctatagaaatgtttgaaactataaagcattctggtattaagcctgatggtgtcacttataatactcttcttggatgctttgcacatgctggaatgtttgaggaggctgcaagaatgatgagagagatgaaagataaaggctttgagtatgatgccatcacttactcatctatacttgacgctgttggcaatgtggatcatgaaaaagatgatgtttcatctttctaagatttgatttatctaatatgaataacaaaaagaaaaaaaagtagaagctgaaaaattactacactgttccatttcttacacacatagtatagtgctagttgaaatgtataaacacttgaatctaaaattgagtacaagaaagaagctcaactataattaagtttgaaaactttagaagacacaacaaatctagcagaaaaagacttagaagacacatcaggatcttcatgatatgcgatagttccatcattctcgaagtttagggaataagtgaaaggatcataacgaacacgatgatcaaaaatcttatttatcttcttttgattcatcatcaatatcttcctccatatcaatctccattttgagatcttcttcaatctcaaaacatcttcagatagatctttgatccgatcgtaactacaagacttggaacaacacattaggtgtttcttgtcgatacctgaactgcatagcaccattagagcagatgaaaatacactttggacaacagaattataaatttaaggatactgattttttgggtgatatgttgtggcttgtattgaatagtggttacgatctttatgataggatgtgaagaatgatttgtttaattgcatataaaagtttaagtatcattcttgttacaacttgcttatcctgcaatgtgatgcatatattttaattacccgtatatcatattattagtagatattttctcttataaagcaatttaaaactagaaatcatttgagatatacaattaatggctatccattgaatttaggggcaatgtgtatgttggcatataaaaaatattgccgttttgtttatacgttacacaaattgttttaattggccagtgagtagattgtctatatcatatgacatataatctactgtaacacagcaatatattaaatgggatgattaaacactgaacaggtaagatcaatacataaagaaaaatttagcagattggatctacaaaccaaattcgcatctgatttgttaagaaacaaatgataatctactgtaattgtttatagtaatcttaatatatgtgattcaataagtgagttttaataatattttttaaaacatcttgcaacatggagaatatttgaacattgaaattttcgtgatttcatgctgtttttttttgaccttttagatataaacatacaaaaataatcaaatctcatatatactcatatagttttggaatgccagtacgggttgacatttggaccctgaatggatgctgatttttgattcagtttttgagtttagattttagtttatagattttagattttagttttaaatttttgttattatatatttttgtttaaaaaatcccaaaaatttgttttttggtttttgagaaaaataacgctgattaataagtaaaaagtagattttctaaattttaacaaaagtaaaaaactaaaatcatgaatgaaaaactacaataaaatagttttactaaattgtaggaaaaccaaaatttttactaaattgtagaaaaaccaaaattttaaaatcttaattattatgaaaataaatttttaaaaaacaaaaaccaaaaactcaaacaaaatctacaaaacattcgaggccttggtttctaaaaaacattttgtaatgaaaatcaccaaacaagtcatcatagcccatatttagagcctggctaggttttgactgtgatgctcattattggcccatcatcacattggttttcactaattccatcgccgatgaagttgtgatctttcccgatcaccggatatctgtaaaagttgctgaggtaaaaggaaagtttttttgaaggtcgcatagtatccatttagaggatcggcgatagtaaaagacagtaaccaaaacccttaatatctattacatcgattcgcgttgaaaagcaatgacgaagctatctgatcttcccggagatttgctggaggagattctttctagggttccggtgacatcatcgagagcattgcgatctacttgcagaaagtggaacactttatctaaaaatgagagctttactaagaatcgcattactcaagtatattcatcagcagttagaagagaagggtgatcttcaggcgattgtcttgttaaagtatagtctttattcg

SEQ ID NO: 1398 - DNA, 3000 bp, Unknown
  misc_feature (1)..( 3000): cDNA_ID_2134991_gDNA_ID_1620396_Annot_ID_155776 3000 nt of promoter + ATG
aatgacctaacgttcttcacagtctctgcaatgttacctgttgcggttaaatctccttggatcctaatcatagcagcaccttctctgattctcctcaaagcttctcctgtatcacggcaaccacaaatgaacggagatcggaaattatgtttgttgatgaaatgatcatcatccgcaacagagataatctcgctctcgtcaatgtaatcaaccgcaagagattccaagatctgagcctcaacaaaatgaccaacgcgagctcgtgccatcacaggtacagacacagctcgttttacctctttgatgagaaccggatccggcatacgacgaacaccgccgcgagatcgaaccggatctgagacgattacagaacatgcgccggcggattcagcgagcttagcttggttaaccgaggaaacttcaacaatggcgccgccacgaagtacctgagctaatccgaccttaacagagaacggatggtttttcttcgcgtcggtaatggctgtgccgctgtagagagtaacagctccttgatcttgatccgtcatagcttgatccgccatttttaggttctgtgagtttttagtaacagagagcttttcgccggagaaacggtgtttgttagtaacacgatctgagacgagaacgagaaagctgcgttgaaggtgaggagaaatatagagagaacggagaagacgaagaagagtgtggtttggtctagaaacttctgagactgttcgtcactgagaaatggttagggtggaatcgcaaaacggcgtcgtatgcagaaaaaggaaactaagtgggcttccatgatgatgattgatgacccaagtagacggactttttctttatttttgtaagagccgttggatgtgaatagaacacgtggcgtaatcgtgtgtaattctcgtccaaagtattttgaaatgattgttttgatggacacgagtcaaagaagaaaacaaagcatgaaatatttacgaaataaagggagtggtacatctaacaactgtcttacttagtggcccaccatgttataaattgtcacgacactagacgacgtcgtttgtagtgctcctcacgtgtttcaggttgttggttctatacatttttacagttttgaagcaattaaataattgagtacgtaaatcttactcttcccaactgtcactaccactgaggatgtttaatcatataaagttctgaatcttgtatgatttgatattatattagatgagacaaaatcagtcggcaaaataaaaagatggaagaaaaaagttcttttttaaaccgtcatcaccgattcaccatatatggatgatggtaaaaatgactacaacggttttggattgtttggcagcttgggaaacaaaaagattgtaggaggatgtagtttactttcatctcttacgtaatgtgagtacgcgggcatgatccagagatttatacggtgcagttggttttatgacatatggtaaagaaaatttgtttaacatcaaaaaatgtggtgatcgtttactgatttgtcttctatcaaatcaggaagcaaggtctatgaagaagggctacgaaagtggtgaatacacacaacgtcaagcaactacggcaaaggatcgaagcattgtctaagagatttaattacgaaacttcaaactcaaagtaacacgtagttgtaaaaacgttttttttggattggtaaaattttacattcattttttttaaaatgtggtgatgttttgcatgtgggtgtagatttgaaaataccaacgatttgttgttgagttttagacacgagtaaataaatggtgggaaatcgattaaacacacatatgaagcgatgtatgaaaacgacatgcgaattttatataaacaaatatcagctcatattgacccatgcgatcccaaaatgaatggagaatgacgacgtctgatctgaccatatcatatgtatggaaaagaccatttatgttcaagcttcgaaataaacttgatgatatgatcttctctatgttttgatttggagttgttcgattgctcattgagagagataattaataaatatggtgacactttctctcttattcgtcttagtcatatcatatattcatatctcatgttgatttgttattttgctatccagggagaccacaacgaataacactcacaaacgacaaagggcgcgacacatttgcttttgcaaaattcaaacttgaaagctagaaaattaataatatatagtcctgctctataatagaatactataaaatagtaaaacaaagccactgaattcagacaatccaaattttaatgctatcatgatcactctaaaaaacaacttttacttatacaagcgtgagaataatttggtcaaaaaagttaccattacttttgaattcaaaaacgttaattatcgaggtttagctaatataacttaatttttagtgatattatcagatatagttgacgtatgtaaatttaacattgtagaagttcatattagtaaatgtaatccgtatgattttctaatgaatttaattgaattttagaaaaaaggtccaaactatttggataaatcgactacatggtattgatatgacaaaaaatctcatactaacaaaaatacataaattagtagtaaaataactctgtatagtaattagtaactataactatcatgtaatccaaaaaatcccataaaataaaataaaataaaataaaagcattaagtagaaaaggtccacaaatctgtgattaataattagaggaattaaaacgacatatagaaatcgagtttaagggagcgtcagagaacgaacagcgaccaattactctctctactctctgcgctttaatttgaacttgtggagagagaaaagggttagatacagagagatagcgaaagagaagaagaagaagaggtctatcgacagagcaaacttcgtcaagagatccgttaaaaggatccatttggagctccgattcgagctagagtcaata

SEQ ID NO: 1399 - DNA, 3000 bp, Unknown
  misc_feature (1)..( 3000): cDNA_ID_1030309_gDNA_ID_1620396_Annot_ID_155780 3000 nt of promoter + ATG
ttgtcttcgaataaaacgtctcgcttttgttttgttgttccttttccatgttataatatctcttttgggatgcagtaccgagataaccgttgtgcaagaatcaaggaaccgtactctttgtcaaaaatcatgtttcatgagtttgaccattggacctacttcatgtattcatctaaaatagctaaatattctatctctcttttctttccaacaacacccaaagatgaatttagaattttataatgattttttgccaatttagagggatcgtattcacttatagatttgtatatttttataaataaactaaattttataagaaattagatttgaactcgtccgatgtaccgactttaaaacttttaaataaaataaatttaacaagaaaatatattaaaattttattgtaaagaaaaactatatttcggaaataaataaaaacatttggagtaaaaaaagagttatttaatggacttggctagtttttaactagcaactcaaaagtgatttagttgaacgaattttgtttaaaccgactttgacaaaaggctatcaaagatgaatgatttgtgttgattatgtgactacaatgccaagcaatggaggtacttattgcttttgagactattgaatagatttataagtttttgtaatgaggttgaaaaatatttgcaagtacaaaatcctcctcaaataataatgcaagccttagattctcttcatgccttaatttcaatcaatcagcatggaattttaacagaaactggagccatgctttctaaattgccagtggagcaaaaattgggtaagatggtaattttctcaaaacgatatggatgttttgaggaagtaataatcgtggcgatacgaatgttctgaggaagtaataatcgtggcaatggtttgaggtacaattatagagaaagggcttgtgattcagatcgtctttcaatgttatttgcctatgagtcatggacagaatctaattattctgaaaattggtgcaagagaaacaatatgaagtattatcaaatgaaacttgtgagggatatgaagagaagattgaaggaaaccctcgagaaacttcaaataaaaatatatttcaagaggaatgatatggatgttgttaagaaatcgattatatcatggttttttctcaactctacaacacttgaaagagatggtttttataaaacacgaaagcatgtgaggatagaagttgatccaacttctgtgcttaacgaggtaagttcttaaatactaacaaagtttgtgaactaaatcaacagtttagttgattaaatttttttcttttgttttacctggttcaaaagcctaagagcatttcaatggagagagttctcattttgttataaattaaaagaatatttatgactctagacatttatggagagaggtttagtttttggtcataatggtcataatgtgttctcgtccctccactttttcctcataccttatggttcaaggccatatttgttttgataataaatgtttagtatgttaaaacgtttttatgactaacattttattaaacactattttctcttaattgaatttattagtagtttcctcacactttatgaatttattattagttttaattttaaattgtcttttaaaattcaatatcgtatatttacgttttttggtggagtagatcaaattagcatggatatacaagcaactctatgagatcacatttacaagcaactctctcaagatgtaattgaagtttgaaggacaatttaatgtatcaaaaactattaaataaaattagtttttactttaaaatagaccaaaaaattgtttggtgataagatttatattaagaaacttttattaataccatcattataaacaaaaattgatatgataataataataataataatcaaaactgctgaaaataggttgcaaaacgtggcttatatataaaacagttcccaaattgaatcgaatttaatagtttattattttttaaaagtgtgtataccctacaagatttggtatcaataaacattgttattatatgtttcaaaaaaattcttaatgtttcaaaaatttgtttaaccttctctaaggccgaagtaagttaacgatttgcaaccaggcccatttatgtcacatataatggcccataaattcacttcaatcctaaaaataaaaatctaaccttcataatgggcaaaataaattacgatcgtattcaggcccacaaatacaaacaaaggcccatgcttttaagtacaaccctagaattagaaaacgttgatataaataagctgtcataaaattgagcttcttcttctctgaagccgtatcctagggttttctttgcacactactcgctccaatggtgatctctcctcttcctctttcgtcgattgaccatgaaaaccatctctgatattattattgtggaactttttgagtattgcagggaaagggaacagggagtttcggtaagaggaggaacaagagtcacacactctgtgtgagatgtggtcgtcgtagtttccacatccagaagagtcgttgctcggcttgtgcttacccagctgctcgcaagaggacttgtaagaactctcttcattgttttaaaaaaacattctctgaagatgcgtttcattttctcgatctagatttgcttttgtgtgttaatattcattctccatgatcgtgcttgagtctgatatgcatttggaccaatttgtatattcgttctctaacagaagaagcttatctatgtagctcgattgacatgtctattagttttgtttattatagcttgaaatgtttaaactttatcagttctttaatgtctttgcttcaattgattggttggaatttgagggattatctatgttcatttctgtctctgagctcaattcttgtctctttggttaacagacaactggagtgtgaaggccatcaggaggaagactactggtaccggaaggatgaggtatctccgta

SEQ ID NO: 1400 - DNA, 3000 bp, Unknown
  misc_feature (1)..( 3000): cDNA_ID_2134973_gDNA_ID_1620396_Annot_ID_155772 3000 nt of promoter + ATG
aatccggttggctcctcatgcgcagtatctcgccctttgcagagcccaagtcctcctcgagcttcttcactttcttctctagcacttccctttcttttcctagactcatcacgaggatatgtgcatcttccacattttccttagcttcttttgatgcattctttgcctctcctagtgatcgttgaagtacttctttctcgtcctccaagtttgaagcatgggtattcaccttctcaagctctcgtgacagtattgatgtgttcttgttcatctcatctaaagactttacagcttcttcgagatctgtttcaagggattttctcgcctccctttccatcaagatctgcttttccattcctttcacctctttgttcaacgacaaaacagtctttttctcctcttccaattccttgttactggtttcaactttcttgtaaatctccacaagttccttctggaggctctggttcttgacagaagactctttgagttcatgagttactccctcaagctcgtctttaactctcctccgaagatctttctccagtgcaagttcgctagcagaaatctcattcttttgtttttcagcatcgaggttcctttcatatctttccttagcttccttccattcttcgtgaactatagcaagctctgattctaactttgaacacaaagctcttgactcatcaagcatcgtttccaggtcagagacccgatctctagatgcctgcagtgttttctttgttccttcaagttcatgtctcaaattttttactgtagtcagttctatatccagcattctcttcgagtcttcgtacttctcagttaagtcagcaactttgtctttacttttattaacatcatctagcgcacgatccagattttcatttagctgctgaatctcctgctctttcctgctgatgagctctgcatctgcagctgcttgcgtctcagaagtcaatttcaaagcactataatcttttgaaatactatcaagcttctggatataactctctttctcagccactaaagttgttattcttgtgtttaactcctcaatcgcagagttcttcgagtccaattcactctgagttcttatgagttcttccttctgctgtttgatctctaacttcgcttcagcaagatctcggctagtttgagtgtaaatagagttgagttccttcaattctgcttccttttttgccaacgatgcattaaaacgttgagctttttcttcactatctttcagctccaaactaagcaagttgatccgatcttgtagtccttcaaccaaatcaagcttttctctgagctttgtttctagtgcctctttgtcttcgccagcctttgacagactattttccagactttcgatttgatctttaagcttctcacataatttcttctcgctacttagctcccggcctaattctgtcaccaagtcctttgcagaattcaactggttgatcaatgacaactgttcctcttttgccttttctacttcctttttccgctcttcctgctcatgctgcagttttgcctcgaaatctttctccttcaaaaccaatgctctttctctgtctttcaactggttctttagctgtatgccacggttatcggtagcttaagtcaaaaaggatcaaatccagcactagcaatatattcacaacctcagaaagttaaagaaacaaaagaagagaagctcgaactaaatgatataagctgctaagacaagaacattcacccacaaattgtaaagcaaaatctttaagtgctagtagcttacagattcgatggtttcctcagcagcttttgtatcttgccgagccagtgcataaagtgcaccaagaacgccagcactaaaaattccaagaccattcaggagagccagaaatggatttggggatgttccttcactaactactgcaacctaatccaccaaaccaatcctgattcagtaaaatctcaagcactactttaaacacattgattctcaattaaaaaaaaatcaaattgagaaggtctaagagagtcttacaacctcagtttctagatcaaccttcgatgtctttatctcattgcctcctggaattaaaaagcagaactggtcacaacaatgaaagaaagataaccaaaagcaacatttgaacaaatctcatctaagcaataaaaaaactcactttcatcagccaaagcgggtgatcgaagctgcaaaaagggaagaacagagatacccacaagaaggaaagccctccttttggcggaagcaacgtcatactcgtacccatcttcctggtttaaagaagccaatgttggtcgtcggcgcttgaacttggcgacattactcgaacacagaagcccaaactgagacgaagaaggagaagaagaagaagaagaagaaggagatgaaaggaatcgagagtgtagaggaacagaagggacgaagcaagagccccctatcaggaaacccatcttcgccgccaactacttaagagattggaaatgtgtggcaaatgaagcaatcctaaaatcactgacacaaagcagaccccaaaacccaaaaaaggaacttcctttgtgtactgacttgtgacctcggaaaatctcaaagaagaatgcttacacaaatctcagagttatatccttcgattactgaagaaaatatctacaaatcctacgaaattgggtatcaaagactgaaacttttttttgtttaggagggcaatggcatatctgcaattttggaatagttcggtgctttgtgtacataacttaccaatcaaaactcgccagcttagacttcccctgcttcgttatcctcaatctctgggttcgcctggtttaagaaaacacgtgaacctcacgtgcgtctgtctgaccctaaaatttctctctgtttttctcagccgttctgtctaaaaccaccgacggcgacttcaaatagacgtcggaatttgtcgccaccggagaattgttacatgtgaatcccgttttataaag

SEQ ID NO: 1401 - DNA, 3000 bp, Unknown
  misc_feature (1)..( 3000): cDNA_ID_3062101_gDNA_ID_1620396_Annot_ID_155770 3000 nt of promoter + ATG
cagtgtttcactctacaaagtgcaatatataagatttgagatccacattttctgaaatgctcactacataaattgactacagcctatctcgaaaaatatataaacctttacgtgaattttgttttgcagacttatattagaaatttaattattgttgtaattattctagctagtctaaaatttctaaaaatataacgttttatcaaatcgattttcaaatttaatatggtctggtctatagattctatgatcttcaaatcaacgtgatgaaaaagtcaagtgtaatttacgatttttgttgcataccgttggaatcatgaccccaaatattaagaagataaaacatgatgggaaggtaccaaacaaattttaaggcctaatatatccttacaagtatttaaaatacgaacaaattgcgatcaatgtttaagtaaaaaaatcaatactgataaaaaggaggcgactagaaacaagagtttccttgataactaatcagatggctttgttcaatggctgcttaatattggggtaaaagaagcttagtgacttattcaaatattgctaaacaccaatacaattaatattctagtcaataacaagatcccatagatatttgtaatatttttttccagcaatttgtatatttgtaatatttacttgtaacgataggattcattttttcttatggacggaagacaatattttggtgatggactgatggtgcatgtatttttttagctagtttaacaaaatacccacacaaaaaaagatgatcggtagcattgaattataaaatcggatataaagatccataagtcagctgaaattaaaattttaatttcagaattaatgcaacaacttttggctaaactaaacaatatatacgtgatgctacacaaattttataaactaaaacgacaatatttaacccaaacatagacaaaatatatgaattgtacgtaagaacttgttttgaatcaaaatatattcaaaaatttgttcactaaatagaagagaaggggaatgggtttgcaactaggagtattatttgaacttaatcgtgttttctaccatctatctgagcaacacattccattattgttcatcatttcatcaacacgtcatattggtaacttgaggaagctgtttgaccaatgaaaaccttgttatttgggggatacttgttttctccatcgctaatgatttgttgattgttcaatggctgcttaatgtcggtaaaataagagaggcttaggtatgctaaacattttcaggtcaataaaataagattccatatatctttgcagggatctgtacgtatatatatatttataagatacgtgaacccttaaatctttagataatgctttttatttatgatggaagataagaattaggtgcgttaaattaataattggagtagtatacatactttagcaggtataaattattgattttgaatcaacttggaatctttgtaacgttttcccctttttcgttgtttagtactcatatctaacgtttgatatcgtgaaaataaaaaaaacgtttgatatcattaactatcaaattttattgtattttgttctggaaacttaaattgaagccattaaaagtggaggccccatcagtctcccaaattcaactgtcctcatgaccccaaaaatcaacgttcaaaattgatccacgcacttcgcaaacattgttgtgtgtaactcttgtttttctttaactcgagattagatagtaataaccctgtaagaaatctacttttttttatatatcttatctaaaaggctgaaaaccacaaatttacattcaaagatattgaccaaaataatacacatccattaactaccccaaattagcgtataaatctgacatgtaaagaacatacattaatgacgacctaaaatctgctttagttaatttgacctgcaaaaccgtgttagtgctgaaaattaaagacaaatagtatcttagtttagcaaatatttatgctatgtaaggaatattttttattacaatctttatagtaacacaaatcccctaaaaacaaatagtatacctcaactataaataaatttccagtaaacaagttttataaatgttgaatttgacccatatagataataatcaaaagaatcttttttttttgttttattttgttgatttgaccaacacaattatgttaatgatgatatatagaaacaaatatgttagtttaggaaaaatatatttaaatgtgctatacaaggaatgattttattagaataacataaaatccaatgtttttaatttaattattaataatataaatcatgtatagtcaatactatagtatcccctaaccataaagaaattgccagtgaacaacaatttttgacttcttttttgtaatcacaagtgtggtggatactcagaacttttgtcgtcgttttctcttgactaatccaagtcacactaaacgattcatctgagttaagtttttatttattatgattttcatcacaatcttatgagttctgttttctttttgaattatagtagttttttgttatatatctcaatgattcatccctcttcaatcttcatcatattcttcttcttcttcttcatatgccatgctctacagaaaatatgatttctttagatttcatctttttttacttgtttttattttagtcacttgaatgtgagggagaaaaaaaaaaaaaaaaagacaagatgtgaaacgacgcatttacccttaggaagccaaacatcgaaaatagaaaccgcttttttctttattttttttcttaaagtcaatcagtaaaacaaaaactgccattacccataataccaactacactttcacagccaagtgtctataaatacagagcataattacaccatctttccttacaacacaatctcacaacaattacacactaaacaaaattcaattttgcatctccatttctcgagaaactttcgttttcgtagacttataaaacc

SEQ ID NO: 1402 - DNA, 3000 bp, Unknown
  misc_feature (1)..( 3000): cDNA_ID_3062164_gDNA_ID_1620397_Annot_ID_155810 3000 nt of promoter + ATG
aaacaaaaataaaataaataaaatggatcataatatattgtggtatatagttatatggtgtaatggatttttgagtcgacattaataaattttataatatcattaatctaccgcttcaatacggattgaatttttattttattattttctaacattaccaaattctaattacggtcttttcttcttcgatgtttatatttcatttgattgtcatccccgaacaaaatttattttatatcattcaccaatttttcaattcgtccccaaatacttgtcttctccctacatattgtattttagctaaaccaaacatgctacaacagctgaaagcaaaaccatctttttatatcacaataccaattaccacattcacaaatgaaaaagaattatgagttatggtaaaaatgacttttttgtgtagaaaatggtaaaattgaccaaatttccttatataaaaatgtccaataatattatattaggaacaactaagggaggttgtaaattccaaggagacataaaagaaatgcactgcttttaaacaaaactcagtatttactctaatcgaaagatcgttcttgtatatgtgacaaagatatgcttccctgcgtaacatgtcgtttcaaagaatcaaatttcagctttcaatggatgaactttcattcaccttcaatgttcaaatcgatctcctttagttcaccaagatctagtcaaaataatgttttcctagttgacaatatcgctatatattaatttctccacaaatcatacccgaataggaagatcaacaagttataatttttaccaaaaaatgaaaaaaaaaaagatcaacaacgttttgtaatataaaaactaattccaaatttagtttatacaaacaattatttgttatttacaagtttttaatacaatgaatcataaaaaatagctcattaagtgtatatatgtatagaaatatatacattcataaatgtacaaatgtatatttatacacacatttttattcgtccatcttattaagtgaaccaatgcatattaaaatatacacattttttattttgtataaatttttattaagagttggcaataacacatctattcaccaattagcacaaattgaaggatttagttcttattgatttgtttcattttatatattactttgctataatttacaagcttttttgatgatatgaaagtatatgtaaaggaacaaaaattagaagagccatacatcatttttctgtgaaatatacaaggcgtatggtatggtacaaaatggagtatttgactactgtagcattttgagtttttttgttttaagttctaatctatgcgaatatatttggttctttcaattaattttggtgttaaagatatttgtttatttagatagtctaaatcatatataaacgatgaatttttagaagtttttttttaaacaaacaacaaatccaatttaaataacaacgtaagatagtgcactagaagtgcagtcttcttgatattacatgactattataattcaactaagcttttatttttgtccattacttagttacatcattgagaataatgaagatgaagtctaattaaggacaacctagaggatgcgcttatctcaaatcatttatttcaaaagaaatgaatatttacttcgtataattagagagccaataaaaaaaacataaagagtttgttgctcataatctcaacaacatcgaagacgaaactgaaccacctcttcacatcaaaaacacattttcttaaaaatctctcgactgtttcgtcaaattcttctgaagtctctgacaatggttttcgtccggttaagctttaactagataagctttatatgacccttgaaaagtcacctaagtcatcttccccttcttttccttgagaatctgaaaaaactttttgaagaattattcgattccttccttcttatctgatcctatccatatccaaactattacttttcaaaaacactctagatttatcgtttttcaaccccttatattcgttgaaatctgagaagttgatctcccaagttttcgcaattcccctctagataatgactttatagccattaatctcggagttttgatagatcatttatcacagatccgagcgtgggctcaatctgatattgtttgtggtgtgtgtgatcttgaaaattgaacttatggatgtagaagaaaaaaaaatatgtaattgtaaaattcccaatttggcgattgtgaaaatgtgcaatttggccataatttaggaaaacgatcaaaatcagtccaaataatttgttaaatacttttttaacccaaattgtggtattttcaaataaccaacttgaaccatataagcgttagccgaattctacatcgacctttgttagtaactatcaaacgatgttgagtcaaatgacaccataacgaacaaagtatagtttgactcatcacaatttaattggtttactaacaccatgaaggtcgatgtagaaatcgactaccgatgatatgattcaggttgctactttaaaacttttacttgttcacgttcataaatacatgctatcatagtttgagttaggaaaagtattatgcaaattgttgggttgattttgaccgttttatacataattctagcattgagaataaatgcctataagtttgtacgaatctctttttctttctctataatgaattttgatttgaagttgaaatcctaacataactacaaaatatcgcaaaactatcatgagttaaaagcaccgttgtaaactttttcctaacacttcacttttaaatctccattgtgagattaagaataagaaaaagaagagacaaatgggccttcaattttccctccataatataagaaatgggcctggcctggtatattcatcttcttcctctaccttcggtagagaactgtagacagaacaagggctagtttcattgtaaacgctaatcttcgctctcagcctccaaacacacatcaaac

SEQ ID NO: 1403 - DNA, 3000 bp, Unknown
  misc_feature (1)..( 3000): cDNA_ID_3062152_gDNA_ID_1620397_Annot_ID_155823 3000 nt of promoter + ATG
aaaatttatcttaccatccaagttcattgaagctcaaattgtaatgatgatatctttattcaaatatatgaattacttgtattttattcctttttttgttatccaaaataaatctataaatctgaaaaacttgaatttcactaactatggtttcatatcgcttatctcattgtgatgatgagatgatctatatacaattccgttggaatctgttggattcctgctctaccaattcttacagttgatcaccaattctttataagctaccattttgttttcaatgttatgcgattctaatgttttcaatcttccactattttactacgattttgtttttcctttattcacctgacatttccagtcgcaaacaataagccttagtgaaacacactgcacaaaactgcagcaaatgttgctctcaagacaaaagacattccgggggaaacaaataaaaaaactcaggagagttatttaagataagcaaaaaaagatacatcttaaactgatgccatttcgtttttcagtttcatgtagacacaaccttcttcaccacttttgtaacctcttccggggccttctctgccggtatgttcaccagattctccttcttcgcataatagtcaattacctgcaacaacaacaacaagaacaaatgtcaaattctctgatagtcctcaagttcatgtactataaggaaacataccggttgcgtctgcttgtggaatgcatctagccttgatctaagaacatccgcattgtcatctttacgttgaatcaatggctctccagtcagctaacaaacaacgaagttgatacagagatcaaatcacaagagagaactcgatttactaagtcaaaatgatgaatcagaatttgatggtttttcttacatcatcgactcctggaactttaggaggtgcgaatttagtatgatagcttcttccacttgaagggtgaatccaccttccagtaattctttcttcgagaaccgaatcatcgatcgcaaaattaagcaccttatctatctgagctccccttctattaagcatctcatcaagctacaagatttataaacaaaaaaagtcagaacatttacaagagcgagcagatacacaaacaactaaccacagaaaagaaccagaaaccttctctgcttgagtcacagtccgcgggaacccatcaagaatgaaacctttctgacatttgggtctgttcattgcttcatccatgataccaacaaccaagtcatcagaaacaagctctcccttatccattgcttcctttgccttcacaccaagaggagtcttagcagcaacagcagctctaagcatgtcaccagtagacaaatgacacaaacaaaactcatcctttatgaccggagactgtgtacctttccctgaaccaggtggacctgcaaattccaaatcatacatgaaccaaaactcaattcttcctttctattgaaccaaaaaacacaaattcacaatcccttcgctatgatcatcagataaagcattaacgataacagcaaaatgcaatttttacacactaaaacagataaaaatcggaactttcgctacacaattttcacagagatcaaacctaaagtaccgattgagtgaaagattcagaggtaacgaaagagatgattgtaccgatgaaaacgagacgtttgtcaggtttagaggcacatttcatacggcgaagaagctcagacatgagatcaacagtctgaatatcttccatatcaacagaagccgcactgctcgttgccatgttcgtcgtcgtcgtctcttacaagagaattagatttggtccggtggagttgtgttctctttttgaagtgcgtgtattggattcgatgcttccaatgttttctttcaccgttttacgattttacccttaactgtgccaacaactacaaaggcctgcccttcgaacaacaacaacctgcctggggttggtgacacacccaactctgaaaacgagtctttcttcttacacatctaatatcgcacatttttcataattacataaaatcaaatatcatataatacttccaacaaaccattatgttttaggtcaagtgaaccaaaaaaagcggactagaaaacatagaataagtagagtctaacacattttttcggttttaaggcacgatggaccggtcatttgtccaattaacactagtgttaagaaacttaatttgatattaagtactgaggttgaagattttgctagtttatggtagacttatgaatatcagtataccactagaccacattcacttttcgtcaataagacaattaaactcttgaaaacccacatttttcttttttttttttgaaagccaaactccatcaatgtttggttattaaagatatgaatgaatactacatcattagtttctttcttgataatttttgtatatttatttattaataagtttttgtatttttctaaattcttaacattaataaaagagttttccaaaaaatgcaaaataatactataaaattcaaaatagtacataatataagcttttttttttccaactttacatatattgtaaacgtttttacgatcacatacatctgctttttgaaaattctaaaaatataaataaactctttacctcaaaagtttcaatttgctatatacatttttttaaaatcaaatttaacaataaaaaataaaattagattacatattattttagaattaaattaacataggcccacttcttatgttgggaaaagggaacaacaaatataacaatttagcaacaaagaagtagaaaaaagaggtgatgtcataataaacggtaaaataataggaacgatgagcgagcggatctagctttcgtcaaaatcatcatcactgagtacatctgccacgtcagcttgattgggatctatttggtcgcccgtacacaaaatctcggctcactcactcacactactcaagtcaacgtttctaagattctccggcggagcgatt

SEQ ID NO: 1404 - DNA, 3000 bp, Unknown
  misc_feature (1)..( 3000): cDNA_ID_2135111_gDNA_ID_1620397_Annot_ID_155826 3000 nt of promoter + ATG
agatatatgatttagtttttgatgatggctgctgatacagggtcaggacacagaatgggtaaatgttgttatctcaaatccggagccttcttcagacgattgggttggagtcttctcaccagcaaaattcgagtattttttttacatccattaaaccctctttatgaatcatgtgtttgcatattgattgatgtgtttaacaacttgtctttgtgtttctcttgttatagctcatcttcttgtgctccaacagatgacaaagagatagctccttttatttgctcagctccagtcaaggtttccattacattttgactgttgatttctcaactttgacattgcatttcatctcatttagttttcctctaatatggcagtatatgtatgccaagtccagtcctgactatatgaagactgggaatgcggttttgaagttcatgcttataaaccagagagctgatttctcctttgccctcttcactgggggactctcaaatgttagttgattagattacacaacctctcaagtttgtgttttatctccaatggactctaattgatctcttttattgctctttacagccaacacttgtctcggtttcaaatcatgtatcgtttatcaatcctaaagctcctgtctatccacgtcttgctttagggaagaaatgggacgaggtaagttttccatagcctgatttatcaaagccttaacaagactctcaaatcgatatatgaactaaaacatgctttgcactatgattttgatagatgaccgtaacatggacaagtggttacaacataggtgaggctgttccgtttgtggaatggagtcgtaagggaactcgaagtagacgatcgccagctggtaccttgacttttaccaggaacagcatgtgtggtatgtatgaaactagaaatctatgcacttttctctttatctgaatttgcattttgattcttactacactgtttgacacaggtgctcctgctcgtactgttggttggcgtgatccaggtttcatccacactgcttcattgaaagatctttggccaaacctcaagtatatacactgtttagaagtatcaatttcctttcttgtttaaacacatcgtttggataacggttttgtaactttctggatcatcaactacctcaaggtacacatacaggatgggtcatgagttgatgaatggatcaatagtttggagcaagaatttcactttcaagtcctctccttatcctggacaagactcgttacaacgggtcataatcttcggggacatggggaaggtacttgcttgttgttttctatataaaaacattgccttgttagtgtttcctctcgggacttatatgtttctgtaatatgtatttgaagggagagcgggatggttcaaacgagtacaatgattatcagcctggttctctcaacaccactgatcaactcatcaaggacttgaagaacattgacattgttttccacattggagatatcacttacgcaaatggttacatctcgcagtgggatcagttcacagctcaagttgaacctattgcttctactgttccatacatggtcgcaaggttagcttgaccggccatataagtcttcgctttaacgatttccagattcttggcactaacttgtgtttctcttcagtggcaaccacgagcgggattggccagactctggatccttctatggtggtaaagactctggaggggagtgtggggttcctgcggaaaccatgtttgattttcctgctgagaacaaagctaagttctggtactctgcggattatggaatgtttcggttctgtgtagcggacactgaacatgattggagagaagggtcagagcaataccaattcatagagcgttgtcttgcctctgtagacagaagggctcagccttggttgatttttattgctcatcgtgttctcggttattcaacaaacgattggtatggtcaagaaggttcctttgaagaacctatgggaagagagagcttgcaaaagctctggcagaagtataaagtagacatcgcgttctacggtcatgttcataactatgaaagaacatgccccatttaccagaaccaatgtatggacaatgagaaaagtcactactcaggagccttcaaaggaactatacacgtggttgttggtggtgcaggaagtcacttgtcttcgttcagctcgctgaaacccaagtggagtatcttcagagactatgattacgggtttgtgaagttgacggcttttgatcactcctctcttctcttcgaatacaagaaaagcagcaatggagctgtacatgactccttcactatctttagagaatacagagatgtcttggcttgtgttcgagatagctgcgagccaaccacattagcttcatgatttcttcgagcgtttgatgttgtgaggtagtaagtaaagaaacagtcctagttttgattccttgtagattatacaattgtttcttgctcatctcttaacaaacaaatgtgatcatcaatgtagttttttttttcttcaaacgtcaaagatattgttaaatataaacatcaaacaatcttcaaaataaaaataaaactatttccatcaaacgtattttgctatgattaatgtcataaaaacctgtttactgcaacaatgcaaatcaataattttcttaaattaaactgtgattagatctgcttatgccaaaaacgacgtagttttcataactacctgcttctctcctcaaagtctaaattccaactgccattagcggagctcccgatgctgtgtgatgctcttctctctctatttcaaaaatcacttcttttccttcttcttctttcagcaacaaaacccatttgcttcagacattgcggagcatcaagtaaacaaatccatctttccacggtgctttctcgggcgattccgatcaatatgatctggatcctctgtttgctcctaatctcttattgaccccattctcttccaatcatg

SEQ ID NO: 1405 - DNA, 3000 bp, Unknown
  misc_feature (1)..( 3000): cDNA_ID_3062148_gDNA_ID_1620397_Annot_ID_155829 3000 nt of promoter + ATG
tacagcggcaatgattaatcctcttcttcacgcttaatttctctactactctatccttacttcttcttcaatgtagtttcatgtccctagaaattttcgttttcttctctttgaatcatctatcgaattgttgttgcggaacttttagattctaagaaattgagttcactcttcggcgatggagcgaaactcgtcggacgacgaagaagaccaccagcatttgattccccaaaacgacactcgaatccgtcaccgggaggattcagtttcctccaacgccaccacaatcggcgggaatcagagatcggcgtttcagatcgacgacattttacatcgagtccaacaccgtgggaagatctcgctcaacaagcgttacgtcattgtcttcgtttctctaattatctcaatcggtcttctcttcttactcactgatcctcgtgaactatttgcggcgaatttctcgagttttaagctggatccattgtcgaatcgtgtcaaagaatctgagcttcgtgctttgtatcttctgagacaacaacagctcgcgcttctatctctttggaatggtacgttggtgaatccttctcttaatcaatctgagaacgctttgggatcgtctgttttgtttgaggatgtgaaatctgctgtttcgaagcagatttcattgaataaggagatccaagaggtgcttctatcaccacaccggagtagcaattactccggtggcaccgatgttgattcggtgaatttctcatataatagatgtagaaaagtggatcagaagttgtcagatcggaaaactgtagagtggaagcctagatctgataagtttctattcgctatttgtctctcaggtcaaatgagtaaccatttgatatgtttagagaaacatatgttctttgctgcattgctggatcgagttttggtgatacctagctctaagtttgattaccagtatgatagagtgatagatatagagcggattaacacttgcttgggaagaaatgttgttgttgcttttgatcagtttaaggaaaaggcgaaaaagaatcattttcggattgatcggttcatatgttacttttcatcaccacagctttgttatgtggatgaggaacatattaaaaagctgaaaggtttggggatttccattgatgggaagcttgaggctccttggagtgaagacataaagaagccgagcaagagaactgtgcaagacgtccagatgaagtttaagtctgatgatgatgtgattgcaatcggggatgtcttctatgctgatatggagcaagattgggtgatgcaacctggtggacctattaaccacaagtgtaagacactaatcgaacctagtaagctgatcttgttgaccgcacagagattcatccagaccttcttgggaaagaatttcatcgcacttcatttccgcagacatgggttcctcaaattttggtatggctttttcatcttgctttctttggtacattaccctgaatttcatagtgcagctcatacttcttaaaatgtgattatctaaacaacattccattcttgtttgtgaatctgtctggttagtactgtaaatcacatccacatcacgtaggcactgcaccgaagtattacaatatcttactgagattgatttcctaaaactagactagggaccaggttagacttgtagttttctgaaaatggagaaccttttttcatggcagcaatgcaaaatcgccaagttgcttctatccaattccacaagctgcagagtgcatcgctcggatagtggaaagatccaatggcgcagtcatctatctttcaacagatgctgcagaaagtgagacaagtctgcttcagtcacttgttgtggtagatggaaaaattgtgcctcttgtcaaacgtccaccgcgtaattcagctgaaaagtgggatgcattgttatatcgacatggtatagaggatgactctcaggtaagaatcttgagccttgataaatctcatgaaaacctgtttgattttcctgggtttgcatttggttgctcttcaacagaaaaaaaaaaaagcttccggatttatgaattttgtaggagaatagaaatcctaaatacttgcattttgaattattattaatagcatggcctgatgtatcaaacatggcatgggctaaattctgtattattgaatgtgtaggtggatgcaatgcttgataaaacgatatgcgccatgtccagcgtattcattggagcctcgggatcaactttcacagaagatatattgaggctaaggaaagattggggaacatcctctacgtgcgatgagtacctctgccgaggggaagagccaaactttatagcagaagatgaataagtaagcacatttttttcttacaaactttgaattgttctcaaattctattgttcctctagttaaattgtatagtgtaattatagaatccagttttggatactttccaattcatttttttgtgacaagagtgtgtgtatcaatagaaagagcctcagtttcttacaacaacacatatctaattccggggacattggtgatttttggagattgtttcttgtttacttcattattaatcctacattattcattgcaatttttattatataaaagtacattactcattgttaatgacagtttatacaacgaagattaaacggattcgttttgatgtagggtaaaaatttccatcattcaattggagtaaaaagtatctaaacccaaaagcttaaatacattatacatgtgatgtataacaaagcttaagtaaatagtaacaactaataaatgacgtttaaaatttggacaaataaatgactgttaactgttaagagttaagaagagttaagacagtaaaacacttgagaatttgttacagtattttatttattacagtattaagatttggttgtgcgaactaaagtactttatttaaagacaacattttggcgactgtgtaaaaacaccaaaaagaagaaaatg

SEQ ID NO: 1406 - DNA, 3000 bp, Unknown
  misc_feature (1)..( 3000): cDNA_ID_2135126_gDNA_ID_1620397_Annot_ID_155831 3000 nt of promoter + ATG
gattatattttctacagtttacaattcgttgttttggttgacaggaactacagtttattggaactccctgaagcatttagatggcagaaaaagcttgtataaagcgtcttcaaaaagaatacagagcgctttgcaaggtattattttcttcttattctgttcccatccttgatttgtctgtcactggtatcattctacccattcgattttcatttttttttttatcaaatgtggtttctttgctctatgctagttttcatggtttttggtctaggataagtttttttcttatgaatgttactttggaagtatctttgacatgttctgttctggattgctaggaaccagtctcgcatgttgttgctcgtccttccccaaatgacattcttgaatggcgtaagtcttatctggctatttaatgttccttttctttattttctgctttctagttattctattgaaggtttggctatggggatactggctttaggtacatatagcgtgttgctatggtgacagagatactattggtatcatgttttcaggattaccagtaatatgtaatggtgaaaacttgctttgtttatagaaaccgaaaagtaaacctaaagtttttcttatctattacctaactgagaatggtcatgctattctgctacaagttagggtatttttatcctcgctactagtgttactgcactatttatataaatgtagtcaattgagtttgaactattgggttttattctacagattatgtgttggaaggcagtgagggaacgccttttgcaggttcaaatcttagatttacatttcaaatgtgatcttctacattccaaagtagtatatgattctgatatccggattctctttgataggtggattttactatggaaagatcaagttccctccagaatatccttacaagccacctggaatcacgtaagctctttcgttcttcagaattctcacttaaaatatcactctcctatgttttattcctggtttccaatcaactaaactactgttgctgcagaatgaccacaccaaatggtcgatttgtgacgcaaaagaaaatctgcttgtctatgagtgactgtaagcacagtcttcattttcattcctttgtttattaatttcaatgaacttgtctgttatctaattagctttatcattccatcattccatgtacagttcatccagaaagctggaatccaatgtggtcagtgtcaaggtataagatctgatgtacattcaaattgtgttcaagttattaaaataaacagagtaatggatccttatttgaccaatttgtttccctgaacgcagcatacttacaggacttctctcatttatggtaagcttatggaacgtttcatcttgcagagcctctcagtttatccttggtcattagatctttactgatttaacatggcaatgtcttttttagtttttactgtgatattttattctccattgcgttcattaaatttctttccgcattacaaccttgtggtccacagatggataacagccccacaacgggaagtgtaaacactagtgtagccgagaaacaacggttggcgaagtcatctcttgctttcaattgtaaaaggtaagttccattcccaccaaaaaaatgtttaggatacatctcagaagttgattagagaacaagatagcttctacatgttatgtttctcatctttttcaaactgttgtggcagtgtaacattccggaaactatttcccgagtatgtcgagaagtacagccagcaacaagtagctgaagaagaagcagccactcaacagacaacaacatctgagaatcaggattttcctcagaaggacaatgcgaaagtcgaatcagagaaaagcgttggtcttaaaaaggaaagtattcaagaagtgggattgaaagagaggagaaggaacaagaaagaagcattaccgggttggatagtattgttgctagtatcgattgtcggtgttgtaatggcgttgcctttgcttcagctgtgatttagatgcaaatgcaacgcaacacaacatgactgcaaatcaatctggtaaaatctgtttatcattgtctctcagtctcagtactaagtagtgtcttttgttcttccccctctcttgaaaagaaaacagatacattgagtttggtatggcatttgaagttacgtataaatataaatgttagcttaatttgattaagaacgaactcgccacctaatgtggtggattcatggactttacgacatcatctttttatgaaatcaaccctaaagttatgaaatacgtccatataaaaaattcgagtatcttgcagcaaccaaaaatgccaagctttaacattgtcattgtcatttggaaatgctgcttgcattttgtattcaaaagaatcgaacatgtaagcatctttgatctgtgaaaaagggattccactgaatcattgtgtgtgactatgtcatgtgtgtgtgtataaaggatctttgatctacatatatatatgaattataatatacttgtctataaaggaatcatttcttgttcttatttttgatatttaaatacatacaaatttatgtgacaaaaaaaaaacatacaaatttgtaaattgaacttatgacaccactaacataaatatcacatacaaatttgaatggattttctgatttatttatattttatactaattgaataaatgtttaagacataggttatttttatctaatgacgaactgattactagatatattaaatacacttctataaataagttatatttgaacaataaatagaatactttcaataaccttcatatataacaaaacgtccactaaagtagtaactcatgtttaacataagtttaaaaaagtatataaatttgaaaccataggaactccatactccaaagtcaaacaattagcaaaatcaacataattgatattccttttttaaaattattttttaatcaaaatcttgaaaatagaaatg

SEQ ID NO: 1407 - DNA, 3000 bp, Unknown
  misc_feature (1)..( 3000): cDNA_ID_2105314_gDNA_ID_1620397_Annot_ID_155827 3000 nt of promoter + ATG
actcattatgtcaagaaatgtcatctcaagattcttaaaaggaaggagaagaaggttagcttccaaagtctactgcttttgtctttatttagtttaatttgcaatgtcaacaacttgttttggcattttgattagggattaatccggctgagcagagctactgcaatggaagttcacaaagagtttggcgagaaacaccatgctacgctttcgggtaacgctatttcctctatatccgagttcattagtaacatagtgtagctagatccccaaatgcaaaagttttttgctcttcatgttgaagatatgtttagttagagttcattctatagtgtaatagacatttagtgacactactctttggatgcaagtcgatcggtgaagttagataacattcgaaagtgtaatatatttggtgacaatctttaaaattattttaagtggatctatcaagttagataacattcatgtgtatttcctttatgattgtctactcttaatgaggtatgttagtgatgtactgttgttcttaattttgggtacaaaatgtgtagctgatcccatgagcaacataccgaaagacagtgacctctaccgcacaaaacagaaagaagctaagcgcagatttgagatgtaagtcagaatttccaaacctcacttatgatatagcagagacttttataattctcattaatcatgtttctttacatcattttcagcttggttgagctcgagaagagactggctccgcattttgcaaagcctcgcataggaaacagatgaagaacttagctaccagaagctggcgtttagatgatctctgtaagtatgttctctgctttggtgctgtagaactgtttgtgaaattgtaaggtcatgtagctgtatccaaatattagatggagtctagtttggtgatgtaatttgtaatcttttccaatatcaacaataatattttatcgaaaaggaaaccaaatccagcattatgtagagagagagacactcttcaacaatatttgcctttcttaccacaatattcagtagagagattaagtggttttgtttgttttcttcgttttacattggatattgcactcagcctaaaaaaatcaaaaagacactctttcattttttttttctttttgagaaggaaataaccttgtattgcggtggattttatatgtttctttttttccaattatttaaagcacatatggttgtctagtcagcttgataaactacatggaaaatgcagtatcagcattatttttttcttttaattattttttttttttcctttcatttcaataagggtgaattgcaaaaatgatggtttttgaaaaagttattaaatatataacaccataatgtgtgtaattcatttgatagcacatgtcagttgtgaaaatacactaaactccttcctacggatccgcttggaaagaaagagaagtcactgacaggaggaaagagaaatatatatgactaatatatattcactcctcttaattttgtttactatattagtttaacaatattacttggttaaagttaataatactattgaaaaaacagatttttttttgtttatctaatatgatttgaattttaaaaatcggaaacgaatttttaaaaaaataaatagtggtatcaaattctataaagatcatcatagaaagatagaatagtatatatttgttcaaatagaaacgtttgttttgatgaatccaaataatcaattaaatactttttgatggaaggatattaaaccctaagatagtatatagggaacccaagacttttaatataaaacactaatcaaatcatttcacatccttaatcaaaacaaacaattcattttaaaacgtatatagtacaaggtatacgtaaatagtatattcacaaaatagaatagtatctctcaaaaatttctcaaaatcaaaatcgatttattggttcaggataaggaaacaacgacgccaaaaaattagagagacccaaaaaaaaaaatcaaatgaaggaaacagagaacaaaaattgatcaaattcagcgtttattagcgagaatctcgactaattcaatttcaaaaaacaaaaccaaagtctcttaaaaaaccaaagactccaacaaaatctgaagtcttgcctctgtaaatcaaaacctctaattcaatttcgagcaaaacctaaatgtcatttctggaaattaactgtcttgcttctgtgcccaatacacttttgttaatcgttggcaaaatcaaaagcttcataaaaggtagactggattttattagaaccaatcccatgttcaaaagttaatagttggtgaaagagaatagttggttttctatggaagggagaagatgaagagcgtgtatttcaaacatggatagtattggcattattacagaaaatacaaacaatattagttacttttttttagagtgttagttacctaattataatatttttgtaggttagaaatgcaaatttctctttcaataaaaagatgaaaagaaaacaaatcaaaacaaagggagaaaattctttactatagaaatataaatgaaaatttcttcaagtaatatgcatcctttttccaattggctatttttatgtaccatttagaacgttaggtaaaagaaaaggataaaaacattgggaatttgataatgacaacaaatgttacgacattatgtgctcactcgattacaattattttattacaagtaaaaaaaaaaagcagacacaagttctctatgctctgtcttcctcctaaaaaaagaaaatttctgttctgaaacgccttcgagggagggagggagagaaagggatgtacttgagaacaaaaaccaagagtcttcaaaattcaaaatatcatgcgattggaaagttttaatctttgaaaggtcaaaagattctttggggggggggggttttagcttctgatttcatctatctgtcacagcaaagaagagaaagttagcactctcgacgatg

SEQ ID NO: 1408 - DNA, 3000 bp, Unknown
  misc_feature (1)..( 3000): cDNA_ID_1582551_gDNA_ID_1620397_Annot_ID_155811 3000 nt of promoter + ATG
aagtatgtggtggattattatgattgaaagtgataagaaaacgtttttttttgtccaatattggaatattcactgtcaacagtttggattactgcagcactaaattccttaagttattgtggctgtgaatgttcagggaaatgggtttacatacagtggccaagtgtgagaatgagcagcaagaacttctgcggttagcacaaacactttttgatacaaagatgcctactggtcagacagttttacaacctttctcagatgactcttcgattaaaaagatagccgttgaggtaagtaaagctccattgatggtcacaaagtaaaaaaaagttgtgtgttctacaggtaataatatataccaaactaacttgaatgtgttctttgtcggtagacatttccagaggaactgttctctgtacttcgcactgtggttctgttaagaggactcagtgttgggatgggagttaattattcgtgtgcagaacaatggagagcaatggccgaagaggctttacttgcatctggaagagtgacaagaggtaagtggttatatcgtatagtactcactacactttttgcataaaaaacaagtgctgatggagttggtaacataacacctgagttttacagatggcaaagaaagatctcgtagacgggcttctctacgaaggctacgcacaggaagttaggaaaaagataggagtatttctcatcacttagactctcccatgagcaggatctgagcttttttcatttattgttctttcttttgtgagaatttgaatgataggagaagttggataacacttgaatgtaattggctgatataaaattatgatggaagatttgtaaatcaagatttaattcccaaaagataggattatatgttttggtactccttctccacaatagttggagaggactattatctccaacagctataagccatcttggctattacgtcggcacatatatatgccattacgattcatggagtcattctcaaagatgactgcctcaaaacccaagttatcactgcacatcattgtctaacacaaaaggctggtgcttcagcttcttaaggagactgaatcttcatatagattttggttccacaccattttatgtcttttctgttgcctcaaaaaaaaaaattgaagcgttgacaaaaaaaaaagttaaacagattaaaacgatgtcgtttaaaggatttcattaacacaaaatctgcgttcaacgagttcgctattttcccgtaattttggtctgaggttttggtgacgatggcgacggcggtagtgatgaacggcgagctgaaaaagcaacctcggccaggtaaaggcggctatcagggccgtggattaactgaagaagaagctcgagttcgcgccatatcggagattgttagcaccatgattgagcgttcacaccgcaacgagaatgttgacctaaacgcaattaaaaccgccgcttgccggaaatacggcctagcacgtgcgcctaagctcgtggagatgattgctgcgcttcctgattcagagagagagactcttctcccgaagctccgtgccaaaccggttcgaacagcttcagggatcgccgttgtggcggttatgtcgaagcctcataggtgcccgcatatagctacgacggggaatatatgcgtttattgtcccggtggacctgactctgactttgagtatagtactcagtcttacactggatatgagcctaccagcatgcgagctattcgagccaggtgaagagtgtcttctgtgttatggaattgaaacttgtattacagcttctggattgatctagtaaagggtttggggtttaggtagttttgggtgaaatttgtgatttctgacccaatctaccaccggagtttgaacttagtttcagttgctgacaataggtggtagatagttttggggactatgttgtgtggatagcttcatgaaaacttcaattgagaactttgcttagggtcatagttagtttgtttgtgctttgatatttaggactcaaaatgattgctagaattcaaacattgtagattacaagaaatgtttatgaaatgagaaaaagatctagattatagatgagaatgtagacttgcttgataacacagctgctaaaaaatccataaggaaaatgctataagctggaaagtttgttcttctttatgagtgaattaaaaagacatagaattcttagattgaaattatggactcagtttgctgttcatgtgatgagaaggatgcacgtttcatgtttaaattgattttgctaaagccctgtttatggtcttaggtacaatccatatgttcaggcaagaagcaggatagatcagctgaagcggttgggtcacagtgtagataaggttagagtttgatatttctagtaacctgtgagtattattttcgttctttttaccagtctcttagcctagaggattactcctgattatatgaatgacaggttgagttcattttgatgggaggtactttcatgtcactgcctgctgagtatcgggatttcttcatacggaatcttcatgatgctttatcaggacacacttctgccaacgttgaagaggcagttgcttactctgaacatagtgcaactaaatgcattgggatgacaattgaaacgtgagttcgatgcagtaatcatgtacaacatctaaatttgaaatctgtcttttttgcctcaatgttttctctaaaagccttcatagtatctatatattgatttcattgtattctttgtggcactttgtggaaatggtcaagctgagtgaaattgtgaaaatatatataaaaatctaacaccaattgtttgtgtgaatcagtccttgttattttcattgatcattcattatggagtctagtctctaatctctgaagattcaaatatcagaatacattctctaatctgttttaaaaattcaccaggaggccagattactgccttggacctcatttacgacaaatg

SEQ ID NO: 1409 - DNA, 3000 bp, Unknown
  misc_feature (1)..( 3000): cDNA_ID_2135073_gDNA_ID_1620397_Annot_ID_155815 3000 nt of promoter + ATG
aaatagctctgaagctgaggaaaagccattgcggacgcgaaaggtgagtattacaactctcagaacagcatatgtttcctcttctggtttattctttgcataaaaagataaaattacattcttttattttgacagaggagcaaggaccggagcaggaggatgtccatgtgtttgacagatgaagcagagcaattcatcgacgaattcatttcaaacatagaagacacagacttttcatcactggaggatgagaggagcgaaagtagttcaagttttggaatgataaaaacacaaagctctcaaagcaccagtgctcttaagagtacttctgttgaaatggacggtgttatgctcccttggttgcaatgggaaactccagacgtgtctgctgcagtggcatgccttatcaagtcgccgcacaccccaaattcaaaatctcttgtctgggagtcggatacaactcaggtaacaatactttttgcactgaccgtactccttacgggtctaaaactatagccggttagatagatgactcgtagaaagtttctctgacatgaatgtatgctgataggatgcatcgagtgggcgagggacgagcattggtaccataagtagcagaggaagctggagcccatatgactcggtcacgaagcctgtgatgcccacaaaaacactaaagatagatgtagcggagtatctgaagcgacctaacagctcagatattctaaatgagacgtggaagctaaggcatagaatcagttcgggaagtcttgtgctatgtagccgctcattgatctaaggcagtgccgtgccaagcttccgagaaagatgatgcaaaagatagtgaaatgtgatgatgatgatgacattgtagtgattcttctcttaattttctttttttgttgtttcatttggtaaggtacgactatatatatggaaattagtatgtaattaaccattgttaatctcataaaacttgttagatttgtttgataatcaatcaaccaaatgtcaactaaattagtgtaaatcctacatataaagaaaaaaacgacaaaacgaaatttgatatttatttgtagttgttattagatcttttgcatgcatgtgtcatttttattaaatgtaataaatttttactttaaaataaacatcctaattatatatttaataacataagaatataaaatatttaatcattgtgtggttgacaaaaaaaaaaaaaaaaatatatatatatatatatatatatatatatgtataaaatttttttacttaataaatatattgtatagttttctgttggccctttttagagtgttgtgattctgtttttgattgaaaaatatcgacagaaaatcaaactaatattcgaaaaaaccaaaaaccgtagaatttcacgttttccttaaccaaccaaaaatttgggaatagtaactgttggagccatatattcatattattcctaatttcttattctgttatagtttaggtatttctaattgttgtaattttgtcgtagacctttagaagttattttgagttacatacgattgtatatatatatatatatatttattggaatcacatattttttttatgataaaagaaagcgaaatagatagctacacgattcatatttattattttaaatcaaaaagacgaaaacaataagatttatgaattctttttttttttcttgaaaagagatttatcaattctttttaaactcatttgcaagttttccatatctatggcagaggtcgcggtgggttaagtctaagacactccttctcgcatacttttatgttctttgaacaaaagtgatacttccctctgcagcaatgacagttcttgaataagctaaagctacaacgttttctaacacacggtgatagatatacaactattttgctggcgttcagattctcttccatgtttccaatttcatctacaaaaaaattatagatattttaacaacaattgtggtatatatgttgatgaataagctatatgtacaaaacatacattgttgaagagcaaacaatgaaacgaggatgatgcaaaagatagcgaaatgtgatgatgagatcatagtaattcttctctcaaagaagtaagaaatgttttgttctttgatttggtaaggcatgactatatatatagtgtgtaaattgatcacatctcgtatagtagtattaataatctcttaaaagcccatagatttttttttaattataaaatagccaaaagtcgagttaattaatgtatcctgtaaaaaaaacaaatgccaacaaaattttgatttttatttggatttgtggttagatcttttacatgtgacattatttctattaaatgtaataaatcattacttttacatgaccatcctatttatctatttattaatataaaaatatatattatattttacacaacatatctttagcattatgcaagaaaatatatttaaattggtattggatagttgttttgagaacaaattgttaagtcagtctcactagaaaacaattctcatctaatttgtggaccttgtggttccatctaacgcaaatgaatccataattacctgtcacaaatctagtgtcgctatatacatatttatatgagttccataataacatgatacaatcagagcggcccgaacaattcatggctggaagcaaaaaacctattaataatatactattgttatttttgtaactagtcaaaactcatatcgtaattattttgaaagtaagatatcattttcttaacatatttttctattaaagtattaagatatcatatcgtaaatgagaggcatatcgtaattactgttgtttgtaagtttgtaactgtaattatacgaggataagatatcatatcgtaaatgagaggcttatcctaaggactggagatcttaaatggtgcttcttctgtccaagaaaaaagttcggcaacaatagtaaggcgagaagatcgactgattgagtcatg

SEQ ID NO: 1410 - DNA, 3000 bp, Unknown
  misc_feature (1)..( 3000): cDNA_ID_3062189_gDNA_ID_1620398_Annot_ID_155853 3000 nt of promoter + ATG
atctttgtttgaattgtttaacaaagaaaaatatttgatatttctcacctaccacaaccacaaccacaaccacaagacaaataatttattttcttataactattgatacaaaaattgattcttttcaaacgagacacgtgtgaacttgtgatttggtagaatttcgtattacaaaaagagaagcatctctcatctctcacctactactctgaaagatgttcattgtgaacatatctccaacacttcgcattgccttcagataacaaacacaaactgttataggaccacaagtcaggtacaactatttattagtttcgactaacaagtacatacggatttttttgcacacaaaaaagaagaagtacatttgcttatttatgtccgttgaaattgataagtttattcactgaagaaattggtgttttatatacaaattttacatataaagtacaacatttatataatatttataatttacatatactgttttactgtccgtcgaaattggtacgttgaactacagaagtaaagatgtaaagtccaacatttgattcaataaagaggatcgtgctatgacaatcctcgaatgttgtatacgagatagcttaattaagagtcatgtgtcatatacaccagtttccagtttatgattggaaatgacttttgcattggaaattttaaaatcaaccaaaataacacatccaaggtttatgaagatcaaaagtaatatataaaaattatagtggaaaaacaaaatactatttttgacaaagttacccgacaagctcatttagagttaaatttaaattatgtagtcaagttatcatccaatgtacttagatcatccaagttagttgacttcgatgattaattttcttaatcatagtaaaaataatataattaaggttttggagtatggcctctattttcaaaagtatagctttaatctgaaaaattctataatagcaattagaaaatagaaaataaaaaataaaaatgggacgagaaacctcaattttcaaagtcttattgagggaaaaaaaaaaaaaaaatcctacctactaccgtgttatacgtcatgatcacagaacgtgccttatattatccataaaagaataagtaaaatagtatttatggatgttacatgttaaccttgacacctaaatgaattaaatcgtaaaataaatagaaaggattggaaatggattgtatccttttggtggttgctcgacatgaaattcacaactaaatgttcggtgttccagtacacttagttttcatgcatatgataatatatgaacaaacataaatatatgattttttatttttattttagactaaagggtggtgatttgaagttttacgcacaagcgtaagtatcagacttcacacctgaatatcacgtcctcgataaatatatatcatcagacgcaaacattagaactagcattttcggaactagcttatgcctttggtgttttttgagaggtgttttcaaatcattgttttgtttgaggatagttttgcaaatttccttgttatcgtaaccaaccaaattctcaatattctaccaagtttctttaggccgaacatacaaaagtctgattttattcaagtttgcactttgtagttttcggccattataagttggcccatattactaaagcattaaggccttactctaattgcaactgtcccttctctcactcgatttttacaagtctagaagttagaaactactctttatgactacaaaaaaaaactaaaacattaagacccttcactagctgcaatgtttggtcttccactctttccttccgacctctacgagttgggaaaaatggggacgaaggcgagaacaacgaaaccatcattggaagaagaagggagtccactcagaggcattttatgtgtgaaaaccagacgagacatgaagagatttgaaaaaacagaggattgcttcatcctcgatttcaatccttttgattcgtttgacgttaaaaggctctcattttcccttgataaagatttggaaatcatccatgagtcaggccaggtttgagttttaaaattaaggctataattagggttttatatatgattttccttctcttttttgggggtcaaatgggtttacacatatttataatcatgacaaaatgtgatgaaatatattgagcaggtggcttgtagagattacccacatccgagacatctttgcttgaactttccctttggatcaacttctaatgcaacccactgtgatctggtaattgttaatcttttcattgaagggtttaagtaaaaaattaagtgaagtatgaaatggactaattttgtagtttaatgttttcctaaaattattctatgaaactgtcttttttctcgcttagatatgtacattgttttaacagtagagatcaacaatattatgcagtgttactgtcacgtgtgtgataagcctgctccttgtgcactgtggatgtcttctcattgcaatgcttcagcggactctgtggatccgaagtcaccaaccaatgagagtgagagctattattactccgattaagattagctttggaggattatgtaatgacaatgcctaactaattatgagattggtaatgtttgaaaccaatttgctagccgaattgttgctggctgaattattccagtatagaccttgcggatagacgggttatatttgccgtgaacatttgtctacgttcagaccgaataacacgatgcggttttatagaaaagacctaactttgaaccaacaacttctttgacaagcaggcttattgattcatatatgctaaagcactcaataataagccaatcacataatgaagtctaattgggctaatagttaggcccatattgctatatataaaaagcctttttaaacgctacgtctgaaggaagagcaacggttcggtgtctctctcactcgtctcttccgtttcgatctctgagacttttgtagcgaaaaaaatg

SEQ ID NO: 1411 - DNA, 165 bp, Unknown
  misc_feature (1)..( 165): cDNA_ID_3062176_gDNA_ID_1620398_Annot_ID_155861 3000 nt of promoter + ATG
ctcctctcttactcaacctccattggcgaacttcgtttttgattctcgtaatccctaattcctcttctcgaacctctcacagtcaaaaatttctccaaccaaagactgtagcagagagagacaaagtcattttcagatgataatacttttgcttcagtcatgatg

SEQ ID NO: 1412 - DNA, 3000 bp, Unknown
  misc_feature (1)..( 3000): cDNA_ID_3062184_gDNA_ID_1620398_Annot_ID_155857 3000 nt of promoter + ATG
tttttcagattaaagctatacttttgaaaatagaggccatactccaaaaccttaattatattatttttactatgattaagaaaattaatcatcgaagtcaactaacttggatgatctaagtacattggatgataacttgactacataatttaaatttaactctaaatgagcttgtcgggtaactttgtcaaaaatagtattttgtttttccactataatttttatatattacttttgatcttcataaaccttggatgtgttattttggttgattttaaaatttccaatgcaaaagtcatttccaatcataaactggaaactggtgtatatgacacatgactcttaattaagctatctcgtatacaacattcgaggattgtcatagcacgatcctctttattgaatcaaatgttggactttacatctttacttctgtagttcaacgtaccaatttcgacggacagtaaaacagtatatgtaaattataaatattatataaatgttgtactttatatgtaaaatttgtatataaaacaccaatttcttcagtgaataaacttatcaatttcaacggacataaataagcaaatgtacttcttcttttttgtgtgcaaaaaaatccgtatgtacttgttagtcgaaactaataaatagttgtacctgacttgtggtcctataacagtttgtgtttgttatctgaaggcaatgcgaagtgttggagatatgttcacaatgaacatctttcagagtagtaggtgagagatgagagatgcttctctttttgtaatacgaaattctaccaaatcacaagttcacacgtgtctcgtttgaaaagaatcaatttttgtatcaatagttataagaaaataaattatttgtcttgtggttgtggttgtggttgtggtaggtgagaaatatcaaatatttttctttgttaaacaattcaaacaaagataaccaactctgatgacttacaatggtagtattttcttctttttttttggacaaaaaatggtagtattttctaatcatggattcttatcatagattactacgaatttatttggattggatttagtttacaaacaaaatttcaccttacttaattcaactgcaaagttatttgaagagtatatacatattttgatgaggatatacatgtgttctttatattgaagggtctttacctactaatttttgtgtatgcatgtattcttaacttaatcttgttgttaaagcatttaagaaaattaaaagtgatctagaaagtgaagtacatcgaatctggtttagtgaattatctttcacaattcaacacaagttgtatagaaaattaagatggtgtaaaagtattcgtcatgctatgacgacgataaatgattttaaaattttcacttaagtattagtgtattacgtatatgtatcttaataaagaaaacaagaataatcttgtgccgaactcaatttcatagttaaaaacttttttttttggacaaccaaatgaatttaattaaagcatttctaggtaaaacttttcaatcctttcttattttctattgaagtagctgacattctatgaaagcaaatgtcaaggaaatgatttagcgttgaaaaaaatgaatgataacgattttaagcagaaactgacaatcaattaggaacaagtgtgtcgtctgggtcctactcaccatactatctgtccgactttgattacacagtcctctcaagtctaatctttttccttttattaatctatttgtttatcgattaagagtttgatcactctatagtttgtataaaaacgtttggtttcatgagaattaaagttaaaatgacgacccaaaaaaatgtttaagattgtcaagtgtaatgaccatccatacattcttagttaacctactttcatttacatatctgctaattccaaattttagtaccgtactttttcatcttagagatacttttctttttccaactttttctagaattattctctctatttaacaaaacgtgtcattctaccactgtttacataagttaagaaaaaatgtgaaaaaaatattttatgtcctttgataataatctataacagtttatctctctagtcaatagactgaaataatagggattaaaaaaaaactgcaaaacgacattctttgttacacaaaattattatattaaaacaacattctttgtgaaaagggagtattattaattagagtaaacggttaaaacattatcctaacactaataatcagttttgaaattattgttgggctttgtatgatttttttgattgttttgttaaagaaatatgatgataaatttagatatcacgtaattaaagaaaatctgttatactagaaaatcttaatagtacaacttttagcgtagtttctgttctttcaaaaatatgacaaacttgcttactgttaccgaatttaatagctttttatttttggtgtgtgcgaaaccgaatttaatacctttatacatagcaagtttaacataaaatttagtagtacataacattgtgatactagctaggtttcctaaaaaaaggcatacttgttgttactgttagcgaatgtaatagctttatagcaagtttaacatatgtaataaattataaaagctactttagttataaatttgtatttttttagaacggatcgtaatatatttggatgtattatctccgaaatatttattttttcatggcctattatttatttttattaaattttctgacattatggcctattattaattgataaaatacaaaagaatggatgtgtctcgattttcaattggaccaaatcattaagccagatcagaaaattgcgttaaaatatgccaatcgtctctaccttctttaatatattttcatataaataaacctctcaacctccacactttctcacccatcacacaatcctcaaaacagagtaacccaaaaaacagagcaatctctaaaaaatctcaagaaacctcactaaa

SEQ ID NO: 1413 - DNA, 3000 bp, Unknown
  misc_feature (1)..( 3000): cDNA_ID_2135963_gDNA_ID_1620398_Annot_ID_155860 3000 nt of promoter + ATG
cttttagccgaaaatcagtgagcttggacaatgttcttgttccagaggcagtctttggtctttcagagaaacccgtgtgttcatttgtagggcatttggatgacgtacttgatctttcgtggtcaaaatctcaggtgggtacgagttcccgatcatctcatttcgctacaaattcttatttaaagcatgaagtttgttttcaaactggtaactttattttgtggagcaaaaattttcatgcgaaccttgctcatcttactagtgctaagtttaggttttctaagtttgttatgtgagaatctgcttcgtctttcttaatcagataaaatcttgaattctcaagactttgcacttcatttttttgtttccagcacctgctttcctcttccatggataagactgttcgtctatgggacttatctagcaagacatgtttgaaagtcttctcacatagtgactacggtgagtggatataccatcctattccccaccagtgatcatgatttacttttcttcttagtctttatgaaactaagcatatattgttagaagaatattaagtcattttaggtgtcaactctgttctggaaagattcatatgtcaatataatgtggtatgaatcaagcttcttccacttgtaaataaatccctgaaacacaagaatttctatgttggttatgtaacataaaattttctctcatctagttttctgtttcctcgatacagtgacttgcatccagtttaatcccgtggatgacaattacttcatcagcggatcattggatgcaaaagttcggatatggagtattcctgatcatcaagttgttgattggaatgatcttcatgagatggtcacagctgcttgctacacaccggatggacaggtatgccattaaaagtttttcttacattgaagtgactttgggtaaaactaaatcacgcagtaccttaataaagctctcttggtttgtaaagggtgcattggttggttcatacaaaggaacatgctgcttatacaacacacatggtacataagctgagaacttactcatctgaaacttgagttgtttctccatctcgtcttttgaacttattatcttttttgtttattcagataacaaactgcagcagagacgcgaaatcaatctgaagaacaggaaaaagaaaacccatcacaagaaaatcactggttttcaggtaaagctaaaacaacttacaccgttctgttctcatcttttcatttatactacaattttgttttggatgctgtactggtttatctgactattctcgtgaaactttcacagtttgtggcaggaagttcatcggaagttctcgtcacatctgcagattcacgtacgcgtgttgttgatggtgttgaccttgttcacaagtttaaaggtaaacaatactaagcttaaaactctcttctccattcttagaactcgggagttaggaataactttattgttcatggaggtgaatttctcgctctatcgtcatctaagatacacatgagtcccacatttcatgaacatgatgttctttcgctttttcttgatctggtgttggagtaaaataagctcaacgttcttgccaagtaatgtgtgtttttctgagttttagaaaattttcgggttcgcaggatttcgcaacacgaatagccaaatctcggcttcacttacatcaaacgggaaattcctagtatcagcaagcgaagactctaatgtgtatgtatggaactacgactcagactctcgagcaggaagaagcaaacgtgtcacagtcacaaactcatacgaaaacttttattgtcgtgacgtctctgtggctgcaccttggcctggcaaaatcagtaacaaccacactaacaacagccccgaacagtcatccttcacagccaataataaccctccgacacctgtcaacgatccaaccaacaacaaaaccgtcaccaacggtatcatttcaagcgccacaaaccgatacttcttcgatagagtctcagcaacatggcctgaagaaaaactcttgctggctgcaaaaaaccgagccagaacaagccctcgtgtgagcgtggacatgtctaacatacaggttaacacaaaaccgagtgcctcggcgtggtctatggtgattgtgactggcagtctacgaggcgaaatcagaatatttcagaattttggatttccagttcgtctatgatgcaaggagaaggttttacaatatcaaaatcctaaggcaaagtgaaattttcccttagtaaaaccatctcctgtcaaaagtgtatagattgagagaaggtttggttcatccactgacttctctcgttttttttttttaccacgcttcttttatttatctgatttgttatctctaaaattcaaatctctagcaaatatatataatgttatttttaagaaagattcaaataggcagaaaaagaaacttcatataccaatatagtttgcttcgatgaaagtctgtgctattcaacttgaagtttgtagaatttgtctctgatattataactcttcaaggagagaatatatggtaaacttttgtatacacattttgtaattgtctttaggtttatctttacatgtaaaataattgggtatttttgtcaattcatcatttcaatgaacagttttatctttagatcagagtgtccataacaagtcagagtataattttgtttcatacctctagggctctagctctctgttaatcctcccatacacaaagagatggagtcccatgaaattatacattaaaatatctactgacagaaaatctaattctcgaattatcattggctttaagaaaagaaactgacaaaaactttccctaaagataatcttatccacacatatcctaggaaacacatatgggaggggaccacctttctcttgtctcaacttctatataaactcacgcaagcacagacatttgcataacattcacattacactctttaagtcttaaacgaaacaatg

SEQ ID NO: 1414 - DNA, 3000 bp, Unknown
  misc_feature (1)..( 3000): cDNA_ID_2993663_gDNA_ID_1620399_Annot_ID_155881 3000 nt of promoter + ATG
tcacaaagcggaggtaaactagtccacgggaacataaaatcctcaaacattttcctcaacgggaaaggatatggctgcatatctggaacaggaatggctacactgatgcattcattaccgcggcatgcagttggctatcgtgcaccagagataacagacacaagaaaagggactcaaccgtctgatgtgtatagtttcgggatattgatattcgaggtactaacaggaaaatcagaagtggcaaacctggtgaggtgggtgaactcggtggttagagaagaatggacaggagaggtgtttgatgaggagcttttgaggtgtacccaagtagaggaagagatggtggagatgcttcaggttggtatggtttgcacagcgagattaccagagaagagaccaaacatgattgaggtagtgagaatggtggaagagataagaccagagaaactagccagcggatacagatcagaggtttccacaggtgcgacaacaactccgattggaagtctatcaggatctccgtatatactataagaaagactattccatctttccttaatgtattgaccattcagaaaaagatttcaatatttctacagacgattatcgtgattgccatttgagaaccgtttccaacaaaactagaatctgtcttctaacaatatttgaaatatacttgtaaccatttgtttcttatattgacactactggtcttgtgttacatgaaagaatccattcacattttcgaaagtcgaaacagaatataataaacaacacataccaccatgatttcagctattagtaaccaacagaaaagacattcgaaagtcgaaacagatcttactagtggtccctccaaagtttatgaacagcgaggaaagttgagatgtagtcacttccacacaaatttggtcttgataccccctgaaaaatagtggtagagcttgatgagcaaataaactaaccacaaacttagattgaatcacaatatccagaatcttattcatacaaaccttcagattcctcaaaagaaacttcctttactaatgaggcagatgcattgtactcaaatctggaatgaacacaaggagaaaccattatcagtataaaacacaaactgcacatataaaccaatagctgagttttacgatatgggagatatacaaaatgtttctacggactattatcgtgattgccatttgagaacagtttcaatcaaaactagaatatgtcatctaacagtatttaaaatatagttgtaaccatttgtatctcaacgtactaatttcagtagttatctcctaaaagtgttaattctttatcttcttccataaatatagatatgattaataggtacaagtggatcctctggtctcaccactaactaatagccaagtcacttaagaaacagagctcactaagtttcagagactaaaaagacccacatcagttctcagtaacacaatacctgtagtgtcaatatcaggaaatgagatgaaaataaacaattctcatgtgcatggtattagcattcaaagaggagacatcaaaaaccaaaaattgcggtcatagttacctgttagagagaagcacttcaagttcatagtcagaagcacttttagtgacatctaccatgacctgaacaagctcagtcttcctagtgctggccatgaagagatcatattccgtgggaataatgatagcgaagaagttatcactcaatttgcttaaacacatcttctctactgatgacaaagcaattctcctggtcatagcttcagtctcgggatcaattagatagatcgcaaaatcagtgaggataaaaatacgccgtttcatcttccccgagccggtgaacttcaaaactttatcagcaaaaagaatcgatgtatcacctataacaacaatgaatcaccttctcaacatcaaacacatgcaattcaaggtgaatccaatcattagcaatccaaacaaccacataagaaactataaatcgatgccacaattctacagctgattcaactattcctccaagttcttcgattcacaaattgcctctcaatctcaaattcatcaaataaaaaccaaaagtttggagaaacctaaccttgtttctccagaattcgcatcaatccaggacgagaagaaacgtgaagatagtcaccacgatgctctctatagcgagacgctttccttctgactttacctccagcgaatggcgtgtgatctcctccgtctacctcacccacacttcgatcttcatcaaaatcaggtggaggtgattcttcgccgtcgaacttcggccccttttgctccttcaaccggttcattcctcccggcgacgaactcgaaatcggaatcggttagcttattctcagattctgcgttagaaaaatctccaaagtgagagagaagacgtggcttcaaatgattcgatcgattaaaagatacaaatctcagccgttagattatatgacttcatcgcaacgcgtttcgatgccacttgatttgaaatttataataaactcgcagccgttagatttcaataccacttgatttaaggataggatatcaaccgttagattagatgactttttaagacgatgtcgtttcaatgcaacttgatgttttaattaagaagcgccgcgtcgtttcaaggtccaccgaataataagagggttaaaagtagagtccactagtcaaagaaagtaaataatccacacggtatttattgtagacgtgagcacagagaataattcgtattcttcgtctttcgtccaccaccatctctattttcttcctttcccctaagtcttggttcttcttctctctaatacgagaagaaaaaggcgaaaacctcgccaatccgattacgcgaaaaatcaaaggtattgtctctgtagcttttggatctattacttatatttctcacggatttatagcttctctgattcgtttagaatctttgtttgatttttgatttttaggtttttggatatg

SEQ ID NO: 1415 - DNA, 3000 bp, Unknown
  misc_feature (1)..( 3000): cDNA_ID_3062222_gDNA_ID_1620399_Annot_ID_155886 3000 nt of promoter + ATG
tatggcttctgaaacgtatggaagtaaattagatatatatctgattccattttatttacattgaaaactaatgacttaaatttaagtacataagcagtagaagctaagtcatatacctgaggaccacgcagaacagcaaaactttccttcatctacatgcttaacatcaagacccacaaaccatgaacccgtgctgacgtcatcatgagcatacgaatgaagaatgtctctgtcacccccccacccccaccccatcatcatacataacagacaacacaaaaactcagtttcaatcttatttctctgtttgaaagatatgtgtcatcatgcgtaactgagaggtgaaactgacctattgatcgatacaaatctagccaatgcgtgcgttataacatacatctccccataagcatgccggaagtatctataagataaatgaaacaaagaacaggtggttcttagtcacatggaagaaatgaatctagtcaatgcgtggttctgattatttataaaacttacgctttcttgtcaccgaatttccaccactctggttcataccatttgtggttcctgccagaaaatcaaaacttggttaagattatatcagactgacaatatcctgacaaccccaatggtcctagtggttttgggtttttaagcttaaaactcacggttctgagaagacttcgcctgatttcatgcaaccgatgtaagcccgtgggttttccagatgtgctgcaagcgtagttcccagagcatctgcataggatcaattacattaataccacataatcatgtcagcaaaatgcatacatggaaactcgttgacctcagaccttttttttttttagtactaacttacctatatttacgtagatattgtcgatggcttttgcataaaactgtgcatcccacctatctgcagcgtaggcaaagaacagttttaccttcttagaagcttcctcgggtgcctcaactacatcatcctgaaaaccagtaaatggccaagctctcaaactaacataggtgagcttataactgaatgattcaaggtaataacttaagaggggagaagcagaaaacacatacgagaataatgaagtcatcggtttgactattttcagtatcaatgctcttgtccatgctgtcccctttatttgcactacatatcacaaaaacaacgtttcaaaacaagattccagtaccgtataatcatctttaaacacatagagaaatcaaagagtgataaacagaatccaaaccttcttccaataacaaatcttgcaatcacacccttttcactttcaagttttttaagtgatgcacctgcaataaaaggaagtgctaagctcataacacattgcaaataacagactggtgtcttactaaaacacgtataaagagaaaccctaccagtccccatccatgcttgacgaactgcatccctcttcttcttgttacccaaacttgtcattatcccgataaccactaacggtcttttcttggtttcagttccatcagcaagtttgggactttttgaaacaaagccttcttgcctagctgaacttaattccatctcaagagctgctagtgtcttcttctgttccctagaaagaaaagtctgttttcaacagtccatgaagaccaaacaaattaaacgaaaaccaaaatcaaacaaagtaccaatcttttacctgcaagctatgatcttcaaagtatcatccactgatatagcagatttcccctaaaccccaataaaagaacatcataaacattcaagtacactaaaccaaagtaagacagtaattgcaaatgtaataactttctgacatgacattactctctgctgtaatgaaagtgacagtactcaaatactaacctgtccggttactctatcgagctcattgattagatgaaccctagtttgagattcttgccataaactatctcaaaaaaatgtagagacgagaccaattaacaaacaaaacaaataagtaattgttagatatggataaatgtagatttaagaactaaccggcctgctacatagaaggaagcaaaagttgcaaacataaagagcaaaagggttgatattctcgagctcgataatcttatactcgaccctttcctcgccattgaaatagatccaaaatcagatctcttagtcaaagcaatcagacgcaaatgcctcttcactgtcgaaattcgatcaaatttcactaattcaaatctccagaaatcggattttctggatccaatgattcgtcgtcactcaaaataaaaccgattaggaatgtatcattggatctgcaattctccggtgatgattcaccagcggaacacaaacggcgagatcactcacttcgctgagaaaaattggaatctggattgagaaataaggagagacaagagaagagagtgccgttgagatttatgatttttatcggattagtttttgggatgtcaattttgtgtgatcttcttaattactttctgatcaattaccaaacctagtctctctgattcttttgattataggttaactctacaatttaattctcatttatttctactgatttgtaaactttttcgaaactgtcaaatattacccaccgtgaaaaaaagggatcaggtgttctttactaaacaacatttgttttttttgttacccggcggttgaaaaggaggaggaggtcaagacgacgacgtttaaaaaaccatgggccgtcaaatactctcgtcaaactcttaccagatgattattgattagatattctctcttccatttttcccctttcgaatttttgcatttcatcatccttttcgtgtgcttcacaacttcatctctctctcgagagaatttgcgtcatcaattcaaatcctttacgcaaagtttcagtttttattcactttcttacataacccatcaaaccaaatcctcgatcggattatgttaatcaattgctaagagctttttcttctacttcttcgcaatccgcc

SEQ ID NO: 1416 - DNA, 3000 bp, Unknown
  misc_feature (1)..( 3000): cDNA_ID_2136122_gDNA_ID_1620399_Annot_ID_155887 3000 nt of promoter + ATG
aacaaggactaagtaactagatagctagacgttattaataatgaaatattttagtatctagattccatcaaaatgcatacattaaggtacgtaattccatttaacaggtttgtcccacgtgagattgcttcatgattatgaatacgtagttaggtagattaacgtacgtagtagatagggtaaatagtttctcttatgtagtttctcgcaatatattcatctattgattccatgtaatacgtgtgttatacggctaactcttccaaacaacaaacatgcccgcaatgaagtacttaatagcttctagcccaaagcccaccaaaactcagaagccataaaagagaagttgttggtatcaattaattagagatgaagatatcttagatcataaagcactatgatgtctagattaaaatcaaacttctaataattatatatataacgttctttggttagttagctatctctaatcaatacaacttttgactttaatttctgctctccaatggttgaattcagtaagattttaacgcattaccaacaagcaatgatcttatgaatgctgctgtcaaattcatctaactgtatgagcattattaagtgtaaatgatgtcatgcaagtgactgaattctttttaatgataattaagatagtggttcatttttcgctaattcgatataaaacataatatatatctctatctaaagaaatggaacttacgaataggctaacgtgagatctgtttgttatcaatcttgtgagttatgataattgagaaaagtctacaaatgataacctgattggtaacccataacgtctaaaaagcagtattcagttttatctatatactgccaataatggatatcaaaacatgcacgtccacgtattgagtggcacatgaatatgtgtctttaatttgtacaaatttacaaaataaatgatttgtggttctaacgtaattaattctttcttagcaatgcttaatttatgtttctgacgtgaaaaaaaaaacataaacgattcaacatgttatcaacggtgtgatgatttcgagttttctttaaaatactaatgtcaaacttaaacagtaaattcatcatatttcataaggtttttcttactagaaaaatgggaaatcagccatcacataattaaaacatttgtaaaaatattttatagtgtccatgtatatcgtatgtaactaaccttgaaactattttacatgataactatataccttaataaattagacggtaatgtgataaacaaatgcgtcaatgaaccacataagacctttttgttaaaggtaattggaacaacaagaatcattcattagtcgtcagaatgttagtggtctcatgaaatagagaactttggtgaaagagacaaagcacaaaatgctaagataagaaaaagaaaaagaggttaagggacagaagaagacttatggtagaggacagctcactctcttattgacattgacttcatacccaacctttaattttgttatcattatggtatagctaaatagctactcatcgtatacagaattctatcatatcaacatctagttctccgcgtgactttatacttttttttttttttttggcaaaaacattgacttaaacatcaaacataccataacaaaaagggtattttttgtgttcttctaccaaattactttaaacaatatccaatatggtaagcatggaaacaagattctgtaggaacctagtagaaaaatatactagtttcactccttaaccagagcattgaaccgagcttttcgggaatatagtgattgaaatttgaaccacagcaaaaaaaccggatagaatccacaactactcacctttgcatatattctacgtatggtaatggaggactatgtgcgtttttttttgtatgtgtgtaatattggtagagaggtctatctcaatgactattccattttaatttatggggctccagttggtgggcgatgtagatttgtcccatcgacgcttttcgaccatatgagcgcttgccttgactcttcctgttctcgttgattttgtatgtatacgcttgtaagtatttagaaatgttttgattcctagcctgtatcgatccaacggtcgagctagccgcatgcaacccgacgtgaattagataatgctcataatccgtagtaggtttgcgggaaattgttgtcaaggactcatgttggtttggtatagaggaacatccatcatataatcatttcgagtgtaattctacatttctacctaatattttaccaaagtcgttaactcaaccagggaatttttggttatccgaaaagaagagttttaaagatcccgaggtcgagtattagtaacgtggaagtgactatgaatttcgatacaaaaacttttgctacttaaaaacaaaaataaaataattaaacaaatcgagattaagaaagaaacaaatatccgtgaaaaaaaaagaaacaccgacaccgttaggtgagtagaaaactctttcaaagcactaagtgttgatataatataatatcacaaaagcatcaatcagttgatcgcaaatagacatttgcgattctataatagaaatgaataaaggtatattagttactatatttgctataatgaacttcttatgaaaactaaaacaaatttttagtgatgcagtcgttatatatgcgcattacacctccaagaatactcaaatacatcgaccatgtacatattatatcgttagagacttagagccatcgacacattttgtttgtttgtggtccttttgaatactacattttcaattaaatatgactataatattacagctatcaggcataatatatattgaaattgacacatacatatatatagttttatacagaactcatgacatttttattcttaaatagctccttctatataataatttatagagccttccacatctcctttgttcccttaacaaactctaaaccaaaaaaaaaaaaaaaaactatg

SEQ ID NO: 1417 - DNA, 3000 bp, Unknown
  misc_feature (1)..( 3000): cDNA_ID_2136112_gDNA_ID_1620399_Annot_ID_155883 3000 nt of promoter + ATG
gttgtctgttatgtatgatgatggggtgggggtgggggggtgacagagacattcttcattcgtatgctcatgatgacgtcagcacgggttcatggtttgtgggtcttgatgttaagcatgtagatgaaggaaagttttgctgttctgcgtggtcctcaggtatatgacttagcttctactgcttatgtacttaaatttaagtcattagttttcaatgtaaataaaatggaatcagatatatatctaatttacttccatacgtttcagaagccatatgcgcaggagtgtagtagaaccaaagacgaatccaaagtgtgaggctcttggctctttggtgcttatagagaaagaagaacaaatgacatttgtctgaagaaagctaattacaccatttcatctatgtattctaaacttgccattttattggcattgcattatacgaagtctaggatttggatgtgggaatagatattcttaccgacaaacgttaaactccaaaaaaaataatcattcatttacagcaagtaaaacccaataatctatactttaccaatctttatgttatcaaacttgatgttcacttgaataaactataggataaagagttgaaagccaaatttaggaagaaccatggagcaaatgtgccaatgccttatcagtgtcgttctcaaacatgaagagagcatctgcaacagcgtttgtcggaaaacccatctcccgtatcgctgtgaacccatttgcaaattcttgaacctgaaaacgcgtaaaaactgtgattagattctcctttgggggaaagaatgaagaagcaagctggtttgtcaattcaaagatccacaaatttaactgatagttgatcacggttttaaatgatggacggactcaaaagtatatatgatcgctataaccactagttagaatccgtataagcttcattagctaatacaagaataaaatctatagtgaagggatgaagataaatcacctttgtgggattatcaccatagtttgcaacagctatgttgacagcttctctgttgagcccagaagcagtatatttcatcactacatgatctacaccctgcatttgaccctgcatttggaatcacttattaacgagaataatgcatatataacgatcatacactgtaatgcacaaatctacaagatcttcacccaattcgcatttttaagttaatacatagatgatccacaacaattcatcctagacatcacaattgatactatagtttagtgccattaatcgtctaactcaacaaagcttccattctgttcccgtgtgatgatccacacttgttcttcctagacctcacattgacactatacattggtgccatctacaaagcttccattctgttccggttaactacgttcatcgatgatgattcacacttgttcttctagagaacacatcgatactatacgatgatgctattaaccacctcagcctaactttaaaatgcttccatagattttaagaagagccataccactgaagaaggtgatggttcatgaaacttagccggtggattctcactcccaaatttactccaatctggattatctttctctgcctccgcgagaactttcctctctaatccgaaatcgaactgaaaactactccgatgaatatctcctactcgaggcaacaactgaggctacaacaatttgcaaatacaatgtaaaactacttcaaatcttcaatcacagagtttaaagatcaaacatacaaaatcttaccggcggagtaatccgatactcaggcttcaaattcactctgattcctattccagctaccaaaatcaaattcaacgatcaaaaccaattactaatcaaattcgcgtaaaaccaaattcgagatcagaacaagacttacatgaaggagaagtgttatgttgaaacgaagagtttctctccggcggagagaaaaactgtgggccgggaccggtttgttgaccgatcttagggtaaccgtacataggatggttagatgacggagaaggagatgttgatggaggtccatacataggtcgagggtaagaaggaccaccagacttgtttctgtaatcgtaatccattgttgtgtgtttgttttctagtttgaagaagaatttgcagaaaagaataagaaggaaattggaagaagaagtcttcaaggagatcagatctgtttggatatgtggattagtgtatccttctccagctttgacttgatcttgtttttgttttcagttttttttctttttgaattgggccattaaggcccatacattatcatccacatgccggaaccagagcaaaaatgagaaccactttgctgtatacttatgtttatatagatcagatcaaaaatactgattttttttttgtcaacaatatgtgtgtgtttttttggaacaatatgtgttaaacgggtgttttgataatagactatgttcccacaaaactatgcaaatcttaggatgaaccatgaaactctctttttctaatttcaactgttacaatacacgacttaaggaaggtgagtggataaggagagagactcgacaattagcatgaaccatgaaactcactttttctaatttcaactgctacaagacactacttaggttatacacaacaaaaatcaaagttcaaatgttgaaaaatattgtccagaaaaaaaaagtaactttgaaaattcaagtagctttcaccgtgattttctcagcaaacaaaaacaaaaacagagttgttatgcatcaagtcaacaactcgccgaacctaacattaacctaaagcaacccactttcgttataatacacactgataaaacaaaattaaacctattgaataattcttacaatatagctccacaaaagtcaataattgtaaacttattatatatctaactaatctcacttcttcatcttcatccattattataaacgccactttactcttaaaaccagttttttctccaccctaattaagaaaatg

SEQ ID NO: 1418 - DNA, 3000 bp, Unknown
  misc_feature (1)..( 3000): cDNA_ID_2105348_gDNA_ID_1620400_Annot_ID_155903 3000 nt of promoter + ATG
tccttgtgccttttcatttgcaagaacttcctgcacaacaaaaatacggaaatgtttttgatccaagaacatcaaactctaattgcaattgtaaccaacaaaaaaacacttaaaattcgctatacactatcaaatttcctgacacgtagacctcatgtcagcacaaatagaatctagcctatctctgttaattgggttaccaaacaacatgagattgattatgtggaaaaccaagcacattatttaccctttgaaaatacgcgaaatcaagatccaagaagaatttatggagaacagcttcgaagtacgaaataaacaatgaagattaaattacctttttataatctctagcagctgccgccaatacattcccgaatgccagattcgagagggtcgacttcaccgtatccggatccatctctttaccaaccaactaatccaactcagaaaattttaaaatctcaatcaaaaatccctctaagatagccagagaagagattgtaaacaaggatttgaaatctggtgcagagaggagaaactccccgacaatgaacaccaacgatctaaacgcggcgtttggtaaaagttgagtaaattttgttagggcttagttttagtccatgggctaattagtaagtgatttacggcccacacatgagcccaaatgtttcagacccagccaagtttcttcaaattcacccaatcaacgacgatgtacgtgtgtatgaaaatcattaacacgacgcatcgctttcgaggaggagcattacgtgtcctgttagctacgataatgttagtaccgccacaaagaaaaggatagatattttgctttccagcaccctgtcatgggattgatatgaacacgtacttggtatcgacatgaaagctcaaaaataaattcaatccgattcctttagtgatatcagaagttcattttaaatacgaacacgtatggcgaaacaccacgccgacattttctgctgctgccacgcgtcactttccaaatattgattcattaaactaatagttgatccatatccgaaaccggactataaaactatcttcaatgcgttaacgaatcttcatcgatcaaactcatcaaagtctaatatcacaaagaaagagtttttttaactagcttagctcaaagtgtttgcttaagacaagaagaacatggcgtcttaccagaaccgtccaggaggtcaggccactgacgagtacggaaacccgatccagcagcagtatgacgagtacggaaatccgatgggaggaggaggatacggaactggtggtggtggaggagctacaggtggccaaggatacggaacaggtggccaagggtacggatcaggtggccaagggtacggaaccggtggccaaggatacggaaccgggaccgggactgaaggctttggaactggcggaggagctaggcaccacggccaagagcaactccacaaggaaagtggtggtggcttgggaggaatgcttcaccgctccggatctggatccagctctagctcggtacgtatcaagtgtataaagaagatttatgatgttttagtttagtatgtgaagcgtaattcgaatgttatatgtataacaggaggatgatggacaaggagggaggaggaagaagggaataacacaaaagatcaaggagaagttgccaggtcatcatgatcagtctggtcaagctcaagcgatgggcggcatgggatccggatatgatgctggtggctacggtggtgagcaccacgagaagaaggggatgatggacaagatcaaggaaaagcttcccggtggtggccgttaagcttcgaacaatcgtgtatacatattaaataaaaataatgagggtttgtaacgcagtcgcattcggtcgttgtattgtgctttttatgtatgtacgtcctgcgatgtgtgttgtttacttacatgagtgtgtaatgagcatctggctctttttatgttctgagatgtttgtgttatgtaatttcacatctatataaatctactttcttctgcttagtttgtgttacacctctcgtccactgtgaactccgttaacgcactacaattagtgtagtagagtgtagacgtacatgttaagatgggattaggcctgttttcgaactcgtattccccattttgctgggtttaaccttgggccgaatcataatttgatgcttgggcctatgaaatggagagattttattagtgatctgtattttctgaacgtaggtaaaagacgtgagaaaatgatcaaaagacattgaaaaagtctcaatacatcgtccggtgatatttctttaaaatgacgacttcttcttctttgccattactgcacgaaaagaaaaggacatagttggtttggttttgtgaaggagagcagttgaagctgtttctcaatgattttgtcattatctagcgtttattatgtctttggcgtactctatcaaccgtatctatttgttaagcacacaatgttaattagtttgcttgcagaataattagcatttttttttgactatttgttcaacggtcaaccaagtaaaaccctatggatgtaattgttttgcgtagcttaatcatcttcaggctgatctctcaatttaataaaacataaatccccatagaaatcttctccgcgttgactattaaaagcaaaattgtgctttaagtgttgctaatgcatggaacaaaaatcccacacaacaactgcgaataatctattgatatgaggtgcataaagtgatcatacatgagaaatatacgaaaagaattctaacaaatcttgtattcataccaattcaaatatcaatgtatccatctaatccaatatatagctaaaattagataccaactccaacgtctttctcaattgtccacaaagtctactctataaatgcaacccttggcatcacacacaatcaccaagtacaagtaaccgagttatatacaacgagtcatcaagagaaagaatccccccaaaaaatg

SEQ ID NO: 1419 - DNA, 3000 bp, Unknown
  misc_feature (1)..( 3000): cDNA_ID_2136231_gDNA_ID_1620400_Annot_ID_155906 3000 nt of promoter + ATG
cctttgactaagcgtatagtctcgtataattgacattgacaactttttacatgcaatatatgtatgatgttaattgttaagcaatttctactttgaaaataaagagcgctaaattcagaaataatcttatatagtagtgacgtacttgataagcacacaaatctagaaatgtctaaccaaatagttcacctttattaattcaagatcattttccaaacagagagatctataatgttatcagttatcacttgtattaatggtcatgtaaagcgtagcccaaagcccacttcatcatgatttgaactgtaggagtaagattctgctacggatatgagacctgtcgtctttagttatatgggccgaagtcagaggttgataacgagcatagaaatatcgtgatactgaaaggccaaaatggcccacattaatccattgttcatcgtatggtcgaagcctaaaaatttcagctaggaaaattgaagtaatatatcaaagaggcaatttcatcattccatctgaatatctgatcttgtcttgtaattagaaaaataacatgtttagagtgtgttttttttctcgggtaaaagaatggacacagtttaataagtcaaaagctagaaattatgttttgtcatctgatacgaatgagcgttaattatttcaaacgttctaaatatggagaaagaaatctcaaaactgttatcgattttttgtctgaaattagacggttagataagataagtttctatatatgaattacgtgttttgcatgccagatattacgtgacatacctggatcaattaggataaaacatgaaagattcaaaatacaagatgcatgcatttgctatattactgaaagttcgagtaaaaatatatggatgcatttgtgtaccttacgtacatcaaattcccacccacctctataaataattgtctgaagtgtcgttagcatccctgaacaacataaattatttctggacacaaaacttaataatgggagaagttgatttcatccacaccattaatccttcctcgaggtttttctctcccaatatggatggcatgcatgcaagcgtgtgtgtgtgagtctatgttgaattgacatcgatgtatatttgtgatgcaggtgtgacgggggtgatgagagaagtagtatgtacagttttgtgaatgctctaaggatgagcggtggagatggagataatagttactccaccaattctcttcttcaggtttctcccatattccatataactgtttgatccattagttatatcccacacagatttgttatatatataagtaaataactaaaagtttctttaatctatttctttttctaatttagaaaaaagtattatcaaaggccaaaccggttttggttaagaacacaaaaggaatgatgataaacttaaattttcctaattacatcaaagtagctgatttgggatgtgctactggagaaaacacgttcttgacgatggctgagatcgtgaacacgatcaatgtgttatgtcaacaatgtaaccaaaagccaccagaaattgattgctgtctgaatgatcttccggataacgatttcaacacgacattcaagttcgtacctttcttcaataaaagggtcaaaagcaaaagattgtgcttcgtgtctggagtccccggttcattctactcgaggctctttcctcgcaaaagtctccattttgtacattcatcttatagcctccattggctctctaaggtctcacctacttacttgcctagtacttgcttaaatatgtagaaagcaaattaaaggttatatataatatataatggaactgtgagatttgtaggttcccaaaggactggagaagaattcctcgtctgtgtacataacgacttcaagtcctccaaatgcatacaaggcttatttaaatcaattccaaagtgactttaagtcatttctagaaatgcgttctgaggagatggtttctaatggacgcatggttctcactttcatcggtagaaagactctcgatgatccattgcatagagattgttgtcacttttggacactattatctacatctctacgcgacctagtctatgaggtaacatataaaagtaccaaatttcgacatttaaaaatttatcggctttaaagattcaaacttttttttgggtcaaacaagaaaagattcaaactttttatgatccacaatatagggtcttgtgagtgcgtcaaaggtggactctttcaacataccgttttatgatccgagcaaagaagaagtgatggagatgattcgaaacgaaggctcattcgagatcaatgacttggagattcatggatttgagcttggcctaagcaaccatgacgaggactacatgttacattcacaaatatctaaagcagggcagagggaagccaactgtataagagcggtcagcgaatcaatgcttgtagctgacttcggagtagacattatggacacattgtttaagaaatttgcataccatgtgtcacaacatgctagctgcacgaacaaaacgactgttactctagtcgtttctttgatacgaaagtaatctgtcaatgtagattttttagatttcatgttgagactaggaaaatgttatatgatatgtgtatttggtacatatgtaataaactgtactctgggggaattaaacataactcaagggcagttttctaatacagaaaattacagggtgtattatgtaataaacaaaatttaaaggtactttcgttaaaaacaaaaaccactgggaatgttttttcacaaaacaaaaacatttaggcaattttgcaataaaacaaatttacacggcgaattattgggaacgtgaccaaccgacaataagaacagctgacttaacaacttactactatttgctactacgtttttttgcttcaaatccaacaaacaacaccgcatagaaatcagacggcagtgttggatcggaggattttgatctgtggagacgaatatg

SEQ ID NO: 1420 - DNA, 3000 bp, Unknown
  misc_feature (1)..( 3000): cDNA_ID_3062300_gDNA_ID_1620400_Annot_ID_155914 3000 nt of promoter + ATG
tgattctgcttctttgtggacaaatccatgtaatttaagtttacagtttgatagtaagaaaaattctcggtttattacttgttatcagtaatcagactgggtttacaaatttacgaataaacacagtggggcccctgatgactacaaaagcctacccgaaacaccaggagatgccacgtcactaaacatacaaaaccccatcaaaacgcagccgttccggtgattccccaaaacccagcgtgatacgcggtcgttgcgaatgaaagccttggtgaagaggtttaaattaagagtttgttgcgactaaagccttggagaagaggtttctcttttttctctcctcctcagtatatatctaatctctgtttgctcttttttcgcaccatgtcatatcaatctaccatcaatcgatcgtctcttcttcctccgtctgcgttgatcttttcgtttcgtcttctccgattgatgctctgtcgcgaggtaactatttctatcgagtgattttgctagctgctgactgttcgatttgatgattaaggtcttggttccgtgataatctctgttaaatttagtttaggctacttgatgttgaatgattagtttgataatctcgcactctatggtttgctccttcccgaaattgaactctcagattgttagcttgtttgtataggttattaattgcttgacattgatttggatttttgtttatccgttatcgactctctcgatgttcattactttattagttgaacaacgctctctcgctgttgtgtatccctattggtggatttctaattgaaatcttcaatgatgcagagtcatgcctacattttctgctgccgctttgggtagatcactaaattcagggacgtccttatctagtaaatttccaagcacactgcagtcaaagccgtctattttgaatgatgaaagtaagcaacctaaagaaaagacattcactcgtcctcagatgtcaccttctctatatgccactactaaagaaatccctcatcccaattcgccttcttcctaccctccatctccctatatcatcaatcacaaagctcgtgggcctgttcttttcaatagggactctgaggtggatgggccttctcacccgataacctctggtgaggaaaagattagtggtaatgtagatgtggaggctactgcctccttgagcaagtccacatccctatcatttcctatcaccgaggctattgcggtggatcacaccaatggtgttcacacccaaggcatccatgaacgtcctgtttgggattgcagtccccctcttgggacatttttgaacgagaagtcgggaagagatatcagcaatggtgggattggaagtaataatgctaccagtaatttagaatggcaaagttacttattggagccggtaagaataaaagcagacaaggagcttgagcctgaaaatttctataacccaggtgaattagtaagcttcacaagtaacacagaggtagaagatttcgagagagctgaaagctcacacagtcttgctacacatgttggagagttttatgatgcttgcgatggtactgtttcttcctactaacttttttaaccacgagatagctagaaaattcttatgatgtctgacatttctagcatcatcactttttgccagttcttggagcctcttctcctttagttttaagtgttatatgcatatatcagtatgtgattttggttgtgaagtggccttttaggcttgggattcctgtgtttatagtcatcttgaattcgtgatagttatgaatcagatttccaaagacatagaaaatctgcatgcatgattcactggtatatctaagaaactggttttaatttattcagttactgtttcttggcttccagaactatcaactgacagtggaatgcagagttcagctaacaacattgaatctgaggtaagggagatgagattgggtttactaatggaaatcgaaaggaggaggcaggcagaggcgactctagagcaaatgcaagttcattggcggaggctccgtgaccagttggccgatgtgggtatgttccttcctcttgatcccaccagaagccaatacagcatgaacctagctgatgagctacgttgtcaacttgaggtcaccaggtttgtctccgacacactaggcagtgacttggccaagacagaggtagagatggagatggaagctgagctcgaagctaagaactttgaaatcacccggttgtctgaccgtcttcattattacgagactgtgaaccaggaaatgtcccagcgcaaccaagaggccataggtagaagaaactcaagttaaatttacaagaatgtcttatcttatttttctttatctcaatgcttcaactctctttgatatcagaggtggcaaggcgagacgggcaaaagagaaagaggaggcagaggtggatttggggatcaatagctgcaaccatcacactcgggagtggagtcttggcctggtcgtaccttcctcccggaatgttatcatcagatgaagctcaacctcagctgtctccaaaagattcataatgaggttgaatcaaagcttcaggccttgtgaataaaaataggaaaatgggttttgttttaaccttttctagagaatgtatagaacattcatgatgacgacataactcagcttcatacgatcaaggtcataccaatttggttctgtttgtgtcgcttattgacttgcaatgttattattagccagaagttccgtgcctgattcttgcttttgttatgttggttcttaaatttaacgaggggggtaactgggtaaagaaaaataaaggcggttgaaatgggaattatatttaacaaggggtgtaagtggaaataacaaattctgaaacggcgtcgtatgaagatcatatttggttccttcgctaatcactaaagaaagcacctgtgaggaaaaaccaaccagtgagagctatcaatttgaaaaaccaagtccaacaatg

SEQ ID NO: 1421 - DNA, 3000 bp, Unknown
  misc_feature (1)..( 3000): cDNA_ID_2992979_gDNA_ID_1620400_Annot_ID_155920 3000 nt of promoter + ATG
ttctctcgaatgatcttttattgttcttgtcgtctagtttgatgcttttgctggtggtgacgacgaagagacagataaattaggaaaagcaaggtatggtttcgatgctctctagtctctatcacacactaattgaactaattagagaatacaccacgctttgcagcgctgtagatttgttctaagatgttttttcttttcaatggtaattaggtatgatgatttctttggtggcaaaaaggagacaaaaatgaagttgaaagatttgagtgaagatgaggaagctgaaatagaaaacaaagtactgtaatacttaactattcatggcattgtgatatgtaatgaattcatttctgatttatgaactaatttatctacctttagggcaatgaaaaactctctacccatgagagagcacgactaaagcttcaatccaagattgaacagatggagaaagcaaacttggacccaaaacattggacaatgcagggagaggtagccagacatgttttccctcacaattaaactgtaaaagaggcatcttgctttctgtagctaaatttatgtctgattttacttgttgtaagataactgcggcaaagaggccaatgaatagtgctctagaagttgatttagattttgagcacaatgccaggcctgctcctgtaatcacagaagaagtcacagcctcacttgaagatttgatcaagagcagaatcattgaggtaactacttgtggcagtaatttgtaacaaaggtctcccttgtttcttcctggttttgcatgactgatctttttactctttaggctcgtttcgatgatgttcaacgagcacctcgtctacccactaaaggaaaaagagaagccaaggaattggtgagttttattgaagaactattacttctatcctcttttcttgctctggtgtaatagttacaattgatttgttacttttgggtatatgcaggacgaaagcaaaagcaagaaaggtcttgccgaagtttacgaggtttgtatcatgtacaatatttgattgtgttattgcattttttgtgagataaccaaacttacatatgtgttttggtccatttggttatttgtaggcagaatactttcagaaggctaatccagcttttgccccaacaactcactctgatgaactaaagaaagaggttccaacttgatttgatacttatttttcctgggtttttgtgtttgcatatttatcttctcctttcattgttagtgtatatatcacattctcttacttataaacgttaaatcaggcaagcatgttgttcaagaaactatgcctgaagttggatgctctctcccacttccacttcacacctaaaccagtatgtttcttgcttagatcctaaatgatgatcacctcaagtgtctagacatagctgttctggactgaaactttttattttctccaaactttcaggtgattgaagaaatgtctataccaaacgtttcagccatagcaatggaagaggtaattctaagccctttccttttttttgtttgtttgtttggtaattgggattggagaccattatacttatcaacttgttccatgtgtactgtgtaggttgcgcccgtggccgtctcagatgcagcaatgcttgccccagaggaaatattttccgggaaaggtgacattaaggatgagtctgagctcacacaggaagatagaaagaggaggagagcgaataagaagagaaagtttaagggtaaggaagtgaataacaaaaagaatatatactcaattggtaaaaaatacaaaatctgagtgcatcatgttgcattttagacgcataataacctctttgcttttcacttgtgaaacagctgaatctgcaaatgaaccgcctaaaaaggcgctggatacaagtaccaagaacccttaaactggtattttctgtgctcttacatgactgactatagattcaaaaagcatcaaaaaattaaacgttgcttacttttgtgaagttacatgttgaagaaaggagagagttacagaggcaaattcaagatgataagatctcggtcaagagcattgctacacagacagcttgaagattagataaaacaacagttttgaatgagagaaatatttaaactttgtctttcacaaatttgaattttattgtatttttttctctttgtatgagtagttccattttccttgtatcgatagaaaaattccaaagaaatcttaaaagaacaaaaatgtgcaaaattcttaacaccaacatgaatcctaatggtaagattgaatttgatatgttagctacaactaatgaggcacacccgtaagataatgaaagagcagcagcagcatacattacctttccgagtccagcatgattcctccttttaagtgtaaccactctatagtctttcgattgggctaaaagcctcaaagaagtgaaatagtaaaaaggtaatagatagaacaaataagctggagtagctcagttggttagagcgtgtggctgttaaccacaaggtcagaggttcgacccctctctctagcgttatgcactaatttttaataagcccattagtaatattggacctggtggaatgtattgaacagcccatacccttctttgtagatattattgataagttagtcggacttaagaaggatattcgtaatccataaacgatattattctcaagttagtggtcaacgttaaactttgggtcccgaccgccatttgaagagccggtttctccatcgtcgtcactcgtcattcgtttgtttgtctcttccggatagatatataaataaaaatgtccgatatttttttaaaaaattacattagttttgctgcgtttagtattcaatttcatcgacccaaatcaaaatctctattcaatccttttccttcttcttgttgccctagtacgagaggaccgggaaggacgcaatatataggatactagatagagagtgactgaaggagagaaaaacaaaaatg

SEQ ID NO: 1422 - DNA, 3000 bp, Unknown
  misc_feature (1)..( 3000): cDNA_ID_2136302_gDNA_ID_1620400_Annot_ID_155925 3000 nt of promoter + ATG
gagactttatacgatgttgatttggtagagagaatcttaggccactttctcgacaccttggaacaatccaacaccgccatagtcgaagttgacggaaaatctccgtcgctgatgctcgtcgggaaattaatcgacggatttctcgcggagatcgcatcggacgctaatctcaaatcggataagttctacaatctagccatctcactcccagatcaagctcgtctctatgatgacggactttacagagccgtcgacgtatatctcaaggtataacaataaaattcaatgtgaagagaagatcggagaatttggatctgatttgttttgaaaatttcgttttcttcaataggcgcatccatgggtatcggaagcagagagagagaaaatatgcggcgtgatggattgtcagaaactgacgttggaagcgtgcacacacgccgcgcaaaacgagcggcttccgctacgagccgtcgtacaagttctcttcttcgagcagttacaactccggcacgcgatcgccgggacgttattagctgctcaatcgccgtctacgtcacagtcaacggagccaagaccgtcagcggcaataaggaatctaacgataacggaagaggacggtgatgaagcggaaggagaaagacaggtggacgctgggaaatggaagaagacggttagagagaatcaggtgcttcgcttggatatggatacgatgaggacgcgtgttcatcggttagagagagagtgctcgaacatgaagaaagtgatcgcgaagattgataaggaaggttcatcaccggcgacgacgactgatcggccgagaagttggtcgattaccaaaaaattcggatgtaaattcaagacacaggtctgcgattcacacgaagcaacgatggttgatcatagatcacgacggtcttgaattgttttcgattgattttactctttttagtacagaatcagaaagcatattgttgtgattcttggattttagtttttgttaatccttcgagattcttgctatgcgactgctctacacaaatgtgcatcgttttgagtcttgtactcgaattagtaaaaccagaaatgacatacggcacaaagcccatcgttaaacgtttcgaattgagcccttttctcgacttcctccgaatgggccgtaacaatgggcttcagttgcccttatctatcgtaaactgggcactgttttggagagaaattgtttcatatttgtggaatgtgcgccgttttaacgtaggaaaagagggacgaactactcgctgttcagaatcggtagtaggacttcatgtcgttttataaaggagagttcctaaaaacctaaaccctactttagttctactatataaatcaaccggctttggctgagaagaagccattagcacaatccgagtaccgaatcaaacctaagtctctgtaaatttcctcgttttccgtagatttagttctttgtcatcccatcttattagggttattcgtttaatttcgtttgaatcagttgatactctctgattttccaatatgtgtttgaatcggcatattaatctttgatcgactcgattttgtgtttttagaaaataatttagatttttttagagaaggaaaaatattctcagtgatgaagaaacaatagatgacgagtccgatgaaatccattcataaaatcgtggggacaaacgaggcatttgtctgagaggattatttttcttcgttttagcattctaaaatatctaggttttaggaacgtgtataaaggggatttctcagtgatgaaggaacaatagatgacgagtccgatgaaatccattcattaaatcatggggacaaacgaggcatttgtctgagaggaatcctttttgttcaattagttttgttttaattagacttagcaggaagaagaaaggcatgatgaggattgttttattgtcatctgattcttattgatgaatctatacctcctactcattctgagtgccttctcttgctcttaattttcagtcacagatatcattgcattagtagtcactaaattcggattcaattatattgactctagggaacactacatttcaagtgaatctacagatactctaataatataacacaatctgctaagaccaagtgataaaccaattgaactaacaaaaaaaataagtttatgaaatcataactatttcttgatattaaaaaataacagcaaagatgccaagttcatataacataaggccttcaaggagaaaccataacttgtaatttcaaactgtatactggaaagcagactgtgctcaatgtggttttggataattccctgcatcctagtcctgaagttgaagcaaaacctctagtattggcattcttacatatgatgagttaatttctgagagggacgtacattctgattcaggctctaaaggatcgattaagatttttaatttatcaggaccaaatcagaaaaaatttatatgatttctatctgtatacttagaacagcatccataaaagaaaaatgttgttgaagatcaattggacattggacaaaaacctagtgggccgggccttctttgcatctactacttgaaagccttaaaaaagaaaattaattgaaaattaaattttacatttaagtgttagcatccaaggcccattagctcagttggttagagcgtcgtgctaataacgcgaaggtcgcaggttcgaaacctgcatgggccacctttaatgtttttacaacataacaatttttgattattttatactattatacaggtcagcacccctgactgagacagtatccatatctccacttcagatttcgacacgtggcaacaaaaaaaaccagacactccgattcccacgaaacaaaccaatcaaaatcgttgccttatcccaatcttatctcagcccttttgattattactctttagtctttactttgctcacagctttggatcaccaaaaaaaaaactcaagagagactttgtggcc

SEQ ID NO: 1423 - DNA, 3000 bp, Unknown
  misc_feature (1)..( 3000): cDNA_ID_3062286_gDNA_ID_1620400_Annot_ID_155932 3000 nt of promoter + ATG
taaaacatattgtaaacatcctccatgatgatttgacaaaaaaaaaaaaaagtcctccatgaggatcactattctcattaatcaataaagaaacctttttaagaaagtgttaaacatattgaacataaaacacctcttaaggacctcatgctatgaacgggatgggatgttgtatccaattagtttacacatatttaaaatttaacacttaaaaaccaaaatattatgtatatattagaaaataaaacattttctgttatgtaaaataatactttaaaaatcttaaaccttataatagtagtataaaaatattaatttaaaaatatttttaaataaaaacacaagtaaaagtttatatgtgtaaaacatattgtgaaaacaatttactttttaaacaaattgtgaaaatcttgtgataatcaaaagtattatgtatatttaaaaataaaatattttatataaattattacttaaaaatcaaaaacaaagtttaaatagtggtataaaatacaaataaaaaattaagtgttaaaaatttatatgtgtaaaatatattaaacctaaaacacctctgaaggacctcatattatggacgggatgatgtatctaatagtttacacatattgaaaatttaacactaaaaaatctattaaaaacaaaaatcaaaacaatttacttaaaaatatatttgtgaaaaccttgtgataatcaaaagtattatgtatattttttaaaaataaaatattttatctaaattgttacttaaaaatcaaaaataaagtttaaatattgatataaaatacaaataaaaaaattaagtgttaaaaatttatatgtgtaaaacatattaaacctaaaacacctctgaaagacctcatattatggacgggatgatgtatccaatagtttacacatattgaaaatttaacactaaaaactctattaaaaacaaaaatcaaaacaatttacttaaaaatatatttgtgaaatctttgtgattagttttaaatcagaaaaataagaagtggaaaacataaaatctttttgttccttttttaaaaatcaaaatcattatctttattaaaaagaaaaagggtagtaaagtaatatacctagaagtctgtgatatcctcaggcggcgactcgtgcttgttctgaaacttgaaaccacaaacgagagcgtcttggtgttttccttcgccatcctcttatttcctcgttgtctccggtgaaagcatctcggtggctagatcattatccggtgaactgaaatcgatcttgttttttactgtagacgacggtggattgatggagattatcattcaatcaatgaaacgatgatatgcttttcggctccgatcagtcttaaatcttacggatgttacagagatcatcatcatcggcttctacttggatcatcgtcgtcggcttctacttggatcatcatcatcgatcggaatccacagagtttatgtataaagagagagttttgatttgtctctaaaagaagaagatgaaaaagggtgaaatagagagagttttgatttgtctctcaaggaagaattagaagaagcgttgttgagactgcgtaattaagagacctagtttttatttataaggaaagaggttcaaaagaaaaaaggaaattggtaatcacaattaacggtcacataagatttgaccccaaaaaaaaataacggtcacatgagatttccttttttccttggatggcttttcatgggtttgttttctttgtttgttacgtgagagaatctgatgactttaagtaaagtgaagaattcactcattgcatgatccgatcataaaaaaacagagatggagttgatgattcgatcctcaaaagtatactaaccacaacactgtcttctttcatcaaaactagagagtagccgaaaaatgaaaactttattgattacaatctgactttctgcctccaattggttaatcctctctactagcaattcatctttctcattctttagcttctctaactcctcaactgcagctaaccgttgcttgtttaagataaggatatctaaaatacacaacaatacattcgggtgagttaactttcacatatgaaaccgaaaccaacctcaaccaaatttctttacttttttgagcttctataaagaggttccatatgtccttatgttttgcttcttttataatagaagattgtgcaagactttcctgtgaactaaaccagttacattctgctagaaaaatcaggaagtagtagtatacttcaaaaccaaagaagagtaacctgagaatcatcaaactcttcatgcccttctgatcttgaatcaaaaataatacagttcaattatagagaagcaaaatcaatctttgcagcacaaatcagcaagattgaaaaaggttcacttgtaacttctgtaaaccaaaattattgttaattgactttaattaagatatacgtcacgtggcaaaaccagctggaccacaagtgtttttttaattgactttcttgtccatgtgcctgcgtttactcctctttctcaaatctttcctcatttgctcactcccattctccagttgtggaaaccccccaaagacatggcatttgaaccttttgagtcatcatcagcgtattcattcacacgacgatttaggtcagcatttatcttctttaattcttactttcacttgatcctttttatctctccgcgtcgttaattgtgaaagtggagagctttacataattccccaaagtaaaaagcttcgaattttaattctcataacaaatttcacaacaggtcagcctctaatttggggaattctagaaaaccctagtggaaaattttaccaatttgattcttttaagtatacaagatgacaagttttgcttcttctgcttggtgctgtaaaaatttctaagtttagatttaactttgtgtaaatgcttggcttgttaagttaatttttgtttttcttctaatcctttggtttcagaga

SEQ ID NO: 1424 - DNA, 3000 bp, Unknown
  misc_feature (1)..( 3000): cDNA_ID_3062282_gDNA_ID_1620400_Annot_ID_155933 3000 nt of promoter + ATG
tctaagattgttgaggagagtttgaaggagaaaggcaaaagtaagcaatttgaagatgatcaagtggaaaatgatgaacagcaagctctgatggttcaggagagtctatacatggtggagctttctgctcaacttgaagaagataaaaacatttcaacaatacctccgctgaatgaagatgcgcagcttcagaaggttatttgggaaagcgcgaagggtaaaggccaaatagagcatttcaaagatccagtggaagaagatggaaatcttccaagggtagatctcaacgttaaccatcctcataggtaagtgtttgtctattactttggcggtttccttgcatgctttattacaagatagaaatgtcctgacctggttaagattatttcacttgtagcatatgtgatggttgcaaatctgcgattgaatatggaagatctgttcatgccttgggtgttaattggcatcctgaatgtttctgttgtcgttattgcgacaaaccaatcgctatgcacgaggtttagaaccgtatatgaaagcttccttttttatagtgattggtactttaatatactaattgagttgctcattatgttttctgatgcaacatctaactcctgagggctacttagttttcaaacacaaaagggaggtgtcatataacctgctacgagcgtagtcacccaaactgccatgtctgcaaaaagaaggtaacttcccattggggtctatgagttgaaagttaaataattggtatcttataacagtttacgacttatgtataatctgttgtacttttcctggcgatgatggatcttaatgtaattgtattcagtttcctggtagaaagtataaagaacatcccttctggaaggaaaagtactgcccttttcatgaagttgatggaactcccaagtgttgcagttgtgaaagattagaggtgggtttactttcacttcaatatgaatattggcaaatgagcatgagataaagaatcaaccgccatttcaaaagaagaagtaaagctttctcatgatttttttttgtttgcagccctggggaacgaagtatgtaatgcttgctgacaatcggtggctatgcgtaaaatgtatggaatgcgcggttatggatacttatgagtgccaaccattgcactttgaaatccgtgaattcttcggaagcttaaacatgaaggttgagaaagaattccctcttcttttggtggagaaagaagcgctgaaaaaagctgaggcgcaagaaaagatcgtgagtacattttttgaactgaaaattccttatctctctatttctctttcactcatatgttttgtgagtttcaaaacaagcaggacaatcagcatggggttgtaaccagaggtatttgcctgtctgaagggcagattgtcaatagtgtaagagcttatagggggtaacacttacttgagactaaaactagattggattcatgactttaactctgctctggtccacatatacaggtctttaaaaagccaaccatggggccaaacggcgagctagtaagcttgggtacagaacctcaaaaggttgttggtggatgtgaggtcactgcaattctcatcctatatggacttcctaggtacaataatcttttttaagctcatctcatccttctaagtaatctcacgcaaatagactaaatcaaatctcttttcggacacaggttactaactggatatatcttggctcatgagatgatgcatgcttggcttagactcaatggtactactagtacccaatttgtatttgccaatcaatatggagagagctctcaactaaaagtgctatttggtttgatcacaggttataggaatcttaagttagagctggaagaaggaatatgccaagtgctaggccacatgtggttggagtcacagacatactccagttctgcagctgcatcatcagcttcttcttcttcgaggactccagctgctaatgcatcaaagaaaggtgctcaatctgattacgagaagaaactggtggaattttgcaaggatcagatagaaacagacgattcaccggtctacggtgttggattcaggaaagttaaccagatggtctcagactccagcctccataaaatcctgaaaagtattcaacactggacgaaaccagattcaaatctttgaagcacctaatataggacaaatcgaaacatacctctctagaacatatatatacaaacgcacacttatgtctggtttttctttctggatccaaaatacaactataacagaaaaatagacatgagcacgtccaattatataactttctattttcagcacaatatcatttcatagtacaattatgacaaattaagacattgcatgtgtgctgctacataagtttcaatatcgaaaaactatgtttcacactttcttaatttaatttccagtagttgcattgtcattttcacaaaattaacccttttacttatatcatattttgaaactttcttatatttttttaatgaatgatagttagtaagtggctaaatgctataaatattttcttttatttatttatcatgattcttattggatgttgttgacaagaaaactagtactatttgattggatacagtatttcgcattaaggagctgaaacggcaacgtttcaagagggagggaaataactaattaaaatcgtctcgaaagggtaaacaattacgaaactgccaccaagaaatgtgcttgcggcacgtgtgcaaaaaaacagctggtctttcgctttggaccacaaaaagtaagtgtgtgtgtgtgtttctctttcttctccacacgccttgcattctactactttctttttcttttcttctctcaaaaagaccaattcaacacagtagctgctcaatggtctttcgaaacttctcgaaattctcgtggaagacctcgcgaactttccacttgaggaaaagaatcggaaaccggtttgggctacaacgagacccaaaaagac

SEQ ID NO: 1425 - DNA, 3000 bp, Unknown
  misc_feature (1)..( 3000): cDNA_ID_2136312_gDNA_ID_1620400_Annot_ID_155928 3000 nt of promoter + ATG
acgttcaagggctacgacgatgaagaaatcttgtcggccaagaaacagaggaagtggttcaagaacaaaaaggtcatgaagatgaagatgaagaagacgagtgagtcatttggaaactcgctcaagtcttgtctcaggctcttgttctcttgcttccatgtctaattctcatctttgttcgataacttttttttttttttttttaatcgtaatttcaatctatcttcactttgcctttggaataatttcgaactccttgtataagttaaaccatatactgaattcgaatacgttcatattttggattcgatcaaatgagtatttctcgtcttttgtttttgcatagacttcgataattgaccgacggaatgtagctgttctgcttcttaagcgttaaattttaaaaatcttgtttatgagtccaacgagaaagttatgaatatataaagtttagttaattatgtgagccggcacagtcgagttcttagaaactttcttcaaaaacaattctttatattgttgtaattctgtattttatttttgagagatttgactcatgtttattttctatatacatacattgccatcgaatattacgacaaaaggagaataacatattataaggatacaatcaatttttactaagattataaaatatgagtagaaaggatagaaagatacgtgtactgactaagttggtccatcgcgatcaatgagtagataaatcgtactgacagtgattcttatgttattacgattttaaatcactaggatcctggattttccacatttgaatttaaattgtgacgatgaaaaatattaatgtaagttttttgggataatagttttcttgttaaaaatgaaatgaacattgcgtaggacgtttaggctttttctgtacagaaatgactaatgaggcttgaattgtgacgatggattctaaagacccaaaaggccccagcaccaaaggcccaagaaccagaggctctgctgatgtcaaaaccccctcattttgtatttcctctggatataaatccacaaaagtaaatgacatcaatccgacaaagtttaaaaacaatcgcatttcttgaatatggctaagataacatatctcggatatcgtgaatatatgtccgacgttattcacaattcgaggtgattagtgataagctccaaaaacaaggtacgtatatgttagtttaccattaccaatactctctttgttaaactcttaccattactcatcaaacttaaaacactcgcaaaatattcatatacatgcagatgcaggcccagttccaaataataataaaaatcaaagatttcaaaaccaaaatcggatcggatacgtaacgttatagtatactactttttttctataacgactagttgaagcgtatgacgacaatatagagaagacctggattgtcccacacctttttttatgcattgatcttcggagaaacactaaagaaaataaaaaaactttatgtttacacatttacaattttataatgggttcgtgtgtggattctttgacaaacgaaagtccacttctcacacaaaaacaaattctccggacatcgcatttgtcaatttttctctccaaaaaaaaaacacattagacaagtcagaagaacccaaaagataccatctttccaaaaatttgatgtttcctttttaacccttttttactttcatttcttttgaggtcagttttttttctgtcgtcttccaccttctttatctctgttgagcgagttacatttggaattttatcactttctttcttttgatggtgtgttggatgcattcgaccatgtccttggtttcgggtggattttatttaatgttattatagcggtgatttttggcttttcagaaaccggagaatatgtgttcacgggtttattgcagactatgtgttcgttgaaatgtctcactgtagacggtagtaccatctcctatgtcctggcttctgctgctgctgttgatgcgtctctttaccattggtaatcttttttatctactcaaccaaatttgactcgaaaagaatttatgattcagttgaagttttgtatactttgaatagaactaaaagtctaaaagtatgaataggattacattaacattaagtaagtaagaatgtagtttcatgccaatggggccatgtgatttaagaactgtggaggagttagagggacggtcaacaactctgacttgcttcccaacaagtaaacttatcaaatcaattccttttttttctactttgtgaatccattttatattcttttttccttagtatctttagttgttaaaacttatgaatattgaatagaccatcagctaatctatgaaagcagggtattattattataatatacattaacataatctatagttttaagaataataaatgttttatctagtttgatgaagataagcaccacagtaacttttatttccaaggcaaatacacttttgtcactttgtctattttgattttgaccatgtatgtagatttctagctctctcctttttttggccgatttggttgagaatttgacgacgactcgtggggtcgtgtacacattggtgactggtcttttgacacgagtcgcctctcttcttctccctacccatttccatgaaaacatgagccatagctaacttttcttcttcaattgaaacccaccacgcttcttttgttcatttttaatatttaaagcttcctcctttattgctaaaagattgaagattcgcaagtttttatagtttccgttggccttttcaggtgaagaagattcacttgccttttcttctaaagtccccaacttttcagtctatctcccattgaagctcaagctttttatgggtttctagcagaagctctgctttggatagtgacataattgtcgctacagtctcttgaaacatttgctgtaactctttagctaaggagaaaaagtcagctcctttgtggtcattctgagacaaatg

SEQ ID NO: 1426 - DNA, 3000 bp, Unknown
  misc_feature (1)..( 3000): cDNA_ID_2136298_gDNA_ID_1620400_Annot_ID_155924 3000 nt of promoter + ATG
ctccattttcatttatcataagttttaactatagctttattatgaaaattttaaataaaatccatcttttccatgtacagttttttactatttttaacaatagtttaacattaccgttacattatagttatatatattttttgtcatctcaccaatcacaaccaaacctttcacatggaattaggctatctagctaattagtcatggaaaattaggttatctagctaaaaaatcttcattcttgcaatgatagtaagaaattggaattctttatattggaatttttgtcttcccgaaaatggtgtttgtgaaaagaaaaatatgtaaagttgatcctccattctttatcacagcctgtaatctgtatgatccaataagaagatgtcacatgtaaatgtaaaataggtattcaaattgtggaaaagaaaaataggtattcaaatggggcatagttatcgaccaaaaaaaaatggggaatagtttacaagccataaaaacaattgggcctatttgtaaggccttacagctatttgaattattttataaattatcaaacattattggtgataaagcaatttacgtttttcaaaggggttgcaattataaatacccttgggcctgtttttgagcttctcgcacatatggaagttattgtgaaaatcgtacaactactaggactattttataaatactaaacactaccggggagaaagtaacagagatagaacaagtgacatagactctgagtgaaggagttgaaacgtgtatgaccagtggaagaaatgggacgcggtggtgatcggcgcccacgttgtgtatcacgaccatctctacgaacaaacatctcctcaaaacgatgtgttttgatgatgacaaggatgcagccagaggggaagaagttaacattcctgatggctcctctaagaagatggcctagaagaaagaatatgtcttcttcaagaaagctcgaaagctcttcgatattgacgttatacttgactctgatgttcctcaagaaggttccagaatcagcgttgtggtttaccgtttcgccacgaaacagccaaatcaaaatggtttgattgtttcgtgtgtgcagttgcaaaaatgtttgtcatgtctattcaagtctattcatggaaattataagcatttaagactattcagagtctacgtaaagtccaaaagaaaaaaatcaaacgaagcagcctctgaacaagggtaacttcctacccatagaattttagattcttaaatgaatgtttgcttcttttggagtttgtggtctaaactttcgttgaccgtttattgtatatcaaatggtttgtttaatttaagcgagctactagactagtagtttgtgatatagtgtatgtcaattaaggataaacacaaatgttacatttatgtgattgatattctgtttttttctaaaaattgacagaagcgttttagttgtgaacaaatttcaacgtatatgttaactaatgtttaatggtgtgaaagtttgaaatggacgagacgatgtgaggagaatatgaaaccacaattgtttagtctttcgtaactttataaagccaacattccatcaaatgatatttctcctaacacgagatcataaggaataagataaagcaaaagagatgaaggaaaaatgaatgacttccaaagttctcttcgcaaaagtctacgcttactttgattgtgtttcttttgttgtcttgtgctattagtagatggagtccaagatattgcatccatgcttaaaaagatcaagaatacaccacatgtttttgggggaaaagtatattaaagcccaaaagaatgttttggaataagtatatatatattttgatacgatttttgtttcataaatggaaagccaaaaaaatgaaactatcatactaagaagttacatattaatagacgtatcttacatcttcataaactcccaaaaaaccctaaacctaagtgaagaaaatgtgtactagtatgagatgatagatgaacatatttagataagcattaaaaacatgaaaggaaatgtttgtaacaatcaattccaaagaggggtctactacaaacatatataataaacacgagcaaccgtaatgtttgcttccacattcaaaatttcaaaaaggtcgaattattagtgtattgtttttgtttgtttggttttagactgtggatgaacaaatcaatgcattgataattgcacatacttttttcttttctcttgctactcactttacatctgtaaatattgcaataaatttcatatatatatatatatataaatttagaaaaacaccaattaatgtctccttgcagtccacatgggcttcctaaacgtcaaattttcccaattttcagaattaggtgaaacgttattatatctaaaaaacagtctagataatatgtctgccacttaaacaaaaagcagcttcctcttttgtttagttttgatgatttatcaaatgaatatcaataaaaaaaatacgaataaaatcaattaatatactttgtaatatcaattgaaacaatgcattacacattaaaaaagaaatagtaacacataaaaagaaacagtggaaagcagaaaacgagaggggtgtgtatatattactaaagaattagtttaaatgattaacaaatgagtgggatttttgcttctcccaaagcgtaatttatctgaaaatgtgtctcgtgttgagagtagttgagattcttgctgttctccaactaaacattaacttttattaaaattaaagaaaataaaaagatggatcaaaaacgagatcccctttttcgatatccgaataatgtttttctttgcttttaatgtgtctctttcttatgatttaggattccaattccttccctttccccttcttgttctctccatattctcctctttagaaagagatagagagagtcttgtttttttcctgtcttgagtgatatttttttcagagccctgagttgttgtctccatta

SEQ ID NO: 1427 - DNA, 3000 bp, Unknown
  misc_feature (1)..( 3000): cDNA_ID_2991424_gDNA_ID_1620400_Annot_ID_155918 3000 nt of promoter + ATG
tatcaactttttcttctaatatttttttttttgggttcatcaggcttcttctgcgggggcctccgtgagaggtctaaagggttgtaaaactctcaataaggatccagaccctaagaacccaatagagggtaaagaagacaggttggtttggtatttgtttttcttcattaactacagatcttatttattttatttcacttgtttcatggttgtaactccttaatttctaacatttcagggatgcagtcacttttcctggatttgtggataccgtctatcttgatgctcccaatgaattgcagtttgataatggcttgggtgataaaataatcatcaaaaacacaaagtacatttactgagacacttatatggctttctacagggtctatgtttcgttctgtgcctcatgagtactacttgtttttgaaaaatgcagttggtcggatgcggtcttgtggaacccgcatactcagatggaggcttgttacagagactttgtgtgcgtggaaaatgcaaaggtatatcagtttacacttaagtctttcctctttacaaaacttatagactcaaaagtttataactcttccttgtcatttttaattctcagcttggggatgtcaagctagagccgggacagtcttggactgcaacacaacttctcagcatcagttgaaaacattgtactttaaacttataatgtccagtggatccattttcttaagcaataaaagttttatttcctctcccaaattttaccagtagtccccacaactgcatttcccatctctgaaatgatggaaccttgtcctatctctcattacaatatccctcttgtatatcttagagatgagcttcgttactttgtgacaatctttgcatactcggagattcttcattatacgaataatggttcctggtttagtcttgattaacccgtatgtaatagccaatttctcgctatgctgatgcacaatagcctctctttcatcatcatcaactagatcaagcagcatctcttctaactctggtacgtacccgttttcctcaagtttccttctcatgattctccatttagattgaattttctctatctctgggtgtgatcggtctcccgctaaaaactcgtgtgtggtcccttccaagctaattgtactacatcctggaacttttgctactccttgttctttcatcaatcttcttgtttcagctgctttgtcccactttttatccatagcatgaatatttgccttatgaacatatcttccgccatgatatggatctattgcaattaagatttctccaatttcctctcccaattcgatgtttttgtgaattcgacaggctttgagcaacgcaccccatatcacagcatttggcttcaatggcatctcctgaatgaaacgttttgcttcatcaagcaatccagctcgaccgagtaaatcaacaatacagccataatgctcgatggtcggtttcaggttgtaatctctctccatgctgtagaatatcaactttccttcttcaactagtcctgtgtagctgcaagccgtgagaaccgcagtgaaagtgatcacatttggcttaattcccatcttttgcatctccatgaatttgctaatagcttctcttccatggccatggtatgcatatcctgaaatcaaagctgtccatgcttgcactgattttttcttaatattcttgaaaacttccaaagcttcttccatttcaccgcactttgcatacatatctataagaacacaacccaaaacagagtccattctgattcttgtcttattaagataggaatggatccatttcccttgctcgagtgctccgagctgagcacaagctgagagagcattagctagggaaacattatcaggctcaacatctgaattctgcatttcatgaaacaattgcagagcttccttgttcatgtctgcttgaacatacccagagatcatcgtagtccatgatatagcattcttttctgccattttcctgaataacgttaatgcaatatccatttttccagcttttacataacctttgatcacagagttccacgagacatcatcaggttcggggattctgtcaaagagaaggtgagctagcttgaaattcccggtcacagcatatgaattaatcagagaattcactgcatagacatcattttcatatccaagtttcgtgatctgtgcgtgaatttgcgttgtttcttcaaatgcagataggttcgaacaagctttgagaagagacggaaaagtatacgcgttatgaggagctgaagaacagagcatacgttgatacaggagaagagacctctcgggttcgtctgagcacgagaaccctctgatcattaggttccacaagaaagtatctggtcgatcaaacccgtcaaacacaatctgggcataaggcaaaaagtcggaagacgttgaagaaatgcagaaagaaagaaactttgtgattgcataagaatcctgcatcaagccagttttcagcatgcgagcgtggatttgcttcagttcttcttgctttgagcatctctggagacaagacattgtctcgtagagattatgttccaatgagaaggagcatgagatcacattcattgtagttcattcgataaaacagagagacctcttgagagataaggttcttctttggttgatgttgatgataactatattctcaattctcagtggacgccaaagtgtgtgccgtttgttcgagacttaaaaggataaagtgacgtggcgaagaattaccataatcaccataaatttacctcctaattttaccaacagcaacctgaaataacatgaaccggataataacggtccgaccgaaaattgagcacaaaaccaacaaatggggatgagtcgtcaaagactgcactctctcctcttcctctggctccggcgaaaaaccccttttcgatttcattgataaaacgcaaatcgatctctcgtgtggaagaagaagaagaacacgatg

SEQ ID NO: 1428 - DNA, 3000 bp, Unknown
  misc_feature (1)..( 3000): cDNA_ID_2136223_gDNA_ID_1620400_Annot_ID_155904 3000 nt of promoter + ATG
cccagacattatcgtcctctgccacggaggtatagtaacttctaaaatccatcattcactgtttgatatagaagttttgttgtagtaagctttttgtttttaggtccgatatcgggtccagaagaggcagagtttgtgttgaagagaacacagggttgtgtccatggcttctacggagcatcaagcatggaaaggctacctgtagaacaagcaataacaaacactgttcaaaaatacaagtccatatcgatcaagtgaagtcaaaataataagttcacttagaaacctttatctttggtgtttctagtatatttgcatgtgttgtggcctatgggtgtggatgtttccttttgttgcatggttttttttttctggtcatctttgattgcctctgcaggatcttatatgatctctagttctgtattacacgtttttgtattttaataaagttcatagtgctcaactcttatcatttcttttcaaatcttgtcattcacctaatgacttttgtttatatggttagacaccataatttgcagttttcaaataaacaaaaacattgtggaacgaaatttcccactataaagacttatagaagcataagattcatagaccaaacaattcaaacagagcagcggtgaaaacaaaatacaaaaaggctcggaggtctactatgagaaaagcttcgagatcaatctgaatcagagtcgacattcgctgaagacctaacggaccgacgtatgctttcttgatactcgtaatcttcctcatcttcctcttttctcttttcactaagcattcctgtgaaaaaaccttaattcaacgaccaaagctgtaaactataagtaccaaaagcccagaatgtgagacattgatgctacctttcttgaccagaagattctccagcttcgtcgtggagaaatcgtccttggcacctagatcttgaaacccgacaagcctatccatcgcgattcccttgctgaagaataatgatttcaacattcgtgttttcgttagtttaaacacataaagacctaactgcgctaagaaataatgagtgaaaaatgtaggagtgacctaaaaaggataacacacggcaaagtcttgattgcaagcttggtgacgaagaagggagcgttctacatgaagtgtctcccaagtattagaagatggcaaaatggagtttcaaagaagagttaaggaagtggattactgacctcagcgtccatcttaatgaactttgtgtccacatgtctaggagcaagggtcttcaaatgcttgtccattatcctagaatgttcaaacgcataagcttcaaattctgaatattcacatatcaaaaaagtgatgcgagggagagaagggtatttcatcttacttgcagcgatagaactccttgtggtagaagtgacatataactttttcactccttgtgacttctcccaagaagtcgccttcgctaacttctcggtattcaccatgtccttgtcttttgaatgcttctctcttttccacttctctctgtccagacacatcttgggattagatcatagtccatactaatgaagacaaaagtgttaaccaaatatagataatgagagaatgtggggggtgaagttgaaccctgagtgctgcaatcctatctgcgtgcaacttttctagctctggatcctacagaacaagagcaagtcagtctcccatagagacagaagagaaacataacatttcattgtacagattataaaagaacaattcaaagagagcccccattgaacttacatccatcaattcgtcaagatcaacttcctcgttgacaggtcttgatccttgtgccttttcatttgcaagaacttcctgcacaacaaaaatacggaaatgtttttgatccaagaacatcaaactctaattgcaattgtaaccaacaaaaaaacacttaaaattcgctatacactatcaaatttcctgacacgtagacctcatgtcagcacaaatagaatctagcctatctctgttaattgggttaccaaacaacatgagattgattatgtggaaaaccaagcacattatttaccctttgaaaatacgcgaaatcaagatccaagaagaatttatggagaacagcttcgaagtacgaaataaacaatgaagattaaattacctttttataatctctagcagctgccgccaatacattcccgaatgccagattcgagagggtcgacttcaccgtatccggatccatctctttaccaaccaactaatccaactcagaaaattttaaaatctcaatcaaaaatccctctaagatagccagagaagagattgtaaacaaggatttgaaatctggtgcagagaggagaaactccccgacaatgaacaccaacgatctaaacgcggcgtttggtaaaagttgagtaaattttgttagggcttagttttagtccatgggctaattagtaagtgatttacggcccacacatgagcccaaatgtttcagacccagccaagtttcttcaaattcacccaatcaacgacgatgtacgtgtgtatgaaaatcattaacacgacgcatcgctttcgaggaggagcattacgtgtcctgttagctacgataatgttagtaccgccacaaagaaaaggatagatattttgctttccagcaccctgtcatgggattgatatgaacacgtacttggtatcgacatgaaagctcaaaaataaattcaatccgattcctttagtgatatcagaagttcattttaaatacgaacacgtatggcgaaacaccacgccgacattttctgctgctgccacgcgtcactttccaaatattgattcattaaactaatagttgatccatatccgaaaccggactataaaactatcttcaatgcgttaacgaatcttcatcgatcaaactcatcaaagtctaatatcacaaagaaagagtttttttaactagcttagctcaaagtgtttgcttaagacaagaagaacatg

SEQ ID NO: 1429 - DNA, 3000 bp, Unknown
  misc_feature (1)..( 3000): cDNA_ID_2136227_gDNA_ID_1620400_Annot_ID_155905 3000 nt of promoter + ATG
gaaaccacgggctgagtttctgttagggtttgatcgtttctcgctgattatggttccactgctgtccaatagtatggaagcatcacatccctgcagcacaaatatatatcacaaggataaaaatatattaagattggaaaatttccgtatgtttttaaacgttacgaaattttgctaagcttgagaccttgacgaaacagtcgtggaaatggagtctgagcaaggaggcaggcatgcgaggatcatgttcgaatgctttagcgacaatggactgaacaatctcttgagctttaggacacgattggtcataaaactgaggaaagagatagccgccacttccataggctttggaacacaaacaaaaaggagaaaatgcaatgagcgagagagctgcaataaggatgttcaatgacttggccattttttggggggattctttctcttgatgactcgttgtatataactcggttacttgtacttggtgattgtgtgtgatgccaagggttgcatttatagagtagactttgtggacaattgagaaagacgttggagttggtatctaattttagctatatattggattagatggatacattgatatttgaattggtatgaatacaagatttgttagaattcttttcgtatatttctcatgtatgatcactttatgcacctcatatcaatagattattcgcagttgttgtgtgggatttttgttccatgcattagcaacacttaaagcacaattttgcttttaatagtcaacgcggagaagatttctatggggatttatgttttattaaattgagagatcagcctgaagatgattaagctacgcaaaacaattacatccatagggttttacttggttgaccgttgaacaaatagtcaaaaaaaaatgctaattattctgcaagcaaactaattaacattgtgtgcttaacaaatagatacggttgatagagtacgccaaagacataataaacgctagataatgacaaaatcattgagaaacagcttcaactgctctccttcacaaaaccaaaccaactatgtccttttcttttcgtgcagtaatggcaaagaagaagaagtcgtcattttaaagaaatatcaccggacgatgtattgagactttttcaatgtcttttgatcattttctcacgtcttttacctacgttcagaaaatacagatcactaataaaatctctccatttcataggcccaagcatcaaattatgattcggcccaaggttaaacccagcaaaatggggaatacgagttcgaaaacaggcctaatcccatcttaacatgtacgtctacactctactacactaattgtagtgcgttaacggagttcacagtggacgagaggtgtaacacaaactaagcagaagaaagtagatttatatagatgtgaaattacataacacaaacatctcagaacataaaaagagccagatgctcattacacactcatgtaagtaaacaacacacatcgcaggacgtacatacataaaaagcacaatacaacgaccgaatgcgactgcgttacaaaccctcattatttttatttaatatgtatacacgattgttcgaagcttaacggccaccaccgggaagcttttccttgatcttgtccatcatccccttcttctcgtggtgctcaccaccgtagccaccagcatcatatccggatcccatgccgcccatcgcttgagcttgaccagactgatcatgatgacctggcaacttctccttgatcttttgtgttattcccttcttcctcctccctccttgtccatcatcctcctgttatacatataacattcgaattacgcttcacatactaaactaaaacatcataaatcttctttatacacttgatacgtaccgagctagagctggatccagatccggagcggtgaagcattcctcccaagccaccaccactttccttgtggagttgctcttggccgtggtgcctagctcctccgccagttccaaagccttcagtcccggtcccggttccgtatccttggccaccggttccgtacccttggccacctgatccgtacccttggccacctgttccgtatccttggccacctgtagctcctccaccaccaccagttccgtatcctcctcctcccatcggatttccgtactcgtcatactgctgctggatcgggtttccgtactcgtcagtggcctgacctcctggacggttctggtaagacgccatgttcttcttgtcttaagcaaacactttgagctaagctagttaaaaaaactctttctttgtgatattagactttgatgagtttgatcgatgaagattcgttaacgcattgaagatagttttatagtccggtttcggatatggatcaactattagtttaatgaatcaatatttggaaagtgacgcgtggcagcagcagaaaatgtcggcgtggtgtttcgccatacgtgttcgtatttaaaatgaacttctgatatcactaaaggaatcggattgaatttatttttgagctttcatgtcgataccaagtacgtgttcatatcaatcccatgacagggtgctggaaagcaaaatatctatccttttctttgtggcggtactaacattatcgtagctaacaggacacgtaatgctcctcctcgaaagcgatgcgtcgtgttaatgattttcatacacacgtacatcgtcgttgattgggtgaatttgaagaaacttggctgggtctgaaacatttgggctcatgtgtgggccgtaaatcacttactaattagcccatggactaaaactaagccctaacaaaatttactcaacttttaccaaacgccgcgtttagatcgttggtgttcattgtcggggagtttctcctctctgcaccagatttcaaatccttgtttacaatctcttctctggctatcttagagggatttttgattgagattttaaaattttctgagttggattagttggttggtaaagag

SEQ ID NO: 1430 - DNA, 3000 bp, Unknown
  misc_feature (1)..( 3000): cDNA_ID_2136144_gDNA_ID_1620401_Annot_ID_155953 3000 nt of promoter + ATG
ttgtggaccctcgacaacgttagaaaacatcttctgctagatgtttgatggcctttaatagctaagtgatttatagagaacgacatataatgggctttagtttgggccttttaaaagccatagtatgggcttatttgctttgtccaagttcagtattgggtttataaggaaactttttatcgtgaaaaatagagtaatttatattcacaagcagatttccatttcgagttattttatttaaaaaggctgtgattactgataagactgatattattgagtgaaggaagtggtgtgggattctaaaattgctttgaacgttttgaataatcctgtcataatgattatgacaacactagctttatcatgattaccacctcaatcaatgtttaattaaccagataataaacgaaaaaattaacgaataagaagatggcagtgtattaaaatccaagcattgacccatccgacccatgatcttctcggatttgtcggtatcattacatgctgctaaatagtcttctctaacgttgattttgtctagccacatcaagaaagaaaaaactatattcaaaagtttaaatgttagggaaaccatcacataacatgcatttttaccaaaaaaatagttttgaaaaatgaaatattagttgaagttgcagagattcgaattaaaaccgcgagcctcttgttaaaaaataaatccctcaacttcaaaactgtagtcataccataattctggcttgtgatctcaatagaaatagtatcaaagagtgacaataatgagtaatgacagaaaatgagtacaaaagtgttgaagaaaaaaaaaaaagtgttgaagaatattatttatcttgagctttaagtatatttataacacaagcgttgcagatttatgtttacgtggaatagaagaaaacttttttccctcaagatttttaattttttgcgtagaggaatatttgtttcttcttcttatatattgacaataatgtacatgctatttctaaccaagagaaatacagctagaagttaaaaataaacaaaatataccaacttgaaaaataagaatgaaaattattatttaggttttagattgaacctcttgattttgtatagtcactaatgtttctgcattattttgttagtaaaaggataagatattaaataatatgaggaaaagaaatggacatccccggcaaatgaaaatggaaaaaggtataataaagatgaaaaaaagacaatgataaagctattttggtttaaaacaaattaaaagaaaaaagcaaaacgctagagagcgtgtggttgaccccttcgttctacacttgtcgattaccatcaccattaccattaccattaatctcttaccattaataaacataaacacgcacaatgagagtcggtggatgaatagatcaatttatttttcttttgcataatttaaaaaaaaaaaactaaaacaatagaaagaataaaagacaaaaaaagaaagaaagaaagataaaagatagagatgtaacgttaagcccgttgtgtcactttattccaaagttgcatgtatgggttgggtcttcttctttttttcttccttttgtattcactactaaatatatttttaatagattcgctataaacttgatttatacttattacctatttcatgtaaaatatttcttcttgtctaccaaaattcgttgttagaatagtaaactaaatctttcaagttttaaatatcaagcagtatcaagcagagcagtacaatggagacactttcttatattaataatatacttgcttgtgacatagctaaaaacaaccgacacttttacattttgttttcaactcgagttattgtttgttagtattaaaaaacaaactttaaatagtcttttgaagtttggaattgttggcccatattatgttgtaggtaatatggaatcagccggtacactggaccacagaggattgtctttccgtctacagtctacagaatcagccggactagttttgtaacttttgtttaaaagagctatttattatttgtaatcttagtttttaagttttaactaaaagaatgaagaaaatgtagacaaaatcgaaaagtcgatggtggaggtatgtacgtgtctttttcctttgtccgtcttgaaaccaacgaaacaaaatcggaaattgtctacgttaaaggacaatcacattcttagttaattaatactccataccaagggacatttacgtctttaagcaccaaaaccatagtattggattggcgaaaatttccaaatttccaaagcaacaagaccatgagagtccatccataatcatttttattataaacttaatagtcaatttccatgaagctggacttgaatagttaggctgtctattcttcgtttttatgtcttttacgtgaacaactcgtaattctttatctgtttttctgaacatatgtttgttgtcgcacacgtataatacaattatacaaatacatttgtttttagtctaaaaccatctacattgggatattttataagagttttttacaattaaaaaaataaaaataataaaaatgaaagaaagaaagtgaataattaaattataatataatattaatattttttttgtttgaaaaactttgtgggtttctgtcctaaattatttttttaatcattttattaagtactggtaattactaattaacggatagtttaaaataagcagattaaacgatcccggaatgctgacgtcagcatcataaatctcagatctcgatacgaaacgaatttctcactgcagcagctattactttccctttttcaccttttttttcctttctttttctttcttttttccatttcttaattttttcttcccattgaagattactctacgatctgacgaacaaggcaaccaaaaaaagggcaaagaacagagagagagcaaaaagcagaagaagatgaatttagacgagaattgtaaaatagtttatcacgattcgcc

SEQ ID NO: 1431 - DNA, 3000 bp, Unknown
  misc_feature (1)..( 3000): cDNA_ID_3062357_gDNA_ID_1620401_Annot_ID_155967 3000 nt of promoter + ATG
gatctttttgaggagcatcaagactggcttactcaagataatcttcataagctctcggatcatctcattgagtgtgattatgtaagtgaaccaacggtctcaaacctctcaaagtcattgaaatctcgatgtgggtcttcttcttcttcagcacaaccattgttagccgtagatgtaacaactcaaagtcagggcgaaaaaccggaggaagatttgcttctgcaagatacaacaatggaagatgataatagtgctaatggtgaagcttgggaatttacagagactgaactcgaaacgttgggtctagaagaactcgagattgatgatgatgaagaatctagcgactctgattcactttcagtttatgacattctgaaagaatgggaagagagtagtaagaaagaatgaaaatgcttgtaaatttcctcaaaatctttagtagaacaaaatctcaatttttttgcttactcatctcacttcaaaatagtttcaaggttactaaacagatcatccacatacaataaaagatcagttatacagaatctcagattcggagaaagaacatacatatgatcaaactgcggatttacactgttactaaccaaaaaaagagagcagataggtttggaaacttaaaaaactctgcaggtgatgagatatcgcctgattcaagatcggcactcttaagaaaccagtaaacccactaagtatatatattttatggcttgctttgttacagaacttccccatgatggctatttctttctgtttcaccaaggatgattacggatcctgaacttcaaagctttcatggctgcctttgcaaatatctgagcagcttcagcttctgcttctgctctttctgcctcttttgctgcttgttcagcctctgtgatagcaaattctgcctctgcaactgctcttgctgcagcctctgcagcttcttgagctgtcatgccttttatcatatataattcaccgtctactcggaatttagtgagactgttggcaccgttctcctcgggttttgttgggtctttcttgttgtttccttccagaaagagttgaggagccttctgtcttgcacctgcgggaataaaattagaagaaaacctgtacttgtgctttatctgaaagtgagaaatcaccaagtaagtatttttgaaaattctgagagtaatgaagtgttagtgatcatgaatcttgaatcaaaagttgtgtgtttaccttaactaatgttccattcgatgataaatgctttaatcgtactgcgacatgccttttcatattcggtggagtcttgaaattctcctgaaatttaacagctactaagtaagtatgcaacaaaccccaaccaaacatgtaatcccaatggtagaaatacctctatatacagaaagattgatgttctgtcagaaccgcgtagttccctcaagttggtaattgcctcaaagatgatcttatccaaactacaaaaacagacaatagcgcaagatcaaatctttatgaactcaagaaaatcgttatgtggtgcataagtcagggaaccaaaccttgtaattgatctcttagaagcacaagtgcgtggtgatccaccaccagaacctccgggggaagttggttttgcacgttcatcatcattagtcaaagccacaatggtaagagctgtgttgttatcatcctgtttagtacctggtggagtcctcttaagcgcaagtttagccttcttccttgaaccccataaagctgtcacgcttatatttctccatttgtcctgttatgccttgaactatcaagattagtccgaaacacgcgatcacaacctccaaaaagcatattatattgtattaccttaagatcaacattagagcgagacttaaggattaaactaaactcagtatccgagagtatggtacgccacttcccagtcccatgcttaagaactccagctttaagagctgcttcttcttccggtgtccacttctgctttggtgcacccatccacagttatcaatatttgaatttcttcttttctctgccaatagatgtgaacgctaacattagaatctgttaaatcgtacgaaacttaaccacatcaaagccattgttgaacatttcttatccaatacaaaattttggtcatctaaatccagcagatacacaaagccacaacataaaaatgtaactacacaaatccaaagaaattagatacgccccaaagctcaattcaacaaaaaaatgagtgattcgagcaatctcgaaccaaaaaaagaggatcaaagcccattaacaacgtcgcaaatcaacaggaatttggaaatacagccatcaatctaaagcgatagctaaattatcaaccaaattcaaatggggcgatcgtagaaaattaaaaacaaaaatggaaaattcagagaaggaagcagaaaggaggaaggaggagaagaagcatgccagatcaaacgaaaccaaaggagagttttcgagagagagacttgatgatgaaagctaattccttgtatagatgtgtcatagatcaaatgtgattcgctgaaacgaacgaagaagaagaagaccagagaggctagcataaggaagaagaatatccatagaaacgagaaacaaacttgagcttttcttttgtattcaagctaaggaagatgtaaccctatatttctccacattcacaaatttgcctcaagtttatcaaattacacaataaaacctaccaactaaatgaataggatcaagctgaataaaatatactagtactattttttaaaaataatgtatctataaaatttatcgttgttaaatctcacagatagtttaggggctattaaagatttttcatataatagtaagaccgaaagcgtaatttataaaattttgatggctagattgaaatatgtgttttttttttctttctaaaatctacagaagtagaagaaaccaaagcgaaatcaaaaagctcagcaattttccagatttctctaattgacg

SEQ ID NO: 1432 - DNA, 478 bp, Unknown
  misc_feature (1)..( 478): cDNA_ID_2136202_gDNA_ID_1620401_Annot_ID_155973 3000 nt of promoter + ATG
cttgtaaaagaagaaaagtatttcagttgttggatgcgcgggaggggaaaatagtgtactgctgatgggctctacgcttgggcttttatcttcttggcccagtattgttgagttgttgtttgtcttgttgtgggccttattgtggcccaaatagtgggccgagtaacatgtgcaactttatctttgatcacataaagatagagttggtgtttagtagctgctactcccaccaccattgacattgttttatgtttctccgcatagccaagttgtgaggttatctcttctcgcaagataaaaggctaaagaagtttttgcttatcaatacacactctacggacagtttacggtgtaagcgacaacaaaccagtttcatgagcatcgtcttccccatatgaagctagttcttcttcatcctcacttctttcggcaagctataaataagtctaaagatgttgtactaatctgtggagccatg

SEQ ID NO: 1433 - DNA, 3000 bp, Unknown
  misc_feature (1)..( 3000): cDNA_ID_2136195_gDNA_ID_1620401_Annot_ID_155971 3000 nt of promoter + ATG
ccccatatgaagctagttcttcttcatcctcacttctttcggcaagctataaataagtctaaagatgttgtactaatctgtggagccatgccggatatgacgaagttacaccatcaccgcctacttgatctctccattctagaaaatctttttgtgaacagagggaatcataagaacagagtgaagtgtgttttctcgtccatgttttgatgtcttatatgggcgtttcaatggactttggtgaagtgcagatagtgagagtctaaaatgctttttgttttgtctattttgctcaacatctggtgcctccatttgaatctttattggaaagtggctttgttggctgggagacttctacatttttttggctgctgtgggatactttttcatttgtggcttctaaaaagagaagagaagatgtgtttatcaaacacttggggttctacgttggggtcgcaacatgtcttaggtggaaggataatgtgttgaattgtaacgagatcaacacttgtggacttttcggaaatcatactattcacgagaacagtcgctttttggttgtaatgagttctttcgacgccgtaccttttgtcggtgacttgtcaaaggtccacattttgcaccaccaccaggatcttgtcaacatcaagtcagcattgagtggagcttctaaatgggtaaacagaactgttcgtaacccacaatcggatttctgttacatgtccacaatatttatgtgttggagtgacgttgcttacacaacaagcaagctcttgacatgtgaacatgaatgcagtcaatgttgtgttcatgtgaaagttacttgatttcagcttggatatgcaggcaacaattaaatggagaggaaagatctgcgaggtgatgagtttatccaaaaagacagaggatatcttggtcacatgtgttcaaggaatcttggaattcatttaacaaagtttttatatggaggaagctttagcaagtcgctcttgaggctgaaaaggaaacgccataaagttcttaagagaaagtattatgaattggtggacaaaggatgtcttcaaagatttcagatttgggtcgaatctttctaacccagaagggctgatgcagcgtatctcaaagacgaacgtgttgttcgtcccgtttgggctggctcgttgtttgggttttgtttctcatgggcttcatgtttatttagccttttagtacttgtattcgtttgcttctcttttatgttagtttttttttttatctttctcttatttgaaaagacgtaatttagtattgtaattagttttgattattgattaaagagttttaaagagtgttttgtgtaaagcctataaaaaaggactcctaaccctaagagcttgtgttcaagccctgtaaggaggacttgcaaaaccttgtcgatatcgatcccttagaatcgatctcgatcttatcatttattgcttcttcgtcaagttttgacgttttagcaagatctattcgtgaatccgacttttcctgcaatcatggaataagaatgtgtttttttttaaaatgtgtttattaaagaaagaaggaaaaaaaaagttttagttacatttgacgtgaactctttgacttgtgtgggtgcaatactatatcaaaaaaattgggagtagtaatacagttaccactaaagtttagggacataatgaacaaaaaaaaaaaaaaaagttacacatcttatgaattagacggagatttcgctgccaagtgccgacgatgcgacggcgagaagaaaagcgtcgagaatttcacgaagctcttcttcaaacactgtatcctccttcatcgccaccttcttctccttcctattctccgcctccggtattttctcaatctctatttgtgtcaatttgttagttctcgattgggttatgaatcgataaatgttcccgccattgtttcaggtggaggttgttgataacgaaccattcgatgtgtcactcataaacccaggtacgattaatgtaatcttaacaagttatttacactttggaagtcacattcaaatttgtttattattcagaggattacttgaaaatcgattcatctaatcacggagaagacaaagaaatcggagacgaattggggattgcagagaaacagagtcgagcgcagagaaagaggttaaggaagaagatgctcaaagaggaagcagctcgacggaagaaagtcatcggacctttacttccgactgaaatgcttcagacccatgatgaaagaagtgtcggagatgcttgtgggagcaatgttgaagaagaagattctgacggtggcgaagaagaggttgatgggagcattagcaacatatgctcacaacttgttcgaccaaatgcccaagagaagaaagaaggtacacacagcttttgacttttttgacgatatccttagtttcaaatcttttgggaaaaattcgtactttatctaactagatttcataacacatgtacgtattcagatcaagggtttgactttaatcaaaatctactagctcatcaagttgttgtctcattgttggtcctgtgcaaattactcaaacgttctcttttgtgtattaattacattacgcgtctgactctttattttttgtttggtaggactaatcggtgacaatgataagacgagaaaagtcaagaagagaagaaatgctaagaaactggccaaagagagttctaagaatatccaggatggatccaatgcaatccctgaaattcctaattagggttcaaattatcacagacctttatctaagagttaattacttcatctttaataattcaagggtatattactaaatttataattctcgtctataagatttgtgagttccttttatgcccttgttaagaggatttaactcttacatcgtcattgccattgtgtagcttttctctaaaccctaaaaccttaactttttgctcttctccctccgcctcaatcgcacgaagacgataatcgaatatg

SEQ ID NO: 1434 - DNA, 3000 bp, Unknown
  misc_feature (1)..( 3000): cDNA_ID_1023572_gDNA_ID_1620401_Annot_ID_155965 3000 nt of promoter + ATG
cctccggccggttatcctccagccggttatccaccgccaggatatgctcagggataccctgcacaaggttatcctccgccgcagtactctcaagctccgcagcagaagcaaaacgccggtatgcttgaaggatggtacgttcttgatcccatcttttctactttatattaactttattttggtttcttgttttgctttgtatttaggttttagtggaataatactgtattagttaatatatgtctttgctctgttcataaatacgtcacagtttggctgcgctctgttgttgctgtctcttggatgcatgtttctgatcggaggataattatatacgttgcctcagtcaacttttatttcctcatatatgttatgtaatgttcaacaatctttcttctgttgttatcttctttcaattcgaattttggtatcttatgttttattgactccgaccataattatctctctctttcataatccaatcacacgaattcgaaataaaccagtaaagaagtgatcagaaatcttgatgaaatatcaaaggagtgtgtttcatcatcatcatcatattattgtaataagtaaacatagccatggataatggttcttttcaaccaaaaagctcacagatgctaaaataacaaagaaacatgagaattaatatcaaatgaggtttcttcttttgctcgagaagaattggaagaaggtgtaacatcagttttctggttgaggattgcctttccacttgaagttgtccgagtaagacttgacctgcagttagatgttagatgatgaacaatcatggggttaggttaaaacttcaatctaaagaatgttctaccaaataaatcaaaggaatgaaagagactatcgctcgtcaaactagtagctaaatcttaaactagaggcaccaaaccatttctgatgaagcaatatgagttaagttaaagaatatcctatctatttaacacaacattcaagggtcgttccagtgaatctccagctttagggttaaacacctcatatgagtagagctcgtaagtcataatgcggcattagcaaaaagatagttactaaccttcaataatggtgtgttgggcttcttgacctgcaatgatttagatgtaagtttttcagtactctgaattctatattaagggatcttaaaacagaaccatcacaatggtgatcgaaaaaaaaaaaaaacagaaccatcacattctcataaaatgtgagtgaatgcgaccagaaaaaaaaatgagctaaaaacgaagaaggaaacaacgtaccttataatcccaaccatgacgctcagcaaaagacttagcagcttcttcagaatcaaaagcaagagcagagtcaccaacattagcataggggtcacctgtagaagtccatcccatcaacggattctcccacctagaaacatatgaatgccatagataagtgatgtcaatcgaaatctaatcaacaagtgatggactagtactagtcacaagcagaagacttaagttttgaaaagataggaattttaaggataagaatcatattaggacataaaatgtgaggaaaagaggattatcttaatcaaaaagtagcatactttaaggtggagacgaagttaatcttccattttccgagttttccagatcctgactgggtagctgttctagcaggtgagtatattatcacctgttaatttccaaattcaatactcttagcactattcgattgaccaaaatcaaatcaagaacacgatgtagctcaattaagacgattctctgatcacgaaccctaattttctaaactgaattcgtaagaaatcgaatgcttatttaccttgcgagaaagatgctcctctgggattccggagaccttaccgatctcaccacgcttgtaatccgactcaaccaccgcgtcagtagcgaaaggtcgagcaacacgccggagcgtcgccgctatacggatagtcctttgagtagtagcacaaagcgccatcgtcaattagagaaatctggaaaattgctgagctttttgatttcgctttggtttcttctacttctgtagattttagaaagaaaaaaaaaacacatatttcaatctagccatcaaaattttataaattacgctttcggtcttactattatatgaaaaatctttaatagcccctaaactatctgtgagatttaacaacgataaattttatagatacattatttttaaaaaatagtactagtatattttattcagcttgatcctattcatttagttggtaggttttattgtgtaatttgataaacttgaggcaaatttgtgaatgtggagaaatatagggttacatcttccttagcttgaatacaaaagaaaagctcaagtttgtttctcgtttctatggatattcttcttccttatgctagcctctctggtcttcttcttcttcgttcgtttcagcgaatcacatttgatctatgacacatctatacaaggaattagctttcatcatcaagtctctctctcgaaaactctcctttggtttcgtttgatctggcatgcttcttctcctccttcctcctttctgcttccttctctgaattttccatttttgtttttaattttctacgatcgccccatttgaatttggttgataatttagctatcgctttagattgatggctgtatttccaaattcctgttgatttgcgacgttgttaatgggctttgatcctctttttttggttcgagattgctcgaatcactcatttttttgttgaattgagctttggggcgtatctaatttctttggatttgtgtagttacatttttatgttgtggctttgtgtatctgctggatttagatgaccaaaattttgtattggataagaaatgttcaacaatggctttgatgtggttaagtttcgtacgatttaacagattctaatgttagcgttcacatctattggcagagaaaagaagaaattcaaatattgataactgtggatg

SEQ ID NO: 1435 - DNA, 3000 bp, Unknown
  misc_feature (1)..( 3000): cDNA_ID_2136159_gDNA_ID_1620401_Annot_ID_155960 3000 nt of promoter + ATG
tacgaatcggcatggatctgacgttgtgtttgttacggagatccttggataacggcgagctcatgagaacgcgcctcacgcttgaaggagctgtgaagtgagccttcctgttcttccggcgagaagagctcacacgcggattgaacttcatcgccgctgaatttgtgaagaaattagggtttttttgtgctgaagaggtggagcgttgtgtgcatgagtttatatatgagatattaaaagttacttaaacgctgccgtttctcacagtgagaattagggttttgaaggtttctgggtcagatgggctttgataagttttatatgggctttcaaaccattaaaatggaccaatctaaccttgagaaatataatgggcttattagattgttgtcaacttctaagttaagtgttgtactcaattctaaaaccaaacgcattaaagagtttgtattctttttaattttgttctctccaaaacaatgtgttgggttcttgagaagactgactgttattgattattttttttgtataattaaaaaataaggctgcttgaaatagtaatggttacaatcttgaatatttggttatttggttacaatcttgaataaggctttttgtatatttggttacaatcttgaatataaaatatatctttcaatgaaaaaaaaaataaaaaaaatagtaatggttactgactaagttggagataaggaaatcatcaaatcataaaagatccatttaggttagaaataaatacacacttattgaatatcatttgataaggcttatctcaaactaataaaacaagaatcgagattcgagaatctcactaaacaaatagattaggtgaatccgacaaaagccaatgatgccgtcacgctcataaaactcggattccacaagcccaaaatagacaacatgttttattttattatttgtttaccgacttaaaatattaatttaagatcgttaaaaaacaaactctacaagtttttgatttcagagtccaccgttgagcctgttcaattaaatcgttgaatctcgcggtgcgttttactttgattctttcgaattttttttatatggatgttgccgcgatggcgagatgtgtgggaaggtgctacgtttcgccggcgttcggtgagtctgaatcgcaccggttatcggagcggcggtttctgaaattgtctagctccacgaattcggatcccgccggtagtaaaagtttgaagcttcgcgggaaaattcatcggagaatgagctacttccgtccgatcatggcaaaagatgaatccatttcatcgcggtccggtaataatcacgtaattccgttctggttcatctctaatcctagtttgggttcctatgattcgtttttaacatttgggttcctgagaccagaaatttccatagttttagcataaagtttggaccttagtagacagatcaatgatgtatatctgaatagatctaatctcagataatctaaccaggtgaaacgaagcaaatcaatggaaagcaaaagaacattgtctggcatgattgtcccgttactaaatccgacaggcaagaattaattaagcaaaagggatgtgtgatttggattactggcttaagtggttcaggtttggtcctttgtttctgaattgatctctaactacatcttgttatgtttctactggattctttcaaatattctcgtattttttcaggtaaaagtagtctggcatgtgctcttagtcgagctttgcacaatcgtggaaagctttcgtatatacttgatggtgacaatgttcgacatggtttaaacagcgatcttagtttcgaagcagatgatcgagctgaaaacattcgaagagttggtgaagtggctaaactgtttgcagattctggtattatctgtattgcaagtttaatatctccttaccggatagaacgagctgcctgccgtgcattattaccacaaggagatttcattgaggtttctccaagttcatgaatttgaatcccagtctcaacatcaatctgactttctcttggttctcttgataggtatttatggatgtgccactccatgtttgtgaagctagagatccaaagggcttatacaaacgtgcacgcgctggtaaaatcaaaggtaactttgctttttctctgcatctgttttcaacttaacccatgttctactgattttcattaattatataaccttcttgatctatccatttgattatatgtaaatatattgttccccaaaacatttcttctccaggttttacaggagtagatgatccatatgaagcgcctttggattgcgaggttcatataatatccaatttttgttatataagttggaatctagctcatctccgaacttgaatctaatgttgtgtttccgactactctttgcagattgtaatacaaaacagtagagacaaggggctttcttcttcatcttcatcttcatcttcaccttcatcttcgtcttcttctctgtgtgaaatggcagatattgttgtgtcgtacttggaccaaaatggatacctgaagaaacactccacaaaatcacgtaattgtatgtaaatgtaatattaatatcattgttgtaacgtttcttaaacctattttacctatggacgattaaattgtgaaaacataaatgtaattcacaatctgcaaagagttggtaagaaaaacttgtttgattgattgagagaatgagattattatatggccgccaagttggcgccaactctccggctttttaagtaatcgagcatttgggcctaaaaatatacggcccagtgttaacaaaacaggcctttttaatatccgggtcggactctattaaggccggatctggttctacggcggcgactcctcctcctgactataacaaaaacaaaacgcggtggggagggcggtagtatcagacagatcgaaaatcgcaacggttaagattccagctactgaaatctatcaacgtcgaagaagtgaacg

SEQ ID NO: 1436 - DNA, 3000 bp, Unknown
  misc_feature (1)..( 3000): cDNA_ID_2136163_gDNA_ID_1620401_Annot_ID_155961 3000 nt of promoter + ATG
gagaacacagccacatacgcagaagaaagacagataaagaatcagacagagaacatagacaaatcttgtttttcacaggataaaagaaaaaagctgtgtcttcttccacaatcaccatcatcatcatcaaatgaccaaaaacacaagaaagatcgacaactgcagagagttgacttctctccttttggggtaaagtttaattcgatgatttggagtgctttacaagccaatcaatgacttgatcgatgttggtagagttcttgcaagatatcatgaagcaacagacttctctatctgtcagtgacttgagacccctgtggcaaacaatggaaaataaaacattattagaatcaaagtaaaaaatgccaagtccattgtcgtgttttaggttttaggcttacatttcatcggttagggcttctttggacaaagctccaggcttgtcgattttgttcccaaggactaggagagggataccattaagcgacgtcttgctcaacaaatcatggagttcactcttcgagacactgaggttatcaggatcagcagcatcaactacatacctgaaagcagaatcagagtcagagagttttaatcatctgaaacctaaataaagatagtacgaaaactaatttcaagagagatttacacaatcgcggaaacagaacggcagtaacgttcccacatgctgcggaacctaggttgaccaccgagatcccaaagcttgatcgtgacacttccttttgtcactttcctcatgttgaaaccaacctaagaaagagtaaacatcctttttacgattagtccaagagcaagcaaatacttcgccacctaaaagtagtataacacaccgtagggatcatgtcttcactgtatccaccggtctggacaaggaaatgcaaaaggaagccatcaacgagtcatttagagaaaaaaagagggaacgatttttggggaagcatactacttactgcaacaacgttaacaagtgatgtctttcctgcattttgaagtcctatcaatgaaagctccatttcttgcttgaagaagaggctgcaataaggcattgtgagactatgcatatcgggcaaatgcgaagcaagcaacttttttttgggaaactaagttcttgctctcacaatcttcatctactgattaaccatctatatccaacatggaatctcacaattgtattgtctaaacttaaaacttgataatcaaaactaaagggtagatttgatgatcaatcaatagctgaaaaagagagagagttgttgctttctttagccagagacttatgtgatcgtatatgcattaatacatcaggaatcaaaattagctaaaatccctaattttgttgtaaacaaaaccaaattcggcggaaatagttggatttccccaatcattgaactcaaaataccaagagaaacaatccaaatcaaaatcccacgaacccagacaaaaaatttgaagtagaagacatagaaactgacctgcgaagccaattgagaagagcatcccacaaacccataatttacgatttccgacaaacacagagattcgtagaaacagagacaacagacagagatcggtctgctacaaattctcctccaaggatctatatcggcttattaaaagggaaaggttccttttctcaatccttgttccgctgctgatattattgttatctcattgaagatttttttttcgtttgtcaaaatcgaaaacacggcaagagagccggcgaattaaagttacaaaatggctcagtaaatctgaaccgtctatatttatgtaggtcgtgagattaacggtctagatctgattataattcgttttgtagggaaactgaagctgtgtctgacagagcgaaaataatggagctttgctatgtattgtagttattattaaagaaaaaacaaaaaactagccactcagaaaaaagattcgatgggacagagagaagttcggaagaaagaatttagatttgataagaaaacaaaagaatgtgtttggaaggcgcgtgatgaccactgaccaatgattcgctgattggaaactgtactaatacgagctgtttgggtcaataatggagaatcattaggatgtgtttgattatgggcttcttaagcccagatctgaaccgtcaatgtttatgtaggtccgtaaatatattgcctttgtggattattagttggtttttcgattttttttatctctatagatacttaataatttttttagactgaatagttggcgggttgagccaagaccgtgcagtagtgcaacgcatggtcgactcgtgaaagcccagatagcaagctatcataatgggctttctcccttaaaaaatagagttaatatcgtgtgggccgatggcccacatatcagatattatactgataagaacagatactacacttgatcttagccaaaaggccgagaaaggtatgaattgttacgatccatggccgcgttttttatactactcctcttctctttcacgcttcttttgttagcgatgtgggactctatgtatgagtgaacaagactaaacaaaagaaaccctcttccgcttttagcgggttttgacacacggcatgattgatgatagtcttaaatcggttaacatactttgatcttttcccacttcttttaaccttttctggaaaaaaaatataacccagtgaaaagaagagctgagtcaaataaaaatccagagaaaacggctcaagatacgttactctaatcactctcctttcttctatttaacaaaaagaaaaaaagaaaaaactgagagaacaaaaaagaaaactttttaagaacaatgtagccacaagctatccttaccttagtaagtaagccaaacactcgaagaagaaagacaattatttaaataaattatactcttcacaaatctccattttttatccaaagaatcccacaaaagaagtcaataaacaaggaacatgattttcgatcatcaacttgttcaacatg

SEQ ID NO: 1437 - DNA, 3000 bp, Unknown
  misc_feature (1)..( 3000): cDNA_ID_2136173_gDNA_ID_1620401_Annot_ID_155964 3000 nt of promoter + ATG
ggagagtgattagagtaacgtatcttgagccgttttctctggatttttatttgactcagctcttcttttcactgggttatattttttttccagaaaaggttaaaagaagtgggaaaagatcaaagtatgttaaccgatttaagactatcatcaatcatgccgtgtgtcaaaacccgctaaaagcggaagagggtttcttttgtttagtcttgttcactcatacatagagtcccacatcgctaacaaaagaagcgtgaaagagaagaggagtagtataaaaaacgcggccatggatcgtaacaattcatacctttctcggccttttggctaagatcaagtgtagtatctgttcttatcagtataatatctgatatgtgggccatcggcccacacgatattaactctattttttaagggagaaagcccattatgatagcttgctatctgggctttcacgagtcgaccatgcgttgcactactgcacggtcttggctcaacccgccaactattcagtctaaaaaaattattaagtatctatagagataaaaaaaatcgaaaaaccaactaataatccacaaaggcaatatatttacggacctacataaacattgacggttcagatctgggcttaagaagcccataatcaaacacatcctaatgattctccattattgacccaaacagctcgtattagtacagtttccaatcagcgaatcattggtcagtggtcatcacgcgccttccaaacacattcttttgttttcttatcaaatctaaattctttcttccgaacttctctctgtcccatcgaatcttttttctgagtggctagttttttgttttttctttaataataactacaatacatagcaaagctccattattttcgctctgtcagacacagcttcagtttccctacaaaacgaattataatcagatctagaccgttaatctcacgacctacataaatatagacggttcagatttactgagccattttgtaactttaattcgccggctctcttgccgtgttttcgattttgacaaacgaaaaaaaaatcttcaatgagataacaataatatcagcagcggaacaaggattgagaaaaggaacctttcccttttaataagccgatatagatccttggaggagaatttgtagcagaccgatctctgtctgttgtctctgtttctacgaatctctgtgtttgtcggaaatcgtaaattatgggtttgtgggatgctcttctcaattggcttcgcaggtcagtttctatgtcttctacttcaaattttttgtctgggttcgtgggattttgatttggattgtttctcttggtattttgagttcaatgattggggaaatccaactatttccgccgaatttggttttgtttacaacaaaattagggattttagctaattttgattcctgatgtattaatgcatatacgatcacataagtctctggctaaagaaagcaacaactctctctctttttcagctattgattgatcatcaaatctaccctttagttttgattatcaagttttaagtttagacaatacaattgtgagattccatgttggatatagatggttaatcagtagatgaagattgtgagagcaagaacttagtttcccaaaaaaaagttgcttgcttcgcatttgcccgatatgcatagtctcacaatgccttattgcagcctcttcttcaagcaagaaatggagctttcattgataggacttcaaaatgcaggaaagacatcacttgttaacgttgttgcagtaagtagtatgcttccccaaaaatcgttccctctttttttctctaaatgactcgttgatggcttccttttgcatttccttgtccagaccggtggatacagtgaagacatgatccctacggtgtgttatactacttttaggtggcgaagtatttgcttgctcttggactaatcgtaaaaaggatgtttactctttcttaggttggtttcaacatgaggaaagtgacaaaaggaagtgtcacgatcaagctttgggatctcggtggtcaacctaggttccgcagcatgtgggaacgttactgccgttctgtttccgcgattgtgtaaatctctcttgaaattagttttcgtactatctttatttaggtttcagatgattaaaactctctgactctgattctgctttcaggtatgtagttgatgctgctgatcctgataacctcagtgtctcgaagagtgaactccatgatttgttgagcaagacgtcgcttaatggtatccctctcctagtccttgggaacaaaatcgacaagcctggagctttgtccaaagaagccctaaccgatgaaatgtaagcctaaaacctaaaacacgacaatggacttggcattttttactttgattctaataatgttttattttccattgtttgccacaggggtctcaagtcactgacagatagagaagtctgttgcttcatgatatcttgcaagaactctaccaacatcgatcaagtcattgattggcttgtaaagcactccaaatcatcgaattaaactttaccccaaaaggagagaagtcaactctctgcagttgtcgatctttcttgtgtttttggtcatttgatgatgatgatggtgattgtggaagaagacacagcttttttcttttatcctgtgaaaaacaagatttgtctatgttctctgtctgattctttatctgtctttcttctgcgtatgtggctgtgttctctgtatattagatttgattggtgttccctcttcttaaagccatgatgagatcacttccttcggggtcagctttttcaattttacgagttcattgcatgttttgaaagaacaacaaaatatgttgcgtttttcgtaattttgaaaaacttgaggccaaaaacggatattttcgaaaaaagcaacaagataaaataaaagatttttccttttactctcacttgcactatcctcctcttcgcaaca

SEQ ID NO: 1438 - DNA, 3000 bp, Unknown
  misc_feature (1)..( 3000): cDNA_ID_2992105_gDNA_ID_1620401_Annot_ID_155957 3000 nt of promoter + ATG
gataattatggtcaaaggagttataaggagagcttacaaggatgttggcatgagcatagatgatactgccattatctgtatagatgactacatcagctttgtatccgtcattgaaaagacgatcccacatatctcttgtggctgtcgaaacgctgctatgcccaagttttttcttgagtccatcagattttgatggaagaggaggaggaattggcacagaagatgaatctgcagatttgaaagattgatgaagatcaacacaacctgtcaccattctcttgtttagcttatcttctcttccctgcatcaatcaaatgaaaatatatattgtcgattctttagccacagataaacttcattgtcatttctacacgaaatatgtgactcagacaacaattttcacagcattatgtaaccagatctcatttacgattacaaatcgaataggataagaacaaatctctacatatatattcacacgaaaatatcaatcagaaataacaagaattcttgaaacagatcgatagaaaatgtaagaacaagaatcaatcaatgctctaatttgttccgacatatataccttgaaaagattcagaccacagaatcaggttgcttcgaagaggcaagtcaaacaaaattaacgagaaaatcttctccttggtagaaagagcatgagaagaaactctctctatagagaagcttgagagatcagagatctcttaccattatataaacacacacactcacaaaaacaatagaagacgacaaaaaaaatcccaccgaaaggataatttattgttttaatttccttattatctcacttttttcttacttttgtgttcaataatttgaagatattttcttggttcatatcatcaacagagacacccacctgcgaaaattacccgagaggcgcgtggagtctacggttacgaaacggacggctgagaatccacgcgccttaacggccttttttcctcgttcttgaaaaagctttcgtcaagttggttttattatcggctttatcaattgaaacacgactctgcatgttttttttttataaatgatttaatttaagagccgtacaaaaacagatcagtgtgtcctttgttttttttgttcttgttcggcgttacacagctcataattagctgttcgttttttcaaacttttatccgtattattatcctttcttcttcaaagataaatttagattagtcttaattttaaccacatgatcagatactctcttcaaaaatgttaactaatcgtgaattatgttgaggtccgcaaaattgcgtcataaatattttactggtctctcttcatatttcttagcttcgcttgaattgattgttacccttttttccctttttttctgtgtttactataatgccacgtttcttctatcgaataatctaaaacagaagaagaagaagtcaaaatgctttttatatgatcattttcttgtatttttttttagtttttgatcggagtaaagttataagaacttcaaaaaaaaaaaaaaaaaaaaaatgcatgatgatgccaatctttttctaacttttaaagagtattggaacataatacatatatcatgtaaactgatatttttaattgtaattttatatcatatacggatttaattgtaatttgagcatcacccagttgtgcaattgtagttatcacagaagtgcacattgcaatgttgttgaacaacagaaataccttgacatcatctcactgacccatgcagccatgcctaaacttggaccagaactcatgtaaccaccgggtaatgtcaaacctgaactctgaactctcaggttagttaaactcatctcttgttgtttccttaattctaaatcatcactaaacctgtattaaagtgtcccaaattttttagatagagatgtatagatgcacatttaacccacctgaggaagaacttattaactattactggaataacaagatcaccagagaatgatgatccaaataaaggcaacgaatttgaagttctactacattttcttccattttctccattattttgcaaatacataaacacataaaacgaatttatttccatttttcccagaaatatataagaacaagctaaaacacagggatacatgaatcctctcagaaatcagagcatcgaccacgttgttcccaatcgccgtaccgagtcggttcaggacctctaggccctccaatctcaccagtatcttcgttcacaaactctccacctccaccaccttctccttcctcttcttcttccttctgcatctgcagattctgttgaagattctgatctggcttcacgtcccggttcagatcctgattcggagatggagcttgcggcggaggaggtgtaccggagcttagaaaccgtgacactggctcgaggaatctagaggagacggatcggcttggagcgatcaaacgtacgatgttgttcgtcgccattgttagatcagatgtgtcggccaaatcaagaaagagatccgaccttcacggtttgtgatagtatagggttcgatagtcatttaggttgggccataattggataataagcccagtagtatctaggcccaatcatttacatgtttataaataaattaagagaattagagagtaaatttggcccagtataattatgtttaacaagcccatcaggagctaggcctaacatgtttataaaacaaataggagagaattagagggtaaagttgacgtgggctgatttcgaacccgtaacctttttatatattagacctcattaccaaaaagcgattcgattatctcataaagcgtcatgtgtttttttgtgccacatcaacggctgtgagtggttagtcactaaagaaaagtcacaggctgttatatagtattggcttcgctatttattttcgtctaccacgagaaaaacaagtcgtaattcttctatcttgatatcttcaccgcctgccgatctctctcaatctccgatcaacc

SEQ ID NO: 1439 - DNA, 3000 bp, Unknown
  misc_feature (1)..( 3000): cDNA_ID_3062384_gDNA_ID_1620402_Annot_ID_155995 3000 nt of promoter + ATG
agttatattgtggtctcggtttcctagctgtgcaaactataggctttatgcgtcttaccttttgggaactaagctgggacgtaatggaacccatctgcttctttgtcacaaccattcatttcatcctcggttacatcttttttcttcggacatcgacggaaccatcattcgaaggactttttcgacagcggtttaagaccaaacagaagaagcttatggagaggcatggatttgattttctgaggtacaatgagctcaactctttgttcacaacatttccgtgtaaatttcattatccggtttagttagccgcatcctctccttggctactctatgatttgtaattttgtatagcttgtgtagacttaatattgggccttaacttgttgtatctatatatgataaagttggattcctactttttgtgcaccctcatatcatatatatctttgcttagttttatgagcttaggcctgtgttacggaaaaagaaccataactattgttttatctaacccaaatcgtttcaagagtttctttcgtgaagtaatttaggtaattttcaagaaatgaagatgtaatcaagaaaataataattatatgttattatggtttattgccatcaagactggattttttttccatgaacatgtttcatttcattatgtagacgtttaacgtaacatccaatgatgtcatacgaaaccaaactctagtaaaaaatctaacctttaacccccatttagtaaattagccagctgtgtaaaaaatgttaggacagaaagtcattcttttttcttaaaaaaatatttaaatcactttattgttattttttaaatgattttgtgcaaaaaatatttttaagttgtacatttttgcaattttaccttacactttcaaaaaatacaaattaattatacgaaatcaaaaataatacgcaatgtaattttttcgcttttttcaaatgaaaaatattgataaatgatatgtcaaatcaaagtcataacgacgaagaattcaaatctactttcaaaaatgtaaagatttaatgtatgtgaccatgaaaatgtttacaatatacataaaaatgtcatattgcgtattattttagactttataaaattaattatatttttgaaataaaaggtaaaattgtaaaaattgacaagtttgaaagcttttttgcttaaaccccttatttttattcattgttattttcaaatattacatttcccttgattaagtaacataaaaaatagccgacaaaaaagtaatagaaaaataagaaaatcatccacaaataacatgtataataaacaccttgttgaatgttattaacattatatttcacttcatataaaatatagctttcactttatcaacaaaaaaagaaaaaaaagaatatagctatcattcaattgtttcctcaaataattattaatatgtcaagaaaagttgatccatagtcctcttgtaattggtaaggatttgtaaaccattaacaaaaagaaaagagagacgtcgatatctattaatagtcgaaaaagttaagttggtggaactttaatctaccaactataatcatagtgcgaattcgtttgtgatttggaacacgtaaatagctggaggcattactacattcttgaccaaaaacgcaacaaaagcaaccaccaattgcattactataatcttgacgcaacaatgcactcattttagtaactatttacactattttttccttacattttctgctaaacaattacaaaataatcaatattacatacacaaattgttgaattattttctacgctccgatttaatacaaaatcatgatatctaaagggtcggatgaggatatcaagattttaaggtttatatatatggatttagatccgtatccgttaaaaaaaaattaaaaatctttgataaaaaaattttgaaaaaaatttattaaattatatttctacataaattctatgatctttttatataataaaaagtaaattgaatttatttattttttatataatttaccaaatttatttaatatcttattatatcaagtttcattttaaaaattaataacttatatgatcataatacgtatcaagtcgattagactgatactatcaaatcttgcaaattacactctaaggcacatcttcatgtgcattagaatctgatgtcaatttaactgtcatagtccaaaaatattcattatgatttgtccggattcaaccatcgcattaccaaactcatatacgattcaaatcaatcaaaaatttcaaaaatttcggatatctaaacgtataagatttagtctgtttttaatccacaaaaccaaataccacaaaaaggttatatttatgttactacttaaatagtttaatatagaaacttgaaacagatttaaaatcttaagataaggatgatgatgtggatcaaagacagcgaatgtcccaacagttttcttctattcaaaaatcatttagactgcaacaaatgtaaaatgtgtatttaataccaaatctgtaaccacaaaaatttcaaattagattatacaaacaaaattgacaccaaatattgattctcactttaaatgtattacagtaacaattatacattataccctaccaccaactcctacccaatccatttgtctctctctctctcatcctttagtgtcacttgtttttgtacaaagagagaaagagattggaaaaaaaaaaaaaaaaaaaaagatttttgtttgttgaggttgctgaaatctagatcacctgttttgaatcagtcatacctcaaaaaccctaactcttattatcctctcccaattgaatttttcaaagcttgaagaaactagtagtagtaatcttcgctctgtcgtctgatccatttttttatcaaaatctcgagctaaaaactcttgtgtttaagcaaatgaaatgcactgtgtttgattttgagatttgatggaagtgaagctgtttcttcgaagaatttc

SEQ ID NO: 1440 - DNA, 3000 bp, Unknown
  misc_feature (1)..( 3000): cDNA_ID_3062382_gDNA_ID_1620402_Annot_ID_155997 3000 nt of promoter + ATG
aaaacccgacgttctgaaggaagtcaaggtcgctattggccttacgtaacaaagctaccgatcaagaccaaagatcatatcttcttttatatattaaaatttaaatatgcagtccatgagcatgatataatattctctttgagaaaaaaaaattgatataatattctaccacacatctcgcaatatatgtgttgacccattattcaatataagcaaataatttactaaaactatagattttacttttatgtaacaagcaaaaaaaaaagaattgaccacgttacaaaaaaactctccatatataaccagagtgggagcagtggagcataccaaaagaggaaagaggcagcagaaactttttagttaccagagaatcttttccaatttatattaaagtgtgataatggaagattgagatgtttttttgaagactgaaacaaaaacaagttatctctacttgaacttgtactcccttctcatcgcactacaacaatacttactacttcaaacgattctcttgattatacatatcaaaaaactcatagaacattcttggaaagaagttcatatatgatgataatatgattcttccgaagctcatatgatcaaaacaagttaaaattatgttaaaactggtaacctaagctgacttatttgttgtagcttaaggcaattagcacttgagaagggttaaatcactggagggttccgcatattccatcccccaactaggccgccccaatgtgaaatccaaattgagatgaatgttggtatcctctttctcttcattgtcctattttcaaaatattacacattataagtacataagtaaaagtgtaccattgttaccattgtcagcatgcaattaatgagagataagggataaataatgtaccttagtgtgatgagttgttcccaagtgagaatatgcttgtgtagatatgctcctagatacttcctttgtcgatgaccatgaagctctgttcaaattttaataataaaacacattttagaaatctgtttataactcctattgctggacaaaattgttgtatttggacctacttctatattatcatcaattaatgtacatatacaaattaacaaagaaaattcaaatatcttatatttctaattagactaaaaccaaaaacaacccttaacgaatttaatgagagatggaaaagtacattcacataagccctaggagagggtcatattcatcaaatttcacacagaactaaggcaaaaagagattaaatgcaaaattttacaaaaataaatatataaataaaaagtaacctttgggtcttttgcacagatgatgagtttggcgaatttgtgtcagttccttcatcagcttcttcattattattattgtcctctatcctctgctctgcctctttctctacctttccttctcctgtttattcccaagaacaaaaatacaaattttcttttaaaaattaataaataatgaaattttatttacatttatatctaataagaatgtaaaaatcagtgaactagtttgaatgcatacctggtgatcctttatcagtgcatttcactgttctatacatctgcattaacaatcacacattcttgaaaaatcaaaaacaaattaaaggacgaaaaaaaataaaagaaatgtttggctaagttcatttcaactatgcaatcatgcgttagatagtggcccaattatatacatttcatacatatttacatatacctatatatctatctacatttatgtgtttgaattcgtatgagattccattaatttatatataaaaaatgaagaaaaaataatgaacctgcaagtgactcttgacatgagctagggttagatccttcacattcatgagctccaacactgatttaggcgttgctcctgagacaaaccaatacatgacaaatcttaatactttggtttcaaaacgttacactaacataccaatctcgattggttatgtctttcttttaaaattttttttgattagtataggaaaatgtaagaggacaatacatactttcatggccgccaagaagttgaacagcatggacgaagtgagcatgaagagtagaagtccatctcattcttggagcacgaatgcttcgtttaagaccaaccattgatgatgagcttctcttgaaatctcgaccgtagatttgaggttggaacatgtttgagcgcctttgatgatgatggtcaaatcctaagctcaagagaggtttgttgaagaagttgttctcatggctcaggtcactgaggctgcttccagaatcactgcttgtggagctccggtcaccgccgtgaagaggttttccggcgtgatagttaggaagactgatctgaagagacagatctgggactgagtttgaagctctcatactgtttcttgactctaacatcatcatctcactattttctttatgattcttgtctacttaaatagtggagatcaaagaatgtgtggaaagagaacgagagagagagagagagctctgcagaaacaacacttttattgagggagaaaaaaaagaggtaaaatattatatttctccatcgttgtcattatctcattaatgtattaaacaaaattctattgtctttttcttattattaaatggtttttttttccaacaaaacaattctctacaataccttattattctgaaaacgcttattgcactcttttcctagtactaccaaatgttagtcccaatgtaataaccaaaaaaaaaaaaaaactagaagtgaggaaatatttatagggtgaattgcaaaactaactgtttttgataatttatttaagaaactaacactataatatacaaaatgtagaaattaacactagagggtagtaaaattactaaattagtctttttgattggagatggtagtggtggtgatggttgtggccggtggtggccggcggtggtggatggagttgatggtggtcggaagtgttggtgatcggtgtggtggttgct

SEQ ID NO: 1441 - DNA, 3000 bp, Unknown
  misc_feature (1)..( 3000): cDNA_ID_2046039_gDNA_ID_1620403_Annot_ID_156008 3000 nt of promoter + ATG
gatcacaagactgtggttacacaattgatatcagacaagttttcagatagaatgtctgtacaacgattccactgcaggaagaaagacaaaatcgttagacggtgtcacaatttctagaccaaactattcaggaacaaattttgctttttcttgctattgctacatttctttcagatttcggttacagtgcctgtgaattcatagtttgcaaactgaagaacaacgagatcatgagacagagtttcaaaatccattggagtagttcgtttccacgtggagttgaagcagaggaggtcaatgcagttgcattcgtcgccttggttttgttcctgcagaaagattttaacaaaacagtaagaatatgtatttactgttcttcaatttgcatatgaatcaactatctttatgacataccctcctgcagtaatgtatatgcatttgtcataacctgtaacaacgacattgaatcagattaaggtaaagatcaagactgttgatttgtgattttggagaagcaaaagctggagattttgtttacttactagggtccttgttgactttaacaccagctcctccaaagctgcaagcaacgtctgttgctctgttctgttggaaatagctattgaacacgaaagaagcatgagaaaccaaagtatctggttgaaaacaaggctggcttggctgaatagctgtgcaatcaacatttccaggaccacaagcccaatccaaagcacctttcagatctctctctgaagctttagaagaagcaatgcaccagctattactactcccacttgagtttgtaccactcgaattagagtgaaacccgttgctctttcccgtgaaatccaactgataaacacttgtctggtcagggtagaacaatccccagtttctctctgaatccaaacccgctttccgattctcgttgaacaatgagaatatataaacgttcattgcctctcctggctttgcaggtgtgccttggttggtaactacatgacggattatgtttgaattgtatgtctccgcgttgtcagaagacgcagcagctttctccttcggtgaacctttggttggccatccagtctcagtaaccataatcttgattgtcctgaagtttaaagccgtgagagcgtaataaagagcatcaacttgagcatcaaacatgttcttgtaaagcaaacccgtgtttgggtcaatcacttcagaggaagactcaaacaacacataatccaaagacacattgttcggagagtctctgtaagcgtagtacggataaagatcgatcatgaaaggagacttattctctgcaagaaactctaacattggtctcaagaaataagcatagctgctgttgaatgctccagcagaaggagggaaagatctagagagaattccgagggaaagagtagtcgaaaccttgattcttctactcaaaccgacttttctcagagcggttaagacattctgcatcgcggggacaacgaaagacgaagcattgatgtgtggatcatcagtagattcagctccaacggtaatgtaagtgatcttggtcgttggatagtatggtaagacgctgttcttaagccaggtgtccacatttgattgggattgagagaaagcgttaagatcagagtttggaactccaatcattagctcaatgcttgtgtttccaaatgctttgaggacttgagaattgtaatcgtagattctaacgtatttgatgttgtgctgttgaatcaattgaacaacttttgacggtgttggaagatcgtcggcgcttcttccgtaacaaactccgaccttgccaccgtaacaacagtctacaaaatttggggaaaaaagacagaatcaattgactttttttctgacgaaattttcttttgatagctctacagtaaattagaagaaggtaatggagtctattcaacaagaattgaaattggaaaccattgaatgttcttaattttgctgctctatttcagaacaaagtctcagacagctcttgaagtgagtagtagagacagagagagacaaacctagaagcagaagcagaattgaaatggagaagataagcttgaagtctctcgccattgctgagtaactacacactttgcttttgcttcctttactcgaaagaaggaagctttattatcttctggcagctcttcttcttcttcgagttaattctctcttttagtgaaaaaagtttgaagctttttctctctctacaaaaaacaaaagcttcgttaaagctctctctctctctctctacagcgagagtgggaaactaatttagtttttttttcttggctattgtttttttcttgtcagaagttgaacactggtcggaaacaaaccgggcctcaggcagtacaataaattcgatttgatagacttgtctggattccgctaagctttgtgaccatttccaactttttcattactcccccgttatttatgcctattctcgaaaactaccccaatataatttaaattaaactggtcccattgaattgaatttgtgagctttatacgctcttaataaattcgatatcaaatacattaatttgcttatacatttaaagtgtgggaaaaatattaatttcaaaccgacaaatcgaaaaaaaaaagtaatataattcgtttatccaatttacacaaaacgttttccgataccaaaaaaagagaaaatcaattaagacttttcttagcgccagctgtcaaatataccagagataagcaatgggccgtaccatcttatatttatcaattcaagcccatttaaatcttacagcccaaatgatttaattcttgtttttcttaatgtataattttttcttttcccggtcttacgcgttcaaaataaattagtccgttattgattgcttcgtcgtcttctctccacttcctaacactttcttgaaattgcttatttagatagaaaccctagaaagagagcgataatcccaaggaagaaaccaaagaaaaaaaatg

SEQ ID NO: 1442 - DNA, 3000 bp, Unknown
  misc_feature (1)..( 3000): cDNA_ID_2045934_gDNA_ID_1620403_Annot_ID_156036 3000 nt of promoter + ATG
catgtcagcttgtacttcaacagttcattgaaattaaatattcaatgtagtttaacatgaatgtaaatcattattaggttgaatgtgttattagcataagcctattgaagttttattttactctgcatctgaaacagaggaatctctttgatgacaagaaataaacatagaagttaacttgatagatgtgtttgtaatagtagacgacgtaccttgctactcaagttttgttagttttagggtatgtgaaatccaagaaaatcaatatagaaataataaagagaacgagcaacaaaagtaaagtgatattttaaaatatcttttgttttattgggatatattttaaaataaagtgctaattataagtttaatattcattcttcttaaaatacgtaaaccaatcaaaacaaaatatatttctatgtataaatattattaggattaggataagaaccgttgcagctaccttcatcgacattttacttattcgatggaataagttatgatgcatcatctgctgcggccgcagaaaactatttgatatgggagaaacaatggctcgaatggaaagatgtgaatggctttctctaatccaaagtggattaagcactgagattttttcatggatagcttatgctacatcatcaaaagaagcatgggaaattttgatggtgagatcagtaggtggtcctatatttcaagctagaaagcttcttgatctcaagaaagagtacaacaacacgacaatgagcgatgcggaaacggttcatgagtttactggaaaattattggagctagtgtttcgtatgaagtcttgcgggtggaaggtcgaagaaaaaatattggtgaagaagattctttcctctttgcctccaagattcgataaagtcttagtggaggttgcagaaaaactttctgttaatgtcattatcgattgcttgttggttcatgaatacaatatgagaccggatcaagagtcttttcaagaatctgtcattcagagtgttaatgtggaagaaagttttgaagcagaagctgaaatattatactctttgaatgacattactcagagccaagtggcaatgatggagagacaaagtgaagtgttgtcgttggtgcaaaagaatcaaaagatgctaatgcagatgcaaaaacaaatgatgatgttaatgcagcagaaagatcatgtgttagcacactccgaatcttatgaggaggagatgacaaaagtgatcgagtctatggagaaacactacttgaagaaaaagtagttttgtttatttttgtttggttttggttttttctttgtttggtgttcctgaaagttgattaattactgatcatggattcattcataaaattcgtctttgcataaattgtggacttcaacttttggtaattgtgagacttcttactcgaaacagagacttattatattttgtcacctcttaaaacagagaaaaacagagaagtatcgatttagagatcaaaagaatgtgatgtgtgctgttattgtggatgaagagcatttgcataatgttctaatttggtagtttttttccttcaataatatatgatatagtgagcaacatctttagaatatgtttagtaaatttttgtaaaacaaattgacctacctcaccaaaaacaaacttcattggaccagaattaagtagccattaggatcaaatcaacaataatatactatttatgtgatgaaatatgaatccccatcattgtcctatatgaatcaacatttaatatattttaattagtcgaatcttaaaaatgaatcccagtcatattatctttatgtatgtagaagaagatataatcaacattaaatagattattatagtacatcaacatgaataccccatcttgtcatattatatgtatgtgggatagaatcaacatgaatccacattcagtattcaaattagaaatgatcgtaggctatgactctaaagttaattttaatttatatgatgaatgcgagtacccccattatagattcatactatacattattttatatgatcaaatatgaatcatcatcattgttctcctatacttgctcttcattccgaatgtagcaatagaatctccatattgctttttaccaattctaaccataaacaattcatagataaatgcatgttgggtagtgctttgtctactagtaattaataacattatcgattacaatatttgagcaaatcaggcaatctttaaataaaaatatgtatacgatgactcttccgtccaactaatatattgaaaatattataagatccaaattatttcattatttatatcaaacaaaaacaagaaataaataagacttgtctttgttcatgtaaacaagaccactttgttgtttgtttctctattttacaaatttgtaaattatatttttgttatgtttctttccacatttttattaggtcatccaactacccacctccccaaaactattggaggatccaagtcctctctctctcaaccatatatcttatatttcctttgcaaaaggatagcctttattatttaatacacatagattccattattgttatggctacctcattctattctataaagcatacatatgagaagaagaagcaaaatatagactatgtgaaagataaatgaatatttcatatttgtgagacaaattaattagattagaattaacattttgtagctagtccatattagtgataaatttccacttataaagacatattttcctcttttgttttttatacgtaagcttgtcttcttattggctaaaagtagaaaacaccaacttggacaacatcatttaaattataaaaccctccaataaataaaacttggtttatccaatcatcttatttctctgtgctctccaccattttacataaaccccaaaatctctcttcatcatcatcattcatcaacatcatctctctttctctatctcgctgtccctccttctctttctcattcattgca

SEQ ID NO: 1443 - DNA, 3000 bp, Unknown
  misc_feature (1)..( 3000): cDNA_ID_3062455_gDNA_ID_1620403_Annot_ID_156034 3000 nt of promoter + ATG
gctagtacacaaggagaccgagaattctgctctgaagttgaagtcttgagctgtgcacagcatcgaaatgttgttatgcttattgggctatgtgttgaggatgggaaaagattgcttgtttatgagtatatctgcaatggatcattgcattctcatctttatggtaaagtttctactaatggtatacaaagaagaacattcttgttttttgttgaaaaaatgttatagatataaaagtttccataggtatggggagagagccattgggatggtcagcacgacaaaagattgcggtaggagcagctcgtgggttgagataccttcatgaagaatgcagagtcggttgcatcgtgcatagggatatgcgtcctaacaatattctcctcactcatgattttgagcctttggtaaaaagaatgttaaatctttgctcaagctctctctctgtctttccggtttgtgctaagcttgaaacttttgaacattctaggttggagatttcggactagcgagatggcaaccagaaggagataaaggagtggaaacccgagtgattggaactttcgggtaatcttacgccatgatcttgagagatatattcttcttgatttacatgtagaacacaataaccaatttctgtttaacttcaggtacttggcacctgaatacgcacaaagcggacagattacagagaaagcagatgtttactcatttggggtagtcttagttgagcttatcacaggaagaaaagctatggacataaaacgtcctaaaggtcaacaatgtctcaccgaatgggtaaaaccaaaaccaactacagtataacaaagttttagtctttaaagctctgaatgctttactaagaagaaacatttttctgcaggcaagaccattgttgcagaaacaagccattaacgaacttcttgatccgcgtctaatgaattgctactgtgagcaagaagtttattgtatggcactatgtgcttacctctgcattcgccgtgaccctaactcaaggccacgaatgtctcaggtttgctcacatctcaaaaacacttacaagttaataacttacaatcgaaattttctgagtgttaatatttctttttgtctatggaatctgtgtcttctcattgaaggtgttgcggatgttagaaggagacgttgtcatgaatccaatatagaagaagcttcacaaggaaaattcttcttagggagtttgtacactatttagggttactattacagctttttaaatgagttttgcttttgtatatgtaaaaatttgttaatgagacaaagattcaactaaagtttgttgagatttttacatttcatagattcatggccggttaaagtctgaataattgaggttattggttgaaccgattggttgactggtcaaaattcaaacctttcagcggggcaagagggtttcagacagcattttgccccatccaccaaaaaatcttagaaaatatactatactatagagatgtcatgtctgttattttacaaatattatccctatctttgaaagaaatagaattggtaaacgcaagagctgatgggtctggttaatgggccagtttgagaaaaccagttcgtaattagggtttatatcaattctcaaatgacgaattggtgagagtgggacttgttcgaatgtgaagagacgttacaagggtatgtatgcctcagctttgatacaaagctgggaaaagtcaaaagcttaagagagttgatacgcaacacaacggtcacgtctttattccaacaacacacacatctcttagcataaaacacatattttccccaatttttctgccatatatatgattttagaccataataatttcatcaaaagttacagtttgacccacagctacagttgtcgcactccttgttgtagttcttctcgcaactataccacacacaaattaatcaaacaaacaaaaaaattagtaattaatatgatgagattaaagattagtcaaccacatgcatctgattctgatcagcatatatgcagaacaggccaaaatgtttttgtgtctactcactaacacaattgtaaacgtaagtcataagaagagtttattgaattttgtaccatgaagccattaaaggtaaagacgagagagaggatcaagggggttacctgcaagagtcaccacatttgcaggaggagccacatccacaattagaatcatcctggttagaatcagtcccatttctcttacttgtctttgattgattaacttctgtagtttcttcttcttcttatgatgcttttgtgatttcaaccaatgggaatggccactatttatagaagaagagagagattcggatcactttatacataatccaaataaatttacgaataacatcaacttgcccatcattttctttttatgttagatttgttccagcttcattcaagaaagtaatttaatgttagagttttagcaagacaacagagtatcaaacaaactaatagaaaacgtcaaattattggcgaatatgtaaaaaacaaaaaaagtcgtacacgcaagaagataactatcgcaattgccaatagtaaacggcagccgacccaaaaaagaggcaggaaaacttatttaatgagaaatattttcctctgttttgaaatcttcttgtggtcatttggacgacgacccaggacatggtctacgctcttctactacttattaatattatatatgagtttcttacgatccatatattacatcagatatccgttttaagatttttttaaaaatgttgacacaaaaaaaaagttttggacgactaagtgccgtcatcaatccattggattacatcatcaatccattggataacccttggtttgatctctctgaggtgagtatcgagtcgtgttatggatcccaaacattgccgcgtagcttgcgtagtaggcattggaatctcaaaacattgaaacttaaaaaactaagtttcgtggatactgatgcttat

SEQ ID NO: 1444 - DNA, 3000 bp, Unknown
  misc_feature (1)..( 3000): cDNA_ID_2045947_gDNA_ID_1620403_Annot_ID_156032 3000 nt of promoter + ATG
tagacctaacactttcagcttgtcctagatatgaagcaagaacaatatctggttcaagctttcgacattgttcttgaccgatgaccgctacaccgagctcatacagacccggacaagatttacgaggtaagttctggactctgtatctacctacaccatcttttccgtttttgaaatcttcccaatcgttggatcctataagtacctgtgcagcatcaaactttacacaatcagataaaactaagatctaaaaccaaccacttcaagtagcaaatgaaacagaattaggctaattagatatacatatagttagcgaccaattctaacagaaatccagagaaaatgcatttgggacaaagcagacacactaggcattcaaaatgggatctttacactgaaatcctggaaatggaagatcagatttttcgattcaactgaaaatctgagaattccgaaatgggtttcagagaaaacacaagatcgagcgaaaattctcaatctacaaatcgagaaagagaaagacagaggacctgccacttggagaagacggtgtcgtgtttagttcgtttgtagtcttctcttttgaagacagtggggacgacggcgaaggaaacgccgtcgccgaattccatttcgataaaaccgatgatatagtgtgaccgttaaattaaagcggacttggtcttttttctcagtgctcgttaatttagagacaccaccgttaaaaatgagaaaagtttttctcccctccaaaaatggatgtttatccttccaaaatggatgatttttgttttattctgtccgaaggaaaagtttcaagttaccgttggaacggtgaagcttcttctgtacggtttattagttaccgttggattttttttttttaatctacattagtcaatgttgacaaccgtaattagcataagggagggaatctacattctttaatgagaatacttaacttttcaattggtcaaattttcttctatctttgggatttttttattacacttttacttgatttggcaaatgttattaccaaatatattgatgagaaccagaaattggtcatgtgatattcgttttcaaccaatcttgtctatcctttgttaatcattagtattttagaataaattgaatatttacaaaatatgcgtaaaataactcttttttaaaaaagtaatgtcaaagacacaaatacttatcaaattaatatttgtcatgttttataagaaaacacatttaatttatgttgttgaatatgtaaatctgttcatcgggtatttctacccaccggattgtggcatttggttgtcgacgatccgcgtcaaatttcactttggaagttctccaaccgttatatatagggagaactaatgttccacaacatctcacaaatgtggtcattatcttaacacttaactcatgagatatacttgttttaatttgatggcttgccctaaggatgctaaccgcgttgaagctataagccaatcaatgtgtctatggaatgtcgacaagcggctcacctatcccctaccatctaaggaccccgtttccgaagccgaaaaaaaaagtaaaacttaaagataacaattctgataccactttattaaaaaaagaaaaaaaaaaactgattagtgtcactttccatgctgccattaagtccaaaatgttgttttcacccttttcacttaagtaacagtatatatttactaaatcataagatctcaaaattgtttaatttctaagataacataagatatattcgattgcatcactagactttgatttattgaagcaccttttatgctttaataaagtacaaatcatcttttctcaacttttgtttttcactttctccactgaaatatataaaaagcaacatgaaaagcatgcaagtgcaacgttcaactccttcattataaccattctaagctaatttttactctttttcttttgaaatgaattatgagaaccaattctataatggttcttttgttataaaagaagaaagttggccataacttgtccatgaagaaagaaaacagtcttattctttcactaattctaaaaaattaaaatcaacaaatttgaaccaaaaaaagaatcaagtatcatcctttgacacaactctcttggtttctttttgctctctttagaataaagcagagtactttgtgaatatttctttattctttttattattcttggaatttatttaaaatacaaaaaaaaatacagagacaaatagagagaaagaagaagaagaaagaaactccaccaatcatataataataataacacaccattgtctcttccttcaaacagagctacaaatccaaaatacttcttatttgtcatctttctctgtttatattttaattgtttggatatttgcttttatcttctaccaaattcctctgattttgtcgaagaaattagtagctgaaaatccaaaaatcggacttacttcatcagctttttggccccactttacaaagtatgagcaagtttttcttgttttctacagcaaagcaatgctcacaccattttcgtggagcttaaagtcttcaaacccaaactaaaagctttgaaatttctctgcaagaaacagagagagagatctagggattggctattaagagagagagagtagagtactacactattggttcctgtgctgttgtgttttgtgcatctgttcttgtgtttctcagataaaatattagtttcagtctttcaaagacattgaatctcacacacttactaacacacactcacacacgcgttaatttctcaactttttttctatttatttcttttagcttctagggtcacttgagaaagcatcttggattgcgtgatacttccactttctcatttcagaagaaaaatgggtttagattgagtgaagtgttaaaagtatatgtaagcaagggttgaagaagaagttctttcaatttctgtatttgtgatttccttaatcttagctagaga

SEQ ID NO: 1445 - DNA, 3000 bp, Unknown
  misc_feature (1)..( 3000): cDNA_ID_2045954_gDNA_ID_1620403_Annot_ID_156031 3000 nt of promoter + ATG
tagcttcagcagcaataactccatcaagtgaagcaaaaacaattttgattctgacatttatctgcattattatcaaagcaaacaaaactctttataatctcattaaccaaaaaagctgtttctttttaaatctacatgaataaaagtgagtttctctaccttctctgcatcataaacattgtgtaactgaaacatcatctgagaacatgactcatgaatatcatctttcctatccgaattcgttccagcaagaaatcttccataacctgatgcacagtcactagtgaacctcgaaaatccccaaatctttttacctgaaagaaaccaaagacataaagattaaatctttacaccattctaactaaatcattcagcaccaaagagaccaaatttatcaccactcaacaccaataagtagccaaatcgaaaaagaagagaagaggaaaaagatgtgtacttgtgtaattagaaggaacaacaacaagaagtctaattcgatctccaggttgaacaacatgagttaaagtccataaaagagctgcttttgggatctcctttgaagctctaacagcaaccattactttcttccccactacaacacctctctctttaaaacccttctgcttcattctctagctaagattaaggaaatcacaaatacagaaattgaaagaacttcttcttcaacccttgcttacatatacttttaacacttcactcaatctaaacccatttttcttctgaaatgagaaagtggaagtatcacgcaatccaagatgctttctcaagtgaccctagaagctaaaagaaataaatagaaaaaaagttgagaaattaacgcgtgtgtgagtgtgtgttagtaagtgtgtgagattcaatgtctttgaaagactgaaactaatattttatctgagaaacacaagaacagatgcacaaaacacaacagcacaggaaccaatagtgtagtactctactctctctctcttaatagccaatccctagatctctctctctgtttcttgcagagaaatttcaaagcttttagtttgggtttgaagactttaagctccacgaaaatggtgtgagcattgctttgctgtagaaaacaagaaaaacttgctcatactttgtaaagtggggccaaaaagctgatgaagtaagtccgatttttggattttcagctactaatttcttcgacaaaatcagaggaatttggtagaagataaaagcaaatatccaaacaattaaaatataaacagagaaagatgacaaataagaagtattttggatttgtagctctgtttgaaggaagagacaatggtgtgttattattattatatgattggtggagtttctttcttcttcttctttctctctatttgtctctgtatttttttttgtattttaaataaattccaagaataataaaaagaataaagaaatattcacaaagtactctgctttattctaaagagagcaaaaagaaaccaagagagttgtgtcaaaggatgatacttgattctttttttggttcaaatttgttgattttaattttttagaattagtgaaagaataagactgttttctttcttcatggacaagttatggccaactttcttcttttataacaaaagaaccattatagaattggttctcataattcatttcaaaagaaaaagagtaaaaattagcttagaatggttataatgaaggagttgaacgttgcacttgcatgcttttcatgttgctttttatatatttcagtggagaaagtgaaaaacaaaagttgagaaaagatgatttgtactttattaaagcataaaaggtgcttcaataaatcaaagtctagtgatgcaatcgaatatatcttatgttatcttagaaattaaacaattttgagatcttatgatttagtaaatatatactgttacttaagtgaaaagggtgaaaacaacattttggacttaatggcagcatggaaagtgacactaatcagtttttttttttctttttttaataaagtggtatcagaattgttatctttaagttttactttttttttcggcttcggaaacggggtccttagatggtaggggataggtgagccgcttgtcgacattccatagacacattgattggcttatagcttcaacgcggttagcatccttagggcaagccatcaaattaaaacaagtatatctcatgagttaagtgttaagataatgaccacatttgtgagatgttgtggaacattagttctccctatatataacggttggagaacttccaaagtgaaatttgacgcggatcgtcgacaaccaaatgccacaatccggtgggtagaaatacccgatgaacagatttacatattcaacaacataaattaaatgtgttttcttataaaacatgacaaatattaatttgataagtatttgtgtctttgacattacttttttaaaaaagagttattttacgcatattttgtaaatattcaatttattctaaaatactaatgattaacaaaggatagacaagattggttgaaaacgaatatcacatgaccaatttctggttctcatcaatatatttggtaataacatttgccaaatcaagtaaaagtgtaataaaaaaatcccaaagatagaagaaaatttgaccaattgaaaagttaagtattctcattaaagaatgtagattccctcccttatgctaattacggttgtcaacattgactaatgtagattaaaaaaaaaaaatccaacggtaactaataaaccgtacagaagaagcttcaccgttccaacggtaacttgaaacttttccttcggacagaataaaacaaaaatcatccattttggaaggataaacatccatttttggaggggagaaaaacttttctcatttttaacggtggtgtctctaaattaacgagcactgagaaaaaagaccaagtccgctttaatttaacggtcacactatatcatcggttttatcgaaatg

SEQ ID NO: 1446 - DNA, 3000 bp, Unknown
  misc_feature (1)..( 3000): cDNA_ID_2045968_gDNA_ID_1620403_Annot_ID_156027 3000 nt of promoter + ATG
gagaaatggcctaattctaatcattgtggtttttttttaataaaaagggaatgacagtttaaaaaagatgagctaatatgagtcttaatgagataataaagaagcattagtcttattaaacaaaaggttaatggtagacaaaaacagctggcattttcttttcttttttctataagataaaaaaatcaaaaggcaataagacaaagaataaggaatacaaaataataataagaagaagatatctttgaatagagagaagaagaagatcccaagaataatcccatctggaaatgaatcataataataaaagaagtttcacaaatccacaagcaaagaatttctccaagaacatttgattcaaacaaaagatgagtcttttttttacaaaaacaaatgaatctaacaatgcccacatgtctgttcttccccaaatcaacagaaagattagatttaagcaagtttaagataaacccagaaacaaaaatcaaagctttattcggatccgagttcaaaggttaaagaatgaaaccttgccaccaagatagattgttccaacgtcgacggagacggcgccgtaagagtccgtcattggcaacaaaagctcttccgcttagccgtcaccgtcgccgtcgttgttttaagaacgccgggataacaagagcttcttctcttttcttcttcttcttctcccaacctctagattgttttttggcttttctttagcttatatacaaagcgatgccttttctctctcctctctcttaagacctctctggaaaaagaaacgtttttttttcgttttcctttttttcttctctttcgttttactctctctataaattttgcggtgatttctccatagacgccggtagtcgtaacatgacacgcgaacggtcaaaaaacttaaaataagaaacatttttaatttgatttatttatagaaacttatttttgataaatattattaaccagctcgaatttcaccaataacagtcgaatactaattcggaaaaattgctgtaaataaattggataattgtataaatgtaaacaaatattaaatgttgataattggataagtaagggaggtgcgaagttttggttaacaacaaaattaacattaagcaaaccgaatataaatttttagagactgtttagttttattattaaaaaaaaaaagagaaaccaaattttctaaaaatactattacatataaaaaattatttttatgtaataatattaagaacatcaatatttaataaacaattgtatatttatactattcgcaattttttcactttgagttggaaaaaatatatcttagtagaaaattagaaatggactaatcttaaaccatcagataggctttcaaacatattcctatcataagaaacatgatgagtaacaccactatctatgatccatgtattttgtgataacacttgtctagaggacgttagagaacatagtaaccataaagtcgaaggtgagaaagagatatcattgaaagcaaaactttgaagtgaccaaatctgctgagttagctgataagaccttggcaaattcgtaatgtgaaatctagtatccaagtctttccagatctctgcagcatcattgaaacgaagtatactcttatagatctgctttgtaacagaattaaggatcctagatttaaccatactgttgcatcgtgaccacactctaaagctaggatcagattcaggaggtcttggtaaagttccatcaacaaaagcaatcttattcttaacgttcaaagaaacaaacatcgcaatcttccaagaagagaaattagatccatcaagtacctcagaaacaagtgtattcccaggactcaccatttgagagcgcgaatggcgaataatgagcatccgagaagtcgaactgtggtaaaggatagatcgatggttttgaattgaaattttgttgaaacggattcgaaattggtggaatcggtggaatcggtgaagcttgaacacgatctggagttttctcagctgaagttttgctcgatcttctagtacgacgccgcaatttctctacggaaaccatcgcaagatcaacgaagctctaaacaactgaaattttccagaaaacgtagaaaattgaagaaacaaagaatcaacgagtttggaagatccaagagctcgaagatactcagagtttaggttgaatcggatgaatcttcgagatccatcactctgataccataatagttgatgaacgaattcagagaaatgaagaagatgagaaaaatttgttattcttcttaattgttctgttacatgaaacactctttatatgtagagtgttccggtttagtaaccggtttacattgtaccaaacaacaatacaataaccgaatttatggttaatatcttaagttagacctatttcaaaacaagcctaattttcacaatagtcaattttttgttgttgaatatttggccgagaactagacttcaataatggggaagaataactaaaatcggttctttctcctctcccaaagtcaactagattcaccaagaataactaactttggttaatgattacatgttcttaaagttatggatcttttgggaaaaatggactatttggcaaaaagagtggcaaaaagagtgtgaacataaaaaatacaaatggggcgttccgagaatcgaactcgggacctctcgcacccaaagcgagaatcataccactagaccaaacgccctcatttgatatttcgttaattagataaataatacctaataatacaaacttgaattggtcttgcatttgggccgttaacaggccttgctaagtcatatgtggtgtgtatttctccatctgctattgatctcagtaaaaattacataaagagagccacaagcttactgactctcttgtgtatcgctctctccgcatttccattaaccctccaattttcccgcctttgtctcactctcttcccgccttgcactcgccggggactccatg

SEQ ID NO: 1447 - DNA, 3000 bp, Unknown
  misc_feature (1)..( 3000): cDNA_ID_3062410_gDNA_ID_1620403_Annot_ID_156026 3000 nt of promoter + ATG
ttcagaagcagcaagcctccgccggtccgggtaccgagcctaagaagcgtcgccgtgtcggattttctcccgccggtgagtcatttcttcttcttgtttgttttcctttactcgcgattaccactttcccagctccgatttcgtatttttctttaatccgttgatttttcttatgtgcagatactggtgtcgaggctaacgagtgcatcaaaatttatctcggtgcgtatttgatttaaatcatttgaagttgattttggggatatagtttcgtacgaaaattagggttacgtttcctgctttcgacctttttggtgaaattagttggccttacttcaatttttctagtttttggcttttccggcgaactttattgctttcaaaaggtagttttcagttattgaacatgtagagcagatctgtatactgagtttctgttgatttatgtgttttatctttcttccaattgatatttgttcaatgagttgtaaaagtattttctgtgtgaagtgtcttaggttgctgtgacataattttgttttctgttttggtaatcgtgatgggtgatgttctagtttcaagcaaagaggaagttgattcctctgatatttccagcgtgaagccagttgacttgaatgatttctttgatggagatggcaagatttatggttaccaaggtttgaaggtaatgtggcctcctaccattagattattttgctctttcttaaatttctggtttcgcattgttgtggttctgttctgacatattcttgtccacaatttattgatgtcagataaatgtatggatcaatagcatctcattacattcatatgctgatatcacataccagagcaccattaacgtaagtgttgattgtatttgctattcgttggattggttttatacggcttttaaagggactaatcatcactatcctgttactttctgttgtgtgtttgaagggagacaaaggcatcacggacctcaaatctgctttacaggtaccaatcaacttggacacatgcttcttttgctctcattatattattctgattgtctgtttcatttcacccacccagaacatatttgctgagaccattgttgataccaaggatgagtttctgcaaaccttttcgacacagagagattttatcaggtgcataactgcataccttctggttgctttcataccatctcaaatttgttcccaacttaattacgatagatctctttgtagtctctgaatataatgttgaactttgtcattgattgttgttctagaaatatggtctcgaatggagaggtaatgcatgctggagcaacagatggaagcagcaagaatgctgaagtggttccttctgatccccaggtagtttttgcttaatatgattcatgtatcctatagtcttaataagtttgagcaaattagtttgagatgttttcagcttcaaatagaacttataaaggttgattatcctcaggttatacggatggaaattggttctccaaatgctggactcctctatagccgattggtaccccttgttcttctttttgtcgatggtaataacccacctaccctttaagtcatcttgaatattttatttctcttgttagtaacttagtactaacgagatgccggctcattcttttgatcaggcagcaatccgattgatgtcactgatcctgactggcatttatatctcttaatccagaagaaagaggaaaaagaagatcctttgtatcgaattgtgggctttaccgcaatttataagttctatcgttatcctgacaggctgcggatgcgactcagccaggtattaaatatattcctcagagatctcaatcctacttacaatctttttgatctgactgtttttgctgattcgttgttttgatttcagatcttggtcttaccatccttccaaggaaaaggactcggaagctatcttatggaggtagtaaacaacgtggccataacagaaaacgtttacgatttgacagttgaggagccatctgaaaagttccaacacatccgcacttgcatagacataaaccgcttgcgcagtttcgatccaatcaaaccagacattgattcagctgttcagactctcacaaaaggaaagctatcaaagaaagctcagatacctcgattcaccccgcctctgaacgccattgagaaagtccgcgaatctctgaagatcaacaagaaacagttcctcaaatgctgggagattttgatataccttgctcttgatcctattgacaagtacatggaagattacacatcagtcatcacgaaccatgtgagaaccgacattctgggaaaagatatagaaactccaaagaaacaagtcgttgatgttccaagctctttcgagccagaagcatcgtttgtggttttcaagtctgtaaacggagaagaggctaataccaatgttcaagttgatgaaaacaaaccggatcaagagcagcagctgaagcaacttgttgaggaaaggattcgtgagatcaagttggttgctgagaaagtctccaagagtggtcaaacgctaaaagtctgattggaatcaaaactttgtgagtcttttatcggaagttttttgttgaatgatcaaactagaaatctcaaactttgttgatcttctgtaaggagtaaggacaaatctgtttgtagcgctatgttatggaagttgagtaaactaatgtagttccggttatgatgtttgttgtcacatccagaaccataaattggaatattccgattgaattttagcaaaaacttgatataaaccgacgctggttgaaccaaatataccgggcaaaccgagaaagatactagtcaaggcaaaaaaacaaacataagaagaacaaatctcgaagggtgggacttttgtgccgtctctatagggagaagaatttgttttcgtgttctattgataaacgaatttgattttgacagagtgaggcagagagagagagagagagagtgagagatg

SEQ ID NO: 1448 - DNA, 3000 bp, Unknown
  misc_feature (1)..( 3000): cDNA_ID_3062414_gDNA_ID_1620403_Annot_ID_156024 3000 nt of promoter + ATG
tcagtgttaatttttcatgtgatccagaaatctcctctaaactggtatgtccatcttctaacactatctgacgggtttctctatatctttggctgcctgttggtcaccaaagccacctctgtgtccttcaggttgatttagctttagaagaaattgtacggcttcaaaaggaaggcccttcacaggaagacatttcagctatccttgaaatcgaacaaagagctcatgaaaatggcatgcaggtattttttattgccataatcatcacaaatccatcacagccaaaaaaccataatttgctgcagaaacaaaactgatttaattttgttcttgtcaggaaaactattactggttagacaggattatacgtggatatcaatcaagggtttacgctggcgatttgggcgcctcttgcaaggtcagtttagaaaacattttttgtcaatactttgatcattttttataaacacagtcttacgaaaagggaagaaacttctctgtggtttttagattttagaagaagggcgtttgcgaatgagagagtcacttgcaccacaaacagcacaagctgcattacagcgaatccttcctcacccgtgcaagaaacagtacactgctgttattctcatgccgcagagatctcgttttggatttctttcatctatctttagttcacgatccgagggcccttatatccgtgataccaaggtcagtgttcatctgttctttgtcttgtctccgtaaatgtaacattgcaatcactaagatatgaatttggatctttggttactagattttggctggcattgcgggattgggtgttgttgtttttggcatctggagatactctcgcaagtagaagtatgaactctctttctttcaattttctgattatttaaccccaagatttcagagtttttaaatgtatctgtgaacctcagcgtttattatgtaagttcccattatttttcatgaatatagaaacacaaacttatttgtttgctacattgtttgtgccatgactatcatagttttcaacttttggtctatacattgagacaggaataagctaaatccttctcttcagctagctctcgtgcagagtcatccattttctccctcgaaaactcgtctatactgagtccttgtacgatcttccaactccctttctcacagataaccggaaacgagtaaaccaaaccaggtggtataccatatgagccgtcagaacaaacacccatagaaacccaagttcctttaggggttccaagaaaccaatcacggatatggtcacaagctgcaccagcagcggaaaaagcactcgactgtttccgtgctcttaaaacagctgcaccgcgttgctgaacttccacgataaactcgttcttcagccagttgtgatctgtgactagttcttttaacggtctgtctccagtttttgtagagactgttgcgtgattggtgtcgggatattgagttgaagaatggttaccccaaacgatcacgttctttacactgctcacgggaacacttagcttatctgcaagctgagctagagctcgattatggtcgagtcgtgtcaggcaagtgatattttcttccgggattgatggcgcaaactcttttaagatcagagcattagtgtttgcagggtttgcgacaacaagaaccttgcaatcatctgatgcataacgctctaaagccgaagcttgagctttatatatcacaacatttttcgacatcacatcttttctttccatgcctgctatccttgggaatccgccgatcattatcacgatattcacatctttacatgcttcaacaacatttgttgtcgcgataacgcctttgagaagagggaaagctgaatcttgaagctccattttcacagcttctagtgaacttgaagctggctctatatcaagtaaatgcagaatcatgggttgatctggacctagcataatacctcttgcaatcattggagcaattgcatatcctatgtttcctgttcaatagaaagttctcaattaaattaagaacaaacgaccataaaggtagggagtagtagataaaagactccaataaaaaaacactgaaccaaaccaaataaattgatagaattataaatcaaaacataaaccggatcgttttttgtttgagttcttacctgctgcaccggtaatcaaaacccttataggatctttctcaatgtttaacaaattacacatgtatattatcattttccatgacaaaccaacacaaaacagtagaaccaaaactttctgaatcacaaaagtataattaatttcttctccaacgaactccattgttttccaagtaaaaaagataataaagcaacgaatgaatgtcatgcattccaaagttcaatttataaaaccaaaaaaaataatcaagaagacataaggaatctatgaaaagcttctaagaggacataacctgatacttaacaaaacttcgtcttacaaaaaatctaagtcatgcaacaaaaacaaggaatctataaaaagaaatgtagccaaataaagatcctcaaacttttatttttgttggttaacatgggtgattaattaatcgaaccaatcagtttaaattcgagtaaaacatttacttcatatgtatttgggccgtaaatgggctactaaaataagaaagcgtaagagggaaatgccaagcataatagcacaaaaaataggcccattaaagcccaatcatttatttattttagggttaactcaaagtgccgcatatatatgcttagttctcttccttcgtcccctttctgtctctcggcgttcttcaatcgaaaggtactactctctctctctctttctcaatctagctcaattctgtgtccttgacctagctttgaacagatctgtttgatttccggtgaaaagaatcgattttgaagtggttttttgtaatgggtaatcgcaggtaaagagtttgaagaagtaagtcacagagaaagagaagatg

SEQ ID NO: 1449 - DNA, 3000 bp, Unknown
  misc_feature (1)..( 3000): cDNA_ID_2045994_gDNA_ID_1620403_Annot_ID_156021 3000 nt of promoter + ATG
aattcacataattctcatcgattagagacatttaggtattttttgtatgaaacttgatcataggtttaattatacataggccaatacaaatgtctcttaggtaatgacgataatggaattaaggattagaacataatttgactgattctaaaattcaggaaggtgttgagtgggagcacaagagcaaaatcgctggtaaaatgcatgcttgcggacatgatggtcatgttactatgcttcttggggctgcaaagatacttcatgaacatcgccaccatttgcaggtctatgcatttttcccttttgaactactttcatcagtaacatttggcctaacacattttgttttgttttgtttagggaactgtggtgcttatctttcaaccagctgaggaaggtttgagtggagcaaagaagatgagagaagaaggagcgttgaagaacgtcgaagctattttcgggatacatctttctgcccggattccctttgggaaagccgcttcacgtgcaggttcatttttggctggagctggagtcttcgaggctgtaatcactgggaaaggaggtcatgctgccatccctcagcatactatagatcctgttgttgcagcctcaagcatcgtcctcagtcttcaacaattggtttcacgtgaaactgaccctttggattcaaaggtttcgttttttactctttgatgatcttcacacctggtctatacattatagaacagaactcattgaggtttcttctgcaggtggtcacagtttctaaggttaatggaggcaatgcttttaatgtcatccctgattcaatcaccataggaggaactcttcgagcctttaccggatttactcagcttcaacagagagtcaaagaggtgatgcgacccaagattgcgcctataatatttcccggtattgttgctttacccatagaaccaatctccggtttcaacttttgattctaggtgattaccaagcaagcagccgttcaccgatgcaatgcgtccgttaatctaacaccaaacggtagagaaccaatgccaccaacagtgaacaacaaggacttgtacaagcaattcaagaaggtggttagagatttgttgggtcaagaagcttttgtggaagcagcacctgtaatgggatccgaagacttctcatactttgcagaaacaatcccgggccatttctctctactgggaatgcaagatgagaccaacgggtatgcatcgtctcattcaccactctatagaatcaacgaggatgtgcttccgtacggtgctgcaatccatgcatcgatggcagtacagtacctcaaagagaaggcttctaaaggttctgtctcaggctttcatgaagaactctaaaccttggttgtagacaggttgttcatcggttattggttcagattcagaagcacaaacctaacactccattgaattaatcaagtgttatcgtacaagatccttgcaagtgttatagaatgatgaaaatgtatttaatagctaattttcaattggcaaattatcaacttttaatagtctgtgtaaaagtattgacagaaacttagaacacgaattatgatcattggtcttgttgtaatgtattggcaaaaatcatatcttatgtttaattgaccaaaatcataagtgaaaaaacagtatttcatagcatagaatcaaaacataatagttcggtgccaaagaaaacaaaaagttacaaatgaccttgagaagtttcacgacaacatctttctctctaacttcttctatttctcagaagagttgggtcctctcttctttccgaaaccaacaactgcacaaatcaatgaaccattactaaccaataatagatacgcaacgtaataagcatttgagtcaaaaccaaatgataaattcagaagctctagtctaaaacatcgaaccacaagtgttccaatataacacatttctcgagtattcacaattcttattcaaattcacaatattattaaccacattcaacaatgcagtagtatcgctttataaaaatcgaattcaacaatgaacactaacacactgtaaaggaatcaacaaagaaactagatcggaaaaattacctgcggtgacaaaacgacggttgtgctgcagacgcttgtgagcacgacctctgggcttctttttcttatcttgcttcgcaacctttggagtttgtcctctaaccttaccggcacgagccaaagatccgtgaacctttcctgaaatcgttaaaacacacttaacgtcaacagatccacatcagaagaaaaatcaaaagctaatctataaatttcaagaagtttccaaggattttacccatgattgattagcttctctgctttttgttcctccgttccgccggctgcaagaagctgaaatgagttcgtgcgaaatctcagaattagggttttcgagatgatgatacgtatttaaacccgataccgaaatatattgggctttatgggcccatactaactacttaattactattgggctttattagctcgaatatggacatctgtaaaactggacctataagcaacacaagtttgacaatataggaatacaaaataattcgaattcagagaaaaattatctctactttaataggtctataacgtttgcataatctaaaacccaagatattttggaaacatatttctattttaataccattttccactaatacttttcaataacagtagttgtttccataaataacgtctccactaattgaataaaatgaaatatttaacgaattattaattgcgataattagatacgaatcaaaaagattccaccggcttcgttggaaactttaagatatttccgattttaccccatataaagggaagatccaacggttattcttacatctctcaatacgcagccaaatacactctctctgaaacctctcctcttttagggtttaatatcaacgcctccaaaatttccgtgcttttgttttcgtagataacgaaca

SEQ ID NO: 1450 - DNA, 3000 bp, Unknown
  misc_feature (1)..( 3000): cDNA_ID_3062427_gDNA_ID_1620403_Annot_ID_156012 3000 nt of promoter + ATG
agttttccccattattattggttttgggtcagaaaccaaatagttttcatctaaaagctttgaatgtgaaaagtgctccaccacagcacgcagagatgaaccctcaaaggaggataagaatacatgttggatatgaatgataactaagccatcctagaaggatttatataccgctcgttttgaaaactatcatattatatagtcagctattccaacataagggggagaatgtatacagctggtgaaaaagataaatagaaatgaattatcaatgatcctcggaggaaagaatgtatattaagagtccaaaaaataattcaattacagaatttagcgttgtaattgccagacgcatttgctgacctaaataaagtgatgaagtcacctataccagttataaattaaatgctccagaatagaatgaatgtcctgtaaggaccaatttcaaactgctattgagtcttaagatcacattaaacataatagaccttggttccaaatagaaatatcctcgtaaaagagaaggagcacaaaattaaaaatgaccaaattgaggaaataaatattttgatgatctctcgaagagagtgaatgatctctagaagacacataaacatgacaaatgaaacattcaagtacttgacaatgaagagatctagctagctatgtcatgtcaaaatataatggaatcaaaagcaaatcgacgtcgtaatgtatttgcatgctatgagcagttgatattatggacaaaaaggaggatcatgaaagaaagtctattgaaaagtgtacacaaagtagtgattagccaaaaatggaaaagaagaaatagacatataattataatctctagtagagatatttggactagtagactatgcacatgatgtgtaaaaacagtggaagataaatgagtctttatgtgaaagaatagtgaaattaatgagattttcagaaacataagaaatgtattatgaagagatatattctcttgtggtggatgtaatatttttaagtatctaaagtctggcaataagagacggaacactggatatgacatttatatgaaattcttgaaagatataatctctgaaggattaattatatgagaattatgttctctagaactctactcgatcgaataaaaagaaatatgtaacatgacatataatcatataaatgtatatttacgttgagtttgtcaaaatatattgatcaaactaatatttattttgaaaatcattaaaactcctacagagttatcataagtaatacgatgccaataatctatgataaaatatcactagataatgatatttataagtctatatgaaacccatataattttgatcattaagattatggttattaattccaacgagatattgtatttgattgaaaatcatctcctgaagaagatgtttccgagggggagattgaatgatatgcgtggatgtaccctttttccttatcatagtttttatcccacacgatttttctatgacaaggtttttaacgagacattaaagaacacacaaataatacacttgatgaatattaagaaattctatcaatcatccaaatgaatattatacactaatgatatttagagaaataaataagatggtcaagatgaatcatctaaaagattcatgagcagaagaatgacgttgtactttatccagaaatttgttcaagagaagatttggcagacttattttcaaatactgtttattctctgccacatcttctaatcatgcagagattttactaattcatgaagctagccgcgagtgtgtatggctaagatccatagttcaccatatacaagaagactgtggtatgtatgcagggaaaaagactccaacaattatgtacgaagaaaatgcagcatacatcgcacaactcaaagacggatacatcaaaggcgatagaacaaagcacatcctaccaaaattcttctacacacacgatctacaaaagagcggcgatgtacgagttctacagatccgtttgaatgataatctggctgacttattcaccaaggcgctacctactgctactttcaagaagttagtctatcgtatcggattacgctgtctcaaaaatctcgacgaatatactcataagggagagtaattgtatgttgcactctttttctcttaaccatggtttttcccattgggttttcctggtaggatttttaatgaggcagcatttcaaatattttacgagttatggtactataatggtcatcagggggagtgttatgaataaagatggatgcccattataaggcccatcatctaagtccatcatctagatgtttatagggttttaccctttccttgtactcctatataaaatagcatttatctcaatggaataacacactcatttcttctatctctttctttgattataacaattttgtaattttgttgatttttttttactcttaacattaaataaatttgtataaatttaaacaataaaatgaatggatgttaataaatagttaagaaccatcaatctttctatattaattgaaagactgtttttactatgataatttttacaacataagtgtgaaagcacattattacatgaaatcttgggggatgtaggtgtaagaatctaaaaataacaacaatatccaaagttattgaataaaagttcatactaaatgtcattttagtacttaatttatttatttacaaagaaaacttcacactttttgtgaaacacaaatatgaagttgtttaatgagatttattatgaaatgatgaatattttagaaagaaaatgaaaaaagagaagattttgaaggtagaaaagaagaacacaaagatcttagtaggccttatgtaatgggccttaatatgtttttcctgtaatggagggtaattttgtaaatatgtctaatattgttgaagaaaacgttttttggtgaaattcgttgaccaacaactctcactctttgaagttgttttcttcccggcg

SEQ ID NO: 1451 - DNA, 3000 bp, Unknown
  misc_feature (1)..( 3000): cDNA_ID_2046013_gDNA_ID_1620403_Annot_ID_156016 3000 nt of promoter + ATG
gacaatacgagatctaccaaaattaataaaaggtaaaagaatgaaattgataagatgagttgatgtcattaatatgcatatatgcgtgataaaagaacacatagacaatttcaaaacatgacaataataaagaagaagtacaaacaaatatcaagattaccagatctgcgtgagatcgattggatagggaaaatgtaagaggaagaagaatttgataaagacgggagtgatctcaatatatatagtagagaaaaataataacttgtgatttatgctttttaagtattataattattgttattaatatctctctttgtttccagaagagacacagaaacacatgtagatacgactttaagtactgaaaaatctatgtcaagtagataaagaaatgaagaagaaatgaggaagacgaagagtaaaggaaataaaaggagttgagactgaaaaggttaaaaaccctaattttactctctcttgtcttgtgcgactcatcttcagtctatcgaccaaaccttttatttatttcctttttgttttatctatctattttatttattattattagtgtattcgtattctaaggtggtatgtattaatattataataggctttgtacatacaaaattagtattactcagctaaatgagacatatcagaccatgtcaactttttttgagcaatataaggaaattacgaattgtgagatatttataagttttagttggagtcaagctgtaaaaaatgtaaggctttctttttatcaaaaagataaaaatctaattttaaagattttatttaataatcttgtgctttaattaactgttgaatctcgctcttttgtttgaaataaatatttgtttgtacatccattttaatagtataaaacctggtaccttctctgaccttctgaatgtttttgaacataattacggattaatttaggagaagattatcaatatttttaaaataaagaacgcaggaaaagaacataggaaacaaagcatttaaggataatctctttggattatagggcaaacacatgtttttaagaatctttttcttttttgctttctttcacattatttgaaatatgtaacatattcttgtgggatttgaacccaatggtcctacactggtgtgggtccaatgatgatgtcgggagatggggcctagccgcagatttgtttgaacaacagatcaaacggtcatcatttatttgatctaaatgattatattaggttttgcattttttcttctcctttgaaaagatgaaaaacgaaaaaaggtcagaaatctactggagataagagtaccgtctgagactagaataaacatagatatcagctgaaaaaattgataagagtatgataatgtgcttattcagttttattattaaaaaaataaaaaaattagtctgctacgaaaacacaagtatacatactatagttgataagagcattatccatggtgtgtagtaagtaagtaaacaaaccattatatttggattaatcgagtattcagcaaatattcatattgtcttgttaatgattaagagcctagaagtctttaaaatatccatcaagattcaaacattatgactcaaactagtgtggtgttgtccattatactcgaaacgaaatggtattttttcaacttttgcttgtaaaacttagccagtgcatggcctttattaaatcaactattgggtcactgcatgacccatttatcaacctgtaactgaatattgggctttggcaaagatccaattagcttcattcgtatttcagaaatttgattttatatccgactgagtaggtacgtatatgcaatacgttatgtcctattagccttatgggactcacgggtacttatgcaggagatggattaatttcatatccatctgcaaactaaatacatttattttcttatggcaaaaagccaaaaactatgtaacgtttaatttacgaaaaaaaaaatatttaatatttgggttatatggatttttttttattttttttttttttttcgggacattagcgagagtcatagtattaaagaaacagtaaaaacaacgaccagatttaatgcaactttattactactttaattcagattcgagaattgacaggcaaatacgcattattttagtacattatgaagaatcatacagttacatatttcacatatatattgttttaaagatgtaaaacgactaagcaagtatgtcatctgatagcattatgaactaataactttttgtcaactctgattttcatttttaaaattattatatcttgttacctctttgtaaccagcaatagtttcttgacaacaaaagaatcggcaaatcaatgaaaacttattaaactaacacacaaaacataaaaaatagtgattagccgacacaacaaaattggatttgtctttctctctttaaaagattttcacccgaatattcctaaagatctgaaatactgaaaatatcacacaaaaaaatccaaaaagaaaaaaaatcattttaaaatttagaacttgtttttcaaggcccaaaattaatcgttgtcaataattggaaacttaaaaataaagtcttgttctagaagaatgtgaatcatcttctccaagtttcaaacgttggtttttttccccactgtgatcgtcagctttatatattatatacacgagaatcttgtacccaattaacatatacatacatgtaaatgtgtgtatgtatataatataaaattattctccttttcactaatttttcttcaaatactttaatgcccaccacctgttcgatcaaattccccatctcgaaaagctagaactttcttcgtctctattggtctctcactctctctcttacctcttctcatttgttctttctccttctaaattgggttatcaagtatattggatcaacgggtttgattcacgatttgtcatttcatcttcgtggagagagtttgatctgatttgttgatcgtcagcgtt

SEQ ID NO: 1452 - DNA, 3000 bp, Unknown
  misc_feature (1)..( 3000): cDNA_ID_3062423_gDNA_ID_1620403_Annot_ID_156017 3000 nt of promoter + ATG
tgacaaccaatttctgatttaactcatatatatatatgagactgaaacaagtccacaaagcccgatttttaatgggccaaaaagcccatattgttgatgaaaggtctaaacagtatatgctctgtttagccgttgcaacaaacttcatcatcacataatgttttgttttcttttgagtttttttttgtttctctagctttgatgtcgtaatcttcttccatcaagattaaaggaaacaagcaaatgacgacgtcaaaggacaactataacaacaacaacaaaaggagaatacaactagaacacattaaggttggaacactccaaactaagtagctagataggagacgtttggaggcacaattcgttggtctctcgatagcgggtcaaggcgacaccgaatgaagttcatgatttaaagtattaaagcagaggctggtcttgatgaagcattatgcaatcttgagtttctttccttccaaagaatgtaaattgatgcttaaaatctccgattctgatcaatataaacataaaaggtgtggttttgccaatgcattacaacaagactagcctattaattataattcatgttctaagattatgccagtatgttacagttacacaaacatatcataaaagttgagaatttcccaattgaaattgttctacgaattaaggcttttcatcatttaaatggaattctatcaacaatggagtgtaaatttggtacttctgaattcgaaccaatgaccgatgaggaaactgtaccaaggttgacagggattagagttcgtcatgaaagcctgagacagaacctttagaagccttatctttgaggtactgtactgccatcgttgcatggatagcagctccgtaaggaagaacatcctcgttgattctatagtgtggtgaatgagacgacgcataaccttgggtctcatcttgcattcccaagagggagaaatggcccgggattgtttctgcaaagtatgagaagtcctcggatcccatttcaggcactgcttccacaaaagcttcttgacccaacaaatccctaaccaccttcttgaatttcttgtataagtccatgttgttcacagttggtggcatcggttggttaccattgggtgctagattcacggacgcattgcatcggtgaacggctgcttgctttgtaataatctagaatcaaaagttgaaaccagggtttgttgattctatggtaaaataacatacagagaaaaaaatcaaaaaggatcagatcacctctttgattctctcctgaagctgagtaaacccggtaaaggctcgaagagttcctcctatggtgattgaatcagggatgacattgaacgcgttgcctccattaaccttagtaactgtgaccacctacagaagaaaccttaataagttatactacaaattaagcatagaccaggagagaaatcatcaaagagtaaaaaatgaaacctttgaatccgaagggtcagtttcacgtgaaaccaagtgttgaagactgaggacaatgcttgaagctgcaacaacaggatctattgtatgctgagggatggcagcatgacctcctttcccagtgattacagcctcgaaagctccagctccagccataaatgaacctgcaagtgaagcagctttcccaaagggagtccggggggaaagatgtataccaaaaatagcttcaacgttcttcaacgctccttcttctctcatcatctttgctccactcaaaccttcctcagctggctgaaagataagcaccacagttccctaaacaaaaacaaaaaaatgtgttagaccaatgttactgatgaaagtagtataaaagggaaatatgcatagacctgcaaatgttggcgatgttgttgaagtatcttagcagcaccaagaagcatagcaacatgaccatcatgtccacaagcatgcatttttccaggatttttgctcttgtgctcccactcaacagcttcctgaattcaattatcaaatcaaattatgttctaatccttaatccaaatttctgaaccatagacctaaatgtaactaatcgatgagagttctgtgaattggtactagacctgaataggcaaagcatccatatctgctcttagagcgacgaatggtggttctccggtaccgatatatccgataataccggtgatagctaccggaaacctatacttaactccgataaggtcaagctccgacctaatgaacttactagtttcgaattcctcgtatcccagctcaggattctcgtggattttccttctgattctcaccattgaatcgaaaacctccgggctctttgctaattcgaggaaattgatcgggattcgagacacatctccggcgacgatccatggagattccgatgaaacacgaagtagaagaaggagtagttggaaagtcaaaaagttgtttagagccatggaggaagatgagactgatgcgccactcaaaatatatatatgagactgaaataagtccactaagcccgatttttaatgggccataaaagcccatatgttttatgaaaggcctaagttgtaatgttctgtttttagccgttgcaacaaacttcatcatctcataatgtttttctctagcttttgatgtcgtaatcttcttccatcataatttaaaggaaataagaaaatgatgtcgaaggaaaacttatattacgaaaactgttatgccattgtagtatttgtaacaaactaataacaacgagatatttttgagttgtcttttaacaatgcaaaaatatttgttttcactcaaaagtcgaaagcatgggccgtggaaactcacacgaattgtcttctccacttggctctaaagttagttagtcaattagttacgaacataatcaaaagaaaaagaaaaaaaacgtaaaaagacaaccaatttattacaatttacacatgttcaaaatccacaatactccaaaatttgaaggagaatatactgtaaatagcataaatg

SEQ ID NO: 1453 - DNA, 3000 bp, Unknown
  misc_feature (1)..( 3000): cDNA_ID_2046001_gDNA_ID_1620403_Annot_ID_156019 3000 nt of promoter + ATG
tatttacagtatattctccttcaaattttggagtattgtggattttgaacatgtgtaaattgtaataaattggttgtctttttacgttttttttctttttcttttgattatgttcgtaactaattgactaactaactttagagccaagtggagaagacaattcgtgtgagtttccacggcccatgctttcgacttttgagtgaaaacaaatatttttgcattgttaaaagacaactcaaaaatatctcgttgttattagtttgttacaaatactacaatggcataacagttttcgtaatataagttttccttcgacatcattttcttatttcctttaaattatgatggaagaagattacgacatcaaaagctagagaaaaacattatgagatgatgaagtttgttgcaacggctaaaaacagaacattacaacttaggcctttcataaaacatatgggcttttatggcccattaaaaatcgggcttagtggacttatttcagtctcatatatatattttgagtggcgcatcagtctcatcttcctccatggctctaaacaactttttgactttccaactactccttcttctacttcgtgtttcatcggaatctccatggatcgtcgccggagatgtgtctcgaatcccgatcaatttcctcgaattagcaaagagcccggaggttttcgattcaatggtgagaatcagaaggaaaatccacgagaatcctgagctgggatacgaggaattcgaaactagtaagttcattaggtcggagcttgaccttatcggagttaagtataggtttccggtagctatcaccggtattatcggatatatcggtaccggagaaccaccattcgtcgctctaagagcagatatggatgctttgcctattcaggtctagtaccaattcacagaactctcatcgattagttacatttaggtctatggttcagaaatttggattaaggattagaacataatttgatttgataattgaattcaggaagctgttgagtgggagcacaagagcaaaaatcctggaaaaatgcatgcttgtggacatgatggtcatgttgctatgcttcttggtgctgctaagatacttcaacaacatcgccaacatttgcaggtctatgcatatttcccttttatactactttcatcagtaacattggtctaacacatttttttgtttttgtttagggaactgtggtgcttatctttcagccagctgaggaaggtttgagtggagcaaagatgatgagagaagaaggagcgttgaagaacgttgaagctatttttggtatacatctttccccccggactccctttgggaaagctgcttcacttgcaggttcatttatggctggagctggagctttcgaggctgtaatcactgggaaaggaggtcatgctgccatccctcagcatacaatagatcctgttgttgcagcttcaagcattgtcctcagtcttcaacacttggtttcacgtgaaactgacccttcggattcaaaggtttcattttttactctttgatgatttctctcctggtctatgcttaatttgtagtataacttattaaggtttcttctgtaggtggtcacagttactaaggttaatggaggcaacgcgttcaatgtcatccctgattcaatcaccataggaggaactcttcgagcctttaccgggtttactcagcttcaggagagaatcaaagaggtgatctgatcctttttgatttttttctctgtatgttattttaccatagaatcaacaaaccctggtttcaacttttgattctagattattacaaagcaagcagccgttcaccgatgcaatgcgtccgtgaatctagcacccaatggtaaccaaccgatgccaccaactgtgaacaacatggacttatacaagaaattcaagaaggtggttagggatttgttgggtcaagaagcttttgtggaagcagtgcctgaaatgggatccgaggacttctcatactttgcagaaacaatcccgggccatttctccctcttgggaatgcaagatgagacccaaggttatgcgtcgtctcattcaccacactatagaatcaacgaggatgttcttccttacggagctgctatccatgcaacgatggcagtacagtacctcaaagataaggcttctaaaggttctgtctcaggctttcatgacgaactctaatccctgtcaaccttggtacagtttcctcatcggtcattggttcgaattcagaagtaccaaatttacactccattgttgatagaattccatttaaatgatgaaaagccttaattcgtagaacaatttcaattgggaaattctcaacttttatgatatgtttgtgtaactgtaacatactggcataatcttagaacatgaattataattaataggctagtcttgttgtaatgcattggcaaaaccacaccttttatgtttatattgatcagaatcggagattttaagcatcaatttacattctttggaaggaaagaaactcaagattgcataatgcttcatcaagaccagcctctgctttaatactttaaatcatgaacttcattcggtgtcgccttgacccgctatcgagagaccaacgaattgtgcctccaaacgtctcctatctagctacttagtttggagtgttccaaccttaatgtgttctagttgtattctccttttgttgttgttgttatagttgtcctttgacgtcgtcatttgcttgtttcctttaatcttgatggaagaagattacgacatcaaagctagagaaacaaaaaaaaactcaaaagaaaacaaaacattatgtgatgatgaagtttgttgcaacggctaaacagagcatatactgtttagacctttcatcaacaatatgggctttttggcccattaaaaatcgggctttgtggacttgtttcagtctcatatatatatatgagttaaatcagaaattggttgtcatcttcctcc

SEQ ID NO: 1454 - DNA, 3000 bp, Unknown
  misc_feature (1)..( 3000): cDNA_ID_2046005_gDNA_ID_1620403_Annot_ID_156018 3000 nt of promoter + ATG
tttagagaaataaattacttaaaaacatgaagccatttgagattctccttgtcttcctcgttcataaggtgagtgtaagctccagccttgtgcaatgctacaatacattaatgttaattcatcaatcaaattatgttactaattaagtgtttagttagttaatagttttattgtgcttacgataaaaggaatggtatcggatgatgaatagtcccggggatggtaaggtgcttccattctccttggccacctatttaaccatataataatcgttttgtgaatcatgtaatcataattaatgattatagttgataaactatagaaaggaattaaagaatttaccagatacatgtagtcatcatgtccccatgacataagaacattttcaagtccacagccttcagaataaattccagctttggtattgtacttagggttgttaaaatcagggttttccataaaatactacaatcatggttgaaaaggaaaaaaatatattatagaaatcacttgtttggtaaatattaatcaactaggttctaactatcaatattttgaggatgtcaaaaaaagaactatcaatactttgagtaactagcaaaatatattgagttatatgtaccttgtggtgtacgttagattcatcaaatgcacacccaacaggaaatgtgtcacctaaacggatagagaattcataaatcacttacttaaaattgataagtttactacttagtaaatcaggattaattaatgaaagaaatcaaagattaaacttaccaacaacagcccattgaggaagccctccaaactgtggtagggtaagaaccttcccaagatctggaagttcagtcatttttagtatttttaggattcttataatatgataattttgattcttataagcatgagtttttgtcataaataacaattaattaccatggataagcgcagtgagatgaagccaatcttcgttaggataatctttacggattgcttccgcagattgaagcaaatgttgaatttgtggttcgtcgaggtcgggatcactctcgtccaccacttcttttgaaagttcacaacattcccaaatgttcatcaccatcttgtccaattttccatactcacttctcattttctgtacctgcaaacgtatcataagttagtaacaatatattttataacagatgagaaacaacaatatgtatcgtatgttcatttcggctaacatcgttaggaaagatttttattttcattagtaattcataaatcacgtccatgcaaaaataataggactcaactataatgttgatcacacaatctaataaaccctaaaccatataagatatataagagatcttacaaagtctaaagtttggttagtgtgttgtgttgcatagaaatgttcgacgctcttttgcctctcgctgtttgtatccgtgtagtctctgcaataatttacatcaataaaatcttaaatgttttggaaaacattttagaaatcgtctaaattatttcttgagaaaaaaggaacctgaattgacgaccaaatgcgttcatctcaggagccaaaaacacttcatcatcggatgatatcttcgacattggtatgtcgctgtccaatcgtaactctccggtcttctgcgttgtcgagtcctcatgtacttaaacaaaacaaaaaagaaacaaaaaaacttctatttttacgaaatctcaagataaaatttatagaagaaaaaaaactacaaagaaaagaataacaaaggaagatagatagatgttttaccaaaaacagggttttcgacggagatattcatcttccaaaaaaaaacaaagtaaaaaagaagatgagttatgaaaactaaagatcgagagagaatgtctacgaaaagatgtaatttgatggagacacaaaaagggtatttgtagtggtgatggtttaggagacgataggtactttcctctatatttagagagaaatccaaatcttttgaccacgaaaaataaactttgtccaagaaaataaaaactgtggcatgataaagatctcttaacatttatatacaagagttaatttttttgttttcgttttttttagtttatttactctactgcgtttgtttatgttttgaaatataccaaacatcctaaatccttaaatttactctcttcttgattggtcaactttttggcatattttcttccttttaagatttaggaagacatgtgtcatgttctaaaatagatatagtagactattaacatctatgtgatattcttatgaattatcatagacacatatgtccaagagagttaattatacttagattctccattttcttattcaaaaaaaaaaagattctccattttcttacctttttatcagtgtttttcactttccccccatttttcatatttataacattcacacttattagtttctcccccatttatgctatttacagtatattctccttcaaattttggagtattgtggattttgaacatgtgtaaattgtaataaattggttgtctttttacgttttttttctttttcttttgattatgttcgtaactaattgactaactaactttagagccaagtggagaagacaattcgtgtgagtttccacggcccatgctttcgacttttgagtgaaaacaaatatttttgcattgttaaaagacaactcaaaaatatctcgttgttattagtttgttacaaatactacaatggcataacagttttcgtaatataagttttccttcgacatcattttcttatttcctttaaattatgatggaagaagattacgacatcaaaagctagagaaaaacattatgagatgatgaagtttgttgcaacggctaaaaacagaacattacaacttaggcctttcataaaacatatgggcttttatggcccattaaaaatcgggcttagtggacttatttcagtctcatatatatattttgagtggcgcatcagtctcatcttcctcc

SEQ ID NO: 1455 - DNA, 3000 bp, Unknown
  misc_feature (1)..( 3000): cDNA_ID_1035346_gDNA_ID_1620403_Annot_ID_156010 3000 nt of promoter + ATG
atgttactaaaccattttgtgtatgaacatgaatttcaaaatgttaaacacttatcccaacgaatatccaataatggttattataaataaacactgaaatactcttgtactttaatcaagaaagtaatctcgcaaactctatgttgcgggtttataacaaggataaatatgacctttttgtcgatgcaacaatcgagtcaatgcgtccattgaatcgatgcatcttttataaccattaggtatctaaatgtcatatagtgggtgatcaacccataattatctccttgtatatacttacgaatagataaagtccaaattacttacactggtaaaaatcacattatcatattgctttttgagcaagtaacatttgataaatcattagggagaattttatggtttttcacctaatgtccacataattctcaatactttcacatcatcattaaaccaggatgaccaatccggttaagataaatatacttttgaaatttttaattcatttgaaacttctagttctttcaaaacttctaatttatttttcattgcttatcagttactcccttaatgagatcttataatcaaaattacgtccatgtattttaataatcaatcatatgttaataaaacaataacgagataataattaaaattttatattctagtataaacgatattaaatttgactaactatgtaagatcttatattcacttcagaatatgagtattacctatcatcgataactcatatattttcttagcctttgaaaaacactcgatttaagtttataatagttctcaaaatttctttcaaaatattgtgtctacaggacaacaatacttgcgtaaaagtttaagcgtctgttttaccatctctgcatcatagatattctcttaacaatgtgagttatattcacaaagagacttcaagtcttgaagtttcagtaataactaattatatcttattttatctgataacacattcgtataagaattgctttatacaacttttagatctttagtagtcaaagattgaacataatcttctggatatgtcacttattatcgatgtgagattcattatttctcctcctcgaaatgatgaaacttcaagttcatctatctcgtttttaattccactctagaatcataatgtattttatatctcatcatattaactttaagatttggagaattataccccatcgatgattttaattttgtattcccatagaaagcaatgtatatgctcttctagagtcttttaataagatttatactacttgatatactagattatttcatcgttagaaatttttcttatttttttttttttttaccatatttattttctcaatttctggtgataatttaagttcttgaaaaaactttgaccatcaaaaatatgatatctttttaagatacattaaaatagtcattcataaaaatttctataagtgattatacctttaaattaagttatttatcaatcaatttatttcataaaataatcaaatattatatattaatataattttaatgcaatattgtaaaaccaatcagaataaaactactttgtgcaaaatctggattttacatatatcttgacaaaacttttatttagggtaatatgaattcgtgcaagatttgggtaaaatgatttcgtgcaaaattacgacaaaaccatgaacaatttttttttagataccacaaagatttagagaaaagaatcttataaaaagaaaaattatcttgcaacgtttttagtaaaaataataataacacaatcaaatatatggaaatcttataaaaagatttagataataataacacaaagatttagatatatggaatcttataaaaagaaaaattatcttgaaatgtttttagtaaaaataataataacacaatcaaatatatgaaaatcaaatatttaatatggaaaagtcaatatctaaaagtgataagatatgtataacgttttaatcaaaggagttaaataagggatatcatatcaatcataaatggattttagacaatataatatttataaaatgatattgaatatagatgcaactattcaaaactggaatgctaaaacattaatacatgcttgcatcacccaccaccgggttatgaatagttacaaagttagttatataattataaaattggtaatttatatattcaatattgtaatagtaaatcacaaaaattaacaattaacaagcatgattctcttctttaacgattttctttgtagaatcattgaatcatgcgatagtaattatagaaacaaatgataagcattattctcttctttattgaatcattgaaaacatgcttttaccgatctatactataatcatcgatcggctcatattgttttgtttcaataatagaaaataagtactatgaaccatgagtcgataagtaaacatggttcttaaaaaaaatgtaagaatctctatatctaccttttagaacgtgctgataacgtgttataaccagagaaagagataaaagaaatgagtgtgttattccattgagataaatggttctttatataggagtacaaaaaaaagataaaaccctaaaaacatctagatgatgggtttagatgagggccttataatggacatccatctttattcataacaaaaatcaattataatgaaaatcgaaacatttgtttttttttaggaaaagaccatatttaattaaatgttttggttttccttaaataagttttctatttttttatttatttcctcccttttcattataactggttgattttctaatacaattttcctctttagaaactattaaaaagagctgtgtctggcacgtgtcaatcatgtataaaacaatatatttgcgtaaatgccattgccacacactcactcactcgtagtttcgacgctatctctagaacattccgataaaccacaaagaagaagcagagcaaaagtaaagaagaagaagaaaacaaacatg

SEQ ID NO: 1456 - DNA, 3000 bp, Unknown
  misc_feature (1)..( 3000): cDNA_ID_2046035_gDNA_ID_1620403_Annot_ID_156009 3000 nt of promoter + ATG
gtttttgagtttaattcatgaaaacagagctgttcatgtttgagtttaattcatgaaaaaaattactctcatatgttattctccttatcttttgatttggccttaatgaaatgtcatagtttgggagaaataagttttttaacttgactaagtctatttaatcacataaaccaaaaccttgtacattacataaaaaaggaagaacacaatgaaaaataaaatctcattcaacttttatagtcaagtaatagtctttagagacacattacacaatatcatgtatcttatcatatcatataccaaatgcaaatgcagaagaagagggcttacttatctaaggtagttaacaggtggttccagagtgccaacaagtatcccgagatcgatatccttgtcctcaaacttttttatgaatggatgactctgagaacatgaacaaacaaatcttagaatgtttcatcagagatactaataaccaagactgaaagagggtggtgagtaggaattacttaccaagaggtccaaagatgatgctcttgctggaggatctttttgtatgctgttatgaatgtaaagaagaatcatttaaccattagttttaattctttgtgtgccaatgccaagtatatgaagatgaaaataatgagttgccacttaccaggctgatacaaaggagcagaattcaggtgagaattgatcagaaggagcagttggtggtggattctctactattgctgccaagagttcataaaagcttggcgggttttgctgatcttcagattctaaataaggaaatcttcctattgcacattctaacactgacatccccaaactccaaatgtcactgctgtagtcatatgtgcttccactaatcctctcaggctgtgaagtgaaaaaagagacaagtcatgattatgtatgtatacaatacagaaacatcaagaaatttgtaatgtagatgatttttggaatgctttcgtaccgacatatagttgtaggttccaacaaatgtgtccctctgtcccatggagctagcaagacttgcacttacaccaaaatctgagattttcacttcccctttatggtttacaagaaggtttgatggcttaatgtctctgtgtatgacatgtctttcgttgtgtaggtacacaagacctagcaaaacctgttcacaaggaataatataagtaagagtgaccgataaatcataagaatgctttgaataagctggtggtgtatttgacctgtttacagacaacagcaaggtaaggttcaagaatagtcttgacttgtctaatcacatccgcaagagatccacggtccatgtattcaagcacaagcgaaaaggctccattgtgatagaaagaatggtagcaaactactacatgtggacattgtgatgatgcttggtttattttaagctcctgaacaatttgcttacggatttcttcttgtatattcatctgtatgacctgtgattcataacataagcaaactcaaaccccaagtctactcaaaggccttagtcactagcataaaatcaaaagaaagaaaaacaagtagtttaccttcatagcaaagaatttgccaacccatttatgacgaactaattgaacaacaccaccactgccttttccgatgactttgacagtctctaagtcttcagcagtaatttcgaaatcaagctccttgctatcagattgctataaatggaagataaaacacatacacaagaaatctcctttaattctctggaacattgaggtctctcataaaacaagatttagggttgaaaaatttacccttgattgcttctcatctgacgtcaaccttagccccttttgattcagaagaaaatctccatcgtgaaatgttccactcgcagtcctgttttcaaattcaatgaaatttcacagaatcaattcaaacccagaaacaatggatcaaatctaatcgattcttgtttacaatctcgccaaacaaaacagatccaagtaaagaaaggagaaatcgcgaaacttacaggaaggaagagattggggattcttgagctggaacggagagcttaagctgcttcaagttcgatttgatcttcaccattttttttctttggtttcttccttgggattatcgctctctttctagggtttctatctaaataagcaatttcaagaaagtgttaggaagtggagagaagacgacgaagcaatcaataacggactaatttattttgaacgcgtaagaccgggaaaagaaaaaattatacattaagaaaaacaagaattaaatcatttgggctgtaagatttaaatgggcttgaattgataaatataagatggtacggcccattgcttatctctggtatatttgacagctggcgctaagaaaagtcttaattgattttctctttttttggtatcggaaaacgttttgtgtaaattggataaacgaattatattacttttttttttcgatttgtcggtttgaaattaatatttttcccacactttaaatgtataagcaaattaatgtatttgatatcgaatttattaagagcgtataaagctcacaaattcaattcaatgggaccagtttaatttaaattatattggggtagttttcgagaataggcataaataacgggggagtaatgaaaaagttggaaatggtcacaaagcttagcggaatccagacaagtctatcaaatcgaatttattgtactgcctgaggcccggtttgtttccgaccagtgttcaacttctgacaagaaaaaaacaatagccaagaaaaaaaaactaaattagtttcccactctcgctgtagagagagagagagagagctttaacgaagcttttgttttttgtagagagagaaaaagcttcaaacttttttcactaaaagagagaattaactcgaagaagaagaagagctgccagaagataataaagcttccttctttcgagtaaaggaagcaaaagcaaagtgtgtagttactcagca

SEQ ID NO: 1457 - DNA, 52 bp, Unknown
  misc_feature (1)..( 52): cDNA_ID_2046139_gDNA_ID_1620405_Annot_ID_156066 3000 nt of promoter + ATG
gatctttgttttcattaggtttttttaaatcttccaagtgatgttgacaatg

SEQ ID NO: 1458 - DNA, 3000 bp, Unknown
  misc_feature (1)..( 3000): cDNA_ID_4262380_gDNA_ID_1620405_Annot_ID_156084 3000 nt of promoter + ATG
atggaaaaattaaacatcccaacttgaattgttacaagatcttgcttataataggtagttattaaacatatataccaaccaaacctttcttctcctcaactcctccgcaaataaaacagaaataatattatatttatatggttttgtgttttctttttcttcttaaacgttgagattgttgaagtggtcgcacctacgtctcacttctccatctttatcgcccttgacgccgaccgtgccaagtttctccatcgcacgagcgaaatcctcaaagaatgctgtctcgttagttgcgtatagatccacaaacggcttggtgctgttgtctttaataaggatgtggtcagacgctaaaagccctagccctcgctttaggttcttgaagtacatgttgtcgaactttcctggagtcatcacgtcgttaaacgcggcgattgtatcatccacggtgtggtttttgcaaagatctttgagagcggctgcgaatcgcgggttgatttctttatcagcacgggatccgtagagtctgtcggaaaactctttgcagtgagagaatccaatggtgtgagccccgcttaatgctaccatctcgcgaagactaaaaccgtttttcttgaatatcccgtggatgtcaggaacagtctggtttgccattgggacatttcctctgactttatgagctttggattcgaatccgtctttacgaccaagctttacgtcaaagtaaggtcctcctaccattgtgacaaggtcacgtgtagcctgcgctagaatatccgcgcatgatactacaccaggacaagacaactcgagagctgtcttgatgcgggtgacgatgtcaaaagcatctcccgggagggaatcattgagatcatcatcgcgttccgctttgttgaacgagttggtcgcgatcaagacagatgcatcacaaccttcaaggaaacaatcatggaaaaagagacggagggtcccggccgcagttgttggttgttggacttgtttggttgtaacggcttcacgcacaattttgtggaaatcaggacatgttttttggtaatagtccgttctcaagatagcgacatcagccgatataattggtgcaaccacggcgagacagaagaggataacaaagggattaaaaccacgagagaattgcatattcgacatcagataataacaaacaatggtaattgaattggatttgtgagagagatgtctacgaggtagacttctctacgatcgattgtcgtcgaaagcaattagaaacgaagacgaagaaagggcctttgcgactatttcatggcttaggaggttactaagaagaggctacgtaaaggatggttttcatttccttatatgtacgtgtggttgtttttcgtttattcttttctatttttgtaatttatctattttttgtatggttttggttgctttgaatttgttttggttctagaaattttcttatgttcgacaaatgtggtaatatgatagttgctttaataggatgcatacacacgtgaaattgataaatacgagagaatagaaactcatgtgaaggaaaaaactaatattaattaaaattattcatttcgcacaaacaaacaaacaaattaaaatcattcatagtttatcaactaaactttaaacttgacgttattttataattttgttgaatcaacaacctgtgaaggtgaaggtgccaatgattgtgacaacatgatgtttggtatgcttacgttaatttgatccaagaacagttttctagcaaatgtttgatgaactagactcaaataaaaatacctactcatgtagaaatcacgcaagctcaacattattagagatctgattgaatttgatattttcgtcagattcgtatcaatctcaattttgtattacatataacgagcctaactctcatatggggcagatctttttgtaagttcgaatgagagttatgcctttggtaacataaattgctagaccacaaaattacatattttcttatttaacctacgcaaaatcgcaaatatctaagagtgcaaatgatttcataaaggaatttaatggaataaatatatgaataaaaaaaaagaagatgaataatgttattcaatcaattccacctgcgacatagtaaaaaaaaagagttgaataattattattttttaattttcacccttttcaatgtaatcatttaaaaaaaaaaacttttttgtcatcccaaaagtatagaattggaagaatggtttattataccacttttattcttctagctgtaccatttgcataataagtttctctataccggaaccaaattcttgtattttctatattaaatattctaatatgagaagttgaatgttaagaatttttttttacttatcatgctatcttattatagaaaatttggtttctcaaaagtagttattaacataatctaatatgagaagttgaatgttaaaattaaatatttacttaacatgtgaacttatcatagaaaactttggtttccaaacttgttcataatttttttctaaaataaaatagtaaaaaagtaaatctaattcaaataaaaataagataatcaattatttaaagtgttagaaaaatagagtgataaaataagaaataaacatcattcaacaaacctaaatatttagaaatatgtagaaatttaattgaaaaccccaaaaaaatatgaagggaggctttggtgtctaaaaattagtaattgggcccaatatctcgtgcgcaaagcccatattacatagagcatggcgcgtataaataacatacatcttatgtatttatctctctcacgcgcccctcttttcttcttcattgacacggacattcgtttccaattctctctaatgtttcactaaagcgcatacataaccctaaccctaactctctcgtactgcacaaaaaaaaaaaaaaaattgaagaagagcgatacgatcgtaaccagggagcttgatttctcccctgatttttcta

SEQ ID NO: 1459 - DNA, 3000 bp, Unknown
  misc_feature (1)..( 3000): cDNA_ID_3062496_gDNA_ID_1620405_Annot_ID_156085 3000 nt of promoter + ATG
cagcaaacaggtaaatggttatgcaaagaaacgggtacctaagtagcctggggaaaaaagtcttcggtccgtaaatccttttggcttatatgttttgtttttgccttgtattattaatatacgctcatatgctctatattattatagtcagatatctgaagcctacccatatttaaaattggtggtggtgtttaatggtgatattgatatgatttacaagttcttttgctttatttggtttttatttttttcacggtctgaattcatgatttgtgtgcaagttttggtatcattggcttatgggcttgtccaatctgaaatttgttttggatttctaagtttcgttaaaactgattcgacttgaattttatgttctcaaaatatctctgagttgaagaatttcataaagattatatttcctaggtttagccgacatgattttgttgtccctatgatttgtttttgagtagatagaaatggttgggcagcattggctaatgaacacgaacatgttaaaaaaaaaattggacattagaatatcatattacattttggtgtcttagatgggttcttcgtgacctttgaacacatgtcatgaccatatgcgactgtgatgaatgagactcttagctatgtggacccacaagcccaaaaatctttttcgaagcgacacgaaacgctctatgtgtttctggtttgacctcaaacagacaaagaaactctcctagtttggctacgtcctctcgaggttttcgttttggctttaatttcaaatacaaaaactgaaagagataggaagtagaattatattatatattaagtggaagataaagtatcacgaaatgtgagatgccgtgaactttatacctgcttactagatttttatgatctagttggcccttctaaatcaatctcttaaattttccctaaatattggcttttgtcacgcctcaaatttcttcttttcaaaactactgaaacatgccataaaaggaaacaaaaaataaaaatatctacctaacatttttcaactctgttaagcacatatctcatctaatccttaactatgaaagatttcaatttcatttcttagtcttctcatctaatatttattcggaatatggactgacatgaatcaatagagtaaccgtctcgtatattttaaactacattagatatttttcccttaattttctgtcaacaacaaaatttagatattttgttttgaggcaatcttataattttggttttccaactattatctttgacccgcctcacatattttagtgtagatatagtacggacaaaataaaaatggtaacggttgcatcatacctgcaaaactcagaatggcagtctcgtaatttatggaaaaaaacaaagggtactgtagtaagacaagtcattaaaaataataatcttatcctatggaaacaaaacaatatttttcctactgaaatttgtgattatctttatatagttgtttagacataaatcaaacttaattaatgtgaaatcaaattacataactgctttctccctaatcttattatataaattatggttttcaaagttgctaattcgtaggattgtgccacgtgtcaagtcaaacgatcagatgtttacatgtgtcattccaaatttaacttttttattctctaaaaaaatagaaaatcttaaaaagtaaacaaatttacatatactaatttatatatctatatatttataaacaattaacatttattcaacaaaaggaaaattaacaaatttgtctttaactcatgtaatcataggtgaaaaataaaacattttgagaaaaatagcttagcttataggatttaacttttcaattattttcatttattaattttaactcatttaatattaatttgcatgatgtaaaattaacttacgagattacgacatatatacaaaatatattttcaacaatgtttggtttttaaatatttttatggattttttattattattaattattagccctaagcgtttgggtattcggatcgggtatttcgggttcggatttttgggtttagaagtttatgacccgttaaggtaatttaagattttaggtcgagttcgggttcgagtttatttatatattgaaatatcaaattttgtgtacaaatctattaaattacttgaaaatttcaaaaatttccaaaacaacacgagtagttttgcttgaatatatcttaaaatacacaaaataactaaaatatccaaaacatcctaatagtttctatatataagtataaatataactaatatatacttatatttgagatatgtttgaatacctattcgggttcgggttcaagtttttcgggttttgaagtttagacccgttcgaatatttgaaaatttcgggtacacccgcctaaataggcgggccttatctagtataaaataaaatgattataaagcaaagatttcaaaaacaaaaaataaatagtatttaattttgatgcagaggacagctgtacatttgatttaagcgtagcttcaactccataacagtcctctctctctctctctctcattctgaaaggaaaaaaaaaagaaaaaaggaaagctaagtgaaacagaaaaagaccatctctgactacactactcctgaagatcccaaacaaaaaagcttcatagtgaaaaattattccttcgttttctcgatttctgaatcaggtttaccatttttctcactctcttctctgcgctttcttcgtttgtgatgaaactctcctcgcgctgtgacattgttttttccgctttcttaggttttttcaaaatttccttatgcgatttttttctctctttgttgttgcagattttgtgaattcagattagtttcgattgtttgtggagtcgtatcggaattgaagttgatcgactgagaattgcgagttttttcttagatgtcgtcagtgttgttttggttctctgggatagtgtgtgactgatttttgcttttcattggtg

SEQ ID NO: 1460 - DNA, 3000 bp, Unknown
  misc_feature (1)..( 3000): cDNA_ID_3062492_gDNA_ID_1620405_Annot_ID_156087 3000 nt of promoter + ATG
cgaatattttttttttaattatcaaaaacaaatattaaaatccagtggtagccattgtaaataagtccgaactacttgatttatttcacaaaatggttgcaaaaatgtatatatagatatataaatataaaatcactaacatttttgttttttttgcctggtatggttattcctcattttgttcaacttttgtattaaatttgggtttcgggtgtaaaaacgttgtcactaatttaaattcctcattttaacaacaaaaacaacatttcataacatgtgttatcgcatttggcataaaacaaatcataaataaagcatctttaactaatatgtccactgaagttgctcatccatatcaatagacccaataaaaccactagaatacatttatactttgttatgtaccatataaaaagtataatgtaagatttgaaatatctataccaaatcttcaacaaaaaacgaaaggtgatattggtggaaaataaaaggagaagtttgaagatggggtttgataaggcaaagaaggaaaaccattaaataagaatactatttgttgttgttattgttagattctctcaaccatcaatccatcctctacttctctttaaattcttgtaaccttttatgagggggaccaaggaccaaccatattttagggtatggccaaaataatttaaatccaacaagctttaacaacaaattatgggttaatcaaacaagaaacgtcaaagtaattataacccctcaagtagctgaattggggatcgcctagagaaaaagttcttcaatatcgtacgtgagtttgaatctcaacggtgggaagagggctgatttaacttgttatggacatctcgagaaaattagggaccaaaagtttggttttttttttcctaatctaaaaaaacatcaaaatgcaataatttatttagacgaaaaattagaagatgtcggatttacatcgattagtcattgctcctcccatattgacgatgcaagtatcatctttctataaatctaaaagcttatcaatcttatgtgtcatttgtacgtagaacagaaaaatttagtagtaacttatggataaaagtgaactaaaaatcagcaccatgaagaaatctaaaagattaaaaaaggataatttggtgtgtcgctataaattgagagaatattaggtcaatgaccattaattccactaaatgtggttatagcacgatatactgttatgtggaatgaataagtaaaatatcatcctctttttttttttttttttttttttttttttttttttatggttgatttttggtaaagaaaaggttataagtgacacgtgaagagagatcgttaatctgttttttcttgcaatcttcattccctctcatttttgtttgatcatctattcctttaatgaggattcctccaggacaagtaattatgtgggtgttgctaatcaagtcactggtctttttgagaagagatatctctctaatgctctgttatagacacattttctaattagtgttttgtttctatatgaacttctctaatctagaaagatgctgcatcttcaaaaagttgctttgtttattgaatgctaagatgggataatggatcaactcagttcacgcagtgaaatcactagagcctaataacacatatattgcatttccctctatgattacctgattgggtaatgtaatgggccttagtctcattgtttcagaaaggcccaatttgttttttcttttattttctctcgtggtcgacatacgaaaatcacaggaataagattttcgtcacccattttattcatgtataagtctgaattccatgaattaaaaaataaaataaatcagtaaccgtacatgcatataaaagataaaatgcgaaaatagtagtataaaaaatacctggacgcgtatgtatacggaataccgtagggagtagctgtggatataacacgtagacatttaagccccagcttccaccttatctttatctgacacgtggcattattacaagcatgggtcccaagaactctcggtcttcttcttatgttttgtctacctgatgccactcgtttttgtctttcccatcttatccgatcgatccaacggctataaatgaattcatcattgggaattttcatatcagtatccatatttccataatatcaatttcatccctcatcttttcagtcaatacttttcttcctctaacttttgttaaaaacataatgtttgataaaatcatgatcttatttacaagagaatttgtttagctcatgaaatttgattaaaaaaccacaaaataaaaaagttgaattgaaaatcatgttctagttaaagaggaaaaaataatattttgtggtcttttatggatttgtgaggaagatcttggtgacaaaaattaaaaaataatttgatgtaaagcaaaaaaaaaataaaaaaaaatccatgttttgcaactatcttatttcaatgagaagaatgtcgattttctaaatattaatttattttactaggatttataaaacatatagaaaataatatttacatgtgtgtaaataaatcgaatataacaatttgtctaactgttgtttatgccgattaattaaaaatattttacaaatttgataaagatatcgaacctaaaatacattttttatacaaaaaatagtaagtttgctttgttaaaagtaaaataattttacattttgtttaattaactaatcaaatccgaactattgaagtaacaattaatttcaagaatgcggttttattttaaatatataaatagtaggggtaattgtttcaatgaaaatactaatataaggactaaatacgaatttcattacaatatgtattaaacaaaagaaaaaacagataaaggtatataataatgtcgacgaagaaatgcgtcggtattataatataaaagacgatcaaaatcgatcttatttacaagagaatttgtttctcgaagaagaagacgttaatg

SEQ ID NO: 1461 - DNA, 3000 bp, Unknown
  misc_feature (1)..( 3000): cDNA_ID_2996054_gDNA_ID_1620405_Annot_ID_156095 3000 nt of promoter + ATG
tcctaatgaaaggatatttacaaaaagtatacataaaagaacagaaaattaactgacacaatatattaatacttatgcagtacattagtaaaaaaaattacatcattattcttatgccttttcattttttatctttcatcttaaaattggttaacaattaaattaccgagttaaataaaactttatctagaggtagtgataatattaatcttattggaagagattcatattttgcacgttatagtaacttgttaatttttttatatgatataataaataagttaagacggtaactataaatatatcacataaattataacttatgacgatacaaaataacttagcatgatataattataaacttattgatataaatattttgttatcatgttaacctaataagtattaccgagatatttgttatcatgttattctgataatacgttatctgctaactattctgattcatgtattttttacatgattattaagtcgcaagtcaacttttttgctttatatgctaaatattttgttactttttaataataatgttatcgtcttcgcatatatatccgtataataaccatattgtaactatgacaattttgtaattaatccaaatatgaaagatacttttggtttatattttttttctctttcatatttacctaatttttaaattatctcttctacttttttaatttcaacttcttctaagtatataaatttaattcacccactagattttaacccgcggtataccgcagagacaatttattttttaaattagtatatataaaaatttacaaattaaatctatttatttttattttatagtttacaattgttattaaataacatcctgccaaacccgtctcgccaaatccgtcccgtaaaaaaaacccgccgtacaccactaatttaaatatataattaaaataaatattttatgggattgcaattgtattttagtttgtcaaacaaatatttgttttaaatagttgccaaaatctagttcaaattttggagaaaaaagatttattggatagataaagaatgtatttaggtgtgttttgttcattttaagggattgcaattatatttttgtttgtcaaatatttattgttttaaatagttgctgaatactatgtgcgtgacatatgagattggaatatatttggaatatttttagtttgttaatcaaattatttctggaaaaaaatcaataattaaaatggcagtcattgtaaataagtctaaacttcataatttatttaacaaaatagctgcattatatagacaataaaatgactttttttttcctttgtttctcatatattgatagatcacataatttattgaattaatatatacaaacaagagttccactaattcttatttgttatttcgattccactattcaacaaggtccacactattattagaaattcaaactatacttaccataaatatcgaaatcacaactagtcagtcacacacctattctaacattagaaaaacaccgacctcattgcaccactattatttgtagttgtacctcacaaagcacctccctcaaagtcttcgcaaaaacgtcacccaccaccacgaaaattcataaccaaataaaacgacaattttgtaattcttgatttaataaaaaaattaagtaaaaaacaatattcttaccattttgtcgccatataataagaagaagagagacacaacacaacacaagtagtagaagtggtgtagtgattacggtgtaacgcttattccaaaaaccccacgcgcgtagggcccacctctcccccgaatccccatgattttctttaacgtctctcgagtgctggtgggacccttgttttatggaaccctgatgtagttttatgtactttcatttgtgacccttatacttctgttaattacaatcttgccgctattttgttgcttccttcttgtttttgttaccttaaaacttttgtttgaatgccttcagaaaaagtttacttctctttagacggatgtgatcacttgttcaatgtaacaccaccgtaagttacagtggttaaaatgtctggtagaattatagctgtatatatttattgatctctaaaaaattagcttgtagaaattattgtctttaaattgttagtaggatccatccaactactacttaaaaaaatctgattagtataagatatatttatgattaatagaaaaataatttttgtacaagagattaataactaagatagtaaaattctatcatttcatttctaaaaccaaaatagatgaaattaataaataaataattattgatttcatgtgtgtttaaacaatttttttttgtatcacattatgtaaagtaacaagttatcaatttcataaaaaaatatttacgataattacattgttttcttaatttttttgtcgactatatatcttaaaaataatgttaaaaatgcaacaattttgacagtaattcctaatcatacgaaaattttcaaactttgcaacttcttcatgtattattgcattgacaatcagttaataattttactttaataatgttgtctaagtaaaaaagaaaattaaaagttaataattgaactaaaaagtgaatgtcgaaaaaaaacatttaacttttttacttagctctctcgaaagttcctcaaaaaccgaaggacgagtaagtcacgaaaaagaccattttgtaacgcctctctatcaattattcctctatgtgtcaataaagtatatttctcaaaaggaaaacaacaaaaatggttttcgatttcttgtactttcaaaaatagcataaaagccaatagattctcctctctcaaagtttcgccccttgtttttactttctctctcttaaaccccaaaaaaaaaaaaaagatcttttgctataaaatcccacttcacactttcttcacatcaacaacaaaacctctctctctttcactttctctctaaaaaccagaaaaaaaaaaa

SEQ ID NO: 1462 - DNA, 3000 bp, Unknown
  misc_feature (1)..( 3000): cDNA_ID_3062488_gDNA_ID_1620405_Annot_ID_156092 3000 nt of promoter + ATG
tgccaccacatttctacttctacaccttttgtctatatatacacaccaagaaaaaagaagagaatatatatacatatctatagtgtgtgtatggtccattctcatcttattatcttatttgtgtaacagtctaatattctaacatctaccattccttcttactataattttcaaaataaataagtatagttttcgctgcaaaataaatgtcatttttaccacatgatacacttttatgtttgttaaagatctatgatatacacgtatgtatatgtttatatatatccttcgttttgaagaagacggaaacgacttttttggttgagaatgtgaaaaattggatagtgtgaagcattattattgttactcatgaggaaacgtgaaggtggcctaaagggataatttttaaaaccctaattaatgaaaatcaatgatgtccaattgtgtattttgcatctaatcaaatctacccctttgaatattgactcttccacttttttatttatttcttaatttttatttaatattatatagtttccatctttctatttttaagtaagtcaccattttttcatcatggccaacacacaaatccaactaaggctaaaaatgcacctatatatacatgtacaagataaacattaaacataaagtcttttaagtaactaataacatatcttaacatcatgtataacttgttgttttacattcaccaagttattactcccaccctagacatacacccattgtttaaagatgccttgtcacatgcaccacccataaagacacaaaaatttcttttaaaaagaaaattgacaccatgtaagtttcgctgaaacgttcgactacgaacatgtctcatggtaaagattaaagaatgtccggaaagttcaccgtctttgtatattttgttatatatttgttatatatgtatagtaaaaaaagaatatgaaggaagtatgaaaaatgagattgttgggtgaggactaagagagaaagtgaggctaacatgttttaggaagagaagaattgaatgttcaagaagttttgcccaagaattcacaatttggtgtggtgggctcctttaaagggcaaagaacaaaagtgtgttatgtctccattactattttcaataatatttagtcttttaacaatcactactatttctctgttttggtccaatactccaatcatatataaaaatagtccgaacagtcgatcatcgttatacattaattcataatagaaattgattttgcattaaccattttgttatatcagcatcacaagttttatatggatatatataaaaaaatgtctatggcagaattaagtttgaaaacaaaatttctcctatcatcatatatatatgtttcttcctcgcctaatgttcaaaactaattaaactttggaacttattaggttaagccaagagcaacgacccacctaatatctatataatatattacatgctcataacttagctggttaatttgataaaacttgttgattatctttgtttagttgttagatttctgttccatcatgatactttactaaaccgaataaatatttctccatctattattatatacacagttcgcgcgcaaatgtatatcatgtctttatcatggaaaaagtcagttacctgcaataacataatttctaaaattcaatcagatgtaacagtcaatttaatttgaatctacctaatttattatcgtgaataaatatgaagtgtattgggtataaaatttttaaaatattgacaagaaaatttcaagaatagtaggaggagcagtgaataataaatttacacgaacgttctactcttttcggagaattacatcattttttttcttatagtggattaaacaaatcttaacatagtaatttttgaaatagatcacctaaaccaaagaaaagaagaatagtaaaaaggagacggtgccgttcgatagcatcaatcaaagcagcaatgaggaaacacgacagagagtcttctcgtgagaaaaagtaagaaaacaccaaaaaagattgagaagataagtttttagtgttttggaaaaaaattactaatttaaaaaaaattgatttggtatatgcatgcataagtgattaaggactatatgattatattaatttaagaggaaccaaaaaaaaaacatgccgaaattaaataccttttaaatttcaatgatgtgtactctacaagatatctcatatgaatcaccgaatatgtagattttatacgaaaataacaaaatattagttacgcatataacatatttatattcaatagaactataagtattttcgttaaagcttcaaaaatttatagagaaattacctagcaaattttatattacttatatttatataatatatatatatatatacggatatttttctattgatattgaattaggttttcactgaaaaataaaattttctattttccaactcaaacacatatatagcatatatataaattgaatagatacattgcaactagttaccttcctcattttcataaattagtaaaacaaaatacaagaaactgctaagattgacgaatcaatacgcgtatcaaaaaaaacgaaatatacgtttccattaaaaaagaagaaaggtaaaaataaataaatgtagatgcgattcaaatattcaaacatagagttatgtaataaatgagaatcatgcttactatgtgcatataatagagagacttattaaaagcccttcccttaaaaacttcccaattccattcctcttcctcttccttctccttcttcttcttcttcaccatttatttctcatcatcatacttataaaaagtaaatcagaatcccgaagcaaactttcaatcttccatcatcatcatcatgtccgatacacatacatacatacatatctttcgtgtgatttatacttattaaagagagattctctcattaagaagaagcttccttctttcttttctttttcttctctctgttc

SEQ ID NO: 1463 - DNA, 3000 bp, Unknown
  misc_feature (1)..( 3000): cDNA_ID_2046125_gDNA_ID_1620405_Annot_ID_156072 3000 nt of promoter + ATG
ctgcaacaacggaaggctcagattccgattagcgaacttatacacttttgctcttgatctaagtttatactttgcagcataaagcttagcaagtgaaccacggataatataagaacagaaattcacaattttctttctgttatctgcaaaccgataccactcagcaatcgtagtcaaaaacttattcatctgattattcgtatgagcttgagttgcgtggaacattctaaaacaaggctgtggatccggatcacgatctccttttataaataacagctttcgaaactgtttgatgcattgcttcaaactcgctgtaacggataaaagcgttcccacgcctttttcgcttataatcttcccaccggtcgcagtatacctcagagtcggataaacaactcggcgacacaaaacatgatcaagaaacattataccttttgttatatgttcaatgggtagattctcattgtcgagtctaagcatatacttctgatcaacaaactcaataagctctttccttaacgttgcagcatcagctcgaggtccacggacaccaatcaagatatgacctccatatctaacgtaatccattttcctcgttttgtcaggaccactcgtgggaacaaattccggccaagaagtgtttccttgatccgcttctccttcagggttattccatataacatcgcttttcgaaggacggtaaaagtctttcactttcgtttccatccaacgatcaagctcgtcaagacatacattaaccaaaagaggactaagaatcccgcaatgtccccactgcggagacttcccagcttcctcaggagcaaaaccaaagaacgtctctaaccaataaggatcaggcttgggctcatcctcagccaaaacccgttttttctgatattttctcttcttagtcttcttcttctcaccatcttcaactttactcgttacaacaggtgtaacaagcgcagatttgatcaaatcaatcactttcttatctctaacatctctcatcaaagaactaatcacaaaaccaactttcattccatccaacacaacactcaaatcacccttaacataccacaaataacccgcgaaattcctccgaatcactctcaacaccgtatgcgcggtcctcccgggccgaaacgcaaacgatttttgcgaaaaccgagattcgtatatcggttccaaaatcatcaacaaaacctcctgaactatcctatcctgaaacggagtaggctgcgtagtagtcaaaatcgctttaatcttcctcttcgacaacgactcgtaatcggtcttatctctaggagatttaatatagaaatccaaccgagaaccccatttaaaccgatcatcgagaacagagtttcttaaagctaacaaattctctaaagctgatctttgaatagagctacgaggaacataagcacctaattcatcacagcaaactttctgataagctaatacccataactcgaatctacgaagatacgaggttaaattagtagcggttttgtcaggttctttgaaattctcaagccacatctgagaacagagagatactccatcttctttcaatagattcgctggatcatctggatctggtgcttgttgttgttgtcttcgttgttgaggtgcgaagtaagatagatatcggaaaatcgcagagccgttgttagggttagaaatgagaggaggatttgtgacgaagcagtaaacgttggtatatgtagaagaaggttttagccatttgtaaggacccaaaacagagaagcttctacgcatttcggacgattgatgaacagcttcgacttcttcctcttcttcctcttcttcgtcttcttcagggaaatggtggaaactgtagtaacccttgttaaaccccaaatcaaagctttgtgatatttttgcgttttggtgggctttttagttgtgaggaaagaatgaattggtcttttagttataggcccaatattttcagcccaagttcatatggaactatactgtaatctaaaagatgatctcacgtttgtgtcattgtgtatgtgatctaaaaaaagatgatctcacgtttgtacttttgtcttaagttctgtctgagaggacaagtttatcactttgaccacttttgactgaatcatttgttagaaaataataagtagagagattggtgcatattcatatcagagagataagtagagaagaagagagtgtgagagagagacgagagaaagaaatttacaacgaaagcgatggctactacgaaccctggatatcttcggtgcaaagaagaaaggaataacaaaagcttcttcatggtgcttcaaagtgttgatgtttcttcagagaacttggtaacaatgttcaaaactctgtttttctaattttggcgatttcttgtaatagtttggaaagtttgagactttttgttttctgtaacaaatgggtgttgtcttaaaggttgaatcttgtcgttatatgacaatgggtcttgccgtaaaggtttgaatcttgttaactttgtttggaaaggttaaatctttcgtcagttgtctttatgtgtatcaaataagttactgtttttgcttctctgtctgaatgtgagctgtgttttaaaggttgaatcttttggtcaatatgggtctcaatagcctcacggcagtttttttttatctttaacgaacatggttttgttgaatctctcggttctctgtctgaatgtgtatgctttatatttcacctttgtttcttctggatgagatttgtgctctgttctttttcaatatcttgttgggtttgtcttttgtgtgtaattgaagatactacattcttattattattgtctcttgcatcttatttgtataaacaaaagcgggcacttccttatgactttgtgagaagcttcacggacaaagagctttcctgtaagatgaagtaagaacgcaatggggacgctcttgggaagtaggaatctccaaaaacccgacattttactacatg

SEQ ID NO: 1464 - DNA, 3000 bp, Unknown
  misc_feature (1)..( 3000): cDNA_ID_2046128_gDNA_ID_1620405_Annot_ID_156071 3000 nt of promoter + ATG
acatggatacatcaataaacaaaacaaatctatgtatgatatataatagtttacggtccatctattggtcccattgactaattcacaacttatttgattcatattttatatatacatgtcacaacccatatcacaaaagattccagaaacacaaatatttttaattcttataaataatattatctaaattaccacttcctaactggataatgcatatctaataataatgatttctaaatggataatatatagttgcatacaaatatatattttcaagcactcttggcaggggaaataaataccagtatgtgcaagcttaattataccaaaatagtaggttattccttagtggattggtaaaactaaaacaacatgacatttattaacatatagctaggttagtccatatttaaccaaaaattcatagatgacaaaatatattagatttaaatattatgatgtgaacaagatatgtaatatattgatttgcaccagtttggtgagttatcatctaggttcaaactcgtataatacgaactttttgacccaaaaaaaaaaaactcgtataatacattttgatgaccaaagaaaataatctatatggcatataaaaatattttaggaaaatagtatgatagtatagacgtgtgatctctaaaacaaaagtgggataattaacaaagacttagaagagagtgacatacatttttatttttcaacattcaaatctatgatcttttcttttaaaaagggaataggagatttaagaaaatatagaaagaaggtcataaaagaaaattaaaatataactaaattatagtaaaatggacgtatctgttagaaaaatagacaaaatagtctttcatataatgtcaaatggaagttatgaaccaatggtttatataagaagagggatataaatgacacagaaataataaactagtaaaagaatggtttggacattattggatatgaacaagaagaacaaataaactaagagaaaataggcaaaaaaaaaacatcgaattttttgtctgtcattcaaataggtttaactacgacaacaagtgaatattttttgggtgggtctagtcgaatattctaaccactacatagattgggaaagctaaactaagaagcctaagaccaagcagaaccggttacagagtagctaaaccgcaaggactgaaaccggttaatgaagccgagccacattggtatggtacagctttcgttttcgctgacttcacaaaactaatcattatacctaactcatcacagtttatttatttataagaaaagagaaaccgaaattaagaatggaccaatggatttctgttgggataatggctttaaccgggaaccggaaaacccggtgagctcaccaccacccacagtaacagtaaccaagaaaaacaattgtcttcccaatgcacctgccacgtgtatagagacagtacagaagtgtcaccacgtttcgactttctgttgtttaaatgacttgaataccctccgttatgacactattttactgtttgaaggaaacgcaagattgatgaaacggcgttttaatgggttggcagcgtttggttgaaccacctaacaaccaccactttccttcacacttatagttcctttttttttatttttttattttattttctgttgggaatctattttttctttatttttttattaagcatttggtcttaaacaattataaaaataaagctgattggtacaagtattaaaaaggaaaaaaggctgactgataatggagttgattagctacagctatagattaataatagctgaaaccttttatttaatatttgtttactggaaaatagtggttgtaaatttcaaacaaataaaatgtacatctttttaaatttagaacaaatataacaaaagtaaacattagtttgttagaaatttttaaaaatataaaaatatttaatttttgattagactattcactttttctttaaataagatatattttaatatgattggattatactttgcttaaaatcttgggatgtttatgaaatgacttaaaaattcttaaaatagatcatgaccgcaccaatcgcagcaaaacggtaggagcgttcattagacacctaattggctaattgatatggcttgtgaagaatttgggaaccttcccgatattcaccaatatttaattataatttgttgttttctttagaattttaattaggaacggcttttgtgttaaaattacggtggccactaaagcatacacgttttggagtataaaactataaattatacattcataacaattttttccggttttccaagtttcttcctctctcggtcctcttttagcatctctacagtttctctctcctctaccgccggaaaaaaaaaacgatttctccggccggttttggtttctccgttccgttaatagccttcgttttctcgtccttggaatcgtcctctggttgatttctgaatgttcgtttgactcggctacgcggcgattcggatctccgtgtttgactcggtccctggctcgttacgcggcgttttcgtagaatgtggtttactttgtttgcatgccaggctttgtattgaattcgtggggcgagatcgtgatctagggtttcgtctctgttcttttggttcgttgcttgttgtggtcgctttttgtttcttaatccggctgaagaaaacgaaagtctacagagataatagattacggaatgatatggtgagatgatttcccctctctgattttagtcaattttgttgtttaacgattttggaattctcgtgaatttttgttgttaacgattttgttggatcagatctctaacattgctcgatttttttagagtttctgctattttttttcttgaattggttactcttttttttactctgcttcgttgtttgatccttctctatggagaatctcacgttttgttgctatttttgtgaacttgagatttgagctctgttgaa

SEQ ID NO: 1465 - DNA, 3000 bp, Unknown
  misc_feature (1)..( 3000): cDNA_ID_2105052_gDNA_ID_1620406_Annot_ID_156104 3000 nt of promoter + ATG
atcgtgtagttaatgtagagagattttaggaagattgttaaatatcaaatatttaattcgaagattttttttctaattatcaaaaacaaatattaatccagtggcaaccattgtaaataagtcccaactataagatttatttcaaaaaaaatgtatatatagattgtaatagtgttgttgcatttgtgaattctagataaatattttcttttttaaaaccaaagaacgaaaaagaattattgagatgaaaccgctaactcgttgactataggactattaaaatagttgacttttgcatgtcaaagcagaaacaaatcaatatccctattcttaattactagttcattgctagcctaatatacatgattaggtagctaatcaatatttatcatgattccatatttccatggaccctctaatttttgctacatcttattttacttagaattcccaactatagtttaaatgaaacgttgattattaacgattatatatatataattaaatactaatcatctttcttagcccaaaaattgtttgcaagcgacaaataaacggaacttttggtctaacaaaagaagactgatgaaaatctcgacccacgcgctgctggtcctcctattttttcatttatgcaaaaaaaaaccaaatcggagggttatatagtccacgcatttttgtctcacgcgctaaacgcgcttatggtgcgcgtgtttttatttagtacacgcgtgtagtttttttttaaatccttttaatttccgtagaaaccaaatgtaaacaagctaacacagagatcaatataataactagtctcaaggatctgaaacaatttgctagaagaaccaagtctaacactaaacatagatgcaacatcaaatgatgtcaatagatgttataatacatacatgagttgcttcaaatataaggaagaaggttacaaactctcacaacattcaaaccgacaatcagaacctaagtgttgttttgttgagatgttttcgtcgctctctccagatcaatcttgcaattttctctcaactctttcatggctacaaagctattgtgctgcacaggttatcaatagcaatggacatcaaaacacagaacccaatttttacggaccaaaacaaaacacagtcgaatataaggtctgaggaacttacgaggtggttgctttcacgagccaagataccttccatgttacgaaatagagatgtccattgttccatgggattatctgtatttgtggagttgttggagttttcagatccataaatatccgttggcgttcctctatcgttcctttggatcaagccactagcttctttctggctcttcttcaacactgcattcaacacaaatacatgaaatttaccattgttattcgactctgtgttttgcagtgtaataagaacacttaccagataatcgacctttgatatcctggtagtgaagatctgaccagatatatgcagctgaagaaattcattacatccacaaaactaagtcagatcatgttattgagaatcaacgagacagcaataacaaaaaaccaacacactaaagaatcagccaaacctgtcaggcaaaatgaacaagagcaagatttaagctcgccgtcagcttccatatggtgattaacaattcccataccgtcaacattcgaacatctattcatattaaacgatttgatagcctgaggattaggcactaacaaaccctcactttcattattgttgctactaaacagagtcatagctaagtcttcactagtaacagcatcggtttgactgccacatacattcatgttcgagtctttctcacacgtctctttcacagtatcatctttagaaggttccacatcaatatctccggcattggtttcaccctgagattctttgacatctaaattctcagaatcacaatcataactaatcttatcctcagaagaagaagcttcattagtatcactagtcctagtactctctttgaccaagtcgtcaacaactaaacacaacctcttggaaaacttaacaccggagccttcacgagcagcaaggctcttaccagaatcatctccagatttaagtagcaaatctcccaaaatcgctgaaagccctctcttgcttggaaggttagtcatatcacacaatgcgacacgtgtttccttggacactactaggctgcaccaatctccagtcatcttcaaatatcaccaaaacaaaacaaaaaccaaaaacgttttaaatttccaaacaagaaatcaaaactcaccaacaaaccctaagaatttagaggtacaatttttaatatccaagatatgaaattgaacaaaacccacttcaattaactgacaaagaagctagaaaatgaagcgattcgtacattagaaacgaagaaccctaaatttaacgaaagagacaaaatcaaattgagtttgggttacttaccaatggattaatggcatccgtcgttggccgagaaatcttgatataatcggaagcaagaaatgagaaatcttggtttaatcggaagcaaaaatatactcaacagagaattagggtttattttagaagtggttgaggcgggaacaaatcctgatttctccgatcttagattttcttttgacccgcgtttcgaattcgtcggactcgggagtcacgcgcgaggactcttagatttacttaatgggccacaaattaaaaacccacagttacataaagcccaaaagcccacattacctaaaattaggaaagttgggtaacaagatggaaaagatcaatctggcttatgtctggtcaaaaatcttatctgacaaaaaaaggaaagagatcacctcgaaaagcacaccagatagagccaaattgttatccacttatatatctacacgtcattgacaacgacgtgtccacgtcatcttccttgccgtaaaagcattcacctttataattttcataaattcgttagcgaagagaaaattttcaactcattgaaatg

SEQ ID NO: 1466 - DNA, 3000 bp, Unknown
  misc_feature (1)..( 3000): cDNA_ID_3062536_gDNA_ID_1620406_Annot_ID_156119 3000 nt of promoter + ATG
tttattgttgatatctcttactatcttgatttcacctttcgttaccatttgcgtacaaaaatttaacaaagcaatgaatgggaatttcttattttttgtatagtcgttttaactgctaaactatgttaagttggtccacacaattaggtgctgaaaataaagtgacatcctaataagtggaaacttgacttatggagcttttcgtctgcttaacattaatttttatcatcttatctatttgacaccttccaaacactattggggaaatggcttcttctcttttttccggtgtaggtttaaggttttagatttgaaggcggatggtgaggagtttgtgttgatgaaatgggtgatttgaagttaaatcctttaagttcttttagccttaagttcttttagcctgtcattacaatatatgtttcagttgtgatcttttggtgctctccaaggtcttagggaatctccgtgtcccctctggtttctttctttgtataaagtctctggaatttaaagatgattttgtcctgttttcttcgaagaatttggcgaagaaacatcaaaagttcactatttgctttacgtgttatgcttgtttgactttgtgtgatctaacttttggttgaaaactaatgctcatcttttgttctttggaatgtcttgatctgcttgattttgaatgctttgtcacattgtttaaacaatttgttctttgttttcagttgaggaaaacatgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtggtacttttttacttcattgctcttcaacctcctgatgataaatttgtttggtctgttttcagaaatttaaactagctttcatttcttgacaatcttttttttttttttatagtcagaggatacttcccatggaacagcaggaactcctcacatgttcgatcaagaagcttcaacgtctagacatcccgataaggttagctattcaaatacttctctatcagtttcttaatcataaatttctacgcatcatatagactaaatcgttatatcgttacagatacaaagacggcttgctcaaaaccgcgaggctgctaggaaaagtcgcttgcgcaagaaggtatgacttcattttcttccccttggtaaactgtttctgtttgcctaatgagttgagagatttgattgttttttttttttgcaggcttatgttcagcaactggaaacaagcaggttgaagctaattcaattagagcaagaactcgatcgtgctagacaacaggttaatgaaatgaaatctaaatatatattcgctttctttcgagttccaaaatataatgcaatttctgattgaatatgaatgttttcagggattctatgtaggaaacggaatagatactaattctctcggtttttcggaaaccatgaatccaggttttgaatcaagaacaatgagtcttttggaaaaaatatagaattcaagattttgattggtggaagcttatttgatttgcagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggtataaaacaaataacaatctagcgtaatgtttaatgaatagaaggaaacaagcaagattacaatgtttcaaatgtttttttttgtaggttcttttgccacattttgatgtcttgacggatcaacaacttctagatgtatgcaatctaaaacaatcgtgtcagcaagcagaagacgcgttgactcaaggtatggagaagctgcaacacacccttgcggactgcgttgcagcgggacaactcggtgaaggaagttacattcctcaggtgaattctgctatggatagattagaagctttggtcagtttcgtaaatcaggtaaaatatatatattcaaactcatttgaaaatactatagtatcagtttcttgattttgtttgttcattcttaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtgaaccaacgtaggtttgagttattttgtaacaaccaaatgaagaaaatggaaagacctcaaaaaatgaagaatgagtgcatctgaaaacagaggactactctgaataaatagaggggttgctgctgatatttatttttactctgcggcggaattagaaaatttgaaaaacatcatgtattgataagttgtaaatatcagaaaaaggtgggggtgcaaaaatttgtactttttagcttttgaaagaggcaagtttttcgaatgtttgtttgatttgtaaacaatttcagaattatataaacttggttccaaatcccctgtaataatgtcgagctatctgcaatttgaaaactataggggctttacttaattttacgttttgtgtgacacctatttgattttttttgatacgtttggaccagtttcgtaattagaggtaaataaaggggcaaatagtaagatataagaaaagccttatctcatagagtttcttctcttcattatcctcaaaatcgctcgagagtgagaactctgctcttcttcttcttcctccgccatagctaca

SEQ ID NO: 1467 - DNA, 3000 bp, Unknown
  misc_feature (1)..( 3000): cDNA_ID_2136569_gDNA_ID_1620406_Annot_ID_156124 3000 nt of promoter + ATG
gatacgggtaagttggttttaacatcaagacatatatgttgattgtggtcacacagctttatccacttctcacactttttggtgttttttttttgcagaaaagctcctaggtttagaaggcctatgcgttacatgccgtaccaataaaaccgtcatcatggttaagcatagaagggattcgctaccagtgtggatgcgtgtattggctatacccatccttcattgagctttctttatgactttggctctttcgccttttagaactttgcgcgtaaacattttcgaacctagactggtattataagtttcatatcgttttgatatgatgcatataatgattggatcaagtgttgcttatataattgggactattgggttatagctgaaatctgttaaatgaaagtgttgactctttttattcgcttagcaaatcaactccaaagatgttccgcgcattttaaacttttattgtcgaggctttgctaccatgcgcctgtaagaggttctcttctgatgatggacgtcaaggtcgtagccatttcttgcaatgacctgagatttaaccagtcacttgtcacagacccgaaaagacgataatgtccttatcgcttccttctcgatacgctctcttctccggctcgactcctgttcgcatcagcaggaggagcaacctctgcttcgccgtctccgccgcacgagcttctcgccgggattctatatcattcccccagcctatcttcctccgccacgtcatctctacccagtcgaatttcgagatcgatcgaaattatagagctcatgcgtcttctatcggatcattcgaggatagctcttcttctaacttactagaagacgccagttccgatggtttcgatttgggcagctttgtttctttcgcggaagcgctttgtattttatcatccgccgtgatttcagtggttctcgcggtgaattacgtggtggttggtgaaattgggaaaaaggttttgtctttaggtttcgttggattggttggctcagtcgccactggttcttggcttagacgacgacaatggatgaggatttgcaaaggcgcgagagaaagtgaggggactaatctaattcgaaggttggagaaacttgaaaaggatttaaaaagttcgacttctattgttagagttctttctaggcatctggagaagctgggaattcggtttcgggtcacacgaaaagctctaaaggaacccatttctgaggtattgttctctttctcgagctttgcttcatcaaatgattccattgaaaacgtcccattctctatgtcactatgtgagtgaaattgcatgaaagtggaacaagtgatgatttgggaattgatctagagttgttgaatgtctgaggaagtaacaaatgttctagtgtttgaatcaatattttggagatttaggataatcttgcagaaaatatcagtttttgagtttatgactggtcaatatagctgtctttgtggctgtatgtatctgaagagtttggtttgttttgtccaaaagactgcagctttagctcaaaagaattctgaggctacgagggtattagttgcacagcaagagattctagagaaggagcttggcgaaattcaaaaggtgctgcttgctatgcaggtatttatctattaaccaatgatccgatttgttttggtattagttatttgagtgtgtaaaagggtatcttctaagattttgccatggctgaattgaagaagtccatactagtgtcgtttgagctcatgaaagctggttgcttgctttgctatgcaggaacaacagcgaaagcaactcgagcttatccttacaatcgcaaagagcagcaagctgtttgagagcagtactagtagcaagcaatcccctagtgaacaacggaaaaataaagcagaggaaccctcaacacccaaacagatactcgttcaataaacagacgtaatgacaatgtgtaagttttgtatggacaatactctttgaagtcaagagagcgataacactgtatggagaaactcactgtggttacgtagctgtattatcatcattgttttgggttttgtaattttcacttgtttcgaattaaagtttttttccttctaataagaaagttcttgatgacgaataatgttaaaaagtttggacataaaccaaacctattcgtaatcaacaagtaacgattatcatatagattttcttgggcttttgggcctcttccagttgtcgaaaaggccttattgtttttattctattttcttaatttctttgttaatgacagtcaaagcatcatcatgattaattattattttaatcacgcacgaaaagcagttttacgacgaatgtcggcttttttagtctcaactctgactggacacaacgactgtcataattgcgatttgtttcgaaagacttttccatctaacaacagctccaacaaatgtaaacgaagaaagaaaatcaaaagtttggtttttctttgtaaaagacagagttttacagttttactttctcttcctaaagagttttcaactagccgaagtggaaccatccaagcctaagtattgttggttttattcgtcgagtgaatctttcttgctggaattattctctttccctttttggattttcttctccgcatcgatttttttttttgttgggcactttctttttctttttgctgttcccaaatctgagtttctcaaattttcttgagatttggggtcaatatctctgtttttccgtgaaaactgaagaattctctgagttatttggatttttatcttttgggtaactgaaaaaagttcgtttttttattactattgtagaattttgaatttagaaagtctcggattcctatagtaaatccactctatctaatctacaaacttaaaaatatgttttaacttttgtttcaaaggtttcttgtagatgtcacaatttcttagagaatccaacgttttcaattttggtagctcttagaaaaatg

SEQ ID NO: 1468 - DNA, 3000 bp, Unknown
  misc_feature (1)..( 3000): cDNA_ID_2136573_gDNA_ID_1620406_Annot_ID_156125 3000 nt of promoter + ATG
tgaaaagatcagcttaatggtttaaacggtattggtagtatcactcagacaacggagaatgcaaccgagaccagctctctctgttagtttctcgtgaatcatcaaacactgttcgcatgtgggttcgtcaccagtcgaaagacctctgtacaagtacctgatccacaccatttaagcaaacaaaacactgcttccacatcacgctaattaaaagctagcagagcaaaaggcaagagacttacttcatgagaatgtcgtaatactcggcagtaagagaatttaacattccttcgatatcctttatcgccatgatagctctgtgcacaactatccaattagctgactgcaatttcacagatatttatcataaattacacaatctttttgatcatgaacaaactacttatgtgcatggtagaggaaacagtaggaccttgcaacgttcgtcgagagttttaggtggcgaaccatcaagagccgttttaagagcttcgacatgtttgtagctgaataaaacgaagtaacaattatagcctaggtcatctgagaaagttggaagaaaaaaggaactttagggttattactgtttgagtaagctttcaatcttctgcgatttggtttcgatccttgccattatttcctctgcattatcagcttcaacaaatgctgctgcaccagccattggatctctctctttctctacactctccagcaaaattatctaaaacctaatcaattaatttcatttcttcattcaaatcgacaacttgctgcataagaaacatatgatttgagtttactaaccaaaggaggcaatgcaaaacttgtcatccccataaaaagctaaaaagagaagtaacaatcacgacaaaatcaattctaatcacgtaaaacaatccattgccgatggtacgcagatttctcacatcatatcagatcagtaatcctgaactttctgatcaaatcatacaagattgaagaatcaagcaggattcgaagattacctgaaattagagagaataaagcaatcgagtggtaaaacggccgagtgagaatttatcagaactgtgataccaattattaaaatcggatgcttcagtttttaatttttactttttcacattgacgtaacaagagaaatagaaaagttgttattgctggtatatatttgtaattaacaaaaatgtaacaataatcttacaaatgtagagagaataaaaacatgttgatcaaattaatatccaatttttaagatcaaattaagatcggtttgttatacttggattcaacaccccaaaaccccacaaaaactgctcattaagcaacaaatgaatcacacagctctagataggagaaatatcccaatcagagtctttaaaacatctatatattgttgttatcaagtaacattcaagaattgaattggtttatctaagagttacaacacatgttactcttgtttggtatcacttgaccaggacctggaacaatatcaatcttcttaccagcaagcgacccgggattaccattctcttgatcttcactcgcagccagacttttcttgttcacaatgttgaagatctcagtcaaaaccgtggagaaagcgctctcaacattggttgcgttaaatgcagatgtctccaagaagaacaaaccttctttctccgcaaattctttcgcatcttctgtcggtatagctcgttgatccacaagatctgacttgttcccaataaggattatcacaatgttcttatctgcatgagcacgtagttcttctaaccatcttgggatatggtcaaaggtttggcgtctggttatgtcatacaccaacatcgccccaaccgctcctcggtaatatgcacttgttactgctctgtatctgtttcaaccaataccacacatatagaaagatatacaatgtaagcatatgataagcatgaaatgtggtggttagcttactcattaaagatcagtgaatgtataaagttgatgaagcatcactgggaaatgtataacaaaagtgtccaaatttgtaccaatcataaaattatagaagcttaataacattggaatagtaatatacataattctagtctatacataattttgaaatcccaatcccaaattctcaatgattctaccattttacttcagatcctcccaatttcgtatacagatcagtaagctttactagaattcgaaatcctaagcagacctatcatcttccagatctagagaaacagtaaaatcttacgagatctaagttcaagcaattgaagtagctaaaagttccgggagaggtcggagattaccgttcttggccggcggtatcccagatctgagccttaacactcttgtgatcgataacaagcgtccgagtctgaaactcaacgccgatggtggccttagaatccaaactgaattcgtctctagcataacgagccagtatctgtgatttcccaaccgcggaatcgccgatcaacaccactttgaacacataatcaatcttctgcgacggatctccgtatcctcctccactagtcatcttcttcaacgtctctctctcgctaaatcctctcttgctaaatcctctgttttaagcttttaccgaaaagtgagcttttttgaagttttaaacgcagagagagatctgatacggtcgtattgtcgtcgttgtcaactattagtcaatatttttaattaatgatgacgtgtctaaatattaaccgttggattctgccggctcggtgagatttgacggattcgacaattatctttctgtcaggcgcatgtttttgggtgatgatgtcatcaaatagggtaatttcgaatgttaaaaagtcttttaaaattgggccttattaggcccattaagttataataaagggccgttatttggttgattacgtgtcgctatccgaattgacaaaaagtgacctaagcgttttcagaagaaaacaaagcaaacgtcgcgacggagagagagcgagagagacgatg

SEQ ID NO: 1469 - DNA, 3000 bp, Unknown
  misc_feature (1)..( 3000): cDNA_ID_3062546_gDNA_ID_1620406_Annot_ID_156113 3000 nt of promoter + ATG
attttcgaaaataagatttcaaataaacaaaataaaaagatgtgatcaaaaccatcgatcaaatacagtttttccagaatgcttaaatttgaaataatgatgatatgtatatgatcaatgatcaatcgtcgaatgaatgtaaagattaattattatcatgaaatttacaataaactcgttatgttcatgaacgcgacgtaccaggcccatatcatgagaaaaatggaaaagtaactatgggtatagaattttcgttttttctcttcctcatatcaaggcccatatcatgaaactggatacaatagtatgtaattggccttggccttcatttttgggcttgaagcaacttaggctcggaccacaaacttacacaacattttttgacaaatctgaagaaaaaaatgtttgataatatctgaaatattataatacatttagaagttaaaaaatcttgaaaatataaattgtttgataatatctgaaatattataatatttagaattagaaaatactgaacccatggatttgtctaattgattaataattgtaaatataccaatctgtttaaatactaggaaatttcatttgacaaacctgtaagtaattttaaaataatgaatagtgatcagatttatacgtcaatgacacggaccttggagaccactttccacacaaaatccatattttttaacaaaccgacccagcccaccttctcacgaaaaccacctgtaccaacagattaggcacgattttaaaaaaccattaaccaaattttatattattaaagaagatatttaatttatagaaaactattgacccaaccttatccaaaaaccaataccacacgtcaaagccacactatatataccagttgcgttgaataacatctaacatagaaccaaagataaccgaacatcagaggtagataaaccggagataaccgattaaatggcggacatagcgattttggtggcggaggagtacgagaggaggatgaagcatacgacggtgggttcgagatcatcgccggtggaatttgattggtggaagataattccggcgaagatgactatagcttttgacaagatgaagattgagagtttgaagaagaattttgaagctaaatctgagtttgctttagccatctctcatggcttcttctctgcttgattccattttgttcatagctaatttcgtttcttaatttctgttttttttttttgctttttgggaagttttatgtaaatatatgtaaattaatctgtttattttatcaaccgttgaatcaatgacttggtcttctccggcgaatcactgttgagtaaaaaaagataaaaaaaaaaaacaaatctcagggactttgttgcatacgtggacaaacttctggggaagaattctaaaattttaaaacttcatcatcttaatactgtgttgagaaacttcggcgtaatttttgcaattcgacccttatattctggatttctcttttaaatcttttcattcaaaattatataaaatgggaagcagcagcgacgagacgccagtggttctcatcacaggatgttctcagggaggaatcggtcacgcgttggcgcgtgagttctcggctaatggttgtcgtgtggtggcgacgagtcgatcgcagaagacgatgactgaattggagaaagattccaagttctttgtgcaagagctcgatgttcagtctgagcagagcgtgagtaaagttgtgtcgaaagttatcgacaaatttggtcagattgatgttttggttaataacgccggagttcagtgtatcggacctttggcggagattccaatttcagccatggattacaccttcaacaccaatgtgctcggtgaatgaaaattttcgagttacttcttatatgcacaccatgtgtttgttaaaattcttgactcaactctttcatgttttattttgctctgttgatttgggttgtgagaagtctcttcaagaactgaactttgtaaagaaactttgcaggttccatgaggatgactcaagctgttgtacctcacatggcgtctaagaaaaagggaaagattgtgaacataggaagtattagcataatggcaccaggaccatgggctggggtttatactgcatcaaaagctgctcttcatgctcttaccgacactttaaggtttttcgatttcagcagtctcttttcatcagcttgattaatatcatctaaacagtaaacactatcttgttttgtgtttgtctaggttggagcttaagccatttgggattgatgtaatcaacattgtaccaggaggtattcaatcaaacatagctaactcagggatatcgagtttcaacaatttacctgaattgaaactatacaaaccgttcgaggacgctatccgtgagagagcgtttctgtcgcaaaacataaagccgatacccacagagacttttgcgaaagagactgtttccgtggtgctgaagaaaaacccaccggcttggtactctacaggtaggttatctacagtcatggcgatcatgcaccatataccgattttcatgaaagattttctgttgactaagagttttatgaaaaagggagtaaaacctgaatagttgtgttcttggttagaaactgttttaaatgtatccaacaaagtaaatgtgttgcctaaccatgttacatctttagtaaaaggattaatcaaggtactactttggtagggtgtgcaaaaacaaaaacaaaacagtggctaagcagaaacttggttataaacaaaaaaaacagtgcctaaccatgttacatttatagtaaaagatccaaaaggccgaaccaaaaccaaatcgaactaaaaatgagtttttattcgattttggtttgtataaaacaggtaaaacttaattcgaaacaagataaaaccgtaaagccagattgtctactagactacccttatactttggtttttggtacaaagatttgtaggggaaatgtcatatcatctgtgatg

SEQ ID NO: 1470 - DNA, 3000 bp, Unknown
  misc_feature (1)..( 3000): cDNA_ID_3062554_gDNA_ID_1620406_Annot_ID_156105 3000 nt of promoter + ATG
tggtgtgattcttactttttaacagcttcgatgaacttggcaagaatgactgtttcaatgtgagattctgcaagcgttaaaagatgattcaagcatctgttccatgccccgaaaccaccaagagtctttgaatgcttctgcaatctcgctgccacattttgtagcaatcgcgatgttcgatactgaggagacaaatgtaaagaatacaattgtaatgaatgaaggcaatgagagtctcagagagatattatatacagcaaacactaactcacccggaaagcatctagttggaatttaggatctcttagatgatcttcaccttcccaacgcgctgtaacgggatttggctgagacaaataagtgttcattgattctctcaagtagctccatgtaactgtcaatgtcccgccttggaacttttctttataacgcttcaataaatcagcagccacctgaaagcaaaagaaaaactttgagcatgattattctcaagagaagtgaaagtttcttaaaggagtgaaaggaggacctgttgcagaagtacagtgttgtctccttcaaatgtttggaaaatgtcatgatcatttctcaagcttccaaatcggttaacagctgcgtaaccatgacctccacaggcttctctgcagaccgagagcgccttggcggtgtaagacgtcacataagatttgagcccagcagagagtgcatggacatcagcaaccaattgctcatcgtgagtcttcttcatctctgaatatttctccacaaggtatacagttgcaaaatggtatgcataggtggaggctaacatcggcatgagcttgtgttgttgagactggtaatcgagaatactgacctcaggttgctttggaggcccgaattgttgtcttagaagagaataacgaatggcaatcgttgcagagattttaaggacgccaacagatgcataggcaaggccaactcgaccacctacaagctcaccgagtgttgcaccaaatcttttattgattgttggcaaactacttgtatacgtcccatctcgggacacatctccaaaacgattgagaagattatcacggggtattctcacagaacggaatctcaacgcaccattatccactccattaagtcccactttatgtccacaatcttggatttcaacaccagggagtgtctggtgtgttttcatatcccttatcggaacaatgaaggcgtgaacacccatatccgagactcctttggaatcatgagttggaagtataagcctggcaaaaacagtggcaaacttcccatgaactgcagcatttccaatccaccatttgatagctccatcattaggtgtatcgatcacaaattcgtctttaagtggatcgaatgtcgccgtggtctgaagaccttgcacatttgaccctagaagaaacatagacagacacttaatactgggcatgacactgagacagactactagatgctgaggggacattagacatcactcaccatggtgtaattcagtcatggcaaagcaaccggtgtaatcaagattgtcaatgccatcaaaatacttgtctctatgcttcttagtccctaaattgatcacagagcctccccagagactgcaaatatatacgtatcaacaaatcaaatccagagactagagtatgaatcctaacatcaatactaacaaaacaagatcaaaccttttccatcaagaacaaccacaaaacaaaaatatttcaatttagactactactaacctgtattgaacgcccatcttaatcccaagggacatatcaacacttccaacagcttccatgattgcgaaatacttctcaggatcatcagcaacatacctaaacggccttaccccagcttctctaacaagccctataagctgattcatacacaattcccgatgatcatccttggagatctcgatcggcgtctgcaaatcgggtcgggaattgaaaaagtcgaaaattttctcttgtatatctatatgttttcctctcatatacagcgacaaagcttcgccgttgacatccagcttcttcgacctcgccgaacacgtctccgtctgcaccaacggtaacgacggcgacggcgtcaaggagggagataggtgtaaagacaatcgttggatccgcctcgccgcaattagcccatcagattcctcctccgtcatcggattcttctctcgccgcgattccatttcaatgagttgaaaattttctcttcgctaacgaatttatgaaaattataaaggtgaatgcttttacggcaaggaagatgacgtggacacgtcgttgtcaatgacgtgtagatatataagtggataacaatttggctctatctggtgtgcttttcgaggtgatctctttcctttttttgtcagataagatttttgaccagacataagccagattgatcttttccatcttgttacccaactttcctaattttaggtaatgtgggcttttgggctttatgtaactgtgggtttttaatttgtggcccattaagtaaatctaagagtcctcgcgcgtgactcccgagtccgacgaattcgaaacgcgggtcaaaagaaaatctaagatcggagaaatcaggatttgttcccgcctcaaccacttctaaaataaaccctaattctctgttgagtatatttttgcttccgattaaaccaagatttctcatttcttgcttccgattatatcaagatttctcggccaacgacggatgccattaatccattggtaagtaacccaaactcaatttgattttgtctctttcgttaaatttagggttcttcgtttctaatgtacgaatcgcttcattttctagcttctttgtcagttaattgaagtgggttttgttcaatttcatatcttggatattaaaaattgtacctctaaattcttagggtttgttggtgagttttgatttcttgtttggaaatttaaaacgtttttggtttttgttttgttttggtgatatttgaag

SEQ ID NO: 1471 - DNA, 3000 bp, Unknown
  misc_feature (1)..( 3000): cDNA_ID_2136597_gDNA_ID_1620407_Annot_ID_156141 3000 nt of promoter + ATG
tattgtaacattttgagcgaaaacaaaaacatgaaaatatttcacctacatgtccacaaaacataagtttcccaagattatatagcaaatcacatttattagacggcacgagtcgtttgccaaagctcataacatccatatatattattctgatgtacatgcattagccattttaacctataagaggtggaacttttttttcttctattcccactcatatgacgaattaaagtcacctgtcaactatatttcagtacacgaactgctaaccatttttgttttaaataaaaaaatatcatcgtcatgtaacatcgtttactaaaccttaataaaaataatttacatataatactaatttgaaaaaagaaaaaaaaaactgagaccacacacaactattactgcaaggaataaaaaaaggagtatatattgacgtagtttcttcatataacgaatttaagtacatggacaagatatcaattaccatgaactcagaaatagtaagtaattttttttatatataatagtaagtaagttgactactaataaattttcagaatattattgggttaccatcctttttgacctcgatggtttgtttaaattttgatattataattatataggatgatcgacatgtaatgatgtacatcaccgattaacgtcaaatatagttttatcttatataccaatcttgatgaaactgaaaaccacacgtaagacgagaacgtatgggcatgatttcctcgtaaataatgttttgattgattagcacttaacaaaattagaactagttttcacaaattgatattaagataatgtggattcatattaagaaaataagtacgatcatattcgtctggttgacaaaaagacgcatgtgataaacatttggccccacacacattgaatttacaaactgtttctgattggcacgaaaagtatggtgcctccttatcctttttttttcttcttcttatgatcaatttccgaatatatttgaaacaaataaattatgccaatgccatagtaacaaacaaatcttctttatcagaaaaacaaacaaaccattttctgtatacattgctgattaaccggttagaaaaacgtgggacaagtagggttttaggttaagaaaacatatcgctgtctagtcaattaccagttgtaaaatatcggttccagagcttttacaaacaaatgttgtgtttcattttaatgttggttataaaaaaaaatgtctgcatggtacatgcaaaggaaaaacatggctcaatacagaaaaatctctaattaatggaagagaagacaaatgactcaacgagtctacgtactagcgtaagtaataccttgaaattcgaatcaataataatatatagtaaagaaaaggaaagaaaaagcaaaatatccgttaaatggggaaataggagaagaagaaaaatgaagtctatgattttcgagctcccaactagtaactacaatctgccgttataatttgatggagattgattaacaaaagaccacattgttgttggcaagtgtgatcgcgtacggggattcttataatattaaataacaaatgtacgtaaaatgttttacaccacatattataccaacatccttgaacaaaaaaaatcttcttttaacgatgataaattctatttttattagatcattcatacccatacgttcttgatcatgccgtaaatctagagagcaaacatttgtgagtgtcagaaagtgtgtctcttatatattaaaacacatgatcaacgatgatgagtactcgagttctagggtaagagtaaagattgacctaggatacggttgttcgtgttaacaacgataagaactcgagtttgcggttcgaaattggtgttttcctcgaaatttttctaactggatcacttgtgttttctttgttatgttttgtttgtaattttcgttatcatttcatttttcagttttttcccgttgtcaaaatttttaaaaaagtaaaattacttaacattgataccacgtaaaaaaatattgcactatggtaattttatagtgcttatctcttataatagttactttccataaattttaaatgataaattcatttaaaatgtgataatggtaactatgagtctatgaatctatgattgtaaaatcatgtattttagtttatgatatttcgacgcattctttaatttcgtgcatagcgaatttgatttacatttttctacaaaagttttttttttttttttggtatatacagaaattgggaggatagtttggttaccaacaaaaatatattattgggagggggtatatgttgaaaggtgagcaactggcaagtgggcacatattacatgaatgggccattttctaaagtgtttggattgcttgtccaacaataactatccaacattcacttgtccaattgctttctagcttttgcttttctgcttgccctttcaattaatacacaaatttatgtatatatacattatccacctacatataaagtatatacatgaactttcgttttcttataaaatgaaaactattagcatattcctaaagctctcatttattttcgtatgatcaacttggtttcttagtttttttgttaatgggcttgattttttaataactcaagagatatcttgaattatataaacccaatgaaacaaaacgtgacaataaaatatctcagaccaaaataaacaattttagtcaatatgggctagattataggcccataaaggtcaacaaaattacaaaacctctgttttcttcagacagctttcgagcttcgtttgtcagacagagaacacgtggcacttccttcagcacctctgtgtcaaagcaccgtgagagacaatggtgacgcgtgtgaccagacggcgtttaaacccttttaccaaaatctcatctttcttcttctccgtcgtcgtcatcgtaatatctttaatctgatcgttttgtcgaagcacaagaggctgaatcaacatg

SEQ ID NO: 1472 - DNA, 3000 bp, Unknown
  misc_feature (1)..( 3000): cDNA_ID_2136632_gDNA_ID_1620407_Annot_ID_156153 3000 nt of promoter + ATG
gatgagggattgagtgttgggacgatcggaggaggaacaaggtttgtagaagtagagagtgcccatgtgaagtctcacttgaatcaagtctaaattggaaagccatagattgtgtgtgggtgtttcttcagctggcttcacgatcgtagcttgcttcacccgaatcttcatttgatccacgatcactaaaaggcaatggctttaaagacagaacacgacttgattagcatgacctgatctgctgatcagtttaccggaaagtggagactgataaagaagaaaaagaatataaaaaggctctttttttttgtcgacaatataaaaatgctaccacctcaaaagaaataagagatgaaaaacaagaaatttgagcactagacgcaaccactccatgaattgttgagaatgggtacaatcataattcaaaagtgataaagagaaatctttacaaagacagatacctaaaaaccccatgataaactcaacttacaataacagcaaagctttacaaaaaagccacagcttattgtctttgatgaacaaagagagtgattggctcagtaaggaacaagaacacgaacggaaggtggaccagatctcatatcttcaagtaacagatcaagaagcgcctttgctataggaccttcttttcctgagtcagacagaaagaaacccatctttaatcagccaatctatccatcatgtaagtaattaaaagtgaggcttttaaaatgtttatatgataatcttacttaccttcaccaataaattcttcatcccattgaatcacaggtctgatcggaattccactaccaataagcatcatctcatctgctttctttccatcttcgactgtcacatccattactttcacagttttaagaatccccttgcttacaagctgttcagcgagtgtaagtgttctctttgctgtacatccgctcaaaacgttatcaaaccgcggcatcacaagctccttaccaccattaacaacaaacgccacattcatgttcgggccttctgcaataaacccatctttacacacccaaatacctgcataagctcctttggcctcagcttccatttgtgagagtacgttagggaggtagttaacacttttcaccgtggcaaactctggaggctttatggggatggacgaggtcactaccttgacacctattgggttaatggcgaagttcgtttttataacaatggcatagagagttggtttgagacattgagatggagataggaggaaatcccctggccctgcagagagccagtatcttagagatccatctctacatccagaaacgctcacggtttgaatgagaattcttttaatagtttctcgatcgaatggaagtgggatcttagccattgatgcagatcgcaagatacggtcaaggtgctgatccaattcataaaggtatctgcttattcgtaggacaacaagcgaagctcagatgattgagtaataagacaaattagaaaagggggctactatttaaagtgactaacccattgatgatcagggcagtgtcaaagactccatgaccacggtgaaccatgtgatcatccaatggaagaaccatcgctgctggatcggttgtaattccatcaacaacacttgagtacatggccaagaactgttgtcctcctcttgctagttttagcctctcaccaaccttttaaaccaaacatacttcactgatactcaatcaatcaacgcctctaaacataaacggataacaaacaaatgtcgcaatccttcattacgggctgcatctataatttcattgacaaaacacagaaatgtctggtggttgtgtcaataaacatctctagctaacaaattgtgaacagtttcaagagttaaagatatgattgataagtacagacataaaagagaaaccataattacctcatagctagataaaacaggaacattccacgactgagagcttgaatctgtggagaaacgaatgcagatttttgtcatcaattccagaacacttatggaatttaacgatcaacaaattgatctcttttttagggtaataagtgtacattaccctaaaaagattataataaatgcatcaccaatcacaatccagaagaaaaatcagaaaagagagaacacaaggtagaaatgtcgaaccagaacacatgagaatcgttcttcttcgtgtcaaccgacgcgggaatcgaaagccatgtcttaaaggacatggaacttgagagagagacctgagattccaagtgttaactgtaaactccagcgacaaacctgccatggggtttgggactcaaaagaatagagagagagagatcattcggaaatagcaacttgctttgcattattattatctcagtcgtgaactggaagaagacgaaaaaatatttgggcctaacttcaccacaaaaataaaataaagttattcggcccataagcccaatatgacttttcgcattgtattttaatattcaatcaatcaaaaataaaagcctaaaacaaaacaaaccctctctgtcttttagtgggttttgtacgacgcctaatcgatgttagtattatatctgtagccaaacaagccaccaaagtggtatttttcttcttccttccttaccttgtagggctctgagctcgagttataaaaaagccaactttgatttctttgccagtatttcatccttaatccattcttgtggtcactttttcgtccttaacccatctaggtaagtcgatttcattgtttgttatttgagtcagtaatttttgaaaatctttgcttttttttcttttcttttgaatatcaaaagaagaaaagatttgggggataactagatcatctctttagttaaattgactctttgaggtgtgtcaattgtcactgatagtctgattaatcttttattggcatcttagaacagattttgattctaaagtcttgtgaatcggcagcggaagaagagtgaattgttcatccttatcttgcc

SEQ ID NO: 1473 - DNA, 3000 bp, Unknown
  misc_feature (1)..( 3000): cDNA_ID_2136648_gDNA_ID_1620407_Annot_ID_156157 3000 nt of promoter + ATG
aagaagaagaagagaatttttacccacaagcattaacacgaacaactttcataagccggtggagattgttgatcaatctgattcttgcattgtatactttataagcaagaggcacaaggctcttcacaaccataccatttttaggcggaggtagaggtctcttaggtttgtctttgttgttcttgactctctccctcgcagctcgtctcaggtccacaatagggactgggaaaggtttcttctctcgccttgtgtactgcttaggtaagtcttcattctgaggacgatcatttctcacaactaatggcagagatcgacgctctttactaagcacaactcttgaattcaactgaaggctaaactcaatgctacttccctgcacaacatatccgcacataacagtaaacattgactctctacttcaaagggaagcaacgaagtgtggtctaattctaagaaccaaaacaacaacgaagcagagtctggagaattggatgatactgactagtaaaggaatctgacctgaagagaaggagagaacccaaatctataaaacgtgttgggattaagaaattgcctcctggttacgctatgaatagcaaaaggtacactttttggtgaaaacccagaaactgtactagctggataaaacaacggaaaccaaaatcaatcacagtctcacaataaatggataaaattgagcattgaggacggattcgacacacagtgaggaagaaacttacaggaaatagcggagtacgttatcgacatcgtcgacagttgctggattaaaccattggaagatggaggataaggaagagagagcggtctcagtcccggagacgaagaagatagctaatgtaaatcgtggacaagcttaaagctaataagttcaaataatgggcctttaatgggcagaagttcccattaggcccacttataataacatttgtttccaaattccacagttgtataaccgatccggcctttaatgttttctttccaatttgaatttaggatattaaccaaaactaacattgtattaaacactcagacagagtaatgcaaagaaacaagtaaacttacaaaccgaaatcgaaccgaattggctaagaaacaagactaaatcacaagccaaagtaacaagtaaaccggaaaatacaaaccgaaatcgaaccgaattggctagaggtaattcacaagactaaaccaaaaggcctaatggaagaagaagaagcaaactccatgctgtgttcaggcttcccttgttcatgatatgagcgtttaaaggagcagcagcaacgcttctgttgtaatttggagacaagacaatgtttacaggagcaggagcatcaacaacgcttctgttgtgatttggagacaagacaacaacacgaagcttctctcctctttggcaatgtccttcttctccacttatgaagtaaaaaggacctgacctcttcagctctatattcgtgtgaccatctttgtatcctcttattggctctgatctgtcacatctctcgtaatctgtttgtctcacttgcaacactgaatcattctccgcattgtatttccacactgttgaaagacaaaatgaacttttatgagaaacaaaacagagccatgtaccaaagtcaaatcttattacttacagagagaatctccaattttgaatcttgttctgcctgaccattggtttagtgtttcatctctagattctggagccttccatgtgttagatttgcctcccaccagaatctctctaccttcagacaacaaaccaaacaagagaagcaaacaacaacacatcattactgaagacattctggttatacaaaaaagtttaattatgtttctgtgatgattaatcatatgatgagaatttgcaagaataaataagagaagataggtcagtggcatcttgaatccaaacaaatccttcccatgaattaaaacgtgactaccatagaaacaaagctcgtgaaaatgaagaagctaaccgttacagttactacagagctgtgtgttaattgtgaccaaaccctttttcaccattgcatcagctgatggtcactgactaactgatgcattaaacacactagaatcatcgatgtgaacgcaaaaagtcattgccttaaactttatttttttttggggtaacagagtaaatggaatgcatgtgaagagatggcaatcttttaacaattgacgtaataagaagattttttttttatatagaagaaaactaaaaccttgcaccagtttccagaaatcaagacagagttttctgcaaaatccgtatttttttaagtaataactaaaaggcgaatctttttttttctcttccaccatctgacttttcttgagggattatattaaaaagtctgaaaaatatatttcaacctccattctcatcggtctctatacaatggacccagttgaatgaagataaacttaatatttacagacgacaatggaacacaagaaacaaaacagaaaggtttggtttcttcaagatttctctaaccaaactaacccattaatataaaaaaagttgtctagttgataaaatgttattaaaaaaggaagttgcttttatgtgttttctttgacccattacacaatttacttagtgccacaagtcattacccatttcctgcataagtctgcttccatcttcatcactgctgtctcaacccaacacactcacatccaaaaaagcaaattttgccttttattttaatttttgttttcttttttcttttctttccttctcacaacaacaacaacaacaacaacaacaacagcaacaacatgatgtgtccttcttttctgcttctttgtccttctctgacttctcctcacattgatattagacttctacacgaaacccagaaccttcctctttctcatttctctctttcctctgttttcatcttttgctcttcatctctctctttctctccttgtgtgattctgtaatttactcatctgatg

SEQ ID NO: 1474 - DNA, 3000 bp, Unknown
  misc_feature (1)..( 3000): cDNA_ID_4371064_gDNA_ID_1620407_Annot_ID_156156 3000 nt of promoter + ATG
acactgaatcattctccgcattgtatttccacactgttgaaagacaaaatgaacttttatgagaaacaaaacagagccatgtaccaaagtcaaatcttattacttacagagagaatctccaattttgaatcttgttctgcctgaccattggtttagtgtttcatctctagattctggagccttccatgtgttagatttgcctcccaccagaatctctctaccttcagacaacaaaccaaacaagagaagcaaacaacaacacatcattactgaagacattctggttatacaaaaaagtttaattatgtttctgtgatgattaatcatatgatgagaatttgcaagaataaataagagaagataggtcagtggcatcttgaatccaaacaaatccttcccatgaattaaaacgtgactaccatagaaacaaagctcgtgaaaatgaagaagctaaccgttacagttactacagagctgtgtgttaattgtgaccaaaccctttttcaccattgcatcagctgatggtcactgactaactgatgcattaaacacactagaatcatcgatgtgaacgcaaaaagtcattgccttaaactttatttttttttggggtaacagagtaaatggaatgcatgtgaagagatggcaatcttttaacaattgacgtaataagaagattttttttttatatagaagaaaactaaaaccttgcaccagtttccagaaatcaagacagagttttctgcaaaatccgtatttttttaagtaataactaaaaggcgaatctttttttttctcttccaccatctgacttttcttgagggattatattaaaaagtctgaaaaatatatttcaacctccattctcatcggtctctatacaatggacccagttgaatgaagataaacttaatatttacagacgacaatggaacacaagaaacaaaacagaaaggtttggtttcttcaagatttctctaaccaaactaacccattaatataaaaaaagttgtctagttgataaaatgttattaaaaaaggaagttgcttttatgtgttttctttgacccattacacaatttacttagtgccacaagtcattacccatttcctgcataagtctgcttccatcttcatcactgctgtctcaacccaacacactcacatccaaaaaagcaaattttgccttttattttaatttttgttttcttttttcttttctttccttctcacaacaacaacaacaacaacaacaacaacagcaacaacatgatgtgtccttcttttctgcttctttgtccttctctgacttctcctcacattgatattagacttctacacgaaacccagaaccttcctctttctcatttctctctttcctctgttttcatcttttgctcttcatctctctctttctctccttgtgtgattctgtaatttactcatctgatgaatccaactcacggagatttcactcccttgaactctaatcatttcgaggatccaaaggtcaggtttaggcatcatagccttatgcaagactatggagaattgcatatggtacgaactctcttttcttgagttttagatcaagtttcagtttctgggtctggttttagttgtctctggatctgagaatgtaattttatttgctcaaagattgatctgggctcagagctactcggaaaacccggaaaaaggaacaactttcttctttaaaataatagaaagaagaaacttttaagtttaattgcttctgcttccttaacaaagttaattacttattaagatttctatgtgtagttagttatgcaaatctctattagtcttaactcttaaacatagttttaggatttaaaaccttgttgtgtacatattatcagctcgatactctgatctttgagatcatttggttatgagcttttgttaacgtgtgttggttgattatatacactaggaaaccgaagctatgagaaaaaggttacaggcagtgcgagaaagaaaggcaacactaatggctgaagtcaggtaaagacagtttcaatccttgacaaaatatatcattagtcctttcctttgatgttttcctcacttgttaatatatcgttcgtttataacctctttaacagatttctgcgacggagatacagacatttgagacaagaccagccacaagagattaaaaaggtcagaagatcaaatggtgggaagaagatccgagtggaagtgtctcctagtaacaaaagtgaggcggaaactaagcatgtttcgcttcctgacttaaaccactcggaaaaggctcacgatgaaaccaaaaccagtcctaagagaagagttcctttgtttgatctaaatcagatatctgtaagcacatttttcactcttaatcagattgtgaagagacttagaaaccaaacatgtctttactcataaattgatttatatagggagaagaagagcaagaaacagaggcagtggacaataatcaagagaacacgagagttgaagaaagtaattcatgtaagagattaatgatcagtagcattgagatgcagcagaaagatgtgaagccatcttcttgcaggaatggcggaaacggatcaaataagaggaaaatttcatggcaagatcctgtcgcagctctcagagtctaaaataagaagacggaaccttttgttcctcctcatagatcttgttgtaacatagcttcacatcaaagttagcttgcttatttacttatcttgattgaacaacatatccaattgtgacttgaaaacttaaaaaccttatccaatggtggcttattgcaaacgtgacatttctataccgaaacatgtgtcagcaaacgacatttatggaagtgatccaaaagtcaaggaacaaaattaacggtcagatgcattgacacgtgtctaaagagacacgtttcgtgtaactttaaactacattattaccgaacacaaagaaccgatctttgaaaacaaaacaagaatctttatg

SEQ ID NO: 1475 - DNA, 3000 bp, Unknown
  misc_feature (1)..( 3000): cDNA_ID_3062601_gDNA_ID_1620407_Annot_ID_156166 3000 nt of promoter + ATG
acaaaaaggcagtggctttggcacttttcaccttagtttggaacctctcctcagtcactgcccgtgtttgggcagcattcatgttactcgtcgccttcagatattatcaacataagatgatttggacaactgatcaagctgatgatgatgaggatgacaatgaagaagaagaagcagaagaagaaaaagaacaagtccctcctaaacacaaaagggctcctcctcatatgatgatgcctaataaactcaagaaaatttcttaaatatactaattgtttttcctccatatataaacaacatttactatgtaatctctttagtttttagttacttctctatacaaagcttacagtttataatgtgaatctgatcttctaagttcaattaacttatgccaacaatctaaaactcacacacttgaaatatttatccattcttcttaaacttagttagacttgaacccaaaaacaaacaatcttaattaggcttctaacgggctttaagcgggccttattacataaactattcagctttcgtgaaataacaaatcggacagaagttgaaagctttacttcttcacttttacggttgctcaccgtcgtgacatctccactcttttcctttcaaaatccaaaatcacgatttgattttctctcgcctccgacgaacaagtttaaggtaccactccatgtttctctgcgatttcaattcgaactccatgtgaccttttctctgtctgtgtttaatttagggtttactcaattcgtgactttcatttgcgttgaaaaatttatctgattttgctttgttgtgacttgtgagtggttttcagatgagcgtagcaagtgattctccagttcattcatcaagtagtagtgacgatcttgctgcattccttgatgctgaattagactctgcatcagatgcttcgtctggacccagcgaagaagaagaagctgaggatgatgtagaatctgggtaaactcaactctcatatgtcatgcattctctctaattgaatcttcgaactctctactggtatttacagtgtgtatattttctcaaaccatgtttctcaatcttttaggttaaagagacaaaagttggagcatttagagggtgaagctctctttattgattcagtcttatttttctgtctttcgtttgttcgattgtattgaattttgaaccttatgcttgcagaagcatcctcaagcaaaggcgaatgcgagcatccaggatcatttgggaatatgtgctttgtatgtggacaaaaactggaagaaactggtgtttcatttagatacatacacaaggtatcgatttcagaatagcttctcttaaatcaaatcttagtttttatttaatgagctttgggaaatctgttttcttaggaaatgaggctcaatgaagatgaaatctcccggttgcgtgattcagattcgagattcttgcaacgccagcggaagttgtatttagttctcgatctagaccacacactgctaaatacaaccatactgagggacctaaaaccagaggaggaatacttgaaaagtcatactcattctcttcaaggtgatacattcagctacattgttttgcttctttttcaaatgtgatctttgtgcatggaacttcagtctagtatttgtctttttttttgttccatctagatggttgcaatgtttccggaggcagtcttttcctactggaatttatgcaaatgatgaccaaactgaggccgtttgttcactcatttctaaaagaagctagtgagatgtttgtgatgtacatatacacaatgggagataggaattatgcacgacagatggccaagctgctggaccccaaaggagagtactttggtgatcgggtcatttctcgggatgacggcacagtgagacatgaaaagagtctagatgtggtgcttggacaagaaagtgctgttctgattcttgacgatacagagaatgtaagtatgatttgtaatttgtcaatgtttcatgtaacttttaatcatgatattgagttgtgctgatgatacttggtttgatgctcaggcgtggccaaagcacaaggacaatttgattgtgatagagagatatcactttttttcttcgagctgcaggcagtttgatcacagatacaagtctctatcggagttgaagagtgatgagagtgaaccagatggggcacttgcaactgtcctgaaagtcctaaaacaagcgcatgctctattctttgaggtatgcactcactggatctaaataaaacttatctcttgtcttgttggagtttgttgattatattattcgtttgtttcagaatgtggatgaaggcatatcaaacagagatgttaggttaatgctgaaacaagtgcgtaaagagatacttaaaggatgtaaaatagtgttcagtcgggtgttcccaaccaaggcaaagccagaagatcaccccctgtggaaaatggctgaggaactgggagccacctgcgcaacggaagtggatgcatcagtgacacacgttgtggcaatggatgtgggaacagagaaggctcgttgggccgttagagagaagaagtatgtggttcatagaggatggatagatgcagctaattacctttggatgaaacagccagaagagaacttcggtttagagcagctcaagaagcaattgaccgaagaagagtgatttatgtaacaacaatgagaaagaagagatagcttttttttgttggatattaattatgaatctatgtctaaagtaaagttttgtaatgtacattacattgtatctctgatatttaaacaaggtactaatttttggttgatctccttaattattttgtttcgtctatgcttatttgcgaaggtctgtaatctaccgacaacttttttgggccgggcctaaatgggccgtatatttatgtccctcatctactttcatttgttttgtttggtgtttgtttctggtttctgattccgtcttcttcgcttagac

SEQ ID NO: 1476 - DNA, 3000 bp, Unknown
  misc_feature (1)..( 3000): cDNA_ID_3062603_gDNA_ID_1620407_Annot_ID_156165 3000 nt of promoter + ATG
aaaggagagaaagagagcggaagctgcaacgcactattaaaccctagctaaagacccagccacttattttattttattttataaattttgcatttgatagagacaggagtttctgtttctgttttctgttacggtggtctataccgcgcctgattattaacccggggaatgaaacagtacttattatttatagccttaaaccctaatttaaaggaggttgaacttggaataatataaaaaccaattctaggcctaatcaatgtataagctataaatttagaactattctaaagcttttaaaatataaaaattaatgaattaaatccaaataaaagcttcaaaatgttgatattggttcttcacattttttttttatattttgtttaacttattttaaataatattaccataaaactaactcagtattgaattataaatggaattaaaaatcaatagatattcaatttttatttttctggtaggaatagatattcaaatttaacctaatgggaaagaaattcaaaaataatattgttaatttttaaattcagtcaaatttaattgaatcccttccttccataatcccctaaacccctgaattctgttcactaataggcctaattaaaaagcccatttatatgagtttgacgatttgttaggaagtttggaactaaaaggagaaactggattgggcttatttcgatgagtaaacccggagcttttgaggccatatataataaacccacactagttgcaaactggtgctgactattattaatctatgtaaaagtttcaatttaaataattttttatattggaaaaaaaaagcaattagtaaagaaatagatttactgcagaaatcttaaatctttttaaaaaaatatgaaattatgaatcaactttttaatttagagcaagagaaaggaaaacaaaagtttagtggaaaaagaaaaagtagaggaattgcatggggggagagaaaaattataaaactaaaaacaatagcagacagctattgtaattggtaaacatgtgtagtagtaaaaggatcccgagtcggtgaagactccaaagtacgtttgtatatttatatatttcagagtagtgaattggaggaaatcaatatctatctaatccccataagatacacccattattgaaaccatggcccattcatatatttacttatttgtttctgtgtgaccgttattacttatttgtctcattcttaaattagtgaatgattaaaaaaagattgtgtgtgtggatgggtcatcaactcatcatgggtttaggtaaatgttactcacaagtcacaattaacaactttttttttataaaagaaaaacaaatatgttcgttgccacggtagtttggctcactccaaatttaataacgtattgtattcgcaaaagaagatatactaggagaaagcaaaatgtgttttgtagtattaaaaaagagtctataaagagagagagagagaatgtgcatgaaaataagaaagacagagagaggggaggaaaacaaagaagcaggtgcatagggagaagtgccatgagtcacgtgccctcttactcgaccacgtgccgtcgaagcaatcccaatccaactccgattcgtgttccaatttttcattggggtctaaacttgattagtgtactactatgtaattaattagtgtggttactaattagacacgcacacagacgcaattgcaaattcacatttagattaaggagaccaggatccgttatagctgttaattaggtagggtagtttatccaatacaccaagcatgcatttaacgttaattgagtgtttgctagtacaatccatgcttgatagtataaatgtattgatattcatatattacaaattaaaatatgtatgcttgtactatctatataaagttacggattgtgactttttcttttggtgtaaaaccgatttattatcactgttttctgccacaaaaagctgtcggtggcactcacttcactaatccagtgacagtaaatttttataaaataagattatctaaattaaagttaaaataataacaataacacgttaaatacttaaattagatccatttgttcattctcatctcaaacactcgaccttttataaaggaaaatttagtttcactctctccgactccttccaaaatgatttactttttaatatccaaactcatctaaatttgggtctatatatggctccgtatagatatattctaatattgcatttaactgacgtagacaatattcaatgccataaattttcctcttggttagttggtgaaaaaagtcaaaaccgaactaatccaacaaatattcgttaaattttagctagtttggtgatgaagtaaagtctttaacatattcttacttttgtaaaaaaaaaaagttatattgatatttgatcaaagtatgagtatttacatgaaccatgtgaatacgtatataaccattcacttaaatctcgtgaggtacttgaagaacaaaaataatagtggaagaggacgcaattcaattgttaaacacggcacatgttgattgatagataacgtaaactttatttcataaagtaaaaaacaagaagtaatcaaaattaattaacttcaaataaaaaaagaaaagtaaaaaagtagagagattgtgatcataaaccttgatgattatgtttaagtaagcatctttgcagtgcaaccacatgcaaaggctttaggttaattttaaaagcagtagccaattatccaatttggtgatctatagctagtctcaatcttcatgagacaaacataggtccccctcctctgtctgatctaacaacccaactccaaattctgctttatcagaaattatatgaaatcaattaccttttggtgcccaacaacctccattttccttcagcttcaaggctcatcatcattactactttcaaattcacagctcgattactagtacgacatagacatagacataaagacagaga

SEQ ID NO: 1477 - DNA, 3000 bp, Unknown
  misc_feature (1)..( 3000): cDNA_ID_2136676_gDNA_ID_1620407_Annot_ID_156164 3000 nt of promoter + ATG
tgggcaccaaaaggtaattgatttcatataatttctgataaagcagaatttggagttgggttgttagatcagacagaggagggggacctatgtttgtctcatgaagattgagactagctatagatcaccaaattggataattggctactgcttttaaaattaacctaaagcctttgcatgtggttgcactgcaaagatgcttacttaaacataatcatcaaggtttatgatcacaatctctctacttttttacttttctttttttatttgaagttaattaattttgattacttcttgttttttactttatgaaataaagtttacgttatctatcaatcaacatgtgccgtgtttaacaattgaattgcgtcctcttccactattatttttgttcttcaagtacctcacgagatttaagtgaatggttatatacgtattcacatggttcatgtaaatactcatactttgatcaaatatcaatataactttttttttttacaaaagtaagaatatgttaaagactttacttcatcaccaaactagctaaaatttaacgaatatttgttggattagttcggttttgacttttttcaccaactaaccaagaggaaaatttatggcattgaatattgtctacgtcagttaaatgcaatattagaatatatctatacggagccatatatagacccaaatttagatgagtttggatattaaaaagtaaatcattttggaaggagtcggagagagtgaaactaaattttcctttataaaaggtcgagtgtttgagatgagaatgaacaaatggatctaatttaagtatttaacgtgttattgttattattttaactttaatttagataatcttattttataaaaatttactgtcactggattagtgaagtgagtgccaccgacagctttttgtggcagaaaacagtgataataaatcggttttacaccaaaagaaaaagtcacaatccgtaactttatatagatagtacaagcatacatattttaatttgtaatatatgaatatcaatacatttatactatcaagcatggattgtactagcaaacactcaattaacgttaaatgcatgcttggtgtattggataaactaccctacctaattaacagctataacggatcctggtctccttaatctaaatgtgaatttgcaattgcgtctgtgtgcgtgtctaattagtaaccacactaattaattacatagtagtacactaatcaagtttagaccccaatgaaaaattggaacacgaatcggagttggattgggattgcttcgacggcacgtggtcgagtaagagggcacgtgactcatggcacttctccctatgcacctgcttctttgttttcctcccctctctctgtctttcttattttcatgcacattctctctctctctctttatagactcttttttaatactacaaaacacattttgctttctcctagtatatcttcttttgcgaatacaatacgttattaaatttggagtgagccaaactaccgtggcaacgaacatatttgtttttcttttataaaaaaaaagttgttaattgtgacttgtgagtaacatttacctaaacccatgatgagttgatgacccatccacacacacaatctttttttaatcattcactaatttaagaatgagacaaataagtaataacggtcacacagaaacaaataagtaaatatatgaatgggccatggtttcaataatgggtgtatcttatggggattagatagatattgatttcctccaattcactactctgaaatatataaatatacaaacgtactttggagtcttcaccgactcgggatccttttactactacacatgtttaccaattacaatagctgtctgctattgtttttagttttataatttttctctccccccatgcaattcctctactttttctttttccactaaacttttgttttcctttctcttgctctaaattaaaaagttgattcataatttcatatttttttaaaaagatttaagatttctgcagtaaatctatttctttactaattgctttttttttccaatataaaaaattatttaaattgaaacttttacatagattaataatagtcagcaccagtttgcaactagtgtgggtttattatatatggcctcaaaagctccgggtttactcatcgaaataagcccaatccagtttctccttttagttccaaacttcctaacaaatcgtcaaactcatataaatgggctttttaattaggcctattagtgaacagaattcaggggtttaggggattatggaaggaagggattcaattaaatttgactgaatttaaaaattaacaatattatttttgaatttctttcccattaggttaaatttgaatatctattcctaccagaaaaataaaaattgaatatctattgatttttaattccatttataattcaatactgagttagttttatggtaatattatttaaaataagttaaacaaaatataaaaaaaaaatgtgaagaaccaatatcaacattttgaagcttttatttggatttaattcattaatttttatattttaaaagctttagaatagttctaaatttatagcttatacattgattaggcctagaattggtttttatattattccaagttcaacctcctttaaattagggtttaaggctataaataataagtactgtttcattccccgggttaataatcaggcgcggtatagaccaccgtaacagaaaacagaaacagaaactcctgtctctatcaaatgcaaaatttataaaataaaataaaataagtggctgggtctttagctagggtttaatagtgcgttgcagcttccgctctctttctctcctttcttttcacacagccgcaaaggctctcatcttcttcttcattcacacaatctctcttcccgacaatcacacggattgttgattcctctggatttggggtgaatg

SEQ ID NO: 1478 - DNA, 3000 bp, Unknown
  misc_feature (1)..( 3000): cDNA_ID_3062615_gDNA_ID_1620407_Annot_ID_156159 3000 nt of promoter + ATG
gctcctgtaaacattgtcttgtctccaaattacaacagaagcgttgctgctgctcctttaaacgctcatatcatgaacaagggaagcctgaacacagcatggagtttgcttcttcttcttccattaggccttttggtttagtcttgtgaattacctctagccaattcggttcgatttcggtttgtattttccggtttacttgttactttggcttgtgatttagtcttgtttcttagccaattcggttcgatttcggtttgtaagtttacttgtttctttgcattactctgtctgagtgtttaatacaatgttagttttggttaatatcctaaattcaaattggaaagaaaacattaaaggccggatcggttatacaactgtggaatttggaaacaaatgttattataagtgggcctaatgggaacttctgcccattaaaggcccattatttgaacttattagctttaagcttgtccacgatttacattagctatcttcttcgtctccgggactgagaccgctctctcttccttatcctccatcttccaatggtttaatccagcaactgtcgacgatgtcgataacgtactccgctatttcctgtaagtttcttcctcactgtgtgtcgaatccgtcctcaatgctcaattttatccatttattgtgagactgtgattgattttggtttccgttgttttatccagctagtacagtttctgggttttcaccaaaaagtgtaccttttgctattcatagcgtaaccaggaggcaatttcttaatcccaacacgttttatagatttgggttctctccttctcttcaggtcagattcctttactagtcagtatcatccaattctccagactctgcttcgttgttgttttggttcttagaattagaccacacttcgttgcttccctttgaagtagagagtcaatgtttactgttatgtgcggatatgttgtgcagggaagtagcattgagtttagccttcagttgaattcaagagttgtgcttagtaaagagcgtcgatctctgccattagttgtgagaaatgatcgtcctcagaatgaagacttacctaagcagtacacaaggcgagagaagaaacctttcccagtccctattgtggacctgagacgagctgcgagggagagagtcaagaacaacaaagacaaacctaagagacctctacctccgcctaaaaatggtatggttgtgaagagccttgtgcctcttgcttataaagtatacaatgcaagaatcagattgatcaacaatctccaccggcttatgaaagttgttcgtgttaatgcttgtgggtaaaaattctcttcttcttcttgtttcatttttggtctgttttgagtatggcctttttttgatgttgtatgattggtctcttaggtggtgcaatgagattcatgttggaccttatgggcatccatttaagtcgtgtaaaggtcccaatacttcccaaaggaaaggtcttcatgaatggactaactcggttattgaggacgttattgttcctcttgaagcctatcacctttttgaccgccttggcaagcgtatccgtcatgatgaaagattctcgattccccgagttcctgctgtagttgagctctgcattcagggcggcgttgaaatacccgaatttccagcaaaaaggagaagaaaaccgattatccgcattggcaaaagcgagtttgttgatgcagatgaaactgaattgcctgatccagagcctcagcctcctccagtgccattgttaactgagttacctgtctcagagatcactcccccatctagcgaagaagaaacagtctccttagccgaagaaacattacaggcctgggaagaaatgagagcaggagccaaaaagctgatgaggatgtacagggttagggtctgtgggtactgtccagaggttcacgtaggtccaacgggacacaaggcccagaactgtggtgcattcaagcaccaacagcggaatggccagcatggttggcaatctgcagtacttgacgacttgataccgccaagatatgtttggcatgttcctgatgtgaatgggccaccgatgcagcgagagctacgaagcttctacgggcaagcacctgctgttgtggagatatgtgctcaggctggcgctgttgtacctgagcattatagagctacaatgagactggaggttggaattccttcgagtgtgaaagaagctgagatggttgtttgatatgtagaagaccttgtaaacttcttcttgtacaaaatcctccattccaccttgtgttgtataataatatcacagcccaggtctttttgacttttgaaggacaaaaaaaacaatccacgctaatcctattatcaagggtaaaaatgtcatttgcttcgttttcatcttttctcgttgccattttcttttttttgtctgtgtcaagtcgataccacttgtctggtagctttatacccactttcatctttttcatgttcgtagttgttcctctggttatcctcatcaacgggacccttgaaaccgtgtagccatgtaagcctttgtctttgtctctttctcttgcttcagcaagttcacgtctgctctatttctaattttgttctaagattcaattctccttttttctatgcgagaaatttaagattggttctctagctctacctctttaaatttgttactatgtgtcggtgtccatcattcatcaaattttttccttttttatccatttgagttgatgtaatgatgttgcttcgcttcatactggtcagagttagtctaatcttcattttagcacaacttgacaacttcatatggttatgacttatttttacttgggtctttcaaaggttaagtattttagtcttattttgggatgatgcagcttgcttaatgattagagtcttaaagctgtgctctttcttcatcgatttgagcaagtgatcttggaaggctcttgagttctgaattccttgtaagcaatc

SEQ ID NO: 1479 - DNA, 3000 bp, Unknown
  misc_feature (1)..( 3000): cDNA_ID_2136652_gDNA_ID_1620407_Annot_ID_156158 3000 nt of promoter + ATG
ctcctgcaccgaaacgctatcttcgtcatcgatgcgtctgtcacgttaggactgcttctaatggcaagaacctgtagattcgggcatctattgatatgtccaaaatcagactcgtagccatagaaaattccaaaatagaggatatcacaaactcaatcacgatcttgataagaaagatatttacctatcggctgcgtaagagagagcgtggtcgctgcaatggcggacgcggatcttagtgagaccaccttcgctccaatcaacgactgatcgtagcattaagtctaccttctgctcgaactcaggggaccacaagtgagtcgactcgggataggaatcgaaccatggctccagatcgaagatagaccagagatacggatctctgcaaacagttagccacgatttttggacgaacatcggaccggtccatagctcctgaatcgtaagccttgaaatgatgttgatgagtatctctggagccaatccgccccaatcagacccgtcttcttccataaagattcttgttttgttttcaaagatcggttctttgtgttcggtaataatgtagtttaaagttacacgaaacgtgtctctttagacacgtgtcaatgcatctgaccgttaattttgttccttgacttttggatcacttccataaatgtcgtttgctgacacatgtttcggtatagaaatgtcacgtttgcaataagccaccattggataaggtttttaagttttcaagtcacaattggatatgttgttcaatcaagataagtaaataagcaagctaactttgatgtgaagctatgttacaacaagatctatgaggaggaacaaaaggttccgtcttcttattttagactctgagagctgcgacaggatcttgccatgaaattttcctcttatttgatccgtttccgccattcctgcaagaagatggcttcacatctttctgctgcatctcaatgctactgatcattaatctcttacatgaattactttcttcaactctcgtgttctcttgattattgtccactgcctctgtttcttgctcttcttctccctatataaatcaatttatgagtaaagacatgtttggtttctaagtctcttcacaatctgattaagagtgaaaaatgtgcttacagatatctgatttagatcaaacaaaggaactcttctcttaggactggttttggtttcatcgtgagccttttccgagtggtttaagtcaggaagcgaaacatgcttagtttccgcctcacttttgttactaggagacacttccactcggatcttcttcccaccatttgatcttctgacctttttaatctcttgtggctggtcttgtctcaaatgtctgtatctccgtcgcagaaatctgttaaagaggttataaacgaacgatatattaacaagtgaggaaaacatcaaaggaaaggactaatgatatattttgtcaaggattgaaactgtctttacctgacttcagccattagtgttgcctttctttctcgcactgcctgtaacctttttctcatagcttcggtttcctagtgtatataatcaaccaacacacgttaacaaaagctcataaccaaatgatctcaaagatcagagtatcgagctgataatatgtacacaacaaggttttaaatcctaaaactatgtttaagagttaagactaatagagatttgcataactaactacacatagaaatcttaataagtaattaactttgttaaggaagcagaagcaattaaacttaaaagtttcttctttctattattttaaagaagaaagttgttcctttttccgggttttccgagtagctctgagcccagatcaatctttgagcaaataaaattacattctcagatccagagacaactaaaaccagacccagaaactgaaacttgatctaaaactcaagaaaagagagttcgtaccatatgcaattctccatagtcttgcataaggctatgatgcctaaacctgacctttggatcctcgaaatgattagagttcaagggagtgaaatctccgtgagttggattcatcagatgagtaaattacagaatcacacaaggagagaaagagagagatgaagagcaaaagatgaaaacagaggaaagagagaaatgagaaagaggaaggttctgggtttcgtgtagaagtctaatatcaatgtgaggagaagtcagagaaggacaaagaagcagaaaagaaggacacatcatgttgttgctgttgttgttgttgttgttgttgttgttgtgagaaggaaagaaaagaaaaaagaaaacaaaaattaaaataaaaggcaaaatttgcttttttggatgtgagtgtgttgggttgagacagcagtgatgaagatggaagcagacttatgcaggaaatgggtaatgacttgtggcactaagtaaattgtgtaatgggtcaaagaaaacacataaaagcaacttccttttttaataacattttatcaactagacaactttttttatattaatgggttagtttggttagagaaatcttgaagaaaccaaacctttctgttttgtttcttgtgttccattgtcgtctgtaaatattaagtttatcttcattcaactgggtccattgtatagagaccgatgagaatggaggttgaaatatatttttcagactttttaatataatccctcaagaaaagtcagatggtggaagagaaaaaaaaagattcgccttttagttattacttaaaaaaatacggattttgcagaaaactctgtcttgatttctggaaactggtgcaaggttttagttttcttctatataaaaaaaaaatcttcttattacgtcaattgttaaaagattgccatctcttcacatgcattccatttactctgttaccccaaaaaaaaataaagtttaaggcaatgactttttgcgttcacatcgatgattctagtgtgtttaatgcatcagttagtcagtgaccatcagctgatgca

SEQ ID NO: 1480 - DNA, 3000 bp, Unknown
  misc_feature (1)..( 3000): cDNA_ID_3062623_gDNA_ID_1620407_Annot_ID_156152 3000 nt of promoter + ATG
aggacaaacaaactgcttgcattactcgtattgacatataaacctatgaagttcaattatgtatgttgcagacacctatcaaaatccaacatgagctcagtagttattacaaacacaaagcattaaaactcgcaaatcagaaagatattagccaattcagacatttgagagaatcaaatcagcaatataccaaagattataattccaaacaaaaaggctgctgattgcgacaaacccgtaaaaaaggataaatttttagctcaagctaagacaagagagataaaacaaattctaaatcagaggaagaagagggagttagatccaaatttagagaggggacccagaaatgagggtaccttgaagggaaaagaggaagcaggagcaccaccatgaggacgaaggagaggtagatccgaagatgaaagagagccaaaagagagagacgaagaagaagaagaggaaccaaatagtctgtttcctcgaccgccaccaggtctcaagctcagaaccgtttgatcgccttgctgcatacctcgatctaatccgccttaagatcgaatcgaatctcacaacaaaaatcgaagagaaaggtagaagctttatcagcgacgatgaatcgctgactccgataatccaaggagaggagggatcggatttctgggtctctctctctcctgccgttagcgaagaagagaagagaagagaaaagttgagattgagaaatgagaagaagaagaagaagtcgagaaggagacacaatcccttctctttattagggtttttttcctctctttttcccgaaccagacacacttatagccttaacgtttttttccgttaagattacagttatgtcctttcattttgtttttttgtctctttattttgtcaccctcattgggttttccgtcaatgaacaatgtcaaatggtaataatggagcttcctcggctcgtgttagctgcacctctagctcattgtaaacatattaagagactgtaaaaactactaatctggcaagttgcaatcaaacttccacatctcaatatctttacttacaacaattgtctgtaacaaactaaagaggcgttaacacaagcagagacgcaaaagaaacaacttctggcgtttatagactcctccttgtgttttgaatcaataccttctcctgaagtttccttgatacagtaagcaactcttcatgaaagtgagaagtcggtgggctgtgcaatgttgacatcctcaaactcgttatcatctgcacatggaaaaaagagatgcaatgcaatcattatgccgttcatagctgtatagattcagaatgcaatacagcatcctcaacagttgtgtaatcgaaacaaggctaaaagaataataagattaggaatcacattcagctatatcacggtcacaaaagttaggcaagactcttaaacataccaaaagattatccagtgataacaaaataactaagattcacaataacaggctcaattgaagtcaatggagtttgaagggttcatataccaaataacatatagaaagatgaagtgtgataagtaattaaccaagatgcatgatccattacgacatttcaacaaggaattgaaaatttcagaataagaggatctaaggtataacctttcttcaaagtcaaagccacaactgcatcattctcaacctgaacaaccaaaaaagaagatggtgacaagcttataactttcaaatacacgcaaacggaggcagtggctatgtgaccaagttcttcttttaaacttgagcaatgactcaaaagataaatatattagatagtcaaacgtgtgataccttctgatctgctaaggatttcgaatcctctaatacttcttcggtagacattaagaccagacgctgattgttaactggttgctcaatgagagcaaacagtttttgcttaacatccaaaacagtctctgttggatcacattggataaagtaagtagttttcatgcgcttcacacgaatatacatagcctgcaaacaatattacacaagactaatcaatactacaaccaatatggccaaaatctaacttgttcgattgattaaagcaaaattattgcaagacaaaagtatctcaacttttattactccaagaagaacagtaataaatgtgatcaggaagctggaattaagaagggaaaagatgttctcattccaaaaacatctctacttcccgtcaaataagcaaaggattgaatatactaagaacaatcaaacccatcaaagtgaacaaaagaagtagaatgtttaccatggcaagataaggatgaacaattcactcttcttccgctgccgattcacaagactttagaatcaaaatctgttctaagatgccaataaaagattaatcagactatcagtgacaattgacacacctcaaagagtcaatttaactaaagagatgatctagttatcccccaaatcttttcttcttttgatattcaaaagaaaagaaaaaaaagcaaagattttcaaaaattactgactcaaataacaaacaatgaaatcgacttacctagatgggttaaggacgaaaaagtgaccacaagaatggattaaggatgaaatactggcaaagaaatcaaagttggcttttttataactcgagctcagagccctacaaggtaaggaaggaagaagaaaaataccactttggtggcttgtttggctacagatataatactaacatcgattaggcgtcgtacaaaacccactaaaagacagagagggtttgttttgttttaggcttttatttttgattgattgaatattaaaatacaatgcgaaaagtcatattgggcttatgggccgaataactttattttatttttgtggtgaagttaggcccaaatattttttcgtcttcttccagttcacgactgagataataataatgcaaagcaagttgctatttccgaatgatctctctctctctattcttttgagtcccaaaccccatg

SEQ ID NO: 1481 - DNA, 3000 bp, Unknown
  misc_feature (1)..( 3000): cDNA_ID_2136607_gDNA_ID_1620407_Annot_ID_156146 3000 nt of promoter + ATG
acacacaagaagacgaaacgtctgtaatcaaaagacaaacaaacaaaaaaaacaaagcaaagtcaagctttgtttgacttgtaggcataagccaaaaggcgctattttgaaacttgtgaacgaagaaattaggtttggcgaagcaagtacgaagaaattaggttgagtaaaaagtaaaattagggtttaaccaggaattagaaagaaaaaaaaaaactcaaaacaatggaggatcgtacgaaattcgaaaaacaatagtctaccgtagaagaatctcagttaaagcttagtcattcataaggaatcgaaaccggaaaaaagcagaaacaaaagagagagatcgacgaacctgtgtgtatcgactcgcactgtcaagagggagattttagattttcatgtgtttgctaggaagtgtttgctttgaatatatttatataagcgataatcatgaactctcgtagctcagagattaaataaggaattaccggcttataattaatcaaaaagagggtttagagtacttgtaaatatatttgatgatgattaggatttagatggccatgtcatcgaatctacaaagttacattacttttatttttatagaaggaagtaaatttaattcgagtattttttttcccttttttctatgccaaaccaattaacatttaaatattatttatgtaccattaacttgttattcacatttaaatttggaaattccatccaacattagtctagtttatgcattctggtattataagttccaaacaaaataagcgaatgttttcatattataatttgattggcctttcttagacatcccaataaaacacttacactagagaggaaataataaggccaaaacatacacacgcaagcaagaaattaactttgaaaccatgtattattacggacttgattgcctcttcatcaagattgaaggcttggttcaaagaggacctggaaaagttccactctccctctgctcgttccacttgtcaacctgcgatgtaagatacgcggcagaaattgtcagatggatcaaactataccagtgtgatttgtgtgtaccactctttgatataataatctaaggtccaaacaaaaggaaccaacccattctccaggacagagggcacggtaatacttggcaaacctttcacagtcattagactcctctccctttgcagttgtacacctgcagaatcatctttgatgtcaacaagagattaaaataatgattttctcaaggatgagctagcaatgaggtacctgtgaaactcgatgtaccgagtgaagcagtgcctagtttgatttgttgtaggaaaccggaaatcagcaggagcagttttcaattcaatctaatgcaaatacaaacacaagtgtgaaagaaactgtataaggttttgtaaacttaaatcactttgtttctttcctcaatcaatgaaccaataaccaaacatagaaatctccaaaatacttgttgcctctagaaatctcaattttccaaacatttcaacaattctacggaatcaagaagatactatcatccaaatccgaagaatcaaccccaccaatacggcttaaagtttattcctttatcccagaattgtctcgacaagtttcatcagatgataaagataccgccacagacatcataaaaatcaaaactttatcaaccaattcctctatgatacatagaaaccaataagcaatcgaaattactgtagcacacagtttcaagaagatcaaattcattaacgttttctgatttactctaggtatacgtagttgtgagataaataaaggaacgagaaatcacctcgtcttccatggctgatctgatcaatgaattggagaaattacagaagcagagaagaaatcagcgtcgagtggggaaatcaggatatgacactcatatctctccggttcgaccgtttactacaacagaaccgaagtagcccattttattgggctttaatgggcccaaaattaagtcttttaatttgtttatgtgattttagattgaaatctgattcaccattttattttttaaaatcaatgtcaatatgtctttagtattaaatataaaattgacctacgagcatccacatcgcacaaaaaattgatagatctttagtattaaatataacaaaagttaataaaaaacagaataaagaagtaagacccgtgtctattgtgtccttggaaagacacattttacctattcgagaggcaacgtggcagcatcagcttaaattattaataaattatacttaaagacattttaaaaaaatgaccgatgtggatggtctaagaacgactggatcgattgtccgaaagtagaaacatcatttattctctaatatttttgattagaatttagaaattatttatattttgttttaatttgtttgatatgatatttgggattgaaattattcacacacaaaaaaaaaaaaaaaaaatttagacaaacatttttttattttctcaaagtaatgtgtaagaacgactggttcttttgtctaaaaacagtaacataataattactgttctcctattatttagattagattttagaaaatttaatgtattatttttagggattttatgtttgacttagttcactacatatatccattaatcttgatgtgcaatatttagtttgtgtggtttataatttctctataagggtttttacttcatttatccataaattaaacaaaacaaacaattaaaaactgtaatgaatttatactttaaacaaaacaaaaaaaaaaaacacttttggataattgatattcggacaagatctcgttgtacttaattaatgtgtacttatttatctctaacttacaaatttgactctgtaaaacccaccacacactcactcactcagacacctatatttatgatctctctgtttctatatatacatttccccatatcaactcaacacctccatagagagagagagctttctttcactttcacatg

SEQ ID NO: 1482 - DNA, 3000 bp, Unknown
  misc_feature (1)..( 3000): cDNA_ID_4254815_gDNA_ID_1620407_Annot_ID_156147 3000 nt of promoter + ATG
ttgatgttgaccgtatcgatttggtgtgggaagcagccatgaagtatggtcttagtgctgtttcttcactcacaaattgagtgaagagagagacacgtttcattgttgtcttttgactctcccaagattggtcattctttgtacaggtgaaaggagatgcaagcaggaaaaaaaagtagaatttcaccttatgtattgttttatcttttattaatgatgtattactttctttttagatttccttaatattaatatatgcacctaatttccaagaaaattcaacaaagcttttaattatccagcttgatttgcttctctgtttggcacttacacaatcagacgacaaagtgtcttcaatgttgctgtcttctatacttttaatttgattagacattattagttgagagaaatatcgaaatatcaaactaaacagtgcattaacagaaattgtaaaaagctgatcagattgttgtttgttctgctaatgaattttttaaggtaaaagtttcaatgaagatttttgaatcaaaccaattgtttatactttattacaaacacattctctacactaaaccaacaaaaatcccacaataacaaaagagacagaggaagaagagctaaacatttgctcaaagagacatctgcttgagttctaaaacaaatgcagaagaaagagattattttacctaattagaaaagactccataatgtgactaacccttgaatcgttcccaaaaagtagccaagaagatcaagagatgagacatgagaagaagaatggaaatgacgatcaagaagataccgagctgccaccatttcctccttaccgatcttatgaatccgaacttacaagatctacaatcatagcataaaatgctccaatcgttcctccatagttgacagtcgctaatccttcccaccatcatctcatcaccgtacattaggttcatagacgacggtggtccttcgtcttttcttctgtaccaaaacgtcgcgtttatcgcgtccatgttacatgtctctggtggcatacaacatccattctgtaacaacatcaaatgtaaagataaaaatgtttgtaaaatcttatacaaatgttttacaaaacgtatatttgagtgatcttttcatcggtatattgttcgaatgtactaattgtacactttaaaagtcggtcttgagatcaaagaatatatatctatgatgatcaaaccttgattggtggcatttttcttctattgtaaggtttttcatttggagatccgtaaatgaggtcgttgcaagctcctttatcatagacacacgatttgatattgttccaggtcacatgatcgtccatgattttgagcttgaaccacatccttgtcgccggaaaccgccggctttgcatctcatttactccggcatacgccaaaccgatgaaaagcattaacaacaagaccaccaccatcaccacaagtgcaggcatcggaaacttccgccgcaaaaacagagctgcgttgctgacaacaaacaccgcgagaagaccgacactagctagcgtctggacacgtggcagaccgagaatatcttcgcagtcgtagctacgcatgtaaagaagccacactgcgtagccgaggagtgtaagtgagaggacgaaagtgaagatcggaaggacaccagcggctaaaatgttcacaagtgccatcaatgttcccatcggtggcttattatcactttgtgactccatttggtctgaactcttggcttctggctcagtcgttgcggttgctgtagctgtggctgtggcggttgcggctggttcctcgacgggtactacttgagcattatcagccatgtgaaagtgaaagaaagctctctctctctatggaggtgttgagttgatatggggaaatgtatatatagaaacagagagatcataaatataggtgtctgagtgagtgagtgtgtggtgggttttacagagtcaaatttgtaagttagagataaataagtacacattaattaagtacaacgagatcttgtccgaatatcaattatccaaaagtgttttttttttttgttttgtttaaagtataaattcattacagtttttaattgtttgttttgtttaatttatggataaatgaagtaaaaacccttatagagaaattataaaccacacaaactaaatattgcacatcaagattaatggatatatgtagtgaactaagtcaaacataaaatccctaaaaataatacattaaattttctaaaatctaatctaaataataggagaacagtaattattatgttactgtttttagacaaaagaaccagtcgttcttacacattactttgagaaaataaaaaaatgtttgtctaaattttttttttttttttttgtgtgtgaataatttcaatcccaaatatcatatcaaacaaattaaaacaaaatataaataatttctaaattctaatcaaaaatattagagaataaatgatgtttctactttcggacaatcgatccagtcgttcttagaccatccacatcggtcatttttttaaaatgtctttaagtataatttattaataatttaagctgatgctgccacgttgcctctcgaataggtaaaatgtgtctttccaaggacacaatagacacgggtcttacttctttattctgttttttattaacttttgttatatttaatactaaagatctatcaattttttgtgcgatgtggatgctcgtaggtcaattttatatttaatactaaagacatattgacattgattttaaaaaataaaatggtgaatcagatttcaatctaaaatcacataaacaaattaaaagacttaattttgggcccattaaagcccaataaaatgggctacttcggttctgttgtagtaaacggtcgaaccggagagatatgagtgtcatatcctgatttccccactcgacgctgatttcttctctgcttctgtaatttctccaattcattgatcagatcagcc

SEQ ID NO: 1483 - DNA, 3000 bp, Unknown
  misc_feature (1)..( 3000): cDNA_ID_3062627_gDNA_ID_1620407_Annot_ID_156151 3000 nt of promoter + ATG
actccaagaagaacagtaataaatgtgatcaggaagctggaattaagaagggaaaagatgttctcattccaaaaacatctctacttcccgtcaaataagcaaaggattgaatatactaagaacaatcaaacccatcaaagtgaacaaaagaagtagaatgtttaccatggcaagataaggatgaacaattcactcttcttccgctgccgattcacaagactttagaatcaaaatctgttctaagatgccaataaaagattaatcagactatcagtgacaattgacacacctcaaagagtcaatttaactaaagagatgatctagttatcccccaaatcttttcttcttttgatattcaaaagaaaagaaaaaaaagcaaagattttcaaaaattactgactcaaataacaaacaatgaaatcgacttacctagatgggttaaggacgaaaaagtgaccacaagaatggattaaggatgaaatactggcaaagaaatcaaagttggcttttttataactcgagctcagagccctacaaggtaaggaaggaagaagaaaaataccactttggtggcttgtttggctacagatataatactaacatcgattaggcgtcgtacaaaacccactaaaagacagagagggtttgttttgttttaggcttttatttttgattgattgaatattaaaatacaatgcgaaaagtcatattgggcttatgggccgaataactttattttatttttgtggtgaagttaggcccaaatattttttcgtcttcttccagttcacgactgagataataataatgcaaagcaagttgctatttccgaatgatctctctctctctattcttttgagtcccaaaccccatggcaggtttgtcgctggagtttacagttaacacttggaatctcaggtctctctctcaagttccatgtcctttaagacatggctttcgattcccgcgtcggttgacacgaagaagaacgattctcatgtgttctggttcgacatttctaccttgtgttctctcttttctgatttttcttctggattgtgattggtgatgcatttattataatctttttagggtaatgtacacttattaccctaaaaaagagatcaatttgttgatcgttaaattccataagtgttctggaattgatgacaaaaatctgcattcgtttctccacagattcaagctctcagtcgtggaatgttcctgttttatctagctatgaggtaattatggtttctcttttatgtctgtacttatcaatcatatctttaactcttgaaactgttcacaatttgttagctagagatgtttattgacacaaccaccagacatttctgtgttttgtcaatgaaattatagatgcagcccgtaatgaaggattgcgacatttgtttgttatccgtttatgtttagaggcgttgattgattgagtatcagtgaagtatgtttggtttaaaaggttggtgagaggctaaaactagcaagaggaggacaacagttcttggccatgtactcaagtgttgttgatggaattacaaccgatccagcagcgatggttcttccattggatgatcacatggttcaccgtggtcatggagtctttgacactgccctgatcatcaatgggttagtcactttaaatagtagcccccttttctaatttgtcttattactcaatcatctgagcttcgcttgttgtcctacgaataagcagatacctttatgaattggatcagcaccttgaccgtatcttgcgatctgcatcaatggctaagatcccacttccattcgatcgagaaactattaaaagaattctcattcaaaccgtgagcgtttctggatgtagagatggatctctaagatactggctctctgcagggccaggggatttcctcctatctccatctcaatgtctcaaaccaactctctatgccattgttataaaaacgaacttcgccattaacccaataggtgtcaaggtagtgacctcgtccatccccataaagcctccagagtttgccacggtgaaaagtgttaactacctccctaacgtactctcacaaatggaagctgaggccaaaggagcttatgcaggtatttgggtgtgtaaagatgggtttattgcagaaggcccgaacatgaatgtggcgtttgttgttaatggtggtaaggagcttgtgatgccgcggtttgataacgttttgagcggatgtacagcaaagagaacacttacactcgctgaacagcttgtaagcaaggggattcttaaaactgtgaaagtaatggatgtgacagtcgaagatggaaagaaagcagatgagatgatgcttattggtagtggaattccgatcagacctgtgattcaatgggatgaagaatttattggtgaaggtaagtaagattatcatataaacattttaaaagcctcacttttaattacttacatgatggatagattggctgattaaagatgggtttctttctgtctgactcaggaaaagaaggtcctatagcaaaggcgcttcttgatctgttacttgaagatatgagatctggtccaccttccgttcgtgttcttgttccttactgagccaatcactctctttgttcatcaaagacaataagctgtggcttttttgtaaagctttgctgttattgtaagttgagtttatcatggggtttttaggtatctgtctttgtaaagatttctctttatcacttttgaattatgattgtacccattctcaacaattcatggagtggttgcgtctagtgctcaaatttcttgtttttcatctcttatttcttttgaggtggtagcatttttatattgtcgacaaaaaaaaagagcctttttatattctttttcttctttatcagtctccactttccggtaaactgatcagcagatcaggtcatgctaatcaagtcgtgttctgtctttaaagccattgccttttagtgatcgtggatcaaatg

SEQ ID NO: 1484 - DNA, 3000 bp, Unknown
  misc_feature (1)..( 3000): cDNA_ID_2136622_gDNA_ID_1620407_Annot_ID_156150 3000 nt of promoter + ATG
tacaacgaaatccaacaacttctacagatgattactaagaagacgcctcaagatccgagtaaagtgtcgtcacatattcgcgacggtatcaattctgatcccaaaacttggaaactttgtttgatttcctccttctcttatctcaaagtttttgtattttgcagatcttgacatggtgtttgtgttggaggaagttggacactcgtgcgacttgtgccagagagatcttgctaaggatccagaacggcctaatgcttccttgagtggcttacaagaggcgtgcgtgctgtcttgtggtcatgtctaccacttcaagtgtttgagaggaaccactcttgatattgataaccattctaaagatccttcttgcattttctgcattagctgttagctactccaactgaatcaacctacactatatcatcccatgtggattcaactttaggtacttctaccattcaatgtctactagatctacgagagatttaacagttttgtcttaacaatgccaatggagttacttacaaataccagagatttactctgaaatcaatcaattttctttttacatccctgaaaagtttaagtaactttacatatggaaaactagaaccacgccgcatggtagcttctaaagccagaagtgaatcattgcctgttcaagaaacaaaaaacatgtttatagttccaaatatcattcaggtatcccttactaagtagcaagaacattcattacctcttgaattgagttaaggactagatcctcttcgggattggacacaggtttagattgatgatgcagttctgatcttaagcttctcatctctgactgcattacattgagctgttctcgaatctcctttagcaaactcaaatgttctcccttgatgctcgtatctcttggcggcttactcacttttctatcgtaattactagtcaccatcttgcctctaacctgtgagattttttccatctattagtaacctgatcaaatgtcttaaacaaaagatttagttcactaaaaataatgacttacatttctttcttcggcttcctcttcttccgagatgattgtaagactttctttcgtcctaggaacctcgaagatgtcttgaacattcttcggagacagaatcggagtctctaaagaagcatcttttacagagaatctttcagggttcttcatcatctccataatcgaactaacatcactcttagctgactcaagtatagtattgctaacttgtgacaccaacgcatgtgaaattgactcacgcctaatcaaagggaatttagatgccttctgagtatctctagagtctgaaatctctctaacatgctcatctattctcctaatctgttcccaatacgcattcaagtcttcacgaggagatacagaactactctctacaagacctttcttctcctcaaagctttcaccattaacatcagacaaaagtaaacttctttcactagatatgccatcaaatggactctgcaacagaaaagacttatgctttaatctaacaatgtcttcaaaaccatgaaagtagaaagctttatatagccatggccatggaatcagttttttcagttataacaatattgaaaagctttaaattaccgaaagatttctcttcatcttcctcttttgattgccacgagagttttcaccggaaaagatgagagtttcagggaacttattctcaatcacagcaggatcagagcaaccaaggctgagtaatttacatctataagcctgaacctgaaactcaagagacgcaatctccatttccttctgataaatcagatcttcgaaaagcacaagagatgtctcagcatgacacattttctcctccgccattctcttgtactgactagcttccatctccaacgcagctttctcaccttgaagccgtagaatcatcgataaagcctcgcttgcagcagatgaagaagcttcacgttctgcgtcaagttcttgattgatcttttgaagaagctcttgttgtgcccacatcgtttctctgactcctgaggtttctccatttcctcctacccccaaactcatcgttctctccaccattttagatcaaaaatttcttgcttttggttgatctttgatcaatgtgtgatttgttctatgattagaagcaggagaagagagatcagatcgaggatggtttttgattgatgcggcggagggaagcggagaatttaggttgatctccgattaaatgtccaccggagaaatcagatcgacaaggaaagccttaaaagcgaccagatattctcggaagtcccaatcaatagtgggacatattaacgtgtatacgaccactttttgaattgggtaaattaaactatactttataaattataatcatatttgggttaattaaactatacctaattatataatccagccgacacatcgtatttaaagtacgattattttgtttacgttttaaatgatttttattatgtaaataattgtttaaagaattagactgaaaatttggcgggatgagccagacccttgcaatagtgcaacgcatgggagactcgggaaagcccagatagcaagctacctagatgggctttcccccttaaaaaattgagttaatatcgtgtgggccgatggcccacatatcagatattaaactgataagaacagatactacacttgatcttagccaaaaggccgagaaaggtatgagttgcttaatctagtggcctctttatttataatactacttatttctcacatctaaatatactaaatcagcagtcacttttccaataactgatgcatttagtgattgacacatcagcttattactatttttttattctttcattttcacgcaggatttttatgtgtcgtttttagttaactttgtttctttctcaaacgattttctctttcatccccacgatctccacatctccactttctctcttccaaaaactccatgactactgtgtaaaatctcaaag

SEQ ID NO: 1485 - DNA, 3000 bp, Unknown
  misc_feature (1)..( 3000): cDNA_ID_3062633_gDNA_ID_1620407_Annot_ID_156145 3000 nt of promoter + ATG
attttaagaaattaaatctttttttttggtatctgtgtgttactttttataaatgtattttgaaaagtattatttcaatttatagataaatataattatgactctcaagtggatttttttttcacggtcaattggagtttggctgtgaatcttgtgaataatatcaactaattaagagtcggccgatactccgtatctttgatcactttcacccatatcttgaaatttaccaaatgttttctttcattggggtttctataccttttttttttggttctttctgtaatttgggttttaaagaaaaaacctataattacaaaaaaggttaaaagttaaaactaagcacgttcaaatatgttctttcgagatcccaccttcctgtctatcttataagaagtcgaacacgtgtgctcgttgtgtgaattagagtggttatttcaacatatataattaaactatgtatgtatcataaatacactgaatatgttggagttgggtcttgtggtaggctaacttgttcgcttcactttggtttagtttagccttgtaatcggtggtttcatatactgaaatttttaattttctaatataatccagatgacaaaaaaaaatcataaatacactgcaatggccatttttaaaaaaactttaaacgaaatatatatacatcaccaagtatcaagtaagtaatttggttgttttgatttttcaaaaaaacatttaggtgattcttttaacaaccaatcatatatgtagcaaagattaattatgtcaatcttttaacgtcacttatatagtttagctgtagtattattgtaagccaattgtacggacttcgtaaccgtttcgacaaagatacaaactaatcaatgtttaagatggcataatattccgacttcccctgccactcggtagtactgctgcgccatcctacaagaagcactcgtaaatgagtggttagacggccaaaaattagcaggattcaatccttgattaagagatggttcagataagccctctaggcctctactcgtcacaattcatatattaattgatcacactgcatgaaatgataagatcaagtcaattacctcaaaattaattgaaagataaaatgataaagcaacaagtaatgatcatatatggatgtaacaaccttcttcatccatacgaatatgataattcttttgtcgatcatttgccacatctatttaactaagtattttgtacattaagatcattttgcgagtattcccgcgttcccaacaaaaacgaattgaaaaactacatagggtgaattttgctctcgtggcattaaagagagaggctgacattatagattatgatatatttattatttttcttagtagatttcttgaccagcctttagatatgcttgctctgtcatggcataaagccttaaaccctaaagccctttacatttgtacagtaccaacaattgtacccaatgttaaatgaatgcggattaatttgtgatatgagaccatcaaaataaaatacttataagatagtagatatatagaaccgtaacaaaaagatgagaagaaaaagacaaattgaatagaaactggaccaaaagataaaagagtatatgaagaagcaagccaccaagaagtgtaaccatcgttgcttcaactgtaaaccgcacattaaatgtgtgtgagagaaagagagatagactccagctgtgagagctacgtccattgcatcaattgggttatatgtcgttaacaattttttaaaaatacataaataaatcaataaaatatttagaaaaaatcaatattataatgatattttgaagaagttaggtccataatggaaatatagagacttagtgtctatttatcaagaaatagtgtctatttatcaagaaataatgtctatttggtccacaattatcatattttttgtggccactcaaactacgaaaataatgaatattgttaatttttgtcttatttaagtctataactaacttactaattcggttgaaattgctaatatgcattttccttggtccactattacagtgctactgctgtcttattcttgaacacaaaataaaaaagatttcaaacacaaaatatgcatttttttgttccaccattacaaacctttatttggagaagtatacagttggatattaaatattttaattaaaaaattgaaaatattgaagttctttttctccagtattttggctggagcaaaactaaataaattccaaattaaaagctcgaacggaaaacatttactatgcaccaaaataaatgttgatatgaaatttgcatcagcatatacagtatgtatgtagtacaattgaacagagtcaaaattaattgtcactgaaacagtcagattttatttctgttaaaaaatattttcagacaaaaaatgattttttaacgtttttttatataattttattaaacctcaaaacattcctcagcagattgttttataatgttattattattttttcttaaataattttatttgaatttcgttatagagagataaataaaagatttttggggtctagttggctctcatagtttgaatgcttatataaggaaacagagctcgaggctctcaataatgccacataaaacacaacaccaaagcctttataactctttctggggtttttaattctctcaacgaacaaaaaaaaaaactcaactaatattctccatcctctttcttcagatttaagagaaaccttatcgttatattctctcttctcttttctttttgactcccacaagaagaaagcaaatttctttttctcaggattgcttgaaaactgtagaaatctttaaggtttttttacaccaataagagtcagagagagagagagagagagaaagagagatctattcataaaaaagacaggtaatctcaactccgaggagataactgatataacaatttgagagaataagaagaagaagaagaagaagaccaagctaaaga

SEQ ID NO: 1486 - DNA, 3000 bp, Unknown
  misc_feature (1)..( 3000): cDNA_ID_2137800_gDNA_ID_1620408_Annot_ID_156185 3000 nt of promoter + ATG
gcattcaatattcatacatgcaaatccaacttaaccacaactaatttcataaaagaaaaaagaaaaaaaagtatatgttttcttctgttacttgttcgtcttgttaacttctaacctacaaatgtagctgctatctgtaaccagcacagttattttccttgattattttatcgtcttcaatttaataatttcggatcgaacttctaactacgactaaaggggatggatctgcgtccaagttggccatacgtgtatatattatacatagaataattcacagacctcatgatttttattttcattttggttataagtttaatatatagatgctatctgtaaccagcacagttaaaaagctcttcttaattaccatattaaacttatatttctgatatagctaggacgcattttcctaatagataattgctttttaaaagaatgtctttttgtaaagagtgtacagaaaagaaggtactaggtaggcggttttgtacatatgacattgacgaatcttttttttctaatgaaaatttattcttaacaatatttatttgatatcaacttgaaaataaatttataagcctttgtgaattctcacagcatatcacgaccacttgaaatttgttttttcttacattttttatatatatgatctcgcataagagagagaacctgtaacgttgttttattcttggtcaagtgtgtattagtggttatgtaaagactaaatagggtatagtcgtatagaattcgtaattgtatatgtgaactatactaatttaataagtgttagtttatatatgtatccatcttttgtcgaggattatatgtatctagtttgtacttacatttacaaaccagaatatttacaaacagtgaaaagtaactttataataaaacatgctcaattctttatatactagaacataaatcaatatatatatatgtagaaattaactaaattaatttcttttaaatgataataatacatttggatcaaaattataacaagctttaaaaatcatttaacattacatataatttggtttaagcaaatagtactgtagcatcatcataagtaatttaacgtagaaaaatgttgtaacatcaaatagtagttcagtgttggtctcttatgctagttctagaggtctttgggctcgtaagtcgtatctacaaagacatttaacaatttgatgagaaacaccttctacttgagccttaaacattatatattgtggtcatgctatgggatacagagaacactcgtcgatgagtggttaatagccttgaagacatcaaattcatcctttctagttgtatggtccctaaaaaatctccagatcagattaaaaataataataataataattgcatgccttagacttgatcggaatgagattgatgaaaaatttggagttctatacttcgaaggataatcacgcatttcataaaattagttgattatatgttcttcaattcaatcagagactccaactagatcgccattcgattaaggaccataatcaaatagtctctgatagagtctatgctggaattgaagtacatataatcaaccatagagatgagttggagatatacttacggagccttaggaagattgccaactctaaaaataaatataagttcctaaagtgggcatgtagtatgagaacgaagaccatatgaacatatgaggtaaaattcgggcggccatcaccaatcaatgttcaaattttcaaatgctcgagagatacgtcagtacctctcggaacaagctctcgtgttagggcagtaggtgctttagggctttgaaaagtggagtcatgggtgctaatgaatttgatatttcatccgccttacgttcacggaccacgaatgtatataccatcatatcattgtgagaaactatgccgcattatcaacgactttttggaagttgagatatatatccatcaatgaaacttattatggtttctattcaatgctacaagaattgactaattataatgccaaatacagtattgaagtcgcaaggatcatactacaaaatgtgtccataataataacgttttttttcgtaatccataataataacgtttataaattatagtgttagttgttaacatctaaccgtaaatacaaccaactttaacaaaattttttttactatatcggttaattgactcttgtataagttaatatatatccaatgaataacgccatagacttcaaaaattcaaacgtatatatttaaaatctgagaatatctcctcaagaacagtgttaacatctaatcgtagatacaaccaactctaaccaaaaaaatgacatatatcggttaattggctcttaagtaagttaatatccaatgaataacgccatagatttccataaatctgagatgatctctgcaagaacggaggtttttttttggtcaataagaagaacaagtttatgtactaaaatgttcctttagaaagaagtgaacaagttggagaccgtgcttgtaaaaccccttatacaatagtagactttctttcatttaagaaatttaaaaatgattccaaataaaataaaataaataataaactttgacattcatgtaaaattttacgtcgatattgtaaaacaattacatatttattagcaaatatctctcaacgtcaaaggcccggcaaacaattcctaatctccgcccgttacggtgcaacacacaaaatgataattgaattactatttttttataactatattacgttaaatgatttattaatataaaaaaacgtaatttaatgttccattaaacaactatataaaccaacttagcgaccacttaagcatttcccttactatttacgttctcttctttctcctccgacacactccaaaactcataaatctatctgatgcgaatttgactaactctttcgtaattcaggatcttactacaaatctttaactcaccaatcttcttcttattcaaagattagagagaaa

SEQ ID NO: 1487 - DNA, 3000 bp, Unknown
  misc_feature (1)..( 3000): cDNA_ID_2137827_gDNA_ID_1620408_Annot_ID_156191 3000 nt of promoter + ATG
ttgcaagactgacgtaaagcatatatttttatagcaataacgtatataatatagtttgcttatagaatttcacatgttcatcagtcgaatctcaatagaaaaccaacgtatagtttctggcccatgttatgtcgttaaattcatgttgtgatcatgattcatgcactctacaattcaaaccaagaaaagaaactgttcttcgaaattacctttgttaataattgactgatgaattcagcgtgatagatcgtcgagacgttgtttacccatctatgataagatccagcattctcgatctttttttgtattctaaacaaaacttaattaaataatttcctcactttcacctgaaataatcaattcactagtgaatatagtaattatgttttagttaatactttaaaagaaaaactttaaattaaaagtttatagtttcttaagaaaatacgtttgataaaacattaactactatgtaacttaagtaaaggacttataaatgtatgactatcatgcttttaaaacatcacaaccaaaactcaaaacgattagcaaacaaattacttattttatttttgttaaaatcttgaaatttctatagaaaatgaagacgattttcttctttataacttttatagttcttgtttcatcatgtaagtttactctcgttatatacaatagtttttagtctataatagtataataatttaatagttttattttcttttgaattatttataggtacatcaaatattatgacaaaatctatttcacaagtaaaatctcagtttttcagccctgcattgagccctaatgttgatccagcggacgaacatattggacactctcccgatgatatgaaaattatcttttgccaacaatgtgcatttcattgtattgagaaaaagaagaatataggtaattgtgaaaattctatttgtcgttgtacattggaagacattttgtaaaacattccctttttaaaataaattatttataaaattaaattcttgtaatatacaaaatttatttgctgattctatgttttcattttgcaacttattttaatccaattgttatgtatacgtacatttgcatgaaatgtttatgttaggttatagaatctaaataaataaattcgctaaactaaaacttataatgatatacaatatctaaaaatagacataatagagaaagtgagagagtataaaggcaaaaccagttagggttattttcgaaatctaaagttcttccttggtttccatgtaataaaaccaagatgctaaaatatgctattgaaaaatggatttataataggaatcgttgtaaagtttttggtccaaatcactagaacttccggttttaaggatgtctctgacggtaatttttcttaaaaaatctctttaattatttgatgaaaatttgaattttcatggaacatcaaaaggtgatattttttgttcggagaaaaaacgaaaaaaagaagaaaaataagcgacccaaaggtttgtaattttaagtatttggtacagattcggactattcgtatacgatctctaaatatttggatagagaacatgtttattttatatgtcaacgaaaaacaagagattattagtttctaaaatatgatttagttcagtttttagggaggaggctagggcgggtttgtgcactatgaattggaagtgaaaatgatatctctgttgttaagcgaattctacacacagataaatttgtaacaaaagcaaaagacgaatcaaacagagtcattatcgggccaagcctaatttaagaaaatagtcccaaaaagcccatttactctaagagaatgtcgagaaataagtatacgaatgacacgtgtccttcttctttctcgtcgtctataaataccaatttaccattctctcgccaaagtttctcttttcttcgctggggtttagagagagaaactaaatagagagagagagtttcttcttcccacatcaagagccaacccatcaaaacttaacccgtaaaatttcatttttttcgaaaataaaaccttcacagaagaacatttacatatatatacacaaagagaaaggtatatatatccacatacatatgccaacacatatagattagaagagagatgggcgagagagagagaaagagattggtatttctcactgtgagatctttgaaatcgcaagtttttgatttcacgttaaaccaaagctgattttatatcaacatcgtttgatttcattactaaaagttttgatttttgagtgaattttgttccaaagttttgaaattggatccgcccagatactataaagcttgattcttttgggttctctgatactttctgtttggtttacttcaaacccacatggagagaatttgtgcatagcttccactttacgttccttttgagaagttagatgatttcacttaacattttgttttcaatttggttttctagggttttgattggatcgtctttggaatcgaccctaattgtggttttgtatactagtaaaagctcaaacgtttggagtgtgaggattgattgatgcgcgagtcagtatttatccccaatttcccaattgggtttctgccactgagttgattgattaagctaataaggtgcttttgagatgctcataactttgaaccttgttaatgtgagttgtggaaagtggttctgatctcgatttctggtgatttggtttggcaggcttatataaatctccaatcttggggtatcactctttattcaaccaaagttgacccttatcagagggttcagaattgtggacttggaatttgatttcttggaggtgattattgcgggtcggaaagtatattattgcgggtcggaaagtaaattttgagctggaatggtaaactggatcatagatactgatctggtcaagtgttgggataaaggagccaaaaagtagggagtgtgtgtggttaaagtataccactttacagttcccacggacaagtgcc

SEQ ID NO: 1488 - DNA, 3000 bp, Unknown
  misc_feature (1)..( 3000): cDNA_ID_2137839_gDNA_ID_1620408_Annot_ID_156194 3000 nt of promoter + ATG
gagaaggatctgaagatgcttgttgaccttggtctttgagtatctggcctgtagaaggatctgaaggcgcttgatgttcttggtctttaggtatcttctttggagaaggtaaagagacagctggaactccaaatttatctttcgtaaccttcaactgttatgatagtcattgattatcaatagaaaactcaagaagtgatatagtaaagcctaaaataagatgtaacaagatcgagtatgaatcctctagggtgactacttaccacagaggcataggatttcttgggagcatctgcaagtccatcatcagggtcataatttttctgtgaatcatctgcaacttctttgcaagttatctcagtccttgcaacttcattagcaatctcaggtaccagaacattatccttagcattctcattatccaagggtttggacacttccttacaaacaggattcactgaaacacatgcagcttgctccgaacccttcatgcctgtaggagctaaagtgtaagaaaaggattggaatagaatttgcgttagaagaaatataagtttaacttaccattgataatagtgggtgttgtagagtttatcccagaaacaacttccccatctatggtctctggaacattatccttagcatcatcattaacaaatctgaggatgtcattcagaacaaagaaacccttttcttgcggggcaaggaaaaaagtttgggtgaatttccttctcgatctctcgtttagagtgaagtatccagtaacgaagagaaggaaacccccattgtgagactcttgagtatcataactggttatctcagccgagttgcaatctccataagtcagtctcttaagctcctcacttataccctgcacaaagaataagcatcaatgagagacacttttagcaagttacttaaactgccatccaatttccaccataccaaatgacactccagcccaaccccatgttagttactaatccttaacatcataaaaatgatatagtctcatcctcattcaaccaaacccaactaaactactaagaactacttacttgaaaagtggagaaatcacgcatgactccgtcctgtccaacacggccaactctactgatctcttgataaaaccggggcagatgctcaggcatgttacagaaaatgtagtagtactgattgacaaacgcactcccaacctatattaaccaaacccaaaaatacactttaacaacaacaaaaacagaacaaaccacacaaagaatcacaattacaactagtaaaaaggagaagaaaccccataattgaaaaaacatacagtaagtgggtcaacaacacgtttggttgcagcagtagaatccattgtatcgccaacttccagagaataaacaacacctgtaattcatagaagactgtcaaaactcagaatcaatgtaaatcacagaacaacccaagaatcatgtaaaaaacagaaaatctctaaatctcacacacaactttccaaaatcgtttccgtagaaaacgtaattcatgaactacacatagtgactcgataaacacttaacaagcaagaaaacgaactaagaggcaacaacaaaatcaacttcacaaaagcaacccaaaatcgtttcatgaaataaacacagaaacaacttcgagaaaagcacaaactagctaagaaaccaacgaaatctacttcacatttcactccgaaacagtgtagatcacatttttccggcgaaatcgtgacattaaactgacggaagagaaatagtagaagaagattcacctgaaattagtgaaattggagcttcgattgaagtctgggaccaacaatggcgggacctagggtttgatcgctagaaggaaggccaagtgtacggagaaagcgaaaaggcaacggaagaggactttgtggggactgtgaagaagatgtttatatagacggggagagagtgtgtgtgttgacgacttttttattgcctttttgactctcacgtgtcaaacatggtccgttgcacttcctcacctttcttcaacagattttattctccactaactttaatattacttaccttttattaatgagtacattagattttaacttgggttagcacataatcccaaagaattctataaggtgaattagagaataataactcctcttgaattgttttgatagcgaaaaaccggaattaaatttagacacgggataatcgatactcttctcgtgcgttttttagattgtagtcaacttatttggcttattcctttgtcatgcggtttttctcgtgcgtttttagattgtagtttacctatttggcttgtaccaaatattgaacgtgagaaacatgtagggtgttaatttgagtatgtattagtctaagtttagtttgaatttagtatgtttaaagaaaaaaagttagttttgataaaggagtatgggctcaataaaacaaatgaacatgtatattaggcaaacgaaaaatgtgtggtgttcttctgaaaattcttttatgaacacccaaacttatggttagaagaaaatcactgatcaagcgtttgaacaatacatgatacaaaaacttgtgagagaaaaatattcggtgtggctgatgatataaagctagaatttttatagccttaatcatgacgaaaaaaaccaaactcaaatttaatccttttgaaactgattatacctcgtcgaaatgatatattcggtcacttcttagctatttataagatttcaatttttatcatctatatgttctgttattcaaaaaacaacgaacatgttatatcagagttaatactttcatttgtttgcctattgggccgataatgggccgagccttaaatttaatttcagaaaaaagcaacgatatgatagatcatgagaccaccaaccaaagagatttgacagataacagaaaaatgttgaacttatgagctaaaaaagcttctcctccttaccaaagactcgacggtctaccggaaaaaatg

SEQ ID NO: 1489 - DNA, 3000 bp, Unknown
  misc_feature (1)..( 3000): cDNA_ID_3062659_gDNA_ID_1620408_Annot_ID_156198 3000 nt of promoter + ATG
tctttctttgtcatactcaacgctgattttgatataattgtcgtcacaaaaacattccaaagacttgagaagaaacaagaaccattcaatatccatacactaaaaacaaaaatgttgcaagaattcctgcaactacaatactctataaactctctcattgttaaataacaccagacaatcttaacatcagctcttggttttccccaagatttggctttggagatgttggttatcttctagcaatctatcatactctagaagcagctctgcagactgtttctgtaacgccgtaacatgtgtttcagcagtttcgagtttcttctctttctcttttgactcagtctctgctttctttagtctctctgtaatagatgacaattttacttgcaactgcttgatttccttggatgctttctcctctttctccttcagttcggttctttctttctggagctgttcaagttcttctttcgatgatccgacgttgcttctcaaattgattagctttctgaggtagtgatgcattctgtcaattataaagccgagaaaaagtacgactcctgcaatgatcattaagattttttagcttcaaatgtaatttcattatgttacacactttatatagctcaacatttttatgtgttacatatagctaagagctagatcatatgtgaatgcactgtaatcaacaaatcaagatcaataaaggaagtattttgttactgttaataaggattcaggttccaaacttatcaactaccgaagcagcttctcaaatctggtgaatactagcagaacagagccttggagacaactatagatatattcatatgtgcgatacgaaaacaccggtactgtggttctatacatcgacaccaccatccactcaattggtatacaaactcttaatcaaaacattattaacttcttacagaagtgctcactcaacttaagcttgcgaatttgcattattcagatcattcctctatgaacaacaaagcctacaagaattcagtaaaagctgtattagccctacttgagagccatgatcaacacaaagtctagccaagatttcaactcttgttcagaaaccataactaaaaactaatcaaacaacaaagtcctatggttcaactgttgttcagaagccaacagctaaagacaaatcaagacaacaatcaaataacaaagccctatggttcaatttttatcacatcaagagaaaaaaagagagaaactgacccaataaagaagcttcaagcaagtgtgttctccaaagaacctgatccataggagacattgtcccaagctttgcacctttattctggatcttgacaatgctcataagattagaaaagagaataacagacatagttccagcgattgttttcacagtggcaggacctttacccatcttcatctggtcaagacttttaatcacaagctctctcaaaggaccaatctttatcaacagtaagaatgcaatcgcaccttccacaaatagaactagaaacagtaactgaatcatgtctgaatgagttctccccctaaagtttgttcctttaccacaattcaccaataaggtaaactctaaaccctaatttctatagctcttgtcttctagttttgctacttgggtatggatttaaaaccaaaacccagatcggagaatgaagagaaagcaagcaacgagtttatctaaaactcattagctttttcaagaaatcggtcactgagttcttgataccaccaagaaatcataaaatggagaagactaagagaagaattgaattcaagaaactgaagaaggttttagtaggagagaggaaacactgaagagtgaagaaggatctgagaaaagttcagtagaaagcataaaggtataaatgttgtttagtactaatctagcgagagagagggagatcaatggttgtgattagtggtgtactaattaattatgtaaacttaaaatttaagagtgaactctatactctactctaaagtctaaaactactcatgcctttgtaaaagcaacaataaatttgtccttttgctttacttttaagagagatgacgaagcaatggtaaagttgcatctgtttttttttttccattgaattgtggatttttttggttagtatatcaaatttattcaatatacaaaaggttatttacaagaaaagagaccaaaaaacattggaaagaatttaaggagccgagttagagacttgatccatcgtgggaggagtgcaagctgtcatggtaacaaagggaagtcaccctcaagttctgttacaattgggatggccttaggtaatttctgtcattcactttctttcccatacctttacgaaaccaaaaacattactccgccttgttctataaagtttctctactcacatagttgagaataagtttaacttgtagcttaataaattcttcataaattctttcattttttcataaaagaattttaggcataccatctctaactttattatctatctcaaatagctatatgtcaattactcaattatttgatactagttaacaaaagttatacatggtatgtcacaaatattggtcaacttaacttctttttttatttgtctaatttcgaaattaaccttctcaaatagtagttttttttgtggtcaacaaactcaattaggttattggaccaattaactataatttttatgtgatcggataatacctagtatgcaattattttattttgattaataaaacaagcatgaagcgcgtcgttcgttggaactattcgttaatcattaaggtgcaaagaagaccaactagcaccgtagaatgagtcgtcgttggtttacgcaatcacaagaaagacaagtcaatgacaatgaattgtcaacgccttcgtgtttacacgtctcttacctctctctctatctttcaataatctctctttgtttcagactccttgaagcaattcttcattctggctgcttgacattcagaaatatg

SEQ ID NO: 1490 - DNA, 3000 bp, Unknown
  misc_feature (1)..( 3000): cDNA_ID_2137861_gDNA_ID_1620408_Annot_ID_156199 3000 nt of promoter + ATG
gaagttgcataatgttttagcaaaaactactccttacatctccataagaataacaaagatattattaaaaaaaatcaagcagaagcaaataaaaaaaaagaggattatgtaaaaaagggaaatgatcatcttcattagcttccctttcggctccatggaggaaaacagcaaccctacacataacaacgtcaattgtaaaaaaagaggatttatgaaagaaagggaaatgatattttggttatctaccttgggactagaaggtaatggttgatgatgttggtcgatgatgggtcgagtcggggtgctatgatcggttccattgtaagatctcgcttggttcctatcttctttcactttgtcaaagataagtgtgtaactctgattttccatgttagaacccgttccaggaaatggaggaatagtcgccacctaattgagaaaaatacacttacttagcgatatatatttatgagttgtgacacatattttgtactataaaatggtaaagttatgcataccctttcactactttgccctctaagattgcgtattggccgcgccgggacatgatcacgtgattgccgtctatttatttctgttggatttcccattgatctgccacctccaccatatgtttgatggttgtatgtttctggtgtgggaggaactgatctaactctgttgtttctttcattgtgtgcaggagacggtctgaattcggtttcgtctctgctattgaatctttcatgtcttggtctaacattatggtttggtggttgttggtcaggcctagacatatttcgattttgtgcagcgtttggattcatatctggatattcattcgggttggccacgttcatatttttcttgctcttgcttgctttttcgaacacgaccgtgaatggagcatcttcggtccagtctccgaatttgggcacgtgtggacgattctataaccacaagaaccaaaaaaaaaagattttgagaaacataggcttgcatttaaattgaaagtaggagacataaatattagaaaatcgaaatctcatatatacggtattttggagttgatgccagagatttacagttgaaactttgtttttggctaaatgtttagagctgaatcttaaggtgcaagaaacataaaccttatctctttttttttggttttgattgaacagaaacctcatctgtagaatctaagtataatttcattacatatgaattatattgatgttcagaagatgaccaaaaagaattaggtgatcttcctacgcataaatgtcaaacaaaagaaaatctcatgataccgccgattctaaaacaaaacactatatgtcctaaacaggatgatataggatccatatttagaactacaaatatttgacaattactctccattctcacggaataaaactcagagattgtgggtataataaatactacacttgtaggataataagctttagaaaatcaaaataaaaagaagactaaaaccacacccaaaagaaaaaaaaaaacttactgccatatttctgaatgtcaagcagccagaatgaagaattgcttcaaggagtctgaaacaaagagagattattgaaagatagagagagaggtaagagacgtgtaaacacgaaggcgttgacaattcattgtcattgacttgtctttcttgtgattgcgtaaaccaacgacgactcattctacggtgctagttggtcttctttgcaccttaatgattaacgaatagttccaacgaacgacgcgcttcatgcttgttttattaatcaaaataaaataattgcatactaggtattatccgatcacataaaaattatagttaattggtccaataacctaattgagtttgttgaccacaaaaaaaactactatttgagaaggttaatttcgaaattagacaaataaaaaaagaagttaagttgaccaatatttgtgacataccatgtataacttttgttaactagtatcaaataattgagtaattgacatatagctatttgagatagataataaagttagagatggtatgcctaaaattcttttatgaaaaaatgaaagaatttatgaagaatttattaagctacaagttaaacttattctcaactatgtgagtagagaaactttatagaacaaggcggagtaatgtttttggtttcgtaaaggtatgggaaagaaagtgaatgacagaaattacctaaggccatcccaattgtaacagaacttgagggtgacttccctttgttaccatgacagcttgcactcctcccacgatggatcaagtctctaactcggctccttaaattctttccaatgttttttggtctcttttcttgtaaataaccttttgtatattgaataaatttgatatactaaccaaaaaaatccacaattcaatggaaaaaaaaaaacagatgcaactttaccattgcttcgtcatctctcttaaaagtaaagcaaaaggacaaatttattgttgcttttacaaaggcatgagtagttttagactttagagtagagtatagagttcactcttaaattttaagtttacataattaattagtacaccactaatcacaaccattgatctccctctctctcgctagattagtactaaacaacatttatacctttatgctttctactgaacttttctcagatccttcttcactcttcagtgtttcctctctcctactaaaaccttcttcagtttcttgaattcaattcttctcttagtcttctccattttatgatttcttggtggtatcaagaactcagtgaccgatttcttgaaaaagctaatgagttttagataaactcgttgcttgctttctcttcattctccgatctgggttttggttttaaatccatacccaagtagcaaaactagaagacaagagctatagaaattagggtttagagtttaccttattggtgaattgtggtaaaggaacaaactttagggggagaactcattcagac

SEQ ID NO: 1491 - DNA, 3000 bp, Unknown
  misc_feature (1)..( 3000): cDNA_ID_2137843_gDNA_ID_1620408_Annot_ID_156195 3000 nt of promoter + ATG
taaggtggtccaaaattttgatataatgagaaacatcaagaacattgtatgggaagactgcaagtttttacatgtatcatcatttacacttctccgtttgtaaccacagacaataaggcaaacatgttcaaagcttccgaaaagcggataagagagatgagtggacatactccgataatgaccggtaagggtgaaacacaaccagataataatctagtgcttctaacaccttcatctccattcctaatatatcctttagttcatatttgttgtactcatcaggatctgcaaagatataagaaccgttgtcgtcgatatgtcaaaaaaaagcatattgaaggggaggtactctcatgatttgaaaaataaaaaaacagaagaagaagatattacacaatcttttgatgtaaaaaacaagattcctggcctgcactatgctttcttcagctttagatgccaggtacaagcacgtaagagcaacaagtcgaggctcaaactctaccatactctttctgagatagtatagtaacaaaaggaagatattagacaccaaaactgaaaactttcgtaacacagttaacgtttttgatagcagagatgcaacatagagagacactggcatgacaagaatttaactcatttcattcctcacatacacaaagatgcacattgatgtatacgatcatatcaaaaatacattgcatacctgatataaacccgtctcatatacgtaattgcagtagctacaaccctacataagtagaaaaaccaaggcgacgattcatatacaagtccaggttacaccagatattagagctagttaaatctacagaagcaaaacaaagtaatggaagtactgcaacagtagaatctctttgatatagcaaaaattggacccccaaattgtaaagaaccaacctttgcctcactttaatgtgctgagccaatttcataatatctgaaaacaacaataaatgaagaaacaaagagacataaactcaaaaaacttctctgatcaatctctaatcaaaccagtgcaacagagacaacaaatttgcttaagtaagcaggagaattcgaagaattaagaagaaaaaggatttcgtacgattagacatatggaacttgatgagcttaaaatcatcaattgagattccacgttctttatcgagatcatgaactacgtcgacttcttctggatccaaaagctgtttactgtttcgtacaaacgcaaaaacaaaacaaaaaaattcgagaaattgaaattagaagttgcttagaaggagaagaagaagtgaattttgatgggtaaagttttaaagaacatttactagtgagatgaattccagaaattggcagccattttttccggtagaccgtcgagtctttggtaaggaggagaagcttttttagctcataagttcaacatttttctgttatctgtcaaatctctttggttggtggtctcatgatctatcatatcgttgcttttttctgaaattaaatttaaggctcggcccattatcggcccaataggcaaacaaatgaaagtattaactctgatataacatgttcgttgttttttgaataacagaacatatagatgataaaaattgaaatcttataaatagctaagaagtgaccgaatatatcatttcgacgaggtataatcagtttcaaaaggattaaatttgagtttggtttttttcgtcatgattaaggctataaaaattctagctttatatcatcagccacaccgaatatttttctctcacaagtttttgtatcatgtattgttcaaacgcttgatcagtgattttcttctaaccataagtttgggtgttcataaaagaattttcagaagaacaccacacatttttcgtttgcctaatatacatgttcatttgttttattgagcccatactcctttatcaaaactaactttttttctttaaacatactaaattcaaactaaacttagactaatacatactcaaattaacaccctacatgtttctcacgttcaatatttggtacaagccaaataggtaaactacaatctaaaaacgcacgagaaaaaccgcatgacaaaggaataagccaaataagttgactacaatctaaaaaacgcacgagaagagtatcgattatcccgtgtctaaatttaattccggtttttcgctatcaaaacaattcaagaggagttattattctctaattcaccttatagaattctttgggattatgtgctaacccaagttaaaatctaatgtactcattaataaaaggtaagtaatattaaagttagtggagaataaaatctgttgaagaaaggtgaggaagtgcaacggaccatgtttgacacgtgagagtcaaaaaggcaataaaaaagtcgtcaacacacacactctctccccgtctatataaacatcttcttcacagtccccacaaagtcctcttccgttgccttttcgctttctccgtacacttggccttccttctagcgatcaaaccctaggtcccgccattgttggtcccagacttcaatcgaagctccaatttcactaatttcaggtgaatcttcttctactatttctcttccgtcagtttaatgtcacgatttcgccggaaaaatgtgatctacactgtttcggagtgaaatgtgaagtagatttcgttggtttcttagctagtttgtgcttttctcgaagttgtttctgtgtttatttcatgaaacgattttgggttgcttttgtgaagttgattttgttgttgcctcttagttcgttttcttgcttgttaagtgtttatcgagtcactatgtgtagttcatgaattacgttttctacggaaacgattttggaaagttgtgtgtgagatttagagattttctgttttttacatgattcttgggttgttctgtgatttacattgattctgagttttgacagtcttctatgaattacaggtgttgtttattctctggaagttggcgataca

SEQ ID NO: 1492 - DNA, 3000 bp, Unknown
  misc_feature (1)..( 3000): cDNA_ID_3062652_gDNA_ID_1620408_Annot_ID_156192 3000 nt of promoter + ATG
ccaatggagaacagagaccaggtgaggcaaacagaatcagctgagaagagtcaccgcaaggaaaatgtgaccaagagtgagaaaccaagggatcaagaaggggtaaagaagactgaagcaaaggataaagacagaaataaagagaagaaagaggaaaaaacagagtcgataaataaaactcgtcaggagaaaccaaaattgatacgagggcccaagttagaggaaagagaaaaggactctccggatttaagaaattgcaagctgcctgacgtttcacggacaagcatcaagaaccttcacaccgagggaaatcttggcaaacggaaggatcatatgacaaatggattcctgtatggtgagttattctctgatccaattctctgtctggtgaatgaggagtgtagttgccatattaaccatcgtatgatatatggtttggtacttagaagcatctaatagttttatccaatcatggtatgttttcttaccttaaaagattttttaaatttacgggtatcttactggtttggtagtttcttggtttggagtaatgatgcaagatccgtatttcttggttttggtctgaaatgttaacaatgtagtttattacctgtttgttgtaacattagtctttaattctttcgcagaaaatggaaccacgccacacaagttacagaagctgagtgcttctgtaccatctgtggaaaatggaagaacattaggtgcaccccgaactcctccaatgcctgcttctgaggtgcaaggaacaacttgcaagccacaagtcaaagaagtcagaattaatggttttgctgtctctggagaaaaacgtaaagtctgtccaccaagccctttggctgcaacaatgaaagtgaaagtcaaggaaaatggtgaagcatccgcaaagccgcctcatcctgacctaaagtatctcaatcagatactccatgtacctacaagggagctgttgccagagattgatgatgaccaagaatggctacttggtcagtcgggtatcaaattaaaaagggcgagaacagatcctccagattctggcgaatccttgcaggtctggaaccaagctttcagaatagagtctgcggatatcacagctcttccttatgtagttccattttagctatgactatattcctacgctacaatccctgaggagaagaactatccctcgcacaacgccactttgcagcagcatctattaaagaagaccgacaacagcagtccatggctccccaaagtttatgagcagggatcaaatatgttatacacgcccataatatgaacacccacaaagctctgcatgggtgggggaaaagaatgaatgaggaagatgtaagtagagtaagtttatagagaagttgattgttgtttgacaccatgttgtgttataaggacaaggatatgtgtggcattttgttctgcacgcaattttgattccctgcttgcatcatcaacattagtggataaagtttgtatattacagagaatggaaaaagaaagagtagggctctatgtgtgttactgggcgtggagacggaagaaagtttaatctttccgttataactatagagtatatagtctcgagtttctcaggaatactattgtaccaaatcctgaataaaccaatgatcactagccaatcctagctccatgcctaataatgttgtgtataattttagtaaattcaatcatttctatcctaaaggttaaatctttcataaatttgacttaaaggatcggtctcttacttcaaatatcaaaccatggacttcaatcgtttcgggaaatcttgtaacttcatttttttacggatgtattataccaacttcagttaagttcaatgatcttagtcaaatgatcgaattcctcaatcagaagcaaattggtgaagagagattggttttcacactaattgggagagagcaatttcggttttggttactgtagtgatcaatgcagcgaaggtgttcgatgaaatgcgtaggagagactttcgggaaattacttcactaagagcttttttactgatgcgaattccttttaatgatagaacaagatatcaagcaaagaagccttgtggtcttgatactgaattctagaatacacagtgacgtggtggtcttgtcttttgataagcttgttgtagctgtctcctctctcaatggctatctcctgcgactgaaacggtaaacctttattctctttagattcgtgtgtattcatcagtatctggtcaggttacaataatatattgcttattaactgatcaatctgttactgtcctgccctgcttactatagtagacagtttctgtggttttgtaatacttaggcatgtgttaactattattagaggacttacagtgagttaaggtgtcttcgtgtgtgtttctctcaaaatgatatatttgttactctgtatatatatatatatgctcgtggaatcctgatgagaatttggttacagctttatcaatcctctaaatagttttcaacagtgcaaggttttgtgttcctctcttgaaaatatagtctctgaagtgttaacgagctctatatatgactagtttgcagagttcaggcagcaatgtgaatgagctagagaatccaataagcaatgataggactgggtcaatagttcaagaacgtgaaggttccgacaactaagcaaactgcttcttcaatttggttccgacaacttttatcattaaaaaatatataaaatatcttttattattaaaaaatatagggatatatcttttatttgattaatcattatattattgtagagaaccctcagccaagagattggtagctagatagataaggttgacttggagtcaacttctagcttagagttttgataaattttatagctttcttcatttatagtaaacgttttaactcatttttttccagagaatctgtacccttggcgttcttgtactggttcatcgtaggtgatactcgacgtctagttgtt

SEQ ID NO: 1493 - DNA, 3000 bp, Unknown
  misc_feature (1)..( 3000): cDNA_ID_2137818_gDNA_ID_1620408_Annot_ID_156189 3000 nt of promoter + ATG
tgtaaaattgcagaatccagaaatgtttgaatctttggttgaatccagaaattatgctaatcaatggtttattagtgttggttatcactatggaatggttgtttctgttttatgttctatgatctggcttttatatggagactgattaacgtatttgaatcgatgttttgcagaaggatagctcaacttaaggagagtgattgccaaattgcaattgaagacataatgtacatgttgatcttgtacaaattctcagagataagagtgcctcttgttccaaagcttcccagttgcatttacaacggaagactcgagatctcgccttcgaaagactgggaacttgagtcaatccatagctttgacgttcttgaactcatcaaagaacatagtaacgcagtcatcagtttaagagtgaattcgagtttgactgacgattgtgcgacaacggagatagataagaatcgtctcagtaaagtatacacagcttcggtcttatatggatactttttaaaatctgcttctcttagacaccaactcgaatgctcattatcacaacaccatggaagtttcactaagcaactgaggcattacatttctgagttcgatcccaagatattgcggagatgcgcaaaaccaaggtcacatgaagcaaaaagcctgatagaaaagcagagtttagctctttttggtcctgaggaaagcagcaaagagagcattgtgacatcgttttctagcctgaagaggttgcttcttgaggctgtggcgtttggtacgtttctatgggacacagaggagtatgtagatggcgcgtttaagctcaaggagaatgagaatgcagaggaagaaacaaatagcagtgtttgaagtatgtatgaaccagtttgctagaagaaaacttgaatatcttttttggtggacattgcatataatatatagattaaatcagggtcaatggctatatgaaattatttttgtctatagtttgagtaatcatatgtatagtgtataatggatgatttaatagagagattggttttgtcattttatatatccatcaatatattgcaacttcagaggaaaagaaaatagttaaaaaccacatttattctaggtgtctctcatatttgaccagtttctcatctctcatcaattttcacttgtggacgcatgttagttaattgaaaataaaaagacaaaatttatatgtaaatgcagtatactgtatactgaatatagtaattatgtttttagttactactccttatgtttcacaaaaagtatcattttacaatttttaacacaaattaaaaaaacatctaaaaatttcttttacctattgtaatacactttttatttttaattaataattgaaaaaacagaaataaaacagatatttgattttaaaaacggcatcgaaaacacaaaacaacaatctttgttaaacaaaacaaaaaaatcttaaaacgatattttttgtgaaacagatgaagtattttaaattaaaaattgtaaattaaagtttatagttttttttactatcatttataagaaaatatgtttgataaaacattaactactatgtaacataagtaaaaccgtaccctacaaaaaaaaaacataagtaaaagcgcatataaagatgctactatcttaactttaaaacatcacaaccaaaacgatcagcaaatacgttccatatttttttgttaaaatattaaaatttttaaagaaaatgaagacaatttttgtctttttaactcttgcagttttggtttcatcatgtaagttctcattcttgttcaattaaaaatatatatatatatatatatatatatatatattatagtttaaattttaatttaataagttttcaaaaaactatttttacgtgcatcaaatattatgataaaatctatttcagaaggaaaatctcagttttccggccctgcattaagccctaatattgatccagcagacgaacatattggacactctcccgaagacatgaaaattattttttgccaacaatgtgcatttcattgtattgagaaaaagaagaatatagctcattgtgaaaattctatttgtcgttgtacattggaagacattttgtaagacattatatttttagaataatataagaaataatcattgtgactgattttctacctttacagcctcctttcaatttttaataaaaattaataatatagaattgaaaatacattgagttatacatttttacatatatttaaacgactatatacactgaatctttataacaaagaaaaaaaaatcaaaattgtaatttttgtttgtatcttctatatgtattaagtgttacatgtgttatttataaaatgtttgtgaaggttatcacataaaatttactcatcatctcatggtttgcttttttagaagagaatttaattttagaaatagaatataaaatcataagtcatatatttctttttttgaatataaacaatccgaaaaaatacctagaaactatcttgtttgttttgattataaacaattatatatatatatatatatatatttatttagtctaaattttacgatgtttactaattgcataacaaccgttaaattagaggattgaatctatcaaaaatttaaagacaaaatattataataaaaagtttaattaaatgaggtattttttatcaataaaaaacaaagtaacaattaaacgtccaattaaaaatgaaatatttttttggttttttcctacgtcggtaactaataacgtcacaaagttgatggtatttgaaagaattagcggcaatttattccccccataaattttcatttgtgacctaaaattaactttccctttctctctccgtgcctcttcccattctctttcaatcttgtttgaatctccctcgattttcatttctctttcaatttcaaaattcgcacctcctcctccaaagttgttgaaatcagattttgttgaccggagagtagttattt

SEQ ID NO: 1494 - DNA, 3000 bp, Unknown
  misc_feature (1)..( 3000): cDNA_ID_3062667_gDNA_ID_1620408_Annot_ID_156186 3000 nt of promoter + ATG
acttactgatggaactgtattcgattcgagttttgaaaggggtgatccgtttgagtttaaattaggaagtggtcaggttatcaaaggtagtgacttgcttttggcttttgagtatctcttttcttttaacattttcttaattccttcaatggtaattttcggttttgttgcaggttgggatcaaggtttgctaggagcgtgtgtaggtgagaagaggaagttaaagatacctgctaaacttggatatggagaacaaggctctccacctactatccccggtataaatacgcttcatcaataagcttttaaaatgtgtattcatgtttgtgaaaaaaatacgggatttcgacattataactaaaaacaaccttgcaaacttcaggtggtgcaacactgatctttgacacagagcttattgcggtaaatgaaaaaccagctggtggtgaagaatacggaggggatgaagatgatgagggatatggaaatgacgagctatgatccggtctccgttctttaacgattttgcttcaagagttctctggataatacaaagaaaccatctatgggagggttttttctagtcttttggcttttaggcgtaaagactgcagatgattgttatggtgatatttaacattttcttttcataattggctcaacttcaattagttagccaaagcaaattacacagtacggcttagcgacctcaatggtgatctatgcgcagaatgagaggggtcaagaaaaatcttaggcagtgtcgtcttacaaaaaaaaaaagacaactacaatggcaaaatacaaaagtttaccatcaatgcttttgtgaaactctttgctattattttgacctcaatccaccaaattctcaatggtcagtggatcaatgattctaaacattgaacactaaacatatctacgaaagcagaacaaataaataaatttcttcaaccttcatttctcacaagatagaataatggcatgagttcagctgttgttatgcttcaccattctttttgtatctgtgtcccttctggacattgtttcagctcacttgaagattaagccatctttacctcaaattccagatccgcaaacggtgaaggatgtagagccttgcaccgttaaagtagtgatggtctttgtgtcggacctcgagaaagaatgttctaagacaactagacaagtaaattcaaatttacttcgaaatacattcttttcttgaaggtgaaaatgtatggctaatgaaacattttatttacttcatcttgcatatgtataacagattaagaaagaaattcaagaagagaaaatggatgtcataaatacctttaaatttatgagaactgaggcgggaaagattataggtagccgcaagaaagaggagagcgaagaatccatgaagctagcagctcaacatcaaaaagaaatcaaagaagggatcttgaaatggagacggttattactcggatcacaaacacaattgttgtaaacacaacaaactctttttcaatggaaagttctacaagcggaaaaggaagttctagcgataatagcaaaagctttggtagcttcattagcggaggcgctttcacagacactacaggttcaggctctaacttaggcattcctgtagttcctgaactaccggtagaagcttgctagtgctagtggaagtcctacgagcaatccttctggcagtggggtttcctttacggacactactggtggaagctccattagtcctactgaaagtggaagtgctggatcagcaactcagaaaaacgctataacattgacacaagttgaggctgagacttccaaagaagtcatgatattcataataaacctcgaaaaaaagtgtccaccaaaggaggaatacgaggtcttctttgagaaactcaagggtataatggctgcacgctcaaagaattctcccaaaagcaaaaaaagtttcttctctacgatcaaatatgctgctgggaaactatctgatgacatgacatttatgcggtcaagaattggaaccaaatcagcaaaggtacaaaaaagatacgtctctttctgttgttacttgctacatgttcttctaactcacaatataggtgaagcagtccatggaaacttaccaaaaagaagtgaagactatcaaagagttagaaaccatccatagtagaatagtaagttagaataaaggcaagaaagatgggtatttgacatgcacaacggcacaacaaacagagattaagaagacaatcactaagtgggaacaagtcacaaccaaattcgttgagaccgctattcagagcgagacatctacaacttcttcctcttctcccggcaagatcaagtcaacttgaactcaaaggcataactatacataaactagttagccacaaatcataaaaaaaattgaaccaaccatacgaaatacagatcaattaactagctaataattttagtttttgtgtttattgtaaataaaaccacggctatagatatttcaaaaagataaatcgtttaagtctttatgctctttttaatttttattagtcaaggatgatgaatagtaaattgtataaaataaaatattatttgatttagaataataaaaaaaaatctagtcacaaaaataatgcttctataatcaaattttaaattttaagtatttaaaatgattcaaaacttgtgtgtttttaaaaaattaatttattaattttagattaacgagacccgctcaaaagaaaaataaaaagtgttctaacaaataaaaataaaaatcacgctaacagtcagtatctggaaacatcgggacacatctttaggctcaaggattcaaatgaaaatcagaagtctctagaaaaaccccaaaacactctttcttcactccccctataaattctcatcacaatttctcaaaccatctcatctctgccaacacactctctagaattctctcgtgattatcgatttcactctcttaaatttgatcagaaaatg

SEQ ID NO: 1495 - DNA, 3000 bp, Unknown
  misc_feature (1)..( 3000): cDNA_ID_2137814_gDNA_ID_1620408_Annot_ID_156188 3000 nt of promoter + ATG
ccattgagaatttggtggattgaggtcaaaataatagcaaagagtttcacaaaagcattgatggtaaacttttgtattttgccattgtagttgtctttttttttttgtaagacgacactgcctaagatttttcttgacccctctcattctgcgcatagatcaccattgaggtcgctaagccgtactgtgtaatttgctttggctaactaattgaagttgagccaattatgaaaagaaaatgttaaatatcaccataacaatcatctgcagtctttacgcctaaaagccaaaagactagaaaaaaccctcccatagatggtttctttgtattatccagagaactcttgaagcaaaatcgttaaagaacggagaccggatcatagctcgtcatttccatatccctcatcatcttcatcccctccgtattcttcaccaccagctggtttttcatttaccgcaataagctctgtgtcaaagatcagtgttgcaccacctgaagtttgcaaggttgtttttagttataatgtcgaaatcccgtatttttttcacaaacatgaatacacattttaaaagcttattgatgaagcgtatttataccggggatagtaggtggagagccttgttctccatatccaagtttagcaggtatctttaacttcctcttctcacctacacacgctcctagcaaaccttgatcccaacctgcaacaaaaccgaaaattaccattgaaggaattaagaaaatgttaaaagaaaagagatactcaaaagccaaaagcaagtcactacctttgataacctgaccacttcctaatttaaactcaaacggatcacccctttcaaaactcgaatcgaatacagttccatcagtaagtttcccctgccacataacaacactaagttacacaacaacaaaaacaacaataaacatttcttcatgacaataatgaatcccaattttgttataagatctagcaaaaacttaccctatagtgcaccttgatcgtatcacctttgtgagcctgaacttcacatgtttttggcttaaactgcaaaaaaaagaaactctttattatctctgaatccaatcaagaaccctaagtatcttacaaatttgttgacaagatcacacttgtcaaatccaaaagactccaactaaaccaaatggtcaaaagacaaaccaaaacagaacacagcacaatcaaaaccagatccaaattcacattccagaaaacaacaatgaataaaccaatattatagctagaaacagtatacgagatcgttcatttcctgatcggaaaatataaaaattaccttgacaccgatctgcaattccgacacatctccggtcttcttggcaaaacctataaacagatccaattacaaggaattagattggaaacaaagagatcatgattttagcacattcaataatgagaaagaaagatgaatggagaaccttggagtgaaatgagagagaagaagatcaaaaagagagagtaacggagactcatcttgctcgccataatcgcttctcagttctcactcttcagttttttccttttcttcagtgtatagaggtaatcttattgggcctaggtaggcctgtggggttctgcatttttgtaaaagcccatcttttatctctacaagcaaagttgaaaatttcggtttaagagttttatcatttcactacgttagagtcttatatttctactagcaaagttgaaaatttcggtaagagttttcatttcatttcatttctttctaaatctactcaagagtgttcactatggtggttacaccggtatgcaaagagttatttaacgagcaagaagacaactacattatctcttaattatattagaatgtttcgcatgcatctaattgtagtttaagttgctgtaatgttttacaaataaaagttttattttataatttcacggtttaatatctttgtttaatatagaagaggaagcaaacaaagatgagaagctcacacaatctcatttgaagatttatgtcactatttaaagttatagaaaaaaacagttaatctctattattattatcatattctattctaattttttttctagtatgtcacatattatttaaaagatgagatgagtgtaatttttttttttttttaataataatatagactgcggtacaaatatctagtaacaaaaatatttatggttttttaaccattgtgattttatttagaatatcttataatattatgggacaaatgaagaatcttttaatttttaactaactaagctaaaattttaatttatatctcagaaaatgattcttcatatttttgaattcgaaaattctagcttgatgaaaaaccaaaagccatttcgactaaattcaaagaaaattacaaccaataagactttcatagtttaatgttacaattaatatccaaagaaatttattaaaatgaaaaagtttttaaggtgatccttgaagagtttttatattacccaaataaacgtcgctttactttactagtcaacttacaaaatcagcattaaccacacaaagcaataaacaaaaaagattttttaccatttgcttaccttatccaaatctgctcccactgactcttccttcaatcttctcctctgtaatctcttcacaatcccaaaaaatctcacaatcgttttttgcttatctctttcaatggacacctctctctcccaccacggatctctcccgtttcccccatcgcgccgcaatttcgttaaacaaaaccgcggcggcgattgcgtttttctcccctcgcgtcgtaagttccgatacgattcgttggtggtggtttccgctgcgtcttcgggacagagcatcgacgcgcctctagttccacggtcgcctcagggaaggtttctaagttccgtcttggtgaaaaaacggcagctctttcatttcgccgtcgctgatttgcttaaacagctcgctgatgataaggaagcttccttatctcgt

SEQ ID NO: 1496 - DNA, 3000 bp, Unknown
  misc_feature (1)..( 3000): cDNA_ID_2137810_gDNA_ID_1620408_Annot_ID_156187 3000 nt of promoter + ATG
atatctgttttatttctgttttttcaattattaattaaaaataaaaagtgtattacaataggtaaaagaaatttttagatgtttttttaatttgtgttaaaaattgtaaaatgatactttttgtgaaacataaggagtagtaactaaaaacataattactatattcagtatacagtatactgcatttacatataaattttgtctttttattttcaattaactaacatgcgtccacaagtgaaaattgatgagagatgagaaactggtcaaatatgagagacacctagaataaatgtggtttttaactattttcttttcctctgaagttgcaatatattgatggatatataaaatgacaaaaccaatctctctattaaatcatccattatacactatacatatgattactcaaactatagacaaaaataatttcatatagccattgaccctgatttaatctatatattatatgcaatgtccaccaaaaaagatattcaagttttcttctagcaaactggttcatacatacttcaaacactgctatttgtttcttcctctgcattctcattctccttgagcttaaacgcgccatctacatactcctctgtgtcccatagaaacgtaccaaacgccacagcctcaagaagcaacctcttcaggctagaaaacgatgtcacaatgctctctttgctgctttcctcaggaccaaaaagagctaaactctgcttttctatcaggctttttgcttcatgtgaccttggttttgcgcatctccgcaatatcttgggatcgaactcagaaatgtaatgcctcagttgcttagtgaaacttccatggtgttgtgataatgagcattcgagttggtgtctaagagaagcagattttaaaaagtatccatataagaccgaagctgtgtatactttactgagacgattcttatctatctccgttgtcgcacaatcgtcagtcaaactcgaattcactcttaaactgatgactgcgttactatgttctttgatgagttcaagaacgtcaaagctatggattgactcaagttcccagtctttcgaaggcgagatctcgagtcttccgttgtaaatgcaactgggaagctttggaacaagaggcactcttatctctgagaatttgtacaagatcaacatgtacattatgtcttcaattgcaatttggcaatcactctccttaagttgagctatccttctgcaaaacatcgattcaaatacgttaatcagtctccatataaaagccagatcatagaacataaaacagaaacaaccattccatagtgataaccaacactaataaaccattgattagcataatttctggattcaaccaaagattcaaacatttctggattctgcaattttacagattttgttttcttctacaactcggcgattctacagtgacaacaaacacttgcgattgtgattaagaaaagtggaggttaaaaggaacctgtggagggaagcttcatcggaaccataactaaggaacatacgagataaggaagcttccttatcatcagcgagctgtttaagcaaatcagcgacggcgaaatgaaagagctgccgttttttcaccaagacggaacttagaaaccttccctgaggcgaccgtggaactagaggcgcgtcgatgctctgtcccgaagacgcagcggaaaccaccaccaacgaatcgtatcggaacttacgacgcgaggggagaaaaacgcaatcgccgccgcggttttgtttaacgaaattgcggcgcgatgggggaaacgggagagatccgtggtgggagagagaggtgtccattgaaagagataagcaaaaaacgattgtgagattttttgggattgtgaagagattacagaggagaagattgaaggaagagtcagtgggagcagatttggataaggtaagcaaatggtaaaaaatcttttttgtttattgctttgtgtggttaatgctgattttgtaagttgactagtaaagtaaagcgacgtttatttgggtaatataaaaactcttcaaggatcaccttaaaaactttttcattttaataaatttctttggatattaattgtaacattaaactatgaaagtcttattggttgtaattttctttgaatttagtcgaaatggcttttggtttttcatcaagctagaattttcgaattcaaaaatatgaagaatcattttctgagatataaattaaaattttagcttagttagttaaaaattaaaagattcttcatttgtcccataatattataagatattctaaataaaatcacaatggttaaaaaaccataaatatttttgttactagatatttgtaccgcagtctatattattattaaaaaaaaaaaaaaattacactcatctcatcttttaaataatatgtgacatactagaaaaaaaattagaatagaatatgataataataatagagattaactgtttttttctataactttaaatagtgacataaatcttcaaatgagattgtgtgagcttctcatctttgtttgcttcctcttctatattaaacaaagatattaaaccgtgaaattataaaataaaacttttatttgtaaaacattacagcaacttaaactacaattagatgcatgcgaaacattctaatataattaagagataatgtagttgtcttcttgctcgttaaataactctttgcataccggtgtaaccaccatagtgaacactcttgagtagatttagaaagaaatgaaatgaaatgaaaactcttaccgaaattttcaactttgctagtagaaatataagactctaacgtagtgaaatgataaaactcttaaaccgaaattttcaactttgcttgtagagataaaagatgggcttttacaaaaatgcagaaccccacaggcctacctaggcccaataagattacctctatacactgaagaaaaggaaaaaactgaagagtgagaactgagaagcgattatg

SEQ ID NO: 1497 - DNA, 12 bp, Unknown
  misc_feature (1)..( 12): cDNA_ID_2137892_gDNA_ID_1620409_Annot_ID_156209 3000 nt of promoter + ATG
aagcttgtgatg

SEQ ID NO: 1498 - DNA, 3000 bp, Unknown
  misc_feature (1)..( 3000): cDNA_ID_2137954_gDNA_ID_1620409_Annot_ID_156232 3000 nt of promoter + ATG
gcgccctggacagattcgtgtatatatatactcggggaaagcttgggtttctgatgatccagaggcgttcaaaagtgttttctttcttcttcttcttctggttgtctccatctttgtgttaaagatgtgaatatatgttttaggacagcttcatttttgttgaaagcttaaaaaacagggtcttttataatctctgtgattagtaccaaattgcagatttgcagaactacgtttttcttggtttgtcaggtaatgtgaaactgaataaaatgaatattatttgaatcaactgagattttacattatcttctagagttttgtgtttgagattcaaagaacactagactgagtatgaagattttgggtgagtaaaaacaatcagggtgataatttatcatacaatagttttggggtcaaaatggaataattctagagtatagagcccatgttgaaaagctcgaaaattctttccaattccagaagaaaaggttttgctgtttccctgtgagcgatcttcgatactcgtctgggcatggcgtttttgctcaacaacgcttcaatttcatctcatttacgctcgtcttcttcacaggtttggatcaaatcttgttaatcgattattgttggaattttgtttgatttttgtgacaattttttcccttacgaaatttttgaagaagacgggtgatgctttatcaatatcgcgtcgtggattccacattgagccaggaactcgagagaaagctgtaagttaatctctgtttctgttcgagtcctggatcattttggactcagtttttgtggaattttctgcatctattgtgatttgaagatactaattagggttcatgaaagaattggcttttatatagattccctgagactctcatgtgtgtccctagtaatgttcgttgtctgaatctatttgaaagagtaatttttatgagagttttgagttgttgttgatgcttatgctgttgttatatggcattttcttaaagctcttgatgagtttgtgtttgcttaaattgaaatcctgtgtagctcttggctgaagattctgctttgaagagattcaagtctcataagaaaagtgtgcacaaactgaagaggattggtgatgtgctcactgttgttgttgttgcaggtaaaaacactttagttcataacttttggtcgaagctaatcagattcttgttttgttagtggtctagaaacataatctggtatggttcaggaatcataatgaatctgagtaagagattgactaggctaggcacacttagatattttcaccttgcttcttgcaattaagaaagctgtagattgaatctcataggtttcatgtagagctgagcttattatgtcaaatcaaactaacaacgttcttctctgttgttcttggtaatatgaattatggattcacgacatactcgaaatctaaattgtgacttatctcgtgtcttgcttgtttttttgtcttaggatgttgctatgaaatctatgtcaaagctgtgatgaaaaaagaagctctggctgcagggaaaagctcatgagtgttcttgtctttgtatgcctttttgttttatcctttatacagtgtctctttctaataatctcacaataatgtttgtttactcaatgaaaatggcatctaataaagtagactaaaagaaaaagacattgtccagggaaaccaaactctggttttttctgacgttgtgtggaatctctgctttttcttctttttaaatattccttagcttttcacttatttgtactttgcttaaagatacactctccatttatagataactgcaacgattaatgtcttatccatggattaggtgactgtatttatgtgaaattgtgaatgatcaatcacacttaatggtttacactggacatgaaattgtttcgaaaggattagtagagcgagtgggccggttcggtgtagcctacctctatcttgggcctctctctaggcccaatttgggttcaaaccggttgagacgaggtctcaaaccgaaatctaactttacacccttaattttcaacctaattgtgactcaacaagaacatatccaccactgaccacttgttttccacaaatcatgcaaatttgattaatacctactgagtactgataaaaacaagtacaaagagctttcatgctcccttctgataacattggttcaccaaagatgtaatataaaaaatgttggaatattagttgaaccaccttggagaacgtataacaaagaagcccaacaaatcaagttacttttgcttgatttgcacacattcatgtttgaaagctacaattcatatgttctatattatctacatttatactcatagttgatatgttgtcgaaattctatcaatttatgatattgataggtttgcaatttcgtaaaagaaactctcacatctattttgactaacccacacgtttttaaaaataataaaactatgagtaattacacatcctaaagagcatttactcatcagtcaaaattagttgatcaatattgagtatgattcgtgaagtcatgcatgatacaacgtcgataatttttttggtaaaatgtaaaagaatacgtaatcaattttttctttggaatttttaatactttggaaattacaaatttttttgttgaaaataagatttcaggaagacgaggagtaatattcttcttagaccaacatcatgacatgttccctggcgtgattattttcgcgacacctgaagaaacggcatcgtttaggtcaaagtcatcatcatcattctctattttgcaatctcataaagacggttataaaaatcacagagacacacccacagacgataaaagctctaacggaccgaccaccgccaagtttttaattttacactaatgctactgccacctcttattccgccagatccaccaccgtctccgccgcatcactgattcctcaaccgtcaccggagataaatccttaagcaaatagaaa

SEQ ID NO: 1499 - DNA, 3000 bp, Unknown
  misc_feature (1)..( 3000): cDNA_ID_2108842_gDNA_ID_1620409_Annot_ID_156214 3000 nt of promoter + ATG
aagtttttggcaaaagaactaaatctgaaattttcaaaattttcttttgaaataaggcatcaagtgtcagcatattcatcttctgaatctccctcctctaccaccaccacgaccgcctcttcttccaccaccgccaccgcgacctccaccatgtccattgccgttagctccaggagtcttcatgttttcaggcaatgggaggatttgatcaacacacttcctgaagctgaaatcgtctgcagtatcgtcttccctaaccagaaagaagcatctgcttttccacattgggtgggttcttacttggaaggttttgattcctcctccaatcttcttttcaggctcagaatggcccttcttaatcagatctagcagcaccatgtgctcatactgaaatgtacaatccagaacaaagttcagtacaacgagttagttagttggaagctcaaaagaaactgcaacaactgtaatatattacatgactatgcaatgttttatcttttatttgtgccctcaaaatttgacattaacttcattcttctaaccattatatgacatcaagacccaaaaaaactttctaattcacacacaatccacaatcatataatcagtaagaacacgatacatttgaacttttcaactagtaaaaaagctgcaaaggagtccaatttacaagctatctccacttcactaatcctctccctaaacataatacaatatccacaatcatctccctaaacataatacaatatccacaatcattgtaaacaaccactaatttgagacaaaaacaaaattctaacaccaaacactgaatccaaaatcaaatcatatgaccaatacaaaggcgaacccaattctcaatttcttttagtttaaatacaaagcacgatcatcatcagattcattgataaaacatcttcctaaacacatcacagaacttaataatcacaatcagagctcttagattaacctatataagtctcgagcaaaggaatgaatatttccaaaaaatttgaaactttacaataaacaaagccaaaagacaaagacgaagagtaaacccaaatatgtattaccttattaacatcgagatcagttggccaaaagtgtaaaaacttgacaaagtaatcgaacatcgccacagaggtaacaaactccttgggaccaagtttaaccggacctgacttctcttcctctccaaccttctgcttcttcgattcacctccgttctcttcttcctctgtctcctctctctcacgtttctcatcgccggtctcggctttcggggtcgcggtttcgacttccatgtccactttctggtctgggttcacttccgctgacagggaatcgacgatctcttgttcttcagccattgttaagctagtaaagcttccgcctttttttcacctttctacgatttctagggtttaagcttgagggtgtgtgacctacagaaatcgtctaagcggtatatttatatgactttggtttccgattgaaccgaactggttcggtctatttgattttttggctcgacggcatacactacatgaaaaccaggattttcaatgtagtaactaatttgtcgtcattgatctgtccaattattatttttacgtctcttaaatcttttcattttaaagtctacatttttctaatatatttttttattaatcatctcaagatatttttttagtctacaaattacttttactgttgtagaaaatttggataatagtcagtaattctaaataatagaataaaaactcaaatcttaatataatagtttaacaaataaatcatattatactttttttggataaaaaatgttgatataatttacaatgttattaaaaataatttttgggatacctaaacgttttagatgttcagtctgtcgggatatcttggagacttaacttattgatcaatcacaatttttgccaaagaggaaaatgtcaaagtcaaacgaacatcttttgaaattatttacatctcgtggaattaatggaacttcttaaatttttcaaaaatttgacataattggaatatattttttttgcttctagtcaatcttaccatattatctatcaacagtcaaacacctcaatcttaaattttctaaaaataatggaattattttatcgtattttggtaaagagttatttttgtaatattatctaaaatctaaaaagaaccaagatagataggtacaaaaaaaaaaaaaacttttttttgtgaaaatctgattatcataacgttaccgtgtcaaatcgtcaacctccataactccggttttgtgtatttaattatatatttatctgtttacacgcgcttcgaaattttgatttacttatctgaatatttttccagaccgaacatcaaacaagaaaacacatttgtccgaatttcatcttgagagctgtttgtgcccttcaagaaatcgaaagagagcttctttcccccattttctgcgattcacgatatttcttcttctataggtaatcataatttgatcatcttctcttttatctctttttttctttcattttcttcttgggttatggttggttgattctgctatttgggaattttgatttctgtgacttttggggtttcaatttcattcctgaattgtgatggaatcgaatggtatctctcttttgttttcatggttgagatgtgattctgaaatttggggattttccgattaggtttatgtcttgaaaatttggggaaatttggagacaaagacatattttaaactcagatcctaatctcttccaccaagacattttccctgaattgttccgctttaatgaaatgaaatcgattgtctgagctcaattatgatgtttcgattcaaagaaatggagatttttgtgttgatgatggaacatttatcattataagagttatgagatttttattttgaatctttggatctttcttggtttttaacaggacaacgtttttttacacattgaggctaaaagagag

SEQ ID NO: 1500 - DNA, 3000 bp, Unknown
  misc_feature (1)..( 3000): cDNA_ID_3062704_gDNA_ID_1620409_Annot_ID_156225 3000 nt of promoter + ATG
cagaggttgttcaggaatccgaagaagggctccgtccatcagcagatggtgttcagatcgtgactgttgttaaaccttcagacaagaaacgtgccagaaaggagactgttcctaagaacaacctgccggtgaggacaaagaaatcactagcaaccaactctgctaattcaaaaacagttcaagtaaacaaggatgataagtctcagaagaagtctgagaggatcactaaacccaggactaagagagttcaagaagagtcaaagaagtcaattaagaaatctactgctaaagaaggtaaaaggaaaatcatataaatgtctttgaatagcttgtgtagcatttgtggctgatcgtttttaatgttcatatgtgtaggtgaagttaaatctctgaagcaaacagagaaaatggagaacaaagaaaacacggtgagtgaaaaacttctttaagttcacaggatcgaaattgttcttgtagctaacacaagctttttctcgtcgcaggttgttgttggtgcaggagaagacatccaggtttaaatgaagaacagagaagcgtttcttcaacatatctcaaacaatctttttcttttggtttgaatgatttgttcaagtacatagttgaaaaacctttgcaagtttgtttccaaagtgtggtttgaaagacaacaaatgttttatttgcttgctctgtaattgttttaagttttactttcatgtcttcatttgaagtctttcttctactgttgtctcttcaaatttggttattcactattatcaaaatatatatatatttatagcagaaatctcatttccgaaatttaaacatccatgtaaaataaactcaaggcagataataaatactattcaacatccaattactcattagtcaatacaacaaaatgaatcatatttatacatagctctgctccacgatctcgattactttcctgttatattctcttttattctcactgaacaaccttgcagcctctgcgttcgctggtgagtcagggtttgggtcacagagcaaagactgtaaaacaaaaggtcttggtttagttcatgcataacctccacaatgcaaaagatacaaatgaagaattcagaagtcaaaacctgaattgatgtgagaactgcagcaacgtcgtagatggggctccactggttttgcaagatatccaagcaaatgcttccatcagcataaactgcaccaaagttcaattatcaaagtcgaatttcctaattggtctattactatgttgttcactgaatgcttgggcttactgtttggatgaaacatccgtgaaacaaaccgaacaatcgggggtttgttcggataatcctcggtgaagtgaagagtcaacttgaaagtacctgatgaacacaacagactgattattttagctataagtttaactcatgacaatatctcggtctgcagcaatagccaataagtactgaaagataattacctccatcccatggagtgtcctcaggtctgcaaacaaagacaatgaagaaataagtttacaaagccatgctttgaagagaaaacaaaacaaaaagttatacccaaagatgagagcattccaatgcatgatattgttatcttgtggagctccacttattcccacaggaggatctttctgcagtctcttgaaatcccacatcagtctcttttttgctggagttgtcattgctgttggaaattcacagactgcatccaaatatgaaagatttcaactttactcttacaaactcatttcataagtcacaaagtaagagcaattgcatgaactaggctttaaatttctgattaaagtttcaattttttttcagacccaaaaaaagtagaagcagagaccaagatctacatttctataacctatcatcatagtttaacaaagacttaagcttcaacaaccatatagcccaaaaggtcagagaacaagaatcaccaaacttctagacaagaaagcttgaagcttggattatttcaactagcaaattaagttcgactcaacgatagtagctgtgtataaattctgaatttaaattctgaatttaagtagatcaagagtacaattatcgatttcaacgagccttaggattagattatacaatcacctatgaaagatttgatcttccgatgtcatgcatcaaatgaaaaagctcgattaacctaaaattacctgaagttcaaagctgcaatgaaaagtgattcgcaacactaggaattagggtttttccaatgtttttcatagaccgaaagagatgatgaaactattatgagtggagaataaataaagtatatatagagggagagagaatcaaagttgagatttttctttcctttttcttcaccaaataaaggaagagaagaagaaaacacaaagaaagtttaaaatgaaaaaatcatatactattttaagaaaataaaatacaaaacttgccagaagaaaaaaacatatatatattttcttccaaagacgaaaaaagacttttataattttaatacaattttaatattattattttttatttgtcggttcgtgtaaaagacaaacgtatacgtctattactcaatgggccaatggcccaagcggacgtgactcagcaagctatcaccattttaatacttatttatctatcaagatttatttatctattttgtaattgacatctgtgttcatcttacaaaattccttggttgatccctggatttgatgtcaaatatcactaatactattgattttccaatttaaatttcaaaagagtaaaacagtagataataatcataaatctctttttttttttgtaccaattttcattattagtttcccttgatatttaactaattactattccattagtcgaattgattagaggaggtctttaaaagagatttactattatttttattttttgctcaacttcttcttcctcatgagtcatgactcatcacatcagggtttataagaagccattagaaactatg

SEQ ID NO: 1501 - DNA, 3000 bp, Unknown
  misc_feature (1)..( 3000): cDNA_ID_1384565_gDNA_ID_1620409_Annot_ID_156226 3000 nt of promoter + ATG
tgcaaaagaccgtgccaggaaccgcacctgataaaagaaagtgaagcgaaatcataaacatacatttaaagatgtaatttcggaaattcagccacaaacatgaaatgtctatataggcatttttgagaacatgccttcaagaattactaagttgttgaaactaatagccaggaaccaaaataaaaaatggtgaagagagtaatgtacctgatcaccacaaaagttttctaaaaacttccgtgtgacaaagacttctccagcagcttgctggtaactctttggagcaaccctttgaattaacctcgcgaagaaatcagcaacctaatagtgtatacacgcatacaacagtagctcagtatgcatgttattcagaaaacaaaaccttttgaattcaagactcgagattcaacaaaaaaagtatgtgttaccttaggtaaggcgagcatatgagctgcctttgtcgagatatctccatataaaaggtatctgtagaaaacaagaccattactatccttcatatatgaaacaaaatgggaaatgacaaaacaagaagaaatagcaccaaacctcaaccaaatcatacctctctggagatttgaaagggttatggagaccatgtttcgggcactgggataagctgtccacaaatggctacaacatagaacagaggaaaactgaaagttagaattgacacggataaacaacattgtgatacgatcaacggtttttgataggctcgtacctgagttcctgattcatccacttccgcaactttgataaacggttctccatttagaggatctagaagcgtgttatgatttgacgatcctatccactttccctgcactatagacataacaatgaaagtagaactcagagacttcacaacagcatttaaccaacaagctattactcatttccatagcgtcaacgcacaatcagtgagaagtaaagacataccaaagctctgtacttcagcaggatgagcaccagagagctcctcggcatctacggtagcaaaaggtatggaatgattcaatctgcaagatccataaacacaaaaattaaggcaaaggaacactcttttaaatggatcacattctcagacatcaaagagtaatcagaacacaaatacataaagtaccatttcaaactctaatcagctaacactctcttcattacatagagactgagcagatgcggctactcgatgatctaaatctcaaatttttaatacaccaacttgctaaagttttctcttttatttatttatatatatatacaaatggaaagtctattactttaggcaaaaacatgcaaccccaaaagacgaagagcaatgtttaacacaaaacaagaaataatttggtgagatcaggacgtttgaaaaacctggagagagtcaaagaagcaagcgaggtggatgatttgtcacagagagacttagctctcagtgctcggctcgcaaaaactctatacattgcgtaagatccacaagtaacggagaaagatgagaatcagacgattggatgagaggattcaagaagattggtgataaaatagcgaattctcgagtgatttgtgtttagcagcttattaaagaattaaatgtttttcccctgattgacgagaaatacattaatgatttaaagatatttacagataatttcttatttctaggttattatcttttttaccccatagtttctaatggcttcttataaaccctgatgtgatgagtcatgactcatgaggaagaagaagttgagcaaaaaataaaaataatagtaaatctcttttaaagacctcctctaatcaattcgactaatggaatagtaattagttaaatatcaagggaaactaataatgaaaattggtacaaaaaaaaaaagagatttatgattattatctactgttttactcttttgaaatttaaattggaaaatcaatagtattagtgatatttgacatcaaatccagggatcaaccaaggaattttgtaagatgaacacagatgtcaattacaaaatagataaataaatcttgatagataaataagtattaaaatggtgatagcttgctgagtcacgtccgcttgggccattggcccattgagtaatagacgtatacgtttgtcttttacacgaaccgacaaataaaaaataataatattaaaattgtattaaaattataaaagtcttttttcgtctttggaagaaaatatatatatgtttttttcttctggcaagttttgtattttattttcttaaaatagtatatgattttttcattttaaactttctttgtgttttcttcttctcttcctttatttggtgaagaaaaaggaaagaaaaatctcaactttgattctctctccctctatatatactttatttattctccactcataatagtttcatcatctctttcggtctatgaaaaacattggaaaaaccctaattcctagtgttgcgaatcacttttcattgcagctttgaacttcaggtaattttaggttaatcgagctttttcatttgatgcatgacatcggaagatcaaatctttcataggtgattgtataatctaatcctaaggctcgttgaaatcgataattgtactcttgatctacttaaattcagaatttaaattcagaatttatacacagctactatcgttgagtcgaacttaatttgctagttgaaataatccaagcttcaagctttcttgtctagaagtttggtgattcttgttctctgaccttttgggctatatggttgttgaagcttaagtctttgttaaactatgatgataggttatagaaatgtagatcttggtctctgcttctactttttttgggtctgaaaaaaaattgaaactttaatcagaaatttaaagcctagttcatgcaattgctcttactttgtgacttatgaaatgagtttgtaagagtaaagttgaaatctttcatatttggatgcagtctgtgaatttccaacagca

SEQ ID NO: 1502 - DNA, 3000 bp, Unknown
  misc_feature (1)..( 3000): cDNA_ID_2137946_gDNA_ID_1620409_Annot_ID_156229 3000 nt of promoter + ATG
tgtttcgccacggattcagctagcttgatatgagtcagccaataagtagaggaagacaagtcttcaactttctttcgagtcactgatgatctgagattactagagacaggtgttgttgtttcattgaagcttctaggaacaatgcgtgatctctttggcttgacttcagaaagagaagtgacgctgctgctcactgatttaacagaagaattgcttgtgggcttgtttggaatcgaaagtcttcttggtggtagcttggttcgatcaacactcttcttcccagacaaatcaagaactgttgtactctgactaacagcagatacaactcgtgccctgagattcaaattcacacacataaatataatccataagacaaattacattgcaacgtttatataaaccataactgatcatcttaaactagcaattcaagatatgaatcaggagaaaatgaccaaaattctgggaaaattttcatcttctctagaattcagaaaatgaacaaattctagcatcatcaatgtctcgttgaatccggatctaggatcattattgaatcaatagtaccttctgggcatagaagaagcagagaaatcaggaacaggaggcttcccttccttggatctaagagccgatctgagaggatacctcagcttcgagtttattgaattacctgttcagaaattttcgaatcagaaaaacattacgaaaactgaaatgggaagtgataatcagatagaaggaattgaagaagatttaccagaagcagcagagctcacgcttttctccattgatttctccattgatgaacttagaaacttttaacgcttttttgttttgtttagactgagagagaaaaaaaactgaagatctcaatttgaaaaactgtgagagcggagaaatctctgacttataataataacaaaacaatctgatttgtttctaagaactcgtggatgacccctacattatttgatatttctcttatagcctcattattttctattaaaccaattctgacccattttttactctacccaataagggtaaatttgatgcttcatttgaaattgaattgattaaaagtttaaacaaatttatttgagtttatatatatttgaaaatattcatatatattagtttgggaacagagataaaggttttagtatgtaaaaacattagcttgggattaaaaatgaagatttctaaagttaaagggtctactttttgaataatccgtaaaacctaaatttctgttgcagtttgccttgagagcgggaaattggttgaaagtctctttgggagaagatagagagagagagagttactctgagccgtccgattcgattgatttaggaatctgagggacctcatttttccaaacgctccgttgtctgtggggtcttctttttgttttgtttatttttcgaaatttcaaattcaaataacgccgttgactgattgattaaccgtttgttatataactgttaagattgaggggcttctttaatatctgacgacccattaatgttttctcgatactgggcttcatttgggttcggtccaatacttttagtactgtgcttttttaattagaagaaaatggatctctaaagtctaaacactcgatcatctaaaaaaacagagggatatgagtcacaacgcttaagctaggttttgccagtttacaagtttatcctctgtctatctatttttgaccataacaaacaaataagaattttaataaattaaacatttctaatcttgtttgtattgtttagtgtattagtgtatatagtaaatcaaaagtgagatttttaaaaaaaataatattctatcgacaacatgcaatatttgaatttgaataagatggtaacacaatgacaatactaatataaaccataagcctatgttatagtcaatggaattttggtcaagctgctcaaaatatgttcttctttatttacgattattgctgccaaatcatatacctaaataagttttcaacaagctatccacataatgcttccttaaaataactttcataaatattaaagattttaagcttacatgaatggtaaaagaaatttcaaaataatataagaaactatcctacctattctcattgtctttgttcacatgtaaccaaatacaaagcgttggtaaaataaaaacatactcctcttagtgcatttgaaaggaaaaaaaaaacacatctgagtggatgtcatgttcttgttcttttttttttttttatctaatcgatagtgtcgctctattccgactttatctcactagaaacaatataattatttgtttcacattataaagaacaatattattaagaatgtatatttaaatatattctcgttttctgagtatgtcgccggtaattaattatcatatggtgtgtgcattactcagtctacttttcttttgtcaaatttctaattacgattaacttaacaaagcttgaactatagctcataatttttgcgtaataaattccttgcaaaatagtatatcctaggttggtaaaattaaatgtcaaagatacctttttggagtatttattccctatttgtaagttcttgatttgatactgtgttaaatgagaaactatttatggctcatggtgattattattaggtgtccattaatgatgatcatcaattcatcacctttacaatattaattcttctcaaaaaagtaaaccatgaaaaagtcaagaatgtcagagtcgttactatcagcgttaccaattccgttttgttgtcccttgatttagctaataaacaaaaatcaaatagatagttttccggtttaatctaacttggttcggttgatttttccggttaatctattggttcggtttaatcatccaaaaccttttggactgtatcaaagactgaatattacgagctttgatttttttagctcggagccgcttcttctttcttcatcttcttcctcctctcaataacccaagttttttcgccg

SEQ ID NO: 1503 - DNA, 3000 bp, Unknown
  misc_feature (1)..( 3000): cDNA_ID_1378800_gDNA_ID_1620409_Annot_ID_156222 3000 nt of promoter + ATG
cagaggactgagaaatagagaaatgtgagattgatgaaatcgaacggtcagaaaactaccaccaactttacttatttaggtttcagatcaagccacgtggctaaattacctattgactcctctcatagtcacggacacgtgttcacaagccctgcttacttcatatagtagtcttgcccaaaacacaaacagagaaagctaagaaaactcaaaaggcggtggtgagtactggtgagagtgtgagtgaaaaaacaaaaaaaacaattcaactgcaaaaatgagttccggaatcggaagtttagtgaaggtcatctttaagaacttcgatgtcatcgctgggtaatttaattagtattatttagcctgattatgattttttttctcgttttattttctccattaatttgatccttcttggtgtgcagacctgtgattagcttggtttatcctctgtaagtttcatacaagtatctctttattttcctgagaatatattatatatgtcaaatcttgagttctttttaatttggattttggtttacacagatatgcatcagtgagggcaatagagtcgaggagtcatggagacgacaagcaatggttgacgtattgggctctctattcacttatcaaactctttgagctcacttttttcagactcctcgaatggtaactttcacacaaaatctctaaacctttcttgattacgcaagctactacttatgaaaagagagtaaggtcacagtcacacacaatatgtttgtttctagggctcttaaaatttgtgataaaatcgatgacttggattttacctaccgaccttactatatgaaatttattaaaaagttggtttggggggtacatagatttacctttcttgtagtccaagtaaggtacttcaggtaacggatgagcttatgtttaacattcctagactgacttcaggagataaactgagctgtatgtaacggtggttcattgattcaattatatagactgaagtttcgagatttatggtatgatcaggatcccattatatccatacgcaaagctagccctaactagttggttggtcttaccgggcatgaacggtgctgcttatctctacgagcactatgtgcgttcattccttttaagcccacatactgttaacgtatggtacgtgccagccaagaaggatgacgacttgggagcaaccgctggcaaatttactccagtaaatgattccggtgcgcctcaggaaaagattgtgagctcggtatgacctcttaactctctattactctataagaccctatttgtgacctaatgttcgatctataaggcacatcaatctcttgaacgtttatattttcaggtggatacatcagcaaaatatgttggtcattcggcttttgatgacgcctatatctactaggctagtagctagtaaactacttccggctagttgtagctgagcatcctgatcttagtgtatcgaaatacttgttttctcctctttttctttgttttcgggttttatgaagtttgttgttactgctaaggaattttaatatcaaaataaatgttaattgagtgagttatataattatgtaataaaatctgagcacaaaaataatagtgaactaaaaggtaagagtctagactagctatgatcaatttagtatcgtatattgctttcttcctcgaccaatgatgagagaattcagaaacgaggttttgatagcgtagctcaccgctcagtcgctcacgggctcggagtagatatattttctttcaatattcgtcgacttactcgactataaacaagcagtatgaagaagagttgacactaaagaaatggtaaagccaaaaatcttatagctgtaaagagaataagaatgagtaggtgtactagccatatattcgttttcttaccacgttaccaaaagcattgtgtgtttgaaccggagctaattaatttgattctattcacatattgtatttacatacatcatgtgaagtctgtcatggaaataaatgtctcttttcatcgtcacgaaaatatgtttaatttgatgttgtcattcttaaatgattttctactttattgttaacaaaagaaattgatttcctaccttacacatatcttgttggtaaaatagacaactaattttaataccctcatctcaataaatgctatttacactaaataaagtctgatatgagaaatgttacagaatgcaataaacagaaagaaataaaaaaaaattgcaacaaaaaatcattctcaattggggaagaaaataaagtcgaaatgataagtttcataagaaatgtatattttaccatgtttactaaaaggcaagacccacgtgggaaggcgttacatattacacagtccaaatcagcatcgttattattgtgaactctcacattagctgttaccgaaactaaccaacaacaagtttttgcctctttgaggacatttaaatatagagaaattgtttctttctttgattttttaaaaaataaaagaaaaatcaaaacttagtctattaagcatcggtcattatcacaaatgtaatcctaagcatccgtatctaataagttaagagtaatttatccacacatagagttttttttttaaaaataattatttattttctttaagtgtaacgactaataaaataagttataattaaattaagaatcaaattctctctatcttttgcactttttcttctttgtctatctctctctctctctatctctaacctttgcttctccgtccttttctctgcttcagttttctcttcctaacaagcaaaacccgaaacagatcgaaccatttttttcctttagaaattaaacaacaaaaatcatttttttgtttgttttcggtttcacctaaccaaattgattctcttacctttttatatcacattgcatctgggtttccattagaaacaacaacaaacgaaaaaagaggcttctttcgtttcagagaggggttcaaaa

SEQ ID NO: 1504 - DNA, 3000 bp, Unknown
  misc_feature (1)..( 3000): cDNA_ID_2781806_gDNA_ID_1620409_Annot_ID_156211 3000 nt of promoter + ATG
aggaagaagagaacggaggtgaatcgaagaagcagaaggttggagaggaagagaagtcaggtccggttaaacttggtcccaaggagtttgttacctctgtggcgatgttcgattactttgtcaagtttttacacttttggccaactgatctcgatgttaataaggtaatacatatttgggtttactcttcgtctttgtcttttggctttgtttattgtaaagtttcaaattttttggaaatattcattcctttgctcgagacttatataggttaatctaagagctctgattgtgattattaagttctgtgatgtgtttaggaagatgttttatcaatgaatctgatgatgatcgtgctttgtatttaaactaaaagaaattgagaattgggttcgcctttgtattggtcatatgatttgattttggattcagtgtttggtgttagaattttgtttttgtctcaaattagtggttgtttacaatgattgtggatattgtattatgtttagggagatgattgtggatattgtattatgtttagggagaggattagtgaagtggagatagcttgtaaattggactcctttgcagcttttttactagttgaaaagttcaaatgtatcgtgttcttactgattatatgattgtggattgtgtgtgaattagaaagtttttttgggtcttgatgtcatataatggttagaagaatgaagttaatgtcaaattttgagggcacaaataaaagataaaacattgcatagtcatgtaatatattacagttgttgcagtttcttttgagcttccaactaactaactcgttgtactgaactttgttctggattgtacatttcagtatgagcacatggtgctgctagatctgattaagaagggccattctgagcctgaaaagaagattggaggaggaatcaaaaccttccaagtaagaacccacccaatgtggaaaagcagatgcttctttctggttagggaagacgatactgcagacgatttcagcttcaggaagtgtgttgatcaaatcctcccattgcctgaaaacatgaagactcctggagctaacggcaatggacatggtggaggtcgcggtggcggtggtggaagaagaggcggtcgtggtggtggtagaggagggagattcagaagatgaatatgctgacacttgatgccttatttcaaaagaaaattttgaaaatttcagatttagttcttttgccaaaaactttaaaagttatgatcttgtctaatgcaactgctttttgttggagaaaaattgtcagtttatataacccattattgctgaagaagaagaatattgtccctactatcttgacaacatcagaaaaaaacacagacgcgtcaatagaactaaaaatctggttgatctagtttttaaaaaccaataattcaaaaacgaaaaactcaaatcaaaatctagatgaaaaaaaaacactttccattgatagtgtagtgttgatctggttgctaaatgataatgttaaataaaaagaattggggaagttatgaaaaaccgacattttgactttggtaacttactgtgtgtgacatgttcaccgtttacgacccttctaagagaaagacaatgccctcaaactaaagctgtcttaaatcttaaccctgctaaaaaatgattacatgaagtgataacactggttggcacacgtcttggaataatggattattttgaaacacattatgaattataaagaaacattatccgatattcggtattcggattaatattccaaattgtcttcttacacaatatacaaatagacacatacacaaattgtcttttgaagatgcaacaaattttgttttgttaagccttcttagatttaggaagcttcttaactacgatcttactgcaacacaatcagtttgtgaaatctatgatctgaccaagatgcaggtgagtaagggacctacagtagaagttgacatggaaaaaaggcagagtttggtaaatcataaaatgtggcagagacctttttggtaatagccaatgagagagcacctcatatctattaccttcttctgcagtcttcttatcttaacgtacaaccgttcacttaatgaaattcgtcaatggatgttatatggttgtgaagttttttttttgtttttttttttataattgattttctattaatggttgtgattaatctttgtgtataaaagaagggtatatgtttctccaaaccaaaaagtgtagatcgttttcaaatgaaggatttttatccttctaccaaccaattaagaaattgcacgtaacaagacagctctcgtgtgagctgcaccaaagccatccccgcgatgctgacatttacctacccaaaagtttctaaacagtttacataattgtttttttttcttcaattcaacaatagatagataattgttaagatatgttagaaatcttatatcagtattatatataacgaagcgtgtttataaaaacactttttctgaaaactttattgcatcctcgtaggagcacttcgttttttatcgttcaaacttgttatgcatttgttccatgtatataactacataagacctttttgatctgtttggttaacggaaagtttagtgaaaatctaaaacatataaaaaaatcgattcttcgaatagttttgacaaagtttaaagaaaataacaaaagattatatgctatgggttttaatggggtttgggagaaaagtaaaatatcagaggccacataaacttgtggtctagaatcaaaccaaaatgctgacctggcatccacttcactttttaaaacgtatcaaaatcccaaatctcacgatttccaaaccaaaaatttccaaactacccaaaccccccacaaaacatcttcgaagagaaacaaaaaaaaacaccctgaaaagaaaggaaaagagacacagagagtcagaaacttacgagtaaaaaagagcacatcttaggaaaacgataataatg

SEQ ID NO: 1505 - DNA, 3000 bp, Unknown
  misc_feature (1)..( 3000): cDNA_ID_2138015_gDNA_ID_1620410_Annot_ID_156243 3000 nt of promoter + ATG
acatgttgtagtatttaaagtcactgaaactacctaacgctttttaaagtcattttcaattttatgttccaacatgcaaaataatacagactttctgttttgcgcatgtttttgaacttgaaacttagtggtagggtctccccaagaaccagttacactgttacaggcatataagcgtataattaattaatatatttaaatgttcaaaacaaattgaaatcaaaagttcttttcatatatatatatactagataaggtccgcctatttaggcgggtgtacccgaaattttcaaatattcgaacgggtctaaacttcaaaatctgaaaaactcgaacccaaacccgaagaggtatccaaacatatttcaaatataagtatatattagttatatttatacttatatatagaaaatattaggattttttggatattttagttatttttgtgtatttttagatatattcaagcaaaactactcgtgttgttttgggaatttttgaaattttaagtaatttaatagatttgcacacaaaatttgatatttcaatatataaataaactcgaacccgaacccaaacccaaaccgaacccgacccaaaatcttaaattacccgaacgggtcctaaacttctaaacccgaaaacccgaacccaaaatactcgatccgaatacctaaacgcctagggctaataatgaataaaaaaaaagaaatccacaaaaatatttagaaaccaaacattgttgaaaatatattttctatatatgccgtaatctcgtaagttaattttacatcatgcaaattaatattaaatgagttaaaattaataaatgaaaataattgaaaagttaaatcctataaactaagctatttttctcaaaatgttctattttcacttatgattacatgagttaaagacaaatttgttaattttctttttgttgaataaatgttaattgtttataaatatatagacatataaattagtatatgtaaatttgtttactttttaagattttctattttttagagaataaaataaataaattttgaatgacacatgtaaacatctaatcgtttgacttgacacgtggtacaatcctttgagttagcaactttgaaaaccatactttatataataagatatttatttttccacaagttcttttcttataatgaactggactataatataaatttgaaacaatatgttctttatttgtgggcaaaactaaaacggtaaaacctatgaagccgtttattttagaaaaaaattgacagggtcctccactgatggctgttggtaacacattcatggttcatggatgtaacgtttgtcctctgacccaagtcatggcctctcccctttcttgtccttttcggtctttttctttccttttcacacagtcagctttatccttgtcctcactttacatttacaactttaccctcgtcttgattctcgtctaaacgggtccacaggatggacttttaaagcgaacaagaaggcccatgaaactttttgcttcgttttccctaaaacaccctataatcttagacctacaacaagttatacacgtaattaacggcggagattagggtcaatttcgtcatttacataaataattattgtcccaggaagacttataaaaagtcaagacagttaagttttgattactatatgattatatgaatcatatggctgaatattcagttaagttcgttttcaaaatacacatatagttataaaaggagttgttttatgtaaaaatataaagccttttgttttatgaaatgtataaatttgcagtgtaccatttttaaattgtttctgtcatttatgtttacgaaattagaaatataaagttttttggttaggcaatgataagacaaatcaactttcattagtgttaactgatttaacgatttcgttatctaaacattttttagattgaagagtgttttgtggatcatcttataatcagtttctttctgtatttaatcacataatatgtgggtcatctttctgtcaagtgtcaatgtggtttcatattttttaaggaaaatcttgatttgagaatgagtaaaaatatcttacgaaacctaccattttaacgaagcatttaatgtgttagccgaaaaagttgctcaaattgaggtcttatcgtatctatgatccgttcatttgtgaacaaaaaatgcttgtacacaacaaactgagatcctagatatataatgaagacatactttttctcctaagaaatagatcctaattaaatgttgacaaaagaccggatcaatggggtcggcgaaatacttggttataaaaaaaattaaaaaataatactactaacacaaattttaactatacaaacagagaaataaatatttatcaaaagtcaactaaaaataaaaaatcctaggatataacccctacattttgattcaatacgtatttaatttaaggtggatatatatacttttatctatttaaaccagatataatcgaatgaaataaagagctaaccggatgtctgaatatatcttaaagggagtaatttgattaattaaaaagttatgcgtaacaattttaatgaaaagaaaaatacatgttgaagaactcaaaatagaccaaaatacacacacaaaaaaagttttgttttttaatatcctccaggaaggaaacgagagaggaaggtggggctttaaagagagacccgtggaggctctactgaagcgatgcgtggaacaaagctgacacaaaatggccacaccaacttctccttctccttctccttcttcttcttataacaacaagtgatacattctcaatctctgattcttctgattctcaaaaccctaatttccacacgctttctatcatttccacccaaaaggtaacgcgctttttatttcctttcctgcattcataaatttgtctcctgcatgttgaaaaaaaaaaatttacatcgagattcgtttttattttttagagagagat

SEQ ID NO: 1506 - DNA, 3000 bp, Unknown
  misc_feature (1)..( 3000): cDNA_ID_2106824_gDNA_ID_1620410_Annot_ID_156247 3000 nt of promoter + ATG
ccaatcacacattttcatttcggttttaacatatactacaactttaccataaattacatagaaaacctatgagcactcaactttcttttccccggttaatgttaaagatcgaattacattttcggtcttcttttctttttgttctttttcgagttggtgatagttttgaaaaatagtgtccttattaggtgtgtctacgaaactttgagacagttggttggatgggagttctctcttgtcctatgcttcatgccctctcccgtcttgtaagttgttactgttttaatatattattcctaagtttttggacacatttgagttcatataaactagtacatcatgtacttttatattaatttattatttataaaaatatgaattttaatatatgaaatcaacggtggaggatatatgagtcgaaccattgcctattcgagaaaacaaattaagaaataaagcaacaacctaataataatggatatgaaactattttaagcgtgttgttgctaaagtaaaagacaaaatctcgttagttttcagttcttattgattagcatatattaagccgattatattgaactaaaaatctattgatttatttctagatttagttaagccatatacgtacctacatttgaaatccatagagggtaagtatatttggtactatatactattaatgctctttatctagttactgttcagctacaggtgaaaatcaaatgaaattagcattgttttggtcaaaaaaagaagtttagtttatatgataacgaattcgataggtaagtcaacatatagtgaatgccaacccatgacatcaatgcacacattaccatttatttccttttactcttttatggtaacgtaaagccaaaatttatttctttatttcttgtagaaaatttaggcattaataagaaatttatattaacatcaatatagtcgtcgtattcatgtttttattgtgcatgtgcgtttgatgcgacatcccattcaatattagttaactaataatacatgcatgaacatgtgtttgagaattttgtgatcatgatacggggtgcttcatgcatcatcatgatgatgatcatcatacatgttagtttggaagtccaactttcttttctaggaaagttacattcgagttcgaggaaactaatggatttatagataaatctcatagaaaagtaacttaaagctttcaacacgctcataaatctcatactctttatcctttttcttacaataaaatattgcctggatttttttttttttttgtagacaacctttttcactttacaaaaataaaaagtttatcatattccgttaatttagcgtgtaagcagctttctttgtattccaaagtgcattgaagtttttaaattgaaataattgaactaaataaactaaatagtggtggtttagtagacctagtcattcgatttacgaagttccactgctaattctacattttgaagattcattcgtttataacatagttaatttgtatagtcggacaggggttaaaagagtaaaagataaatctgtagattaattgaaaatagtaaagcaagaaagaatggtataattcaaaggaactcactaaatcaattattgtttgctgatgtaataagagtttggtcgagagagataagaaaatggttcacgaagaagacacatgattttcctcatttacatcgtttcgtatcaataattaaagttagttgcaagacaagaggtcgttcttcatgatacattttggttaatgaaatgtctagcatattttaaaatttcaaatggtttagttaagacaatattaaaataaattatggatcaaaatgattccctttgtttttttttgttgcataggcttgatgattgtcgttggttcttaccacgtgggctttagtagggcatgccaagaaaagtggaccaaaagatcataaaagaaaaaagataaaagataaaaggagaagaagaaaaaaagataaagaaaaaggtttaaaaaaagagaaaaattaaaaacacattggaagatgttatagatttataatgcacatcatcaattggataaaacattaaaacgaaactgtaaccgaatattcgaggattctttactgcatgcatatataatttgttgttttcatgaagcactttcttcagataccttattattacatgcagctatgcaaaattatacgtttacaaatccaagctagaacatataaaatattcatttacatggtacatttttttctttgggtaccatggattgatcaagaacaaaaagttttaggcacatgtttgaagattatcattaaagcatatctatatcaagctacatatttgaagattaccatctcataaacaactaacacggattaaagaaagtaactaaagatacattgtgactataaattttgattgagtctcatattttgtagtgtgtaaaacttttctccatcaacattttgaagataatgtccatcaattttgtatagaatggaacttcttttcaataaatattcgtttgagtgttgttttcctttgatatgaataataaaaatgttttttaaaaaaaacttcaatctgaaaaatcaattgatagttaataaaaagaaggtcttgcgaaaaacttatttgatatgtctattgccaaatgttttcaatatgatgtgtctcaaattgactcatcgatctttagtttagtcctatttcttggaccatatagattctttggatttgttggactatgatatgaataaaagtatactaattagttcccttaagttatggaattaaaaacacattacaatattagagatcaatttaccccatacttacaatattcagaatttttattattatttttcattttaggacttatatcatccatcatgttaatccagtggtcaacaaaaaaataaattttaatcgattagattcattcaaattatcgattgaactatcatcatttctaaacaaatttgaccaatg

SEQ ID NO: 1507 - DNA, 3000 bp, Unknown
  misc_feature (1)..( 3000): cDNA_ID_2138062_gDNA_ID_1620410_Annot_ID_156257 3000 nt of promoter + ATG
ggaactggccgttttacttatcgttgtatcatatttgataagattttaattttctgggatttttttttggttttcattgatgtatctaataaatttatatatatattgattgggcatacaaaaacctcttgtcttcatgcttcttagattatgcgtttttcttttgatttaatcctttgttaatgtgtttctgtacgtatgactcattagtcatttagtagttatgaacaggttcagtgtagctaagctccgccgtgttagcacttaaataaacaatagtaaaatcaatttcttatgataccttaactatcttcggaaacatatgataatatcgaatataaacaactatttattccacatcaaaagcatgcactaggcgatttaaaactaatgatatactattatagcattagttaatttgtattaacgataaattaagataactcgaaagagtaatcttaggtttgttgatgataggcttgagatatgttagtggcgaattagaaaagattcagagggaattgtacggaaaacgagagagccgtgccgtcgcgtaaaaacagtgcaaagcaagaatagacgagcgatttgcgcagaggacccacgtgttagtgacgagtctcatgcgcgacatgtattccacgtggcttaagatgtgtcccacttcacgtgtcgtaacgtctatggctgacgtacttataatatcgaagtcggttcgtcgtttactctaacaccaatcgctcgtagacgatttcaaagatctatctagccgagagagaacgagtacggattctctgattgtgggccgttggatcaaagaaaactcactgctcgtattggtcgttggattggattggtgacactaggaatcaatggtgatgatggagaggggtccagattaggtaggtggtggtcattgtagggaaaacacttgagaggggagtaggtccattaggacatgtgcataagttataaaatctcatacaaatcatacacgggaaagtttggttgggcggttgggagagtttgggattgtctgtgggttggtgtatgactccaccatgttcccctaatcatttttccttttattatttcatgatttcttacttgtattttctgttttttttttcatcgatcgactcaattgtttgacaaattagctagaagtagttcatggacatttttattcaaatgcgggtttagtcctatatctataatgatggccctaagagtgataggtttgaacgttttaatagattttttcgatagcaagactctttacacttcgccatttttaacattttttctttggctattttgtagaatcttctagaactcttaaaatcttgtaggatggtttagagattctaaagaagtgcggaagaattcaaatgatcattagcacttttcagattctcctaaatcataaatcataattaacttcgtatcaaacacatttactttcaaagatcctaatctaagccatgttgatggaaccattgtgatggtgcgacttggtttcatgcatgttatgatgtaatacgttctcgacacgtgaattatgtctgaatgaccactggtcaaagtgttttttatgttgaatatgcgtatagaatttggggaaaactgttgaaaaatggttccaccaacaaaacctatttttaatctcacattgaaagccatacgtatcaatggacgtcgatatctaaatctaagctccaaagagccgatccgaaaccaacacatggctgaagtgatcacctgctaagatagaaaagattagtgtaggaatctctttagtaaatgtcgaagttgaagattaagtcaccatcagttgacaatgaactcagagaactccaagtatcatgagacaatgacaattaatgaagaaattgaaacttgaaagttggaacggttgacgtcggtgggattaatgtcacatatgtgtaacatggcaatagaaaatactaaaacttaaaatgaatattgaaaagaaagtctcaattagtacgtatgtaaattgttcaattgtgcattatcaagtttacattagctgaaatgacaactaaatgaaatggtgatgcgatcgtagaaaagataagttatagacaaatttagagatttaacatttgcaaagaatcacttttaacatacaaattttgtattgtggattatcaaggtaacattataattgattagctcaaacttgtatttaggtatagtaggttgctgagctgggattacaatgaaacagctgtattgaaagacttggtaagtggtccattcttagtctttgaatcgaaggcatggttcgatcggaactcgtcctaaccgtatttcgcattactatttgtatgtaacagagtctaatctctcttaacttaacaacacaaatcccataaaaatggatagaactagcaaaataaaaatcaaagaattttactgaagttactgaactttatgattgtaatgatcaacagtatcgtctttacacaaaaaaatatatgaagaagatgatacacaacacatttcattacaccatctgatccatctccatcttcaagtataaactcattcttatttagtttacaactattttttgtcttttgggaatcttataaattatttcggggtaattaacgtcaataaaataacttacacctaccgatataagactaaggtgaaaaagtatacgttaagaaaagtgaaaaactttaacaaaagaaaaaattcaaatcagaatcactaacccggtaaaaatgtaaaaccgtttcccggacccaaataaggacctggataacaacccagacccgaaattaagtcggatccggatctccttgatttattttttaacatttttgtctttcccctggaaatttgaaactctctcttctttttttgttcttcttctcattggttgatcgatacgcgctaaatttctagaaatctcagatccataaaattttccgaggagagattctctaatcagagaacctcaca

SEQ ID NO: 1508 - DNA, 3000 bp, Unknown
  misc_feature (1)..( 3000): cDNA_ID_3062724_gDNA_ID_1620410_Annot_ID_156255 3000 nt of promoter + ATG
aaatgaaaaggaatgttgacgccatctgtacataggtgcacacatacaggtgtccttagctaggactaggagctgctggttatttcacaatccatacggaccataccgtcaaatacatgtatatatagacccactttttcatcctatctatataataaattccaaaatgtgtgatacgagcatctatctagaaaaattttatgagtgatttgtttagcatttagagctataataaaataaaaataaaaagaatatataaaaatagtaagagcagtaacatactatttttgggcagagatactatactcttaacaaatatgaagagtgtttgctaaaacgacgagccatgtcagtgagttaagtggaaaggtcaccatcaatgctcaaggttcagtcgtcggtggtcggttgagatagcaaagtcttcttaaggcccatgggtcctagaccgttatatcatcatcacctctgtcacgtgatcattgggcccactaggcccatctcccatcaacatctcacagctctcgtctatcatacttccatttattgtacaaaacacacgcatactcacatacatacaaatacacacacatacggctggataacaaacagatcgtgagatgttttgattttgatagagatatgaaaggtcgatgtgttttgtgtagaaatgtgatttatattgaaaatatcgcagatagttgcagatgatgatctcgatagatcatcaattcattgtctaaaagatcttatttgtgcgtaccaaataatttgtgatattgaatgctttcttttgatgtaccaatttatctttttgtcgtgttcaacgatcctactatattatttggaaagtacattttaaatgtaaccttaatttttataattaattacatgacaatgccattagaaaaatttaatcaaaaacaaaatcttttaatgacgtcattaaggttaccaaaatcatttaacgataatattcatctcttaattatagggtttattggatctaaagacggatcatcaaagatttcttaaactgaagcaaaatatactgagtattcaaatatctgcctgctaccaaattataaacaaataagttcgtaaaacaatttaatattttatatacgaaatcaattaaatcttaatcacataaaaattagcacaaaaaaaaaatattcaacaattgaaaaatttatcaaatctttgtgttatataatttttgatactatattcgaataaagtgtaatataccttttcaatttgtattctttaactaatttaagctagctaatatatttgctaatcttatacctatcaaaaccgactatcgttttttatctctatagtatttttgcaagacttttttggtggatttgggtaaaagtgcattcgggtcatatagtacattcccctattaaataaatatggtgcactcctatgttattagctaaaatatttagattataattcagagtcatatcataaattaaattcatattaataaaataaatgactttttggcaaaacggatttggagggacgggtttttgaatcaacattaataaaaaagtaaaatataattaatccaccgtttcaatacgggttaaatctttaatttattattttttaagatcactaatattaaacctatcaaatcatcctaatttagaaaaaattatataaaaccaaaaatgttatgtggtatgtataatgttactatatataaaattaaactataaaatataaatatattagagaatgatacaaatttgaaaaacttttatatataataaataattcttaaattttaaaaattactacttaaaaaaaaaatcacaggacgggtaaagaattacagaacgggttttattttggaattgggttatatggtagatgtatttgaattaatatttataaaattttaaaatactattaatatgctgtttttataggggttaaaacttcaggttttttaacaattttctcatggattcgtggtatagcgttccttaataacaattataaactgtaaaatataaatattttataaaaataaaatttgcaagttttaatatatattattttaaaaaaataaatcataccgcggtataccgcgggttaaaatctagttaacatatataggagtaccaggcggtacatatcttacaataatatgattttatggaaacataatcatcatctttttgattagaaaaacaaaaaaatcatcacgccatatgaattttactagattatcatgtttttatgccctattttaatttattgaatgactttttgagtacgggccttctgatgtataaagtttagtaagatttgtaaacctattcactcaaattcaaatatatcgatgaatcgatcacatatttatgcaatgcaacaacagcaaacgctaactatcatggttttattgactatttgaacttacgggagtcgtattttgggtgggtcttaggttataagagcgccttattttcctttaacgatgataacaaatgaacgagagaaaagctttaactctgtttttgtaatctttgttttttaccttctttttttagcaaagtttacagacttaggttcaacattttgcaaaaccccaacacttcattctaatgaaattcacattcctatcagaaaaaaaaaagagctttgatttttttccatatcaaattagaaggcccgtactcaaaaagccttctaaggtccaacctcaatgtttgaggactcatgacttctggttcatgagattgactgtatatgaaggggaaattacctaatttttttatataaatttataatttttcaaaaatacaaaaatgaatttaatatagaaatatataaaaagacaaaaacctagtcttcataaattgattctaatataaaaagttgaaagaaaaaaaaaaccaaagatagtacaatcatatagtcagagtcaataatagattgagttttcaaaaagaaaaaaaaaactgaaaacgtatg

SEQ ID NO: 1509 - DNA, 3000 bp, Unknown
  misc_feature (1)..( 3000): cDNA_ID_3062738_gDNA_ID_1620410_Annot_ID_156246 3000 nt of promoter + ATG
atgagaattaagtcagagaggagacgtaccgtacatcttccgcatcctaaggacagaacccaatgctgtgatctgtacggttataaaataggagtactactttaacagataagtcaattaagttatcgttaatatatttattatttaagcaagtcaataattagcacctatcataaatttttatatgagcacgataagcatcaaccactttattggtgaataatcccacgttgtttcgtgaaaattgccgtcattggagcgcgactattacattatacaactaaaactttctgaaaatttacaaaaaggagtcataattattcacgctgaataaaaagtaaatctgtttttaacctacaacttttgactccaatctattcacaccgtttacttttcaattaatccacttgaaggtatatactagtgatgttcacttcaaaagcccgtatctacgaaatccaaaccaaattgaaaaatccaatctaaaaacttatctgaatctttttatctgtcgaattcgttgtaattttccctatatcaaacaaattacaacctgaaccgggcgaacaaaaaaggaaaagacaaaaactgaaatattttttttgtatagctttttgctagtgctaacgttaagaaattctcaacattgtttgttttgtctgttaaagttttttttatatacaaggagttccactaaatagtattatgaataatagataattaagttttaattatggtaatttgatgaagaactagactctatttgcattgtagttttacgtatacatgaaaagtagaagtctaccaagttgagcaataaacattctataaacttgagaagtcaatgagccaataactcctgtaatgaaaaatagttagagacaattttttttgtttgacctttccacaattttcgattcttaacctataaacattggacttttttagttgccttcccctacatgtaaaaacaatatatatatacatttttgcagccattttgtgaaataaattctagagttggaacttatttacaatggctgccactggattttaatgtttgtttttgataattagaaaaaaaatcttcaaattaaatatttgacatttaacaatcttccctaaatctctccacattaactacacggttagttactaaaattaaacttccaaaatatttaatatcatttaattactacacaattatcatttttgatattgtttttctccatgactataacaattcgattataatcatcaaaccgtagagatatttgatagcatttaattactacaaaattataaaatatttagacaataattcataaaaatatcataaataagatcaatattaataaaataaatggtttttttacgggacgggttggcgggacgggtttggcaggacgttacttaataacaattgtaaactataaaataaaaatattttatagataaatacaatttgcaaagttttatgtatagtaactttaaaaaataaattgtttccgcggtgtaccgcgggttaaaatctagtatatatatatagaactaaaaccattacaaaaagaaaagatttcgcctttttaatgatggataattctaaagcctataagacttaaacttttatttaaaatctacagtttgttgcccaaataaaatgtgataagtatagagataacaaaatataaaattatttcttaccaaaaaaaaatatatatatatatatataagactattttaccgtaatttattgatgattgcagacaatacaagatatctctagtttacaaaaatatcatcaacaatattcgagagaatagttcttttgagtatttgcggatggccggaaacaacaacacttagaaatcatatttagtaaagaattatgtttagagtttagactttatagcttatatattatattgagatgatagatgattataaggaaaaacataaggaagtcaacttatcataacgcttcattgtaaggatatgcgaatatcaaaggcggaaagatttagaataagtgaataacccataatttcataaacgttagagcatttttttaggaaattattttaagatagcaattatttcatttggtgagtcgaccacatggaatcctcaagagacaaatgaaaaataattagactttttgacgatttttgccttcattgatacgtacggcctcttaggctttttagctatttccaatgccaactgtcaacattcgtatctctttcgccattttagtgaaattccacaaagtcattatctttgatgtatataacttgccaggctgctactataccaaatagatttataaatattatttttagatttcttttccatactttttaattctcaaacgaaactttatgcaaagttgaaataaagttttcttctgcatttcacttaaaattataatttgtcaaacagaagtgcaaacattgattttctgactgaaaatttttcaaccttacaaaagttgcttgaactttgtttagaaaaaagaaaatactaatacttgataaaccctcacggttcctattttaaaaccaaaaccttcaaatcaaagactcaagaatcaattcataaatgtgtgagacaaaactcataacccaaatatggtacacgtacgtatgaaacgtacttaaatgctacaaaagaataatatgtttagttctcaaatttaaataattttttccttctatcattactaatcaaaattacaactcatatctatactaaatgctattatcagctaacaataataaaattttcacaaattggtaaagtccttattaacttttacttatcttattcaaatctcattattggacccacctaaccctacccaccatatgatattggtatcccctctggcctctatataaactttgcatttctctaatctccaacttacaccaacaaaacacaacaaagaccattagccttctctcccactcagagtctttcatctcactctcgccttaa

SEQ ID NO: 1510 - DNA, 3000 bp, Unknown
  misc_feature (1)..( 3000): cDNA_ID_2137973_gDNA_ID_1620411_Annot_ID_156263 3000 nt of promoter + ATG
gaagccttaaagatcttgtgtcaatgtgctttcggaaaaaactcggcaccagaaggatacaatgatctagctgttgaagttgtggaacttgcaggatatcttcctttaggtctcagcgttttaggtgcatctttgcgagggatgagtaagaaagagtggataaacgctctaccgcgacttagaactagtttgaatgggaaaatagagaaactactaagagtatgttatgaagggttagatgagaaagataaggctatctttcttcatatcgcgtgcttattcaatggcaagaatgttgatcgtgtgaagctgttgcttgctaagagtgcattggatgtagaatttggacttaaagttcttgttgacagatctcttatacacatagatgctgatggatatatagtcatgcattgtttgctacaacaattgggtaaagaaatcactcggggacagtgtctcgacgagcccgggaaacgtaagtttctagttgattctttggagatttcagatgttcttgcagatgaaaccgtaagctttttgagacatgctttccatccaagtcctactcatcacaaaatccacttttagctaactaattgccttctttcttaattgtggtacatttgcagggtacagaaactgttttaggaatatcattagatatgtctgaaattgaagatcaagtgtatgtaagtgaaaaagcctttgagaaaatgcctaatctccaattcttgtggctatacaagaatttcccagatgaagcagtcaagttgtacttacctcacggtttggattatctaccacgtaaacttagattactacattgggattcgtatccgaaaaaatgtttgccttctaagtttcgacccgaatttcttgtggaacttactatgagagatagcaagctggagaagctctgggaaggtattcaggtagcttcttattatatatcttaattcttggtctcctcttataaaatgcctttctatttatacatattgttttgctatctatgttctcagccactgaaaagcctcaagcgtatggatctgagtgcatccacaaagattaaagatattccaaacctatcaagagcaacaaatctggagaagttgtatcttaggttctgcaaaaatttggtcatagttccttcgtcttgtctacagaatcttcataagctcaaagtcttggacatgtcttgttgcataaaactgaagagtctgccagacaacatcaacttgaaatccctcagtgtccttaatatgagaggatgctcgaagctgaataactttcctttgatttcaacgcagattcagttcatgtctctaggcgaaactgcgatagagaaagtgccttcagtaatcaagttatgttctcggcttgtctcattggagatggcgggatgtaagaaccttaaaacattaccatatttgcctgcaagtatagagatcgtggacatataagacaggagtggaactactatacatcgagcatcttcatataccatacattactgaacatatgtatcataccgtacgtttgtgtaattgaaaaagtcatattttcagtcaatagattgaccagaagcagaggttttacgaaggaaatctttttttttttttttaagcaaccgatagagacagagaagaagagagaaatcgaagcaaatgatctcctccacgtagactgacacatggcagcacataattcactactcactagtttgactcttttggagaagttggaaggtggctagaaacattattggccatattcttcgagttctatttagggtttctaattattttctcgattttctttattggttttggcttcttcaacgatttaggttccgttgatttatgtttaggtaccagcaaacataatacagtaacagcaaacaccgccggaggtgctaataattaagctcctgttttcaagccattgtttttttcccctttttgtaagggttttactaatatatttaaagatttttctaaactcaaggtctatattcatgaatttttactttctttcttacaatataaagttaaaaagttgaaagtaaacttcaaccatgggatatatatacccttgtagtccacctataagttagaacgttagacctttatttcagaagaacatgaacaacattgaagaaaaaacattcaatttgttaaataggaactttgcaatgaacctgaaaacaaaacaccacttgtaagacttaagcaattgttttaaagaatattaaacccatatcaaatgttggatgtgaacttaggagaaatagtcctgctttgtttgttagcattgaatctcacaattaatttaactgacgtggtcttctaagcaaatgcatgttcacttattggatgcacattttgtcttttcaagacaagtcttgagaagcaaatggcctagcgaagcaagcttgcttgactcattgcatttactgtcacttattggagccaacttcacttacaaaatgaaatgaagatcttatctgaattatcgtgtcaagtctctgactagtcaaagtgaacatgtgccctccctttgcgaacggagatcttgataaagtaataagattatgtatttggatctatggctaattaacagatacttttaatcaaattttatccattggttgctatatctagttgcactaaatcatcttttattgacgacacatcaacaaagttttctttttgtcttctgccatattatgtaggttgatgatatgctgaatgcattttctaatagtaattagagatattctttcattcaacagactttcacaatttgacattttaaattattaagtatgatgtggatctagatctgatatgtaaaaaaacaaaatagtgataataccaacggagatgcaatattgcaatgtatgaaattgtatatcttgagtaattcttaaagtgtatatatattgggtggtcttcaatttgtagaaacatacatcaaacctaaagcagaaaagaaatg

SEQ ID NO: 1511 - DNA, 3000 bp, Unknown
  misc_feature (1)..( 3000): cDNA_ID_2137985_gDNA_ID_1620411_Annot_ID_156266 3000 nt of promoter + ATG
agatggtgaagatattgtgcttgagtcagaagatacaatgagttgggcttcggcgccgcgatcaccgttaccggaagttatcatttcaagatctgtatccggttccatacccgaaaccaaaaacggaccacaaccactacggagaagcgtatcggaaactgcaagctacacatcagagatctccgacgtatcaacgatcgaacgatccacgtttgatttggtggagaagatgcattacgtcttcatccgcgtcgtgaaagctcggtctttaccaacctccgggagtccagtcacaaagatctcactctccggcacaatgattcaatcaaaaccggctagaaaaacctcttgcttcgagtgggatcaaacgttcgccttcctccgtgactcaccggatttatcttcctctccaattctggagatatccgtgtgggattcatcgacgggaatcgaaaccagccaattccttggtggaatttgcttcgacgtgtcagagattccgctccgagacccgccggatagtccattagcgccgcaatggtaccgtctcgaaggtggtggagctcacaacagtgatctaatgcttgccacgtggacaggaactcaagcagacgaatcattccccgacgcgtggaaaactgatacagccggaaacgtgaccgcacgagcgaaggtttacatgtcgtcgaagctgtggtatctacgcgctaccgtgatagaagcacaagacttgttaccgcctcagttaacggcgtttaaggaagcgtcatttcagttaaaagctcagttaggttcccaagttcagaaaaccaaatccgccgttactcgtaacggagctccgtcatggaacgaagatctactcttcgtagccgccgaacctttctccgatcagcttgttttcacgttggagtatcgaacatcgaaaggaccagtcaccgtcggaatggctcgcgtgccactcagcgcaatcgagagacgcgtcgacgatcgcttggttgcttcgagatggttaggattggaagatccaaacgacgagaagagaggaaacagatctagagttcacattaggctttgcttcgacggaggttatcacgtgatggacgaggcggcgcacgtgtgcagtgattaccgacctacggcgaggcagttatggaaaccagcggtgggaatcgtcgagctcggtataatcggttgcaaaaatctattaccgatgaagacggttaacggaaaaggatcaacggacgcgtacacggtggcgaaatacggttctaaatgggtccgtacccgaaccgtgtcggattctttagatccgaaatggaacgaacagtacacgtggaaagtatacgatccgtgtacggttttgactataggagtcttcgatagctggggagtatacgaagtcgacggtggaaaagaagccacgcgtcaagatctaagaattggaaaagtacgtatacgtatatcgacgctggagactggtaaagcgtatagaaatacgtatccgttactgatgttagttaacggcggcgttaaaaaattgggagagatagaattggccgttagattcgtgagaacagctccaccgttggatttcttacacgtgtatactcaaccgttattgcctttgatgcatcacattaaaccgttgagtttgtttcaagaagatatgttgaggaacactgcagtgaagatcttggccgcacatttgtcacgatctgagccgcctttaaggccggagatagtacggtatatgctcgacgccgatactcatactttcagtatgcgtaaagtcagagcaaattggcttcggatagtgaatgtagtcgccggaatggtcgacgtggtgcggtgggttgatgacacccgtttctggaagaatccgacatcaactttactagttcacgcacttgtcgtgatgctgatttggttcccggatcttatcgtaccgacattagcgttttacttgttcgtgattggtgcgtggaattataggttcaggtcacgtgctgctctaccacatttcgatccaagactctcgttagctgatgcagctgatagagacgagctcgacgaggagtttgacgtcgtaccgagcaaccgaccaccggagatggttcggttgaggtacgataagctacgaaacgtcggagctagagttcaaacgattcttggtgaagtggctgcgcaaggggagaagatgcaagctttggtgacgtggcgtgacccacgagcgactggtatattcgtggggctgtgtttctttgtggcgttggtgttgtatcttgtgccgacgaagatggtggctatggcgtcagggttttattacttccggcatcctattttccgtgatcggaaaccttctccggtgttaaatttcttccggcgactaccatcattatctgatcggctcatgtaatattgtttttttttttggaggggatgtatatatagtttgggtcgtttaaccttgttgggccttattgggttataatgggccactaaatggatttttatatgatttcctattataggtgctgtgtttgaccatgtctaaaacaaagaagtgtttggtatgacaaaattgatgaacctactttttgagcagagtggtaaatgtgcggaaataagcacacaaggaaatcgttgttggtgactaacaaaaggagttatccactgcccaagcattaccaactaccaccaaccaaactcaatttggaaatttcaaaggtccattagtcaaagcagcattaagtcattcagtaatcaacaaatatattcatatgaaacccaaaataaaataaaataaacacttttcaagaaaaaaataaaatactgagtactaaactggaaaccctttataagcaaaaagaccaaaagttaaaagttaattaagatttggtttaaggcgctttgctttattagagaggaaggaacgaaccatcatagaaatctctccttcgttcaagtttttctctactgtgttggttgagcaatcgagtg

SEQ ID NO: 1512 - DNA, 3000 bp, Unknown
  misc_feature (1)..( 3000): cDNA_ID_2137993_gDNA_ID_1620411_Annot_ID_156269 3000 nt of promoter + ATG
atctcttgtaaatcttttaaacccttttaaaatctcttgtaaatcttttaaacccttttaaaatttcttgtaaatcttttaaaacccttttaaaatcccttgtaaatctatttcctgccaaaaacaaaaattttacgggaaaatattttcgaaaaaaaatttggcgggaaatttttttcagagaaaatttttagcgggattttttttccgaaatttttggcgggaaaaatgtttttgaaaaaaaaatttggcgggaaatttttttcacgaaatttttggcgggaagttttttcccgaaattttttggcgggaaattttattttagaatgttttaggcgaaaaatattaatacttcattttattaacctaaatcaatttacaaataggggtaaaatggtcattaaaatttaaagagggtataaatgaaaatagtaaatagaaaagggtaaaattgaaaagagatagtgtgaaaagtgaattagaaagaatttttctaaattaagacagtgggtaagaagattaataatgctctcacttgattttagaaagtataattaaaatagttattcagtcggcgttgtcctttatttttccggtaatcgatccaaaatgtattaacatggaccatgatctcgtgtctattgaataaaaaatggcatccactttcaaaactttgagaacaactctttcaagaagaaagagaaaaaggaaagaaaaaaatcatctatttacaaggatcaagtctatctctaactcagaagaaccaaatgtcggatcatcatgatcattggagccgagaagtcacattgatgaaggtatcttcaggacaagggatcgttaagccacccattggatgatcaaatccaaactcttcctcggatttactgagaagagcttgaaatgaaggttggctcaagtatgagagcggcaccaaatatctcttcttctggctctctcctacgtacaccgcaagaaacccttttggtgccgccgatgcggtggagcggcttagaatcttctttgcacccaatagacttctcaccaaagccatatctgttatttttgtacgaaaaggtttttgaagcttattaagatggatgaaaagattcaagttattggatatattgcttgttgttggttgatgatagaacgaatgtgtttatgtgtgtatatatagaaagatcaatgaaggagttaaaacctctttgaaaaaatcattgaaacttgtggtcttgaagcgtgggacagactagaacagagctcacatggttctgtctttacaatctagaaaagaagcattaatgaaatttgtcttgatgacataattaattgagtttgggccaataaacgaaaaactaactccatatgcacaagggactgtttcctcaatgtttttaagataagacatgctattgtcaataagaaggcccagcaagtttctttccttcatgttctgtgatgatcatattacctcatgtctgtggtgcaatttaataagaacttaaaattgggacctgaagtagctcaacaatagaacaacaagtctttgtctagggttaagttgttcttttttgatatcctcaaataggaggaccacacatgacagttacaagtaaaggattgaatatctcctttcttctctgcatttattataaaaatatggagaaaacagaatcatgtgaaacgtaactctgtttgtgtatgttccatgttggtttgaagtccatcaatctatttatacatctaaagatagaactaactattcaatccgaagcttgaatctgagcatctaggtttttctctaaagcttcaaatttagattttccaaacacaagaaatgtttttgttcagaggtcttttgggtgcaaagaaaattatcagattttctatagaggctacaagcaaaaggccagtttcagcatcaagggggtttcttgcggtgtacgttggcgaagaccaggtctaaaagaaaagatatttggtgccagtcttatatttaaaccagccttcatttcaagctcttcaccgtaattccaaggaagagcttggattcgatcatccaatgggtggctagcttaaaaatccattgtcctgaagataccttcatcgatctgacttctcagcttcaatgaagatgttccgcaagaaggaataactaacagtagttagtgagagatagattattcaatgtaaatacttcatcttgctgtcatagatataatgtgtaaatacattccttatcaccaagaggatttgcttaaaataatgaagattcttgatcttgaccttaaggctaacatcatagtgattttctcaccgatgtttacacttaggtacttaagttgcttcaaagacaagcaaggcatggaggatctcattactgtaatactgttgcaagaaaactaaaggggtatatattttgatgatgttttctttattcttttacttgattttcgtgtgtggttctatttgtgtatatcataaaaaaggaacagcttaaagagtgatggagacatgttgttctgttgttgagaaacttcaggtccccacttttaagttgttattaaatccatttagaccacagagaatcaaaaataggatcatcacagaacatggagaagagaaacttgctggtcttttatctaaaaacattgagaaaacagtcccttgtgaattgcatatggattttgtttttagtttaatgtcccacaatcaattaattatctcatcaagacaaactgcattaatgcatcttttccaaatggtagagacagaaccatgttctctgttctagtctgtccaacacttcaagaccacaagtttcaatgattttttcagagaggtttcaactcattagtagttgatctttctatatatacactcataaacccattctttcaatcatcaacaaacaacaagcaatccaataacttgaatcttttcatacatcttcagaagattttaaagaatttaatattcgaaacaaaaacaatagatatg

SEQ ID NO: 1513 - DNA, 3000 bp, Unknown
  misc_feature (1)..( 3000): cDNA_ID_2046235_gDNA_ID_1620412_Annot_ID_156282 3000 nt of promoter + ATG
agtcaataaattttttattatataaagcttggtttttaaagtttagtaatttataagattgtgtcacatgtcaactttagtgatctcatataattttgacattgataaaccaaaatatctttctattaattttaaaaatataaaacataattataaaaatttataattttaaacaatttaaaaatgtaaacaaatatttacaaggaaactatacttatatatcatacgtaaaacaatttaaaaaatgtaaaatggataattataaagaaacaatctgtattttattatataaaaacagaaattattatatcatttacttattctgacttaagtttaaaaagattactttttccttcaaaattaaaaagagatttaagaaattatacaattaattaataaaatactactataattaaggtaattatacagtaaagtattaatcttagaaaaatggtgaggtagctgagtatctttcgcaacagttcttctaagtagttagcaatttttttaccacaaacaaaactagttgtgcctaaaaaacatttttttctcctccgttagatcttcagtccgatctctgccatacctgtacctagctcaagatgtgagagcccatttatttacaggctttaacccatttgtttaacacaattgccgaatcaaataactattgttttgttttgaggtcgactaaaacaaagtaattagtgagttacaaaaataacagaactgcactaaacgaccataattttaaatggattaagtatatgaactttttagtttacagtatacactaaatgacataaatttagaaaggacccatgacttgtagtggtgagtctatgtaacacaacttgaaattaaattggtatataacatactgttcacagaatttttttgaaggctattcaaactctaacaacaacgacattaaagatgatattgttatgttatattaaactatatatatttcatcttggattccatttaacaaaagacatgagtttagaagaaataatatgaatttcgaaggaagaacatcatatatcttaatacaagtttatagccattatgttcatgaagggtggatgagtgaaactccatggaatttacaaaaataaaaatttcatcattctacccttaaaagaaaatcttgtggatctaccactttgagaaagttaaactgaaattataggtatgttttggtagtcgtctaaaaaacttgtccataatatgttgtggtcaatcaaaaggtggccattaaaatctaccaaacatatcatttatggactagttcttgggggtttagctttgatggacaaattttagtgaacaagtggtaatataccaaaacatattatggacaaatttttgatgaattaactaaaaaataccaattttagtactattttgtagaaatggcaggtccataaaattttaaaagagaagatagaatgagtaaaatatccttagaaaatctaagtctaacaacaacaaaagtttcttaaacaacatcaaagaaaatttagtacaaaagtttcttaaacaacatcaaagaaaatttagagcccatgttctagtggtgattgagaattgaagaaaggttgaaaggaactaatccatgtttggtccaccctcgaaacaaaaaaaattatatttgtgtgagatgtctgggtttgagccaaatacctaaacatcttatctggtagtcactaatatatgatctggtcgaaaaatagtccaaattcagaacaaacagtgtagtggcccttttgaaaaaaatgtactttaaagcacttcttttttatctgtgttaatcggaccagctaataagattaattttaaaaaaaaacacaaattatcatacgaatttattcgtgtgttttgcaatatatattttcgaaaacttgaggatacttggatcatatatagaagcatgacgacgaaaataacacaatatgtacaatttgatacaagaaaatgataataaaatttacaaaacaatttgccaaataacatgttagttagagtatagcacccatccaattaaatagcttttgcaaatgacataagtttctaaaatatccacttaattaattttcttttcttacgttttttacatcctaactaacactagtatactcaattaatttttcgtaacattggttacatacctaactaactagctctagaaaatatattaaaatcgggacaagtcaaccattagacatgtgtaagctgaaccaaatcgagtcatttattttcccagtaacccactctcaccaagaccagaaaaaaagcgtagatccagaggcgacaatattcaaacacacaaaaagtcatcaatatatataaataaataaaagaaaatacaattcctcttcatataattcatattttcatgttacgaaaacaaaaaagatcaccgacacataaaactaaaccaaatatttcaatgaaaaattaattaacgactttgacgctttatttctctttctctcttcactctctcattatatctctttcgctgccgcttttgttactttttgttcgttcgaatcccaatatagaccaacgaagaagaagacgaagaagcagtctctcaaacttcttctccagatccgaatctcactctcatttctccgatctctctatttgaatgacctacaatttcgcatctcttttgatcttgatctctgtttctctccttctactggtaagtgatttccttaatccgtttctctgattttcttattccttcctttaaccttgtatctgaagcttcctccggaactaggtttacgatttgtttaattttggaattcgatatcgatattttgttgtgcgttaattgtgtgtttttatcgtagctttgtttctctgtttatcagatccattgataagaagctttttagattgttaatggcataagcacgatatgtttgtttgttttgtagaatctcttgttttgagtaatcactaatatacacaacggcggcg

SEQ ID NO: 1514 - DNA, 3000 bp, Unknown
  misc_feature (1)..( 3000): cDNA_ID_3062814_gDNA_ID_1620412_Annot_ID_156285 3000 nt of promoter + ATG
gtgttgtcattagcattcttaacataagagtgtctttgtgttttgttttctctccagatgctctcatccaaagacataaactttgtgggttatacttacaagaacgttgaaatcgtaaaccatgatcaattaccagggataggtagatctcacttacacaacaaatttgacttgtaagtaaacatattccatgtttgctctgttgtaatttgtgattgtgtttactgttgcagctgagctgaagaagaagagcacaaagccaaagcggccatcaattaaatccctctttggtacttatctaaaagacatttatcacaatctatttcaactcattgtctgatattagcatatggttttagcactaacaagaattgttataaaaacatttggcagaggatgaatcagccagtagcaccacaagccaccaaggaagctttatgaaactcttgccaacacaaatcgaagttccagagaaagaagacaaatcaagctcatctagtgaaaccctatcatcttccaccacacgtttcgacaatgccacatcctaaaccagactctttgctacactttggtcccggttaacacaccaaaacacggtttgaggtggcggatttacggttggagatagtacagtttccattgtggcggtgaaggctattgtgtgagaagattaaggatttgttcaacagtttctacataggataatatttggttgttcaaaaggtttagtttgaagcaaaaggaagtaaatagtcattttcagaatgtggttttatttatttgtttgattgttttgtttgggtaaaaatcaaatttggtttgtttaccacacagttctaaagcggacaatgggaaaaatgtcaaaaaaatcatgaactttcaaatttgggacgaaaaaaacatgaacttccaaaatgccattaaaatcgtaaacttttgtttgacttttgataaatagtcaagttttgttgactttgccattttgaacatgtcgttaagttttcgttaacaaaaagataacgtgattaattttctgttaattttttctgttaaaagcgaaacgacgtcgttttgaaattaaagaaaaaaacaaaaaacaaacaccaagtagagttgaactggtgaccttttaggtgctattgaaggactaaaaccattgagccacgttaactttttagaagtatagtaaacatatacatatatatatatatatacgtaactaattaaaaataaccaactaaaataaatcaataatatagaaaattacctaaaatttacacaatccttctcatatgaatataggattaatctatacatgcacatagaatttcattcaacttcactttatatataattttatttataataaaacatatattttataaattaatttgataaatatttaataaaagaaaaatataagatcattattccgtcttcaaatcaatttttttattcataattagatggaaagtatataaaaagttattttttggtaatatatttataggtgttatatttcacaagtttgatttttatataatttaagagaatttttttttaattcaatacgtttaataaaaaaatttacattgttatttgagaatatatattaatggtaggtgtatttaatatttttacatgtttagttattgtttttatagttcggtttttatttggtaggtgcatttttataatttacatcatttttaatatttttatttgccattttggttaatatggaggatttggaagagccggaatgatttagtcttcaacaaaaaagcaatcgctgtcgctgatgtgataaaccaagcgataatggacacgaaagaatggctggatgttaagcataaaaatgatgacaacgtcaaagggggccaaaccaagtcctcaagaacggacaaatggcaaaaaccaggagcagaatgggtcaaatgcaattatgatgtctctaaccatgcgggaagacaagactcaggcctcagatggattattcgaaactcacaaggaacctgtttggactgcggctgcgggaaatttcagggtcgacaaacaataaaggaagctgaatgcactgccctcatatgggcaatacaatgcgcttgggatttgggatataggagagtagaatttgaaggcgacaacatcacagttaatcgccttattcgaaacaaagaaactaatccacgacttcgatactatttggaattcattcaacaatggagcaaagctttcaccactgtgaagttcacatttcgacaccgggaacaaaacgtttgtgttgatgttctggcgaaaaaagcagtagctaatcatataaatcatactctatatcatttttgtcctagatttctaatgtcgtttgtaaacaaagatgctgaacacgtgaattaataaagttattggaaggaaaaaaaaaaaaaatagttcggtttttaattagttttgcgtatatatatatatatcagttttcattaatatcgaaatgttatcatagcatattggttgagcgcttgtgataatttaggaggttcacgagttcaatccattcttggcgcaaattttaatatatttttattttgaaacgacgtcgtttcgcttctaacggaaaatgttaacgaaaagttaactccgttattttgttgttaacggaaatttaacgacatgcccaaaatagtaaagtcaacgaaacttaatcattttatcaaaagtcagacgaaattttataattttagcggcatttcggaagttcacgttttttttatcccaaatttaaaagttaatgatttggtttgattgaaatgtccggttctggtttggttttcttttgtaccggttctcataataatagccacgtattaaaaatttattagtaatggatttgggccagacccattctcaaagcccaatcaatttctcagtgaaacatatataaacctaattaaagtgaagcagaagttgtattcttcttcttgcgaactcgctgaagtctgaaag

SEQ ID NO: 1515 - DNA, 3000 bp, Unknown
  misc_feature (1)..( 3000): cDNA_ID_3062797_gDNA_ID_1620412_Annot_ID_156296 3000 nt of promoter + ATG
aaatttgtgggaatcagtggagccaatcagttgcctccacgtcatcgtttgcacgccatgttagccaaaatgtggtcatgcatcccatctaacaagtcaggtgtaatcgaagcatccgagatctcgtcagacaaaaaaaactctaaaacgataactagtttttagtgtaatctaagttaaagtatgattatttactaatatatattctgatcccaaaggtttggttagaaaatttcctcagcatgggttatcggtacatatataattgcttggtgataatgatatgtttcagcttaaccaaataaaaaatgcaaaataataaataaattttaccgtggtggatgagctaattagagtgtacgaggtacatatatagtgcgttgttttgcaaaaataataatattaaaaagttcacaaaatattttttagtcataagttactttttcacacttatttataacttagaaataaaaaatcacttctctgaacacttatttataacttctctgaacacatgttatgttcaaatgttaagactattttccgttaggtgatatcgtaattttatgactacaatatttcaagttatatggaccatagcattccatttctatgattgaggtacactttgtgattattatttatcgaccaaatattttcaatggctccaaagcttaattatatattagttgtagacaaaaacaaatctctaaaacactgtcaaaatgacgtgtttgcgtaaaatccataaaacattttcaagctagccgaggcatcagcaacaaaatcttcttaaaaccttcatggcttgtaaaatattcaatcgggtacagtgggttgtttagttgaattattatgtgtcactgtgtaagtatagcttctaaaaataaaatgtcattatagcttattgtttaaaagtcaaaaaaaatgttgttggacgcaattaaagatgtcacaagttgtcattaattaattaagcgataatgtaaagtaaaatagcgataacaggttatatacggcattttcaagataaccccactttgtagaccttttccgttcatgttactttctgcccagttaaaatcttgtgttaaaaagtcataataccatatttcctttagttaagtaaactatacgcggatactaaaaactaccgatattttatgcgtaagttatctttattatcatgtttttgttatataaacaattttgctacaaaaagttcatttcgcctttattagattcacgagagacggcatttctttcgttttttttatgcttttgatggagaatttcaatgatggctataattatatatcgttgaagatttcttatacacttgtctccataaatctgcaaatctgataataaattgtagtatctgagactcgaaccaaagacctctttatgtataatcattaatgaatttttggttaaccaataaagtgataaactaggggttttcaatatctttattatcatatttattattaaattactatataacttcatgtaatcgtgggacactgcaacaaatactaaataattagaaaaattaacaaccaacatctagttagaatatttaatttgcaccaatgtcttcgagtatagtgaaaaaaatagaagatcgaatatcgaatagtacgtatagaatcatctagatccattcgaactaacgtctacttttcttttccagcattaacatgtagcttgtcattagcatttacatgttgcaaataacacaaattgggaaattgaaagactaaaaaaccttgtacagcagatggtttaacacgtggattcatggacacaaacagaaaacggcagaactaagcacaaaaacgtcaactaagcatatcaaagcttttaatgcaagcctaatataaacacaagtggttatccataatctgttcttaatctcttgcagtagttatcttttcattattcgcaattcgcaattctatattcttatatttcaacttgttcttcttccaaattgtaattatatctacatcgtcttagcttgaccattatagctccagtaccaagttctcttcttaactttaatatcagctactattctcatactgtaaatatcttttgttcaccaaacatatatttcgaaccaaactgctaaaagcttatcataaattgcagttctagccacacaattttgcagttccaaccattaaatgccacaaaatttggacgatttcttaagacaagaagaacatagcaaccaaaccttattgattaaatatgaaatgtctccataaaactgggagatttccccaaataaagagaacacggcaaatgttcacgtaatctccaagatgaatgtttaattttttctttcagaaaaaaacaaaaaaacttaactcaatatagacaactagaatggataccaactaagcaaaagaaattcaaaagacaaatatatattggatatgaagttacattattttcaaactttatatactactaaaagcctaaaaatttgttctaaaatgatatccaaataaatggaaggcatgaatgtcatatgactaaaagagaaaaacacacctgtatataagtattggatcatgctgcctccgagtgacaaaacatacgatgtgggtctttattgggccatacttaaatggaaaaaggagaaaaaaaattgggcaatgtctatggtcgaaatttatatgttttacatcaataaaatcaatatttaattttatatatgtgggtcttaatctagtattatctacatagattaaaatcaaagtactgcatatggtccataataatacaaccaaagcaaattaaaattttgtggcacaaaacgacatcattttactcagaaagtaatatgcaatttcgtttacgcacacacgtatacgcgctaataacccgtggtgcttctcaaatcacataataattaaagtcttcttcttcttcttcttctctacaaattatctcactctcttcgtttttttttccttctcaacaatg

SEQ ID NO: 1516 - DNA, 3000 bp, Unknown
  misc_feature (1)..( 3000): cDNA_ID_2025109_gDNA_ID_1620412_Annot_ID_156298 3000 nt of promoter + ATG
agatttgcagatttatggagacaagtgtataagaaatcttcaacgatatataattatagccatcattgaaattctccatcaaaagcataaaaaaaacgaaagaaatgccgtctctcgtgaatctaataaaggcgaaatgaactttttgtagcaaaattgtttatataacaaaaacatgataataaagataacttacgcataaaatatcggtagtttttagtatccgcgtatagtttacttaactaaaggaaatatggtattatgactttttaacacaagattttaactgggcagaaagtaacatgaacggaaaaggtctacaaagtggggttatcttgaaaatgccgtatataacctgttatcgctattttactttacattatcgcttaattaattaatgacaacttgtgacatctttaattgcgtccaacaacattttttttgacttttaaacaataagctataatgacattttatttttagaagctatacttacacagtgacacataataattcaactaaacaacccactgtacccgattgaatattttacaagccatgaaggttttaagaagattttgttgctgatgcctcggctagcttgaaaatgttttatggattttacgcaaacacgtcattttgacagtgttttagagatttgtttttgtctacaactaatatataattaagctttggagccattgaaaatatttggtcgataaataataatcacaaagtgtacctcaatcatagaaatggaatgctatggtccatataacttgaaatattgtagtcataaaattacgatatcacctaacggaaaatagtcttaacatttgaacataacatgtgttcagagaagttataaataagtgttcagagaagtgattttttatttctaagttataaataagtgtgaaaaagtaacttatgactaaaaaatattttgtgaactttttaatattattatttttgcaaaacaacgcactatatatgtacctcgtacactctaattagctcatccaccacggtaaaatttatttattattttgcattttttatttggttaagctgaaacatatcattatcaccaagcaattatatatgtaccgataacccatgctgaggaaattttctaaccaaacctttgggatcagaatatatattagtaaataatcatactttaacttagattacactaaaaactagttatcgttttagagttttttttgtctgacgagatctcggatgcttcgattacacctgacttgttagatgggatgcatgaccacattttggctaacatggcgtgcaaacgatgacgtggaggcaactgattggctccactgattcccacaaatttgttgcaaaatcaaaagtagggccagactaattatattatttttttgtggatgtctataatatgaaatttgaatcaatacgtaatttatcgattctttgtctaatcgatgtcaactaaatttaacaaattatctggaagtcactcaacattttccttgataatgctagtttcttcgaatcttaaatgaggcaacgcattgtccattgaaattttaagcatatagtgtatatatgtatttatttttctagcaaattcaaaacggcctgggatcgtttggtttgtaatcaatatatgggttttttttggtcaacaatcaataattagtatttttgagaattcatgaaatactggatgagtaaatgagataatttttatggatgatcactagcacatggttgctaaccagtgaagcacctaaaaaatcactgcaaaaaagtttgtaatcaatttcgttgcagctaagcaacatttatgactaatttgagtaaatattaattgacgatcccatgaatttcacctaattgacgagtccctagatttgttttagagtaaattttacaacttcatatactttacattataattaacaaactaaaaaactcgtaaaccaaataagactttgtctaatggtccaagcatgacctctccaaagatataatatgttttgatatatacgtgataaccgatcagatgttgtatatacatattaatgtgtattaatttcttcatataatatttacaaatttttgtgagaagatatcaagtacacgtatatcgaataagaaaagctagattgtgtaaaacgttacggggcttgtgcattaactcacaagttggctatcacaagtttcaaattgtggtgtttagagcatcgcagttgtcaaacaaaaaaaaaaaaaaaaaaagaaagagtatcacacgtgattgttttccataactatgagaacttttctgactattttcttcttttgtgcctttgttatgtttcttcaatcattacttaattattaattactaatcgattttcgttgcctgtagttttcacatgttgtaatctagaaaactgaaaaagactttccccataatagtctctgctaactacatactagtccctatattttgcaattttaagtgtttttaaccactatcttagagactctaaacatgaggaccctaaaaaataaccatcatcttaaattgtacgtaagaaatatattcaatctacatcagatgataccaataaaattcggcatataagtagaatttgaaagaaacaacaacgtgggtagatatgcaccatttacaacaacaaaaaagaaaaatcaattttggtccaactttttcatatacatttaaattgtcaattatcatcataattagtaatacgacaaactgtcgtataaactagaaaaatacatacatctactatctaaaacgacagataaaaatacgtaatcatcaaaaagagttaaaaacaagttttggggttctcttagcaattttgttttatatgtctatttttatgtaacgcgacagctgtaacgttgtgtctatatatatactaacagagtttgtgcttcgaaatcttaagaactttcccagttttgttttttaatcatatcaaagcaaactgtgtg

SEQ ID NO: 1517 - DNA, 3000 bp, Unknown
  misc_feature (1)..( 3000): cDNA_ID_3062789_gDNA_ID_1620412_Annot_ID_156299 3000 nt of promoter + ATG
gagtaaaataaccccaattttccaaatagataacaattacaataattaatttttctgtataccaagaatttatgtatacgaagattatatgctaatcaaaaataatattaggatggagtgaagagaaaccaccaaaaataaaagattcttgaaaatatacagaacataaatgatcgaagagtctttcaaattttttgatatatatctaattgattttttttaaagaaatctgttcaccccttttggagatttcgattcaagagggtcaaggacatttgatcccatttaaggaatattctcttcagatgattcctcatacaaagcaagatgctttgtgttttgggaaaaagaaaacaaaagaaaaacctttttttcgtagtttatatttggcattaccactaaagtggtgatatatgcatgatcagaaacaattgccatcctaagagaaactccaagggccatcatttgttttttttgtagtcatttttctttatccgtttttgttctcattgaaaattggttgctaattatttgtttgttaatgatagttattaatccacacacaaaaaaatgtagctagtggttcttgcaatctctagttcttatgaactatcctgttacgatatgaattgattcaacaaagaagcaaagatcaagttcgtctatttttatgttccacatatgcttccacgagttgtaccgtctcacagctattggctcacgacactcggtttacttattttttcatagaaatacttacataactttaaaaatgtagttaaagtaagttaaagttatgttttcaactaattttctttaaaattaaacgttttaagttttaacgtataagtgacaataggtttctaaatttacattcacttgctactgttcagaattctttcagttttagcctctattattcctatatcaacttttccttacgagtgagaaagaccatacactatgagattcagaaaaagagttatcaattttgttaaaaaaaacaaaaaaaaaaagagaaagttctcaattttgttttttcttattttctctatatccaaatgtgttttttaataataaggaaaaaaaagatgcaatttgtttcagattcagtcacttcaacttatattccaccataactaaaaaaatacacgtattaaaagaattgtttcattttcccaattctaaaacaagtacagaaactcctaatatattttccattttgtttttttctccaaatcttgatgattctttgtccaagtatatatagccaatcccgactaaattcccgacagatcaaatttctttggaaagttttgaccgatttctgacatattttggaaaaatagatatccaccagaaagatagtaccgttgaaacgttttttgttcttgttacttgcttgttttcaaaatcatttttaaacattttctccccttttttacattttgagttctaaccagcactacgaatatgttcttctagactttagttccatcagccttcttagctccgactccaacatttttcttgtctataagttccgctagttgcatcagagttgtcatattagtcatttctatatatcatattgaatagatatgcttttggtaacgaactaacaactatatgacgctaacatgtgaaaatagaaaaatcaatcatcaatttgcactaaaacaaaatgttgcatcaattaaattgtatcagaaacatgatattaatttgaattagttactgataattaatgatacaaaatatataattaaaataatctgttatttatttatttgacatcattagttcattgaaattgatacaaatctatatcagtttgcatcactttttttctttgcaaactgtccatatatagggtaagcagatgaaaacagtttgctttcaaatcagttattgaaattaaatatattttctatttaaattaaattaaatttattttttattaaactttaaatagtttatttacaaattatagaaatatttaacttcacttagttataactgttgtttttattgtcaaaaaatagattgacaacatatatttgatggaaaagtgaagatgtttatcttttataaattgaaatttattaaaaaaaattttaaagaaatcgcaaaaaagtgttattaattattacgaaacttctgtatggttttgaatgtaataggaatactttcatatttgttaagaatatattcaatcgaaactcatattaatctttaataaaaaaagattttttgagcaaataaaaaatatatatggtacaattttagtgattaaatgtatacaataataccgaaactaaaaatatggtctcgaacttgacaaaaatatatatatatggtctcgcttaacataacaattacaaagcgttaaactttttttttgtaaggactactagtcacacgtaatattacatcacggatcatggtatatataaagcctatttgtaaaatggatttaaaatatactatttttggaaaagaatgtctgcaagagaaattttaatattatccttgttgaatgcaatagaagtgtgtttgtgtgtgggattcgtgacgagttgcactactcacacaccaatactaacgagtgcgttatattcaaatctaccaatataagtgagtgttattaagctaagcataatggccaagaaatttaatattaaaaaaacaaaagtttccattttcccatttgagttactttacttataacaaatcgcatcaaaaagttaaattcaccttcccatgtgtgttaaaaatcatttatttccattaaaatagttagtgaccaaaaaaaaagaagaaactaaattcaccttctctacacgtctttctctctatatatacaaactttcttctttccctcttaatgcctcttgtaacattagcctctctctctgtctttctccttcctcacattataatttcttccaagtcactattagcaattaatcaaaacggaagaaattatatgcgacgatg

SEQ ID NO: 1518 - DNA, 3000 bp, Unknown
  misc_feature (1)..( 3000): cDNA_ID_2046209_gDNA_ID_1620412_Annot_ID_156291 3000 nt of promoter + ATG
tggatcattttcgattcctctccactttccaatacgttgacaataatgggtaaactattattcccaaatctccaaaaaaaaatttgttttcatatttttcttgttattgctatcatgcttcaatttatgttcgcattataggtttgattggggagctcaagttcaaaaaaaggcagatcaaattcaaacacttctattagggaaagaagaattaagagaagctcgtcttaaagctctcaaaatcacttcccaaatcaatggctttggtaactccaccacattttctccttctcctaattctctatctaactccttctcttccttgaaaacctccaattcaacaccaaccaaaagaattgatcttatatccgagtcatattcgttaatcgacgacgaaaacaagctctcggagaaggatcaagccagcaaagagacgctagtcagcggaatctgcacaaaactcgccggatttagccctttgaacaagtttcaaggcggtcgtactaaggcggcaaaatttcaaactttgtctaacgttgagagagtttcaagtaaatgttacgatcgttgcaattctattggttactaaacaaaaaccggttcggttttaaattgtaatttcgttctgttacaaaacatccggtttagccaaaccgaattacaacgcaagaaatgctgcttttgctaatcctgtttaaagcttctttagctaaacattttgcagcttctttaggatcctctatgtgtcttattaggttaatcgcttcttgactcttcatcacctgtaaccaaattattttgctaagtgattgatcagtttgtattttgatggatcttgatcttgatcttacctcccaaatcccggggctaccgataatgataaattctgtatctgaattaatcttttctgtaatcactacaagctctgaatttcttggatctgattcatcttcttcttctccttgattacaaactgagatattacatttaaagaatttaagtctcatttcattttcttgtcacacaagtaacctaagaggatattcgggtttgaaggaactaaccagggaaaataaattgtgaccaatgttttgttgaggctttcctatctctgatttgatgagcctcaccatctttgcaaaccactactctatggtccccaatactcgctatagctagcttctctccgttcaccaccataaccgaagcggctgagccaccggttctctcttcctcaacgtacgctcttctcatagtctctttacactttctcataatcccgagctgaaaatgtcccagatacattttgttgacacacattcaaaaataaaacgatgatcacactaacataaaccattagggtaaattttcaagtcatgatttaattacctcattggggagcttatcaaatagatggttttgcatatatttgacaatctctttccctgttccagcatttgagactccaaataaccaaatctcaagctcatcactttgttgctctctctgaacaaaaaccgaatcatcattcgatgaattgtcggcatagcttaaccggtcaaccgtatagtatccatgagaaaccggagttaaccataatggtttcttcttcttccttctcttcccatcttcaactacaagtcttctaaaccggaacgcctgttggattcaacgatctttaaaatccataattcaatacaaaatcttgaattaagaaagattgaaaaaaagatgaccttgagcatgaaagggagatctaagaagcccatcgtcgttcatagcttcttcttatttgcttactatctttataaattgcaaatatcttttgataaaaacaagaaaacttttttcgattctcacaattttaaaagaaacagactttttcaattgcaagttacagtttcttaagtcatttttccatattgtaaaattacaattctgatgtatatttattaagtaacggtaggaaactataaacaattaataaacatttagaatgttgtctagaaaacgcttattgtgaacagttgaacaaagcctcatatagtaacgtacgcctttcgtctttagttaactttgactatgtttacgtttcatcagaagaagaaaaaaactacgtttacgttccaaaaccttaaaagacaagcattggagatttggagatgttatatattttattaagttttttgcattttatatgataatgagaaaattaagaaaaatagtctatttcctcacaataattatcacatcgtatagaatccaaattttatccatgatccttatgtttatgaagtgataattctattctagtttacaatcatcatgggtttgagaactttcatttcatggacataaggatcgaggttaaagtttgggctctatatgttatgatgcgatattcatcgtgggaaaataaaccatttttctgaaaaaaatcatgatagaaaatttaaagttatattacacttaaaaaaagagagaggctatattacactttaggaaacatctaatgccttggcaagtgcatgagtagtatgtatcttcagaaaacgatgaaactaagcttaagaccctagacagcttttacatgtgcatttgtcaactatcgtgtcaattgtctctctatattcggttattgcgaacagaatgaaacagatactgttttttaatttgatgaactgtaacttacacatacccaaacatattgttgtgattaatcactaagacgctaactagctttcaatcgtttaatttagatttgattattctccttcatcttttatgaaaagaagatgtaaaaatgttgtggatgagagaacgcatatttctgaaatcaagcaacgaattaaaccagtgaaccaatcggttaattactaaaccgaaatattctctgacaaaaaaaaaaaactttatttaccggttccaggcatctgccttcttctacctccgtctcctcttaaacctcaaataagggtttttgaggaaagtttctcgaaa

SEQ ID NO: 1519 - DNA, 3000 bp, Unknown
  misc_feature (1)..( 3000): cDNA_ID_2046231_gDNA_ID_1620412_Annot_ID_156283 3000 nt of promoter + ATG
gctaaattatatttacatgcgaaatgataagcatgaagattttgtttaggtgacatatttgctaacatctctttaaaatgtatattaaaaaaaacataaaatattttgggcataaaacttaatgtggaattttattagttgtctcatttaatatgtttatttaatatatctgtatttgtggtattataatgaataagacattaaatatgaataaaaattccaaaataatatttgcacgtttatgatagaaataataaaagtctatttaataacttgaaaagaaatgacatgtagaaactgatttcaaatgttaaatacttatatggatactggatacatcatccaaaacatttttcaactaattttaataaataatataaaaatacttttaccatttccttacataccaacttaataattttcagacaattaatcatgacgaacacattgaccgttacatcatatgaatgataaaacaaaaatagtggtttctgttttggttttcctattactaattgttggaaaccacttcaattatacgcgttacgtagtttgatacattgaatatatggtacaatatacattaaatttattttcgaaaaatatgaatgtgatacatacctacaaagtttggcaaatacaaaaatggtccccaacgttactctcccccacctcaaagctgttcatatcgcccttcaaagattgtgaaaatcaaacccttatcctcttaaaacccttaaaatgttttcttctaaagaaaaagttgctttcttatttttatttttattttgaattctggttttggcgcatacatattagcgaaaattagagaaaaaattcctgtatatgcaaaaaaattaacgtttttttcctacaaaatttagtataaaaatcaataaatatattaaaattatcacacaagaattaactttgaatttcttttccagattagcttttaatatattttgctttgtaataaagaacatactgtattgaaatatgttctactattaactaatatgaagattaccggtaaagaattactaatgtttcatctacattaatttttgtgtgcccataatttcaaaattttgcctagagtgggatcaataattttggtgaagattgaagaaaaaaactaaaatttggggacaacattacaaaagagcattcagtatttggaaagcttaggaccatggtgatttagaagcgccacgggcgtgatgcatactgcatcttcggcggacatcaaggcttttgaaacctttttctaattttgttatctatataattcacatcaaatagaattagtgaactaatgtttacaaaattaggtaaaacataaattatatgtatgaattaacaaactattagtttaaaagtaacatatagtcttatttttttgaaacaaaaagatttactttaataatatatttttttttttttgtgtgtggatccagaagaattgtgaagaaaaaaaattcttctaaactgcatactagtcacaccctttactttcgcgtaaattcagatagttcggctgaaaaaaattggttaaccctcaaaaaccgtcatgttaattaggtttgcacaatccattaacattaggggatgccaagtagtatcacattagtacttcaagtcctcgatgaagtgttgataggcttttgctttgtttccttaatcgtaacataaatgtcttcatgtccttaggatatatacaaacctatccttgcccaattgattattcatctgcattccaaactaaacacaatgcttcttcatgtaccattcatatcagttgggtcacactccaaacatttaattttctttcatttccatataaaaatacataatccgtgaatagttgaacttctctatatttgacttgagaagttaaatagagaaattaacaactataccagttagtacagttggtaattaccaatagatattcaaaaattagggagagaattcaatgatttgggttagtaaggtggaataatcaatatatgtctacgtctagataaggtaacatatgttttattaataataactcgagatctatataattaaaacgcccctaaatcctaatccatcattaatgtcaaatatttgaagattgaaccaaattctcaaaaagtgttaaaaactatttgcaacaagagagagcagttgggttgtgttgtgttgtgttgtgttgggttgtgttgtggtctctttgtaattttacacatcaaaagcaacgcaaagctttacactttcctttctcctttctctttcactgcaaatttctcctacccttaaaaatcgaaacttcaagagaagaaattgaggaatcaaaaattccctagattcgagggttcttctctcacttgttctatcttcctgcttcatcggaatcgtttgatttgtgttctttacattttctccgactcaacttatggtctgaattttacctagtaagtacatttgtctactttctgtttattctttcgaaatcgatgctttatctggaattgatcatgttattgagtttggcttgggttaactaatcatggggaattctcaaaatttgttttttttttggattatgtgtttgattttgggaatatactgttagggtttggctagtgtgatgaagtttctgaaactggtgatagtaaaggtgtaaactttatgctcattttaggttaaattctctgtatcaataaggcactaggcatttagtttaacaattcaatgctcagaattttgatttgagtattttgttagagttcaagtgtttagtttagcttatcgtagtctcttttggtatttgaggtcactattggctcatatatgttatcttgttgtaggtgcaaggcattagagaaattggtacagtcgtgtgacatgtgaagattgttgttgtacatatagctgaaggaactctttgctgatttttacataaaagagtgtatcttgatatttggtttgcgatcgagttaagtggaagcg

SEQ ID NO: 1520 - DNA, 3000 bp, Unknown
  misc_feature (1)..( 3000): cDNA_ID_2138093_gDNA_ID_1620413_Annot_ID_156315 3000 nt of promoter + ATG
cactccacatatgggacaaggatgcgacgacgttttcaccttcttcatcaatccagacgacaaagcgtcgttgttaggcttcttgtgactcgcacggtgacctcctaaggcttggaacgaatgaaactgcttcaaacacgttttacatgtgaaaacgcgtttttgatcgccaccgtcaacgttttcttgtccaactctagataaaagcatcaaacaattcgccgccgtgacatccaccgtcgacttgatctccgatatcgcaaccatttttcttctgatgatgatgattaaaacgaaacaataaaaaatgaaatgatcctcttgtggtttgtgttttttgagtttggtgtgatagtagttgtgatgatgtgttcgtgtccgtttgggaactatatatagataccgagtttgtgtggaccaaagacgtgtggaaagtgacgaatatacccttgtgacttggtgggtaaggaagtggcagcgaagagtgtaggtattaacgtaaatacgtggaaagataaggggtaaaagaaggaaaaaacgggttatgtggtcacgatttgcgacaccgcgtagcttaagagactactaaaaacgaaagagtcgtttcggttggatgagaatcttcctcgtgttttctcgaaaccatttattattattattttctttttaaagatattttatttggatatatacacatcaaaaactaaactcttttgagtagttgacgtcaaccaaaaaaagctattaaactctctgagtttgatgcattccccacgcgcggagccgtcttctagatatattatacggaatagtttaaaatcaacaccttctagatataataataatacttcatatatgaatggtttgattccgtttgaaatgcttctaagttttttgattgacttcatataatataaggatactaattcataattttaatattcattggtatggtataggtatgttatatgaataaatctcttttgaagttttgaacaatatcataaaacatataaaaactctaataaatattggttaatatggtgtaggttggtttcacttttatgaatttgaaatatgttaaaaccaaaaacctatggtttgcttttcgtttaggtgttttggtttatttaaaattcatttctagaattctaatttggtcaggtgtattctagaaagtggaataactagaaaacaaagttcgtggttttgttagaaaaatagtttctttctagaatgttctctaaaaactaccgtcagcaatgagcatctaacacaatcccagcaaaggcatgacaacacaaatacgtgaaaagtacgcgttgaaagatcgcgtggatcagataacaagaagatatgtacggaaacttgatggaaacgtgggaagcaagtagaagaagagatacgaaaatcataaaataaaaagagagagtgacgtggcacttttaatgccttttccacgcggaacaaatcttcgttataccttaagattcttgttttcacactccctttactttcttcatttgttggtagtttcataatcagtagataagtcgagtcaataattaacaattatattatcaatggagtagtttacataattggacaagtatacatatatgattgtttgttggtttttaggattaccaaccaacgtatgaatggataaacatatgacctacttcttttgtttttttgtttgactctctccatcaaatttttgttttgctttgtaagccaaagaaaatattatacttacacacttccagagtatacggccaatcaaatgtaattcgttgaatacaataattaatactaacaaaaatataattcgtttgttgccaaaaaaaattcaagttttaatcgtaagtgtattttggtacgcttggaaatatatgatttcaaaaccattactggtctcaaatcgggtccatttgctttattttattgagttcatatgtacgagtccaattatgtagacattgagctattactcattcattgcgttactcatctccattgcttcttgcttttttttctttttcttttcttagtttgaatgcaagacaatctcattttctgataaacttgattcccggatattaatggtaatgagagtttgacatgagccttgtagtgatttgaggtggttacccacatttggctatttagcgggtcacatgtaatagcctaataggttcaacccacctcttgttcataggggttaaaatgtagaaagatagctaagttagttacgttttatgttgtttatactaagattaaatcatcaaattatattctttacgagcctaaaaggttcaacacacctccgttcgtagggttaaaaatgtagataaattacacattagtttacttcatgcaaactaattttaagtgagttaagaatatactaacttctaattaagtaattgaaaatttaaatcctataagatatttttcaataaaaaatttagttttcacttatgattacatgctttaaacattttaaaataaaacataagtgtaagtttgcaataccacataaagagataataaacatctgatcatgaaagtttacatttggcacaatctgtcagttactaactttacaaaccatatttaatagaataaaatatctatattcaaaaacttacaactacaaccaattaatataaacaaaattctacagctgcagtcaaacaaatcacccacaaagtcaaaattttagtttaattccaaataatagggagataaatatggaaagaagattatgaagatcctcttaccttttttttcgaattagataacagttgaaggaagagatagagttctggctgaaatcactcaacaaactttaaaagtaattaagttgagactgagactgagcgtgattcgatctatttagcaaatatagcgagagagggagatttatggagaactagtattttgtatatgagtatgacgagaagatattcgagtactcaatactcaaacaaaatg

SEQ ID NO: 1521 - DNA, 3000 bp, Unknown
  misc_feature (1)..( 3000): cDNA_ID_3062842_gDNA_ID_1620413_Annot_ID_156333 3000 nt of
tgatataacattagactgaaatctatactccaaacttatgtgttaggttagatttgcaaatgaggaaacttagatctcgtacctgattttgtgtcattgttattttcagaggattggacttgggcttggtgactagcttcggtttcagtcttttcaaccttctcgtcttcaattgttaactcttcgaccttattgtcttccattgttatctcaaaggtgttgtggtttggaactgatgcctcttcctcgagctttgtctcatcggactctagtcttgatgcttcgtcatggtcttgcacaaccgcatctggactgagagatttacctgattcacttagcaaatcggtagtctcagaggataagttaggaagaataatcttactgtcacctgtttcatgcatctggtcttccattgtgacctccatgtactcgtcgtgatttgcttccgaagaacaatcaattttcatctcatcagcaatggatgtgaggtgttcaggctcagggatatgcttctcatcatcaatggatgcgtggtgtccagactcagtgatatgcatctcatcattactagcatgaccagtagtagctctttctttgctgttttcgtccactgaggcttcttcttcaaaagcagcatttcccatgttattcacttcaacaggactttgtgggatcccatgatcgctttttgacggtgacattgatccaccttcggaagtcgactcaatattcatgctaacatccgacgctgcttctgactttgtacatcttgtcagtgtaaagggagtagccgtctgattttgcaccaaaatcccctggccatggctggcactgcatttccttagggcaaatgcttcttctttgaggacatttgtagtaggttccaccttattgtcatcttcagacatcagcatgtcaatttggcttatggtttcaatttcccgaaggttatcatcagatgaagctgtggccatacgtagttcagaaacttgattactactgtgcacctgagtgtcaatcaccttagctgcagaaggctgagtcactgattcagttcctacaatatccttaacccggaaaccatgttttggcaagccatcaagaacagaggtgaaatcaatcgccttcgaggatttgtgcgccacaacatttgtggcatcaaaagcctttgcaagatcatccaaaagcatgtcaccttcaccgctcgaaaggcgatcccatttcatgcaatcttcagacagaggctgttcgaggctaaaagtatcaccagcagaaagtaattcaaccctgacagcttctttgtgaaaccgttttttctttaaaaccttggctatcatattcctgaaagcaatttaaaatccattctcaatgacgcttagcagcatcaaataacacaattgctagacgaatttgatacatacctacaattttttgaaatggcagctctagctctttcagcagagagtccaagtaagaacatgagatttatgacatcatttggacctctaagttctgtgactgaaggagcaccacttgatataattagattcttccccctagtccaatccaccagtaactagatacaccatatcacaagacagtataagcaagttctcataaaactttcacatgatcaactaattgacaataaaattttccacagaatctcaccttagcatttgatataacttgtctcctcgtttgtgcatccataaggatatcagagtacttaatctcaaagtaaatccctcgctgcagataagaaaattcattaaggtgaagcaaataaaaagaataagatacacacagattcttctaacagtgaaatcacaaacctgaatagcagctttaaccatgggatgcttcaatcggaataacatcttgtccgtaaaatctatcgaaataagatcaacctatgaaaacaaacaagctaagagttaaatcctaactaaaaaaactccaattgagctacaaaaactaaagattgaatttttaacagaaaaagagagaaattcaaacctcagctttctcacaggcataatcgaaagcgttctgattcatcggcctaacagcaataatatcataactctttagaatcggattcccagaattcaaactctgacactgagcattactctccacatgaactgtgagacgcgtgtactgccgaaacggagtagttcgcggaacaccgagtaaatcgcgatggaatccgacagaagaagctaaccgcggagcgactttgattagagacccaagagtgagaagagggatcgtacaagagtctttgtcagacattacgcctttgatcgaacggttatgtgcgatcccaacatagcctagctccatggctttcgtggcgagctttaatcgtaaggttttcccgccggcgatttccttaccacctgatcgtggcggctcattgtacggaatgctaagatcgaagaatcccattagtgagtcggagagaacagtggcggagagattttccgattagggtttaagcattaaataacgggtttttagatacttcaccgattttaggagaagaaatataaatacgaccaaaaaaaaaaaaagagaagaaaaagaaataaatttattttactatgcaaccgacgacgtatgaggcagttaccgaaacgcctgcgtattcgaaaataagagaagtttggtttcgatccataaccggcccattaaaaagtaagccagcccatgcaaactagtaactacaaagcgaagctctgaagaacacttatgtagttatcatgcggatcacaattaataaccgttgattaaaatcaatcgacggctatcatgtcatatcagtattgacaaggattgagcttaacagccgttagatgggttattaaatcggatggttgaaaacaaaagccctcttatatataaacaaacacgtccagtcaatatctgaaaatcaaaagcaattcttcttcacacagtagcgaaaaaaagaaatctaattctctcgagaaaatg

SEQ ID NO: 1522 - DNA, 3000 bp, Unknown
  misc_feature (1)..( 3000): cDNA_ID_2138160_gDNA_ID_1620413_Annot_ID_156338 3000 nt of promoter + ATG
accaccgattatattttcgatttcgaatctagtttttatttactgtcattcattacattgaccttttttacaagttaggattttaccatttacatatgacgtacaaaactattggtaagaaataacatttcaacgaaaaaaatgtcacgactgattgtttaggtaaaaaacaagaatttgtgcattcataaactctatataaatctgaagatcaaaaccaaatctaccgtaaattttatcatcgatagaaccaatcacttattaaacctcggattcggtttatgattccaaatcatcctaaaacatacattttggtttttctatatttataatttagagcactctcaaattaatatatttagcaactaactgagatatatcgagacaatttatttatttatttatcgaaagcactaattcttgtcaagtacatacacaagatcactatcaaatattcaaatcaaaatttgaaggaaggaaaaaaaaagggtgcgaagttgactaacagtgacaaagaaagattggtgtggcaaaatgcaccttctctaagataagccttccccatcactgtccttttctttctcttccctttcttcacatttttagtccttaattttagtaatttttatctatatattctaattattctaccaaagaaataagaaatcaaataatttcttttctttttttctcatgaaattacctctatcttttgtcataaaattatttgctgacagattagcttataagagttaaacaaataatatacacgaataggctaggtacgtagttctaacattataaagaaaatgtgtcaattcattttcttttctagtaattatttaaaacactcgaagtaaagttgaagagtatcaagtctacttgattctgattgataaaaacgtgtgggcaagtcaactaagatctgaccttatagtggttaattggttagatttgagctctttaaaaatgtgaagggttatcaaatttatccgatctgattatatatatcctactggtttgtatatatatacttatgtcttagcacttaaaactttaaaactgtgaagggttatcaaatttaattaacttgttagatccacaatttggtaactcatatgattgctacatcaaattaaatttatgtttttttttgtaaattaaatatcctttgacctttatcataatttttctgttttaaaataaatatagttaaattttttaattttttggacataaatacctaaagcagaggatcgacttgcaaaatcttctctatttcaaggttccaaatttatgtatcatgtctatattccacatttgatgcagaatattgtaacagtttagtacttgattaattaatatattagatgtttcaaaactaaactaaaattcaagtcaacatttagatcagaatatcaaaattcaatttaaattttagagatataataaaagtttatatacatatgttatataaatttgtgtgaaaatgtcaaacaacactatttataatgaatatagttttggtttttccatttgatatgacaagttgaatttgcgttaacgatgcatgtaacagaatttgataacatccactagctttatatcaaaaaaattttatatgtctttatatcaatatatatagagtttggcaagttcacactaaacttgtgtgaacattgaaaaagccaaacattattggagcagtgtacataatgctagcatcttataatatctttttaattttgcatagttgttatttgttcaacaaaaaaattggtaataaaaaatataaatgattttttttttggaaattactttattcattttcctgatgcctcaaacataaggtaccatttgaaaaatataaatgatttagttccaaatgatcggaaaaaccttgtcccagattctcttattgttgttccaacgataaaatccatcgtctttgacaacgacgaaacatgagtttttagactccgtagcatctttgtccgaattgtacaaaacgtacggtgtctcgtgcatcccgaaatgtgcttctctgtaaaacgttcctatgcaagttcttggctgccacggtctagatccttgcgccttctcatcaacagcattgtcgccggtagtggttgggatctctatcagcaacttctgacctaaaggtacgagtttggagagccaaggggttcggtggcacgtgacgaagacaggaacatcaccacgtctcttcagctcgttggacacgagaagagtggcggcacgtgtggttgcgaacgtagaaaataacatcatagtcatgatcgagaccattataagagtgtccatgattttgatttttgtgttgaaagtatattgtcgaatggaaatatatcttcgatttctcaaattaggagtatcaatattttcattacgtttttttttgttgtacgtttattgacagatatgattaatagcacattcagttacgattagagattgtcttggtctactacagtagtagcgagttccgtatcggcctatcaaaagcccgattcaggcccaaaagcaaaacacttatttttcttatgtaactgttttttatcttaacttggaaacatattttgcaaacattacatcagccgcaccttcacggtttattttaatttcatatcatttctttcaagtagcactaagtcaaattcagaagttccattctttttataggtctttgattggtctacgtatgtttgacctcaaaaaaaatgctttccttagaactttctatgtttagtaaacttttcatgtgtaactaaataaacaaaacacaaatgttacaaacgacacagaaatcaatgcctctccccctactttttctcctcatctaataattccatcaaaccaaggaaaaaaaaacaaaacaaaacgatctaacaggaataaacaagatagaattataagatctccgacgatccttagcttcaatcaattattggtggcggagaaagaataaataataatact

SEQ ID NO: 1523 - DNA, 3000 bp, Unknown
  misc_feature (1)..( 3000): cDNA_ID_2138145_gDNA_ID_1620413_Annot_ID_156334 3000 nt of promoter + ATG
agctcaacctcaaacagctgagaagaatatagaagaaacacattaaacattattgactcagtcgacaaactaatggactgaagacaatgcaaagaaccttggggattgaaaataacactaaagcaaaatcgtaagatttgcaatacccatttatggaacagtagagagaatatatgtgatgcaaaggactggctccacagctgcaccatcaaatcaagtatatccttccccctctcagacactttcacatagtaatcagcaaggacatcgaaaaagcataacggaccatcagcatctgcttcatcagaagtaatcaaatcctcttctttgctaaggatcacatctgcttcaaattccagctcgaaaagttaaattccagtggtaaaaactgatttgaattcaaaaaaatggggacatgaaaagtgtaacctttggctcgatcgtctacttcgagagctatatcagcaaataagtcttgtaacaagttgcgtgtttgtgctggagagacaacagcctatacaaattccaaaatcaattttatagtctcaaattgaagatgacaaaatccagaaatctagccgtgaaaaaagctgaaaacaggtatataacatttgttgattgataaacattaatcagatttgctgcatgacattgatctcaatcggaaacggtagattcaaaatgaatcaaaaccaaaaaaaatcgaagaaaccatttcttaatcagaatttcgtggaattatctaatgcatgtgtctcgaattagagaaatcgtgttttctgggcaaaatcgaaacccgatcaatacaaatcgagaataacgaagaagaaaaagagcaaacccgtgtaagcttcttcttaatctcttgtgtaagagcttcaagataagcagacctccgtgaaaaagaggaagacggcgacgaaactttctccatttcaaaaaccactgatccaaaaaggaactaccacatgcgatcaacagcgtcgatctattatcgctagtatgagaaatcgagagaatgataatgattgcttcttcgttacgaattattttattcaatcaatcaatgaatggggtctcctctggatttaaaaattagtcgtaattaggcgtgaacttcttttctcttttgctactgtgaactccgataaagacacgagaggaaaaaacgaagatatagtttgtttcaaaacgacttcgttgcattctggatcagagagatgacgtgttggttggctgaagacacgtgtacctcttcaggcccctgtttatttttcttttaatctttttttttttctaaaagtaatcaacgtcgttgtggtagaatagtttcggaatgagattgattaatgtcgttttgtatcttttcagaatttgttatgcaatacgacaatttattcatatcaccttcttttagatctgtatccaattatagaaattggatgatttgattcatcaaattcaaagaacccttaagataccactatctcctttttaaaatggatcaagacctcattatccactaccactcgtggcaaaatgaaaactatataaaatcaacacaaaatggagggaaactaaaatttacgcgctaatgagtaaagttggttaaagcttctttactctcaacatttggacctgacgtcttgtcgtcgttatttatgggcttggtgatgttttattgggcttaaattttgtacattttagtgcaaataaatatttcgttctaaacaataataacgaatcgaaaagcccaagacatgttatactcgagagccaacagtcaagctgatttcaacgtatctcgtcacgccacgtagttgattaacagccgaagatcgccgctgataaagaactagattgacggctgacgagttaatacgtctgctctactgtcaaattcacaattcaaagcgaggtagaaaattagagtcagagtcataagagattatgagtaatcaaacgaactttcaccaaattgcgtgtttccattgttgagaatttagcaaatgaaaacacattacaaaagcgaaatagcaaaaaaaggaaatcaaatcttgctacatttactaaaatacctacattgaaattctcaaatctaatttccagaaacagatctccaaacacaaatctgaaaaaccctgattaaccgccgaatccgtagagagtccttccttgcctcttgagagcgtagacaacatccatggcggtcacagtcttcctcctagcgtgctcggtgtaagtgacagcatcacgaattacgttctcgagaaagatcttgaggacgccacgtgtctcctcgtagatgagaccactaatacgcttgactccacctctacgagccaatcttcgaatggcaggcttggtgattccttggatgttgtctctcagaaccttcctgtgacgcttggctcctcctttacccaagccttttcctccctttccacgaccagacattttctcgagagaattagatttctttttttcgctactgtgtgaagaagaattgcttttgattttcagatattgactggacgtgtttgtttatatataagagggcttttgttttcaaccatccgatttaataacccatctaacggctgttaagctcaatccttgtcaatactgatatgacatgatagccgtcgattgattttaatcaacggttattaattgtgatccgcatgataactacataagtgttcttcagagcttcgctttgtagttactagtttgcatgggctggcttactttttaatgggccggttatggatcgaaaccaaacttctcttattttcgaatacgcaggcgtttcggtaactgcctcatacgtcgtcggttgcatagtaaaataaatttatttctttttcttctctttttttttttttggtcgtatttatatttcttctcctaaaatcggtgaagtatctaaaaacccgttatttaatgcttaaaccctaatcggaaaatctctccgccactgttctctccgactcacta

SEQ ID NO: 1524 - DNA, 3000 bp, Unknown
  misc_feature (1)..( 3000): cDNA_ID_2138164_gDNA_ID_1620413_Annot_ID_156339 3000 nt of promoter + ATG
catacgcttttctaaagtttaccatttttaaatttcgaggttttttcctcctaaatcggataagtttaccattgttagtttagaactattttgttgttgttgttgttaaatgcttaattagaactaattaatctgattacattgttaataaaaagagatggtttcacctcgagcaagtgaaaccatagtgattaagacatatttgaaattaataattggtatgatcgtaagagaaatacttttttttttttcttattaagaaaattacgtaagaaatattttctttgggtgtacttatactctgcttttttctttttgacgttattgaagattggctaatctttggcacttaaggtaaagcatcttaattaatcatcattgatcccttctattcaaaggttaataaaaagaaagttgattatttatatacatatggcttagttctaatgtcgcagtaagattctttggttcctcctaaattatataattggtggatatatacaacacttcctgatataatataggacatggacatacatgatacatttgtacatgcataggcagaacaaatagtataatataatataacaataataatgatcgcgtggctggctaacataacactttctttttaattaacattatcatatggacacatcacacatgcatatatgtcttcacgtggaactcaaaagttttaagagaacttttgtaattatcaccatctttttatattcacctaaaaggtggctagttactgtccgtactaatgtccatatatattcgtataagatacgttctatatatgtatacatacgtgcatacattatagtactatatattgttggagccttaatcagaaatcaagggttggtgtaacaacaatatatgtacatgtgaaaattttaaataagaaaaaacatgtattaatacttcctccaatctaatcaaactcacgtacatgtatgtcttacgcgtatatgtgtgtgtataaagactacactttactacgtagtaattgatatatagtatcaatttaatatgtgtttataacatatatctatttttttaaacatatctatttaagtttaagtttaagtccaataatttcattttactagtaaagatcacaatgtcatttaccgcattcacttaataattgctgaattcacatagtgcctgtaaattaagactaattttaggtttcaaataatttttcttttttacataacttacgatcgatattttaaatggtattggtaagtttaaggtatatagatagtgtgtctaaactagagttcgttgaaattggtctgaggtataaatacctaaaaggttatatatgtttttagtttaatgtaattcgataaattttagtcgaaaccgttaagagatatcagaatttcgttttcaaataatatgggatataattacccgggattaaccgtacctgataaaatatagctctcgtacgtgtcacatgcctaatgcctagttaaacttaaaacgaatatctatatttactgttattgattgtgagttaccaactaaaatattgttaaaagacattgtaaaactacaaatggttcgaactgtatactaatgatgtaaactcgtgtttcatcgttatgtccgatatttttttcattcaaccattattcaatttcaagatttctttattgtctttttttctttctagaaagcctatatatttaattacccactttgcatattcagaggataagttgatacgtacttgttagcaacctgtctagatcatcttttgattgtagatttgactttaaatttctcacaattataaatatgaaaaataacaagcaaagaatttacaaatgtatataattatatacacgcattgatgaataaacatatttagaaaataatgtgttctaaggaaattttgtggcattttttaaaaaataattaaacaaataagaatagtgtaaagttgtttaaatatgtatgtataagtggcatgcctttgaggatacgaacttaaaagggagttaggtaacttgcttgggaaataaaatagccaaccttaatttgaggtttcctcaatgttcttatcaaaaagaataaaaatttcggaaattcccttcatggattttgatatctaaccctaatcgtgaccttctttgatagctacaatctccctctctttgcttattccccaagcaattttagcttacgaatgttttgactaactccacatcggtttatctcttaagttccccacctacaaatatacaaaaaaagaagtaaaataaaaataattattaacaaaccgatgaagtacttatcatttataaacatgcttatgaaatgtattttctaaaacataaccgctaaccagagaagtttcctagagttctgcttcagactcttttggtcgatcaagaagtctccaagagttgtttttgttgggtctaaacaaaacttggccagggaacaaatcaaactatattattaatcttctacatctggtcctaagttccttactatctcatgttaaaatttgaagtctaatatactcaaagctgtcaaagaagcagaacatggaagaggaactgtcatatctgagaaaccaaaattggcaatcttgcatttcatatttagaatctacgccatagtattgagatggaaacaaagagttttcgaagagggtcaaagagtttgacttatctttgacaccactcatacattagctgttcatataatctaacaactagtcaatatcaagtgtctccaaattacggagagtacttctctaccaattatctttttgtttttcataaacattttactaattgttttttctatatctcctgctcaagcaaacacctaactctcctttcctatatatacactaaaggttgaaaacaatgaatccacaatctacagcaaaacataagcgaggcagagtcttcagaaaacttacctgctctaaacaacgcctccgtgtccaagctcacttca

SEQ ID NO: 1525 - DNA, 3000 bp, Unknown
  misc_feature (1)..( 3000): cDNA_ID_3410227_gDNA_ID_1620413_Annot_ID_156331 3000 nt of promoter + ATG
aattcgaatattttgattttgactttaaaataaaaatattacaatcctgatctggaaactctgtatcatatttgttggaagttggatgggatcaaaatttctctaacctccacgttcagcttccatttctcctaaagaaaaagagaaaagaaagaatctcattcacatacatcatacatggatacaggagcagtaaagctacccattcacgagcaccctatatttccttcggctcggatcgtttttagtacatgtaaaggctgcggtgtagaagatttcgtctacggcgggtacgtctgcaatgattctgactgtaaagctcggtttcataaggagtgcgctgaggccccatctgagatcagccactctttccaccaacaacatcctctctttctcaccaatggcctgggagatcttccatgtgatttgtgtggacaaaagcgattggaagccgctggttatagttgtcccacatgtgagttcaagctggatttgacttgtgggataaacccatcaccgcctgctattgaacatcctatctgtcatgaccatccacttgtctttttgaagaaacgagaggagaaggccccttgtgaagtttgcaaggattctattggtggaccttcctattcttgtcttggatgcgatctgtacttccacgtggattgcgtccatctctcaaaagaggtaaatcatccttgccaccctagtcatcctctcaagctcatcgcatctgaatcacttacggataatgctgagaagatttgtcttttatgtgaacaacaaccagaaaatatgctttattattgttctgtttgcaacttcacatcatgccttggttgtactaaacgcccaccacctctttttatcgagcataccaagacccacaagcatcaacttactctctttctaaacggaatttcatatcaaggttccgcgctgacatataacagcagagcttatatgtgccttccttgtggtttcgttgtcaatgggaatggtatcaacctacctcaagtcataaacatcaaccgtcacgaccatcgtatctcttacactcatcagcttggccctggatatttgaactgcggagtttgccgcgaaattgttgacagggattgtggggcatatgcttgtgtcgtttgcagtaactatgcagttcactgggaatgcgcagtacatgataatgtatgggatggtgtggaattagaagggacatctgagatcacagaagatattgcaccattcaaggtaatgggtgataacttgataagtcattttagtcatgaacaacatactctaaggctgcacaaagaaggcatcattcatgacgcgtacgcactatgtgaagcatgtacatatccgatcggatttgatccgatctacagttgtgaggaatgtcatttcattctccatgaaaagtgtgctaatcttcctatgaagaagagactcgtgtttgcaaccacaccattcaaattagtgggagcaagtagtcgtgttcgtgatgtgatagactgtgggtactgtggtgaatgttctactggttttaagtacgcatctcaaagagggtgggagatagatgtacattgtggttctctttctgagccgttcgttcataatggccatttgcatccactatattttgattctaaggaaaatcactcttgcaatgcatgccataaggtaacggttcatatgctttgttgcaatgcttgtgactttgatttgtgtttaagttgcgctagtttgccattaaagataaggcatagaaacgatgagcaccctctcactctatcttgtggtgaaacggcgaatggaaagtattggtgcgatatatgcgagacagagttagatccaagtaaatggttctatacaagctttgattgtggagtcacattgcatgtggaatgcgtactaggagatttctcacgtctcatgccaggacgcatggttgatactgttgggggaaagaaattttatgtggttcttaacaatcacaacactcgaccattatgcagcatgtgtcgctctcgatgcaaggtctccgtcatcttaaaagcttgtgatgaagacaatgtatacatatgttctcgttcatgtttttctgatatggtttcagctagatcatgttgattgagtgtttaatttgtttaattttgtgtggaaaggatgaaacttcgataccctttatattttacaagatgagtgaattattcatggttgcattcgctagctgccctacaagtccaaattcaatatctgattttaatttgaacttctttactttgctcgtcttgcaacataactgagttgtgatttaaattctaatagatactgttaagggtttccatgtctctatattttatctatataaagatatgcctaagagtttataattccatcactcataagattaatgcaagaaaatatcttagagactacaaggttcaaagatatttgtttattcttagttatgttttctaagatttctctaaattttgcccgaattcacaacacagctttaattatcattatactcttccagttttatctgtaagaaactagaatgcaatcagactcattgttatgcgatagcatgatcacttatagttatgaaaatcattgttatacggtaacatattgaaaatattgaattgctatacaccgaatggccaagtatatataaccaaggtaaaaatatgtcaaaataatggcttcgcccgggttcgaaccggagaccttcagtgtgttagactgacgtgataaccaactacaccacgaaacctacatgcttctttctaacctcaacaatatatatatacatatagataactgtttaatattgtaacttgtaaccagtgtcggctaatttcgacttttgtagatctttttctgctctttctctctctctctctctctctctctctctctctctctctcttgtattatttctatctcccccgccgtcgaaagagaaacgtcgatcggagaacctttgaa

SEQ ID NO: 1526 - DNA, 3000 bp, Unknown
  misc_feature (1)..( 3000): cDNA_ID_2990403_gDNA_ID_1620413_Annot_ID_156318 3000 nt of promoter + ATG
tacattggattgttgtagatttatctttctcatgtaaagcaacatacaatgtatatttcatacttcatttatacatatataacttcactaagaatattttaatacatcaaatcattttattgtcaaaatctttcacatattcattcatagaagtatctcaagctcattattttaggcatcaagcacaatcttaacatttcaagatattgtgtctataaggataatcttaagaacatgatcaaggacatttggacgtgcctttggagttcttcatatcgcggtaacaagggcattcatctttgtttccataagtgcctgaaggaacacaatagttacacttctcgcaacatatattacaatacttgagacacctatcttgtcttcctgcctttgaacatctcacgttgcattttcctccgcatggtgctaattaatccatcatcacaatacaattttattaagaaagctaaatttctaatgagaaaagtatctaaaataagaaaatgcattgtgtatacttacacgaatccgcggttgagagtatgaacaaagaagatgtgatgagaagagagataataagaacttttacagccgggaatttcatcgtagttcttgatgagattgttttaataataatctgtttggagaaagtttgttactttgagaagatgaagagaaaactcgaaggtttcacacaatgcaaaaggagtgatggtttgggaagaaaaggaggttacaaaaagagttacttatagggaaattttggagtaggtgaaacgcttgttatctagtccatctgtcccaatttataagatttttgtggggcttaagttcaaagattaagaaataattaatgttttctcatttatagaaattcaactaataaaaaagtacgtcagaattcaaatagtaaaaaactaaggggttgttattggtttatgatttcaaaagagttttagtgatttaaaatgtcatgtagaatctgttgttattcaatcaagatttgttaaaagtatgttaaagttttgtgttattcatttaagatttataagaagtattctaaaatctgcataaattttgggttattggattcatactcaagtcattaaaagttttgtgttattcaattaaaacaaaaaaatttctcattgttaatgatttcaattattatgttattggttcatgactttttacatttttcttcacaaaataaagtcatggaaagtcatgaaaagtattattaaaatagagagattgtttgaaaaactttacaaaattatgaaaaactaatcaacaagattataaaaaactctctaacaatactttaaaatactttatagaatgtgattgaaatcatctaaattccttgtaaattaagaaccaataacgccccctaataaggtaataatattgacttgcacgtcaattcagttaaactattgtcaatatatactggtaaattgttttaaaacaatatgtttacaatgtttttgaggactaatactctgtttatataccttttaccatttattaaagaaatggaattgacgttagcttctatcaaatcatgttccaaacttttgtatcatatcatactaatagaaatgttacaaatatggtaaatttgctttaaagaatatctactaattctgctgtttgcgtgccgttgtataattgtattacagattcttgttgttgttatcaaagttagatatgtatatataatttaaaaatttgataaagaaaaaatacacatgaaatgatcattatttttcttagtgggacaatgtcgttcacgttgagcgaccatcgcgttaaagctataaaaagagtgacacacgtaatccgaatctaaaggcatgggaacttctacatctttctcctctttttttttttttttttctcttagatttcatttaatacttataatcaattttctaaaataaaacccttagagaagttggaagaaaaacaatccataagaaagtattggttgtttaaagctatgcatcaattttaaggatatcaatcaaagttaaaacgatggaccaccgacttattcactatcaaatatgaatgatgtgtgttttgtcacgatttaactaaagttagtagatcgttaatagatatcttcgttcgacgaatcttgtctaatcgagtgacaaatgggatgaattcaacttcatattttgtttggtaaacggtctccggttcttagaaatctttttagcaataggtttttgtctgcatgcttagatatattaaatcttctttttgatcattcacatactgtgtatatacacatatatgtaacctgcagagaatcgggaaaaaagtattttaactttaacttgattcattgtacaactttcaacattttcttcccccatcaactgattatagttctagaaatcattgttgcgaatttgttggcaaagagtagcttataagcatgtatatacttcagccaagttgccatttattttccatatatgctttgtgtgacatttgagtttttgactttcattttgcggaactataactatccataccacgtgtctatttctggttagtccataagattgatttatatttacgagcgtatcagaaaaggcccacaaggactcattaaagaagaaaggccaataaaaggcttcattctttctgggccatcggactatgatcttgctaacttacgctggaggtaatatcgtgcacgcgaagaagaggccagaagagaagttaaatcaggactggcgtattttagccgtccgccatttccatcgctctctctcgtttcttctctgctcatttactataaccaacaaggtctcttctcttctcttctcctctctgcatcattttgatccggtacgcattcttcgctgattcctttaggttcttcaattttcgatctctgttgtcttcagatgacacaaagcaatttggtttttgatctctgagtttttgtttgtttgttttcctcatttagattcgatg

SEQ ID NO: 1527 - DNA, 3000 bp, Unknown
  misc_feature (1)..( 3000): cDNA_ID_3062820_gDNA_ID_1620413_Annot_ID_156321 3000 nt of promoter + ATG
accaaatcggtttcgaaatcgatgaaagccggtcttcaattcccagtgggaagaatcactcgtttcctgaagaaaggacgatacgctcagagacttggtggtggtgctccggtttacatggccgccgttcttgaatacctcgccgcagaagtaagtgtttcccgatctggattttctagtaagattttttttttacatttcaaaatcaattttctgattcgaatttattgatctcaggttctggagcttgctggtaacgctgcgagagataacaagaaatcaaggataattccgaggcatcttcttctcgcgataaggaacgatgaagaattggggaaacttctgagtggtgtcacaatcgctcacggtggtgttttgcctaacatcaactctgttctattgcctaagaagtctgccactaaaccagctgaagaaaaggctaccaaatcaccagtcaagtctccaaagaaagcttaatctgctagagttttcgttgctagtttgtgtttgagctctggtgaatgtagaaatttgaagcttttggatcttagtttctatgtatttggtgatttagaatgttgttcaaaatccttttcctaatcataagaatttatgatctatctattatacgcttcgtctaatcttttggtccactcgtcgtaatgtcattagtgaatatttaataaacaactttgtcatcgacattaacgaacccttttattcgctgtgctaaatttttcttttaggtgaagccaaatctaacatgttctcttctctctttgttcgttgtaattccataacatctccattacgatgttttgcgattcgaggatcttgttctaaattattcgtcggaggtattgttgtctctcttcaattcggttgtttaacttgacttttgtgtcgaatgtcattagaattgttttagacaatctgtctaccgtagaacacaaagggtctattatgtttctttccgtgatgcgaaattgcactctaagtgtttgattaaatgcgtgaaggagaacactgaatgtgataacaccattgcagggctatcttatgacactaatgaacctgttttgaagaatgagtttgaaaagtatggtgagattatagaaggtaggattcgccaagaaagttattagtcttctacgaaattcctccatgcttaaaaccaatgcacttcctgatttgtatttgttggatgtgaaagttcagtgaaagtaatatgcgatcacaagagtgggaaatcaaaaggttatggttttgtgttatttgattcagaagaagctgctgcaagtgccttagcttccatggacaatcaggtttgtacacaaaaccaatccaaaaaaatacattttatcgaaaaaaaagacatgttcatacaataatcttgctgtcttttgttcagttattagaaggaagaaacatcagagtcgaatatgctcaacctaaaagaagtttataccagaatccgaaatgattcttctgattctcgaattctcaaggtaattggtacttcagatctctcaggaaatgcatttactttttagagttgtgacagtgtagaactctagaatgatttggtgaagagtctttagttgttgtgtaaggacagtgtgtgtgccctcttcaatccttgttacttttcagacttgttgttggtgcttctacttcctttgcagtttccacaaatattagtctgccattaacaatctgaaaacaaacaaccaaatgcaaagctcagtataatttccaaaagagctcaattaattacacaccaatgctgaatattttccttactttttccgtgaatcgattacgattatgccaaacaagcgattttctgatttaagattcattttgtttcatatcaaagccaaagatacatactacatttcaagagtgagtgaagattgaagaaatggatcttcaccttcccattcaaagctttcaaagccttttgtgcatcatcctcagactcaaaagttatgaatccgaaacctttaggtctctgcgtttgctggtccttaataagacgagctataagacagtagcatacaaacgacacaattagttcagacacataatcatagccgtaaaacattcgattctgtaatctgaccaaaaggcgcaaacagttgcctcagtgattgatctgtggtgtaagcagagagtcctgcaagagaacagtttgagaataaaaattcaaaaactgagaaaagcagaaaaactggagatgtgcaaagttgtagcatactgctgacgaaagaaagaaacctgaatttgaaacacaagtgagagtcttacctccaattaaacgacggcgcttggatatagacgatctaggctgtgataatgttaacgagatattaagaaaggcccaaaataaagcccattataatgatccattaaccagtctagtaaagtttcataaggcgccccaataaaaagcaaaaaccctaattcgcatcttgtatttagttctcttgttaaactttgcctcttcgtcttttgctccagagtttttgtgcggctgccattttcgatttccaaaggttagagagatctccacagctacgagctttattcctgtttcctttctaggatctgctttcatttctgctcaatcatgacgtgaaatctgcttttaaaattctctgaaaattctcgtagtttcatagtttgagctcgatgctatcgattaacattagtttcttggaccagaatacaattagatctatcgaaagtttgcttatagttctatgtttcgttgattgccatttggttattgttgtattcatttcaatattagaatcaagttcgttgattgtcgatttagctgccactatagttgtgcatttgaagcatgaatcctctttttaacacaaaagagactaaatttgattagtcaatgtttattggtgttagcattagtacgtttggtatcggctcagatttgttgttaatttggtatcaggttttgagctttgaaaaatg

SEQ ID NO: 1528 - DNA, 3000 bp, Unknown
  misc_feature (1)..( 3000): cDNA_ID_2138131_gDNA_ID_1620413_Annot_ID_156330 3000 nt of promoter + ATG
tggttattgattatgaaatccaacttgcagtttttttctgaacaaatgactattgttgtttgctttatgtactgttttatccgctgattttgtttcagtagctgagaattgtttggtattagacttgcaagaatattccggtatttttggaatagatgactattgctgtaagctttgtctacttttttatccactgcttttgtttcaatagctgagaattgtttgtgttagacttgcaaagatgctggtttagtttctaaagctctgttccatattgtcaactatgattacattgtatgtttcctcactcttgatcattgctttagattgacatatgtatatatgatgcatgatttgttcttaattttggcttaggttttgtaaatagtgtgacgtgaagtggagtacatcaatagtattacagcattcgatttgccataactgatttgtattctgcatcagtggatctatcttttaaagataagatcctttacaaaggatgaaaaatcattgaatgtgttcacttatgaaaaatcctctcaaataaaacattacacaagaataatcaatcattcttacttttaagttttcaagatttgcatcatcgaccatcaaaaactcccaatacacagacaggggaatctaggcaaacatgtgatgactcataccagaggtttcacttgcatcagtaaaatcctatacagaagataagcgacttcattagaaagagaaaccatcatcccaagcgcaagtgatgcagactgtaaaatcaaagagacgacaagtgatgcaattaaggaaaactaccaaacaattctcacagaaaatgcatcaatatgtttatacatgcattttcaagaaactagacagaatcaaacctcattgttatactagagtgtgatcggctatgaacatgaaaagagttagatggcttatgtttgctaaaaaaagtgtgatggtgtagaacataattgaatggaatccatgagaatgacaaagatattgctctgttcaagttggtggcttggtgattacttgataaagaaattccagccataaaaaacatactaaagctcaagaaggacgaaagtaaacgatctgaagcatgtgttcttcatgtcttttcggatccaatatatagctgtgacctgtgagcaatgttttttcattattaacacataacctgcgctaaaattttcaggcttgagattcacaacattcactttctctaactagtaaatatggatccatagtttagatgggcttaggagcataatcatttagtgaacggtttataagcccatttaagattcatacccttaaaaatggcttcgtccacgctattcgttagtagataaggattcaattttactctatttgccatttgggcttctaggcattttccttctacatcagcaatgtattttgtacgagtctaggtttcaccgtcaacatttcacattatggataggatctggttaattagcaagatttgtttaatcacaacgtgtccttgttccctgggagctacaagagttgggggcatgatgagaattttttcatgtgggcacgaaaattcaggccgtcagcacagcttgccgcacttattaattcgagaatcgtgattaacatcagattaataggaaatccacttggtttattaaacaaaacagcattaagtaatcgcatcaattagaagatgattgaagactaatctcttagctgttcgctagtttgacctttcatttaattttcagtgacaaagaacgattcaaattctggacgatatgacgacttctatattcaagaaaaataaattaattaagacttaatttgtggaacaattatttaaagttcaactgcctttgagaaattaaaaaaaggactatacacatggccggtcctattttgacgtggccaaaacgttttaaaaataaattggctctaactgttgtttagataaattcatttgacttctaggatgttataggattttttatatgttttatttaattagatgttttgttattttctatgtaaaatttaagtgcatttagtagtcatttctattttttgtcaaacaatagtcatttctgttatgtaccgatttttatgattggttgaaattttataaatttatatatgggtattaataataaatattttttatttaaaacaaaatcaagatggattattattttagtagaatctactagttattgaacattttagctgtccagctagagctagtaatttaagtatttaactgtatgtatgtatattaggaacgattcaaatcttaatgaggaaaattatattccaaccacgactaagtcaactaaattatagaataagaaacgatataaaaaattaaacaatgtttaatgtatagtatttaagctcttcgtacataggttattataattaacaaaacagagtatttttttttttttttttttgttaaagcgtacagagtattttcagaaactaacgttagcagtcgaagatttattcacatcgagttaataagaaacgccacttgagttattaaacaaaaccggtattaactagttgagatccacgacgatattttctttaaaaaaatgattcaagcttcaagcatgttagctgttagcgaaaaaagcctcctaacttcacatgtgagacacagaggaggaccttgtatggcacggaacggacaatatgttccggtatactatataggattagataaacctctataccaagattttttttaaaaattatacaaaaaaccacgattaatatctaaatcgctagaaacctttccaacttttttttttttttttatccccacccaacaccccaatttgtttttggtttgcgaaggcaacatatataacatacatttttcatatttttatttatttatatacaagaagataaatatattgctgtcttccggttcgacttcgtgatctcaccaaagaaacacgcaagatcacttccatcgatcaatac

SEQ ID NO: 1529 - DNA, 3000 bp, Unknown
  misc_feature (1)..( 3000): cDNA_ID_1388464_gDNA_ID_1620413_Annot_ID_156325 3000 nt of promoter + ATG
aatggtggttgtgttgaactggattggttatgttgccgaatataaagtgagatttgatttaaaatggattagaagagttatcatcttaaaaactaagacgaagttaattttgagacgaagttcatgaacattataactaaccttaatctgtttctgtttctgtttctgaagatgattacctaaaatcctaagtctcatacttgatacttatctaaagtatactactagaaaacaaaagtttaccctttcaatgaagatagagttataaaaacgttttcacgagatatcgctttgatgtgagatagcaaagagtcttaagacagtaactcttttgagaaattcctaaatgcctttcgagataatgatttttttggttcatttatcttagagattgaaaacaaattttactttcttgtttgatcaattatatatgtttggtttttgtgagatttgatatcaatgtcatgtagagaatcacgcattccaagttttcaactaagaaaaatacagatgggcttgtgtccataatattctttggacttggaattcttgacactatatctatgtttgtttttaatatctatatatacatttttgcagccattttatgaaataaatcttgtagttgggacttatttacaatggttgccattggattttaatatttgtttttgataattagaagaaaattcttcgaattaaatatttgacatttaacaattttcctaaaatctctctacattaactacacgattggttaataaaataaaactttcaaaatatttaatatcatttaattactacaaaattatcattattgatattgtttttctgcatgactattacaattcaattataatcatcaaaccgcagagatatttgatagcatttaattactacaaaattacaaaatatttagacaatgattcataaacatatgataaataagatcaacattaataaaataaatgaattttttttacgggacgggttagcgggacgggttagcgggacgggtttggcaggttgttacttaataacaattctaaactataaaataaaaatattttataaatagttacatagatagttacaaattgtaaacttttatatatactacctttaaaatataaattgtctccgcggtataccgcgggtaaaaatctagtaacgcctattatggtttgaaatatgattcatcacatattatatatatttttatttgtttgtagttttgtatgttttggggttttggctatgtttttctataaaaatcaacacaatactaagttgagtaaaataaattattgaaccagtcagcgatacaaaaatatctaataaggaagaccaaataatcagcatgaaaggtcgacaattaatgaagaaagtcattttgtagaaatgcaagccttttgataccagcatagcatacgggcttctaaattctaatgctcacataatgtcatttattgtttaagaaatatctaatatcgctcgaaatatgagatttgttgttgtcgaaaaaacataatccaaagagttatcaagaatctaaaatcttgtgttatcaataatctataatctcgaaggaagtatgctttggttcaatcaagtaacacacgtcaatcttaatcctattgaaacaatggtatagaaatatgcaaatacgatcatatcaactaagatataccgaaaccaaatatattgggatctttcaaaaggacacgatcgggaactctaactactgtttgagactttcctaaagttatatcgataactaacggtcaaatacctgcaaattttggatatatataaagatatataccgagtttgtgtataaacatgttgtttctcctaatcatacgttattggaaacattaacgcggtttgctttatgcaactttgaaacatttgctaatttgttgatataaaatttggctatttatactgtttagtttagtaaggaattaacacaaatgttttagcgcattattgcacatttgtgtgaaataatatactattttcgggaaaatcataatcgaaatagaattccaaaatttccacgtggcatattatgaaaggaatattccagctcgggtaagctggcctccatcaccggttatgatgaaaggtgagccgaaagtggagccaacctgagatgccccgcatgagagccatatgcttcttcgacctttcattctatattctttccttttaaagatagcaactattgatcaaaaaaaagaagaaaaaagataggaactatagaactatagtctttttttttcaacgaagaacaaatatatggttatgaactattcttaatggatggtcaaacagattttttgatttttttctaagaaattttgcatgtgaatacataactacagttaattccattcaactgttacttttctttgggtgaaacaataggttggcaacttggcatagatatcaacatcagagttttgaacaaatctatcatcatttaagaaatgatagaaaatcaagtattgtttttcaaatcaagaaatatcaaagaagaattctgtattaagtttagttctcatggaagccatagaatatatcagaagtttgaaacaaacagcaaatatatggaataaaaaacatagttattggaataaatagaatagttatttttttttgtttggcataaaataaagaaaattatttgttcaacaaattgttacagatttcacttatgtatattttgaactaattcttatttttatattaattaaatcaagattttacttttgaaaaataattaatgaatttatgaaacaatctctatgtaaataaaataaagcaaattaaaacgctcacacatgtttacttattcggactagagagcttccgcataaagctgaggaaaaaaaagagagaagacgcacaccgaagaaaacacacaagactccattattctcctgcttcttcgtctcttcaattattttctctgagactagctttgattcaacc

SEQ ID NO: 1530 - DNA, 3000 bp, Unknown
  misc_feature (1)..( 3000): cDNA_ID_2138101_gDNA_ID_1620413_Annot_ID_156317 3000 nt of promoter + ATG
atcttagtataaacaacataaaacgtaactaacttagctatctttctacattttaacccctatgaacaagaggtgggttgaacctattaggctattacatgtgacccgctaaatagccaaatgtgggtaaccacctcaaatcactacaaggctcatgtcaaactctcattaccattaatatccgggaatcaagtttatcagaaaatgagattgtcttgcattcaaactaagaaaagaaaaagaaaaaaaagcaagaagcaatggagatgagtaacgcaatgaatgagtaatagctcaatgtctacataattggactcgtacatatgaactcaataaaataaagcaaatggacccgatttgagaccagtaatggttttgaaatcatatatttccaagcgtaccaaaatacacttacgattaaaacttgaattttttttggcaacaaacgaattatatttttgttagtattaattattgtattcaacgaattacatttgattggccgtatactctggaagtgtgtaagtataatattttctttggcttacaaagcaaaacaaaaatttgatggagagagtcaaacaaaaaaacaaaagaagtaggtcatatgtttatccattcatacgttggttggtaatcctaaaaaccaacaaacaatcatatatgtatacttgtccaattatgtaaactactccattgataatataattgttaattattgactcgacttatctactgattatgaaactaccaacaaatgaagaaagtaaagggagtgtgaaaacaagaatcttaaggtataacgaagatttgttccgcgtggaaaaggcattaaaagtgccacgtcactctctctttttattttatgattttcgtatctcttcttctacttgcttcccacgtttccatcaagtttccgtacatatcttcttgttatctgatccacgcgatctttcaacgcgtacttttcacgtatttgtgttgtcatgcctttgctgggattgtgttagatgctcattgctgacggtagtttttagagaacattctagaaagaaactatttttctaacaaaaccacgaactttgttttctagttattccactttctagaatacacctgaccaaattagaattctagaaatgaattttaaataaaccaaaacacctaaacgaaaagcaaaccataggtttttggttttaacatatttcaaattcataaaagtgaaaccaacctacaccatattaaccaatatttattagagtttttatatgttttatgatattgttcaaaacttcaaaagagatttattcatataacatacctataccataccaatgaatattaaaattatgaattagtatccttatattatatgaagtcaatcaaaaaacttagaagcatttcaaacggaatcaaaccattcatatatgaagtattattattatatctagaaggtgttgattttaaactattccgtataatatatctagaagacggctccgcgcgtggggaatgcatcaaactcagagagtttaatagctttttttggttgacgtcaactactcaaaagagtttagtttttgatgtgtatatatccaaataaaatatctttaaaaagaaaataataataataaatggtttcgagaaaacacgaggaagattctcatccaaccgaaacgactctttcgtttttagtagtctcttaagctacgcggtgtcgcaaatcgtgaccacataacccgttttttccttcttttaccccttatctttccacgtatttacgttaatacctacactcttcgctgccacttccttacccaccaagtcacaagggtatattcgtcactttccacacgtctttggtccacacaaactcggtatctatatatagttcccaaacggacacgaacacatcatcacaactactatcacaccaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcattggagatttgttatgagattatcttacttagcatttagtgaataatctattagcctattttgccgacgtgaaaataccattttctatttaattttgattacttatcaactactattaagctgttattttcccccatcacgaataaaaacaacccaagaaatagatatttatttgaatttgaaacttacctataaatttagttgagctaatcaaaattaaattttaaagcatgatcagaagtggaattcttgagagtgttgtttgtgatctgtcaacatcttctgtccaaataaatggattcaaagaacatggttcaacaccatctcagtgtcacctttgcgc

SEQ ID NO: 1531 - DNA, 3000 bp, Unknown
  misc_feature (1)..( 3000): cDNA_ID_3062919_gDNA_ID_1620414_Annot_ID_156358 3000 nt of promoter + ATG
gattcagcctgtgttgtcttccctcctaaagtttttcggattatggaaaaaccattatatgaattccgtgggcacacgggtgaagtcttggacatctcatggtcaaaagataatgtaagcctccaaaatcttttgcattttcttatattaacttgcaaccattgctttaacggaagcgaaaaactgaggcattttgttatgtaatttcttggtgtagtatttgctttcggcgtcaatggataaaactgtccgcctttggaaagttggtagcaatgattgtcttggagttttcgctcacaatagttatggtatgcttcttcttctttttggtttctagatctctttttctttttcagttactacattgatcttacattacctgttgcctgcaactttctttttgcagtaacctctgttcagttcaacccggtaaatgagaattatttcatgagtggttcaattgatggaaaggttcgaatttggaacatttccggttgcagcgttgttgattgggcagatctcaaagacattatatcggcagtgtgttatcgtccggatggacaaggtggaatcatcggttctctgaacgggagttgcagattctttaacatgtctggagaatttttagaactggactctcagatacatttgcataacaaaaagaagtcttcaaataaacgcataactggttttcaggtaatgtctcctatgtctttccctttctctagatacttcgtttacttctcttgaaatttgtgagatgttaacaaatcgtacttgctttttccagttcttaccacaagaaccgactaaagtcctggttgtttccgcggattccaaagtcagaattctccaaggcaacaatgtcgtcagaaaatacaaaggtatgtttctttttatgtctccttcaactttcattttcttttgcatagctctattattgattctaaactaatcccatctctgttttttcaatctttaggcgtttgcaagacgagaagcctcacatcagcatctctcacatctgatggaaaacacattgtttcagcttgtgaggactccaatgtatatatatggagcaatgatgaggaatcagaaaccaaaaagattcgatcttttgaacgtttctccgccaatgcatcagttgcagcaacatggtgtggattctcagatcacaacacaactctcccgttttcttctccatcatgcttatctcacaacgaaggatttgtccccggatcaatatccaaagggagtgcgacatggccagaggaaaacctacccgcaaatcctctgtccacatccgcgatgaatgcatctcattacaagtttctcaagtcctcttaccagagagcatccagctctctatcttggggtatggtcatagtcacaggtggttgggatggacagataagaacatttcagaactacgggttgcctgtgactacttgaaaaaacctgtttcgttttcccaactttggaaaacaaatcagatgccattgttcctatcttgataggcacaagcacatggttctagcagatcatgaagcaatggtgggtccaaaaccagatccactctaagatctctggagatacatcaattagtcaaaaagtgatacaattctgttacttctcctcaagatttatcatcatcttgtagaaaaatctttgaagaagtggtcagtgggagaggtttcaatcggttgatgtagacgcaggagatgataaggaacagatgtttctgtttttggcaattagtggcggttggagatggtttttagacagtacggatttgtctgaaaattgacaggcgattattgtagggtccaaaaccaagagaggcaaagtagtgatcatgtaaaggagtggttgaaggagaaagatgttgacgttacttccacaagaaagatcttccaatgccttctcctaagatccttttttcaatttaggattttgtattgataaatttctaacgtagtgattattgattcgttgattatgtgtaatttgagtctctaacgtgtagatgagtttgttatatagctttgttctagatttgatttccacttattataagagacaaatcaatagattgtaagagctctccacctcaaagagaggctccggagatttgtagctgtaaattttgtacagagtaaaacttgttttcttccaagtacatacagttaaaaaaaactagagtttgtggtgtaacatgaattacaagaattgttgaaacttgtcttggcgatttacccactctttgactaagcagtaaaagaaatcgcaaatatatgagaacacatagtaaatgatgatcaatgaatctgaaaattttctgattgaccaaatcgagataaggtaagagtttgtggttgaatgttaggaaattgttgtgtcaaacaaattagtgtgtgcaatcatgaatgatggttttgtgctctagggttttaacttttaattgacctagaaggatccgatagactatggaaacaaaaatcttactaataatattccgagtgtatcttataagataaccttacatttgtagaagatgttctcatactaatcaatttttttaatatcttttattagcttacacaaaataaatataatcatttattatttaaaatcgtttttaatgtaataaatacaaatataaattttattttaacataaataaaaatatataaaataaaatatttactattaagctattaattacgtatttagcatggtaaatcatatattttgcgtgggttagaagtcatcaataatatactgtagatgtttaaccgatgggctgcactacttgatattatatccaaaaccgatgaaagatttacaaatggaccaaatagtaatcaggcccaatgggctaaatcgtatatagtctgatattatgatctgtcatgccacgtcataggcatgatccataacgaattgataaaactctatggttgtccaagttcgaacaaaaatctgaaacacacttccatg

SEQ ID NO: 1532 - DNA, 3000 bp, Unknown
  misc_feature (1)..( 3000): cDNA_ID_2046241_gDNA_ID_1620414_Annot_ID_156379 3000 nt of promoter + ATG
tgatgtttataataggaattagggtttctggtttgtgtttgccattttagctactggtgagattttgttctggagttagagtttcataagttccaccaatacgttaatgcttcattaacattactatgaattagttttattttgtgattcttgagatgccaaaattgctaatacgagaacaccttcaaacgtttggtattgatgaatgaatactgatagagttgatgcacatagatgtcatcattgtgaatatccatggttgccatttctctgtagctttgatggtaatgattatactacaattgcatgattaaaaatatgctttagaattagtttttttgagaaccttgagatgccaaagttttaacatgagaaaactgccaaacattttgttggttgaattgagtgttagctttgtgaagaaccgtagcagcattttctatgtagctttaaacgtataggatactgacattggcattgactgttagatttgatctctctttttctacaggcgaagtcttttcatgactctctggatagaaggatctctactcttgaaagcttgagacaaagtgaagctcctcagcttgctgagacaactgaatagtaatctgtctcgacattgaacactctctgcttggcaatgatgttttgagttgagatgctcttttttcggttttatgaataacttggaagttcttgtatgactctactgttataaaacaatgaagtttaaggtagtcgacaatggattgaaacttgctgtaacacttgccatgaacttgtgttcgatcaattattttggatctaacattagtagaatcttgttcttcagaaagatgaacttttgtctagaccatcttcaaagctagggatctagatacatctttctgaacagaagatgcaacagttatggtgaagataagcaaatgccattgactgtaccaagaacaatttgatatctcatgattaggtctaggccggcccaaggagcccagtgtcctaatatgggcttcttggtgggttggaagttcaatatctctaagactctcacgggtctggaattttatggttttgcatgtaaaattacaacttcaaaaataattgcaaaagatcaagatatatagtcatgctagtatcttactattgcaccatttagattcaatgtatgttattgacaagagaaattggcaaacaaacgaaaaaaacctagctattggcaaatgtaacaacaataacatgtttttcttgcaatgtcatttctcaattgaaaagatcttagagttaatatatctaccattcccgttatcactttaagaagaaaaataatctagtttcacataattaaagaaacacaataaatggggaaaagaaagaaggaatcataatggaaagacatgtcgagagcacatggtgtttgtatggggacagattccaatgtaagaaagaaaattaaataaagtggaaacaataatatgaagaaaaaaagagagtgatgcatttgtctccttggcggtggtatggtggcttcactatcacccgacacctcctcaaatttggaatacacctaatcaatcatgattatattacacacacatttcgttatgtagatacgacactcaatcacggatcattttgttgttccatcattttcctctttattagtataaacatcaaaaaacattttcgaaaacgtaaatgttggatgagactttgtgatcgcatccaaaccacttaattatttaaaattgtaacgatttttgttattttctacatatgagatttttttactatagatagataggttagtgtcacaaaggtagcaattggtttgatggatatttttacttctatagtttttgtcagactccaatgaacttactcatatgtcacttttaattggatgtgaaagaagatagagcatcaatattgaaatggcaatagactgagaagtcagaataattttttgaaaataaaggacaataagagagtgtccacatcaacttttaccatcttattttgtctggtggcttctgcttctttggatttaaaccttgagacaaatagaaagacgttcttcacttggctacctaacaacttcactttctgtgctcttgtcacaatcttaacccatttttccttacatctaacgtatatcattgattccttttgagaatttccatgttcaagacaatgagagaatatatttacgcaatttgatccaaacggtttaatttgtttattagtttgttacactttgtgtaaactatgatattaaggtaaggatgttggccttggatcagttcatgatgttttttagattaccaaaaacgttttagacttttgaccataactcttttgtaagacagaccatccctagtacactaatcaaccttgatttggccatgggatctacgagtcggtttgcggttaatatgtcaacaacgacaaaaacaactgatggatatgagatatgacggtttggtcatagctaggccggtccttggaaggctctttagggactgagccatgtcctgatttttactattacatagtaacattgccatattaaactctacatcaatccacaaactagattcatagaaaacatcccccaccgttagatcgttacatcccctaagtgatatgatattgatctacaagatgggtctgtcttttaaggattgatccaaatgtcggaagcatggaagcatagtataggacaatcttggcggcaacccatcactactccatatcctttgtatccacccaaatctctctccctctctctctatatatgttacattagtatgatatgaaagtaaaggcaagcaacgttttactcattatcttctcaccaaatttatagcccacaacggatcttttactttctttcttttgaaataagtcacatgttcttcagtctcttctcatgataatataaagggcaaaagaaaaatctcacaatctttacaagagtttttaaaatctctaaccttc

SEQ ID NO: 1533 - DNA, 3000 bp, Unknown
  misc_feature (1)..( 3000): cDNA_ID_2990620_gDNA_ID_1620414_Annot_ID_156378 3000 nt of promoter + ATG
gactgatcaactgctaagtaaagaaagcgtcacagggtgtttctagctagtcaaagacgatcccgacttgacatgttttagagattcttgggaattttcggagtttcttgacgatttcatcttttgctgaacaatactgcaaacgtagagctagacgtagagtgagtttcttcagggttgtggaattctctaggaagtactttactaacttcatccttgcaacatatactaagatgctgcttttgatatcgacaaactctagtgacgatagcaaacacttcggtacagatgaaaaattgatatgatagttcccattcaaaagcatcctcttagagttactattagattcctgaggataacaaagagagagacatataataaactcagtaaaaaatgataagcaaaactatatagctcgatagggttaaccaaaagcattaccatgatgagtgatttcaagttcgggcagctctcgagaaaggttggtaaaaattgcaaatcagatactccaagagtaacactcaagcgggacatgtaagaaaatttaggcaggtgagggagcggtattaacgccaagtatcggtacatgagctggaaacaaacagaaaagaatgtgattagtgatagaaacatgtccaagatctctgcattgacatataagataggtgtataccatgaaagctggtgaatgtattgtcatttccataacacttaaaatccctggaagaaatctgtcgatgctacttctcattgatgtaacgcttgtttcatcaaaatgccataaaccaaagaggatagaaagatctaacttgtcattagaacccaaattgtttactatgaagcttttcgatacattatcgttaatcctcaaagagcatagtagaggagcatcaatcacaactcccgaaagagcaacctcatggaggaaagaagagactcgttttaaactgaacctctttagtgactgagagtgcacccgaaagacttttctatccatcccataaatgataaccgttaagtcttccaagacagggcagcaagagataagtttcttgaaagtggattcattgggatacatattatcttctaaatgcatagtcttcatacaagggaaagagacaaacttggcatcgtatcttccttcaatctccgactaaaccctttggaacaatcctgtttcgatttctttctaccaatcatggtgttgatcattctctacgtagcgaaattgaaaaaataaatttcagagaaacaatcaaataaactatcaaacgaagacttgaagaagaagagatctcaccgtgattttggttcatagaggtcaatgaaggttactctttttttttaggggactatctccacaaccacgtagttttttctatgatagttaaggaattaacggcgtcgtttttgtgtagcttccctggtctcaactattgatagaaaacgatgtcgttttaatttgcaatcaatttgaaatttgtttttcttatcgtattcatttatttcgatagtctcttgggaatatgttattttactgtaaactttctagagtaaagatgagattgagagatctaaataaactttttaaaggggttttagatcttctgctcttataccatgacaagatatgaatatcgaatgaattggttgattattgatggacccttaggtctgtatttatacaagttaagaatcggtaaacctaaaccaaaaggaaatctaataaaagacaataatacatagtggaaagaagaaacccttactaaagtgagtctctttagtgattgagagtgcacctgaaagacttttctatccatcccataaatgataaccgttaaatcttccaagacagggcagcaagagataagttccttaaaagtggcttcattgggatacacgttatcttctaaatgcatagtcttcatacaagggaaagagaagatcctgcctttatccaaggacacctcaaagagtcttaaggaaaccagtgcctcacatttataaagattaaaatgaatcttatgaaactgaggcagaaactgaacatctagatgttggatcttacgcttagctgcagcatcaatccatgacttgagataaaagccatcttcttcattttcactaatagttaacttgagcttgtttatgcatagaaccctattggaatcgaaatacctatcacaaaaactcacaaaggtattgaaatcagagaaatctcgggaatccaattccaaactaggaaccaaaagccagagacttctccatcttgtggataaaacgcttgtcttaacaacatcctttgtaggaagataattaagtatttgacataacaaagattcatagaattggcttattctgtcttccttcaacctctgattcaacccttttgaacaagcctgttttgatttctttctcctcaccatgtctaattttttctctagataactttatctgcataactaaaattggaaaacacaagtttcagagagacagtttggttttgaattagatattcattcaagttcgacttaacctaacgtcccaatcaaaattctcagtctagtaatgtaaaagatttcaaatcaactaaggcttaaaacatacatggtgaccaaaagctataaaaagattcaggcttttggacctgtttctgatgggtaagaacaaaacgatatgtagaagaagaagaagaagaagaacttacggtgacttaggtaatacgaaagaggtcaatgaaggtttcttacatttttttttagaggaccagtacaatcataatgacgccgtttctagtaaataaacgccgtggtttcactgctctacgtaattggagtattgaaaaccacgtcgttttgatcagcggactagtctctcaagctattctaagaaacgaggtcgttttgattcgcggttggtctttctctctctctaaagcagaaaattcgtagaatcggagagatttgagaagagaacgaaggaagaagaagaagaggaacg

SEQ ID NO: 1534 - DNA, 3000 bp, Unknown
  misc_feature (1)..( 3000): cDNA_ID_2046255_gDNA_ID_1620414_Annot_ID_156375 3000 nt of promoter + ATG
tcttgattattcattaaattctattagattttgtgtcaatggtgatactattatttgaggaattgttatggaaaagttattgaattgtttgtttttatcatatcatttatcaaacgaaaacttgaggaaaacttaggaatgtttgtcacatcatttagttattaatattttttaaaaaattcaatgttgttatcattgttatgtttttagtaaattatgaatactttagtctattgtaaatataattaaattttcattagtttaattttaaactagttatgttgaaaatcaaaaagattaagtagaacctctgagcgtgtttattcatttttggaagtctttagagatctactgtatgtatcttattgaacaaatatcaaaataaatgactagtaaattataaggaaatgtagaaaaatatagttaatagattttaaaatataactaattctattacagatagcatattatagatatgtgtagtgtttccatatatagcaagttagcatgatataggaaaagatcttaccaaaatttcaaagctactagataagatcatattagctaaaataaaataagaaatatagcataatttatttaatggaatgatttataaagagtgatgtgtaagtgttttattgatttattacatatcttataattccatctccttagatctcttcccaaagaaacaaaagcatatagagttatgacacttggtctactcagccttgtttttggagaaatctttttgcatattatattatatatacttaagaagtttcataagaaactacaccaaaaaacaaaagtattcttgatagctatctagatctcatatacaatgtctttacaatttttgacgctcatctttctcctttctgctgctgtgatctatcacatccccgtcgtgacttgcgaaccatggtgctcggcgatgccttcttccacacctgagcagttacaagccaacattcagcttgcttgcagtcgtgtggattgtacaccgatccaacccggtggattttgctattaccctaatactttactagaccatgcttcgtttgtcatgaactcttactacaagagtcaaggtcgcacttatgctgcttgtagcttcggcaatactggttaccttatttattccgacccaagtactggcacatgtgaattttaaatttaatcgaaaaaaacatagaaatcttcagcatacttatacatttttattttgttttaataatgggtttctgtttcggactcttgtatttccaaactaaaataaatgaaatagacgttatttaataatttattctgaagtttcaatgttcttagtgatgacgtcttttactttctagtactattgttgtggttcaagatcaggttgttttttgactcgttatagtattcaaaattggagacttcaaaaacttagatttgttacaaatagtgccttatatatgtaagtcttgtcaccaattataattacttacaaaaagcctttggagttaatcgttactaaggtgtagagtgcttgtgttaatattatcttacacctgacttgttaataatttcaaaataaacttccaactgattcacgaagctatatatggagatgagtttttttttttttcttatgtatctacacaaatcatcatttatctagtaaattcaactcatcatgtaaactcttttagatgtaacgtaggagatgttgtttaatggtttgtacgtactttagtggattcgggttacaaacaaattttctgacaaaggaaagtacacgcatgagatgtattcaaagaggggatgatcaaaagatatataagtgatggttgaagaaaaagatagtataacgaaatgaaccaactgcctagatttgtaaccgcatgcaaaaaaaaaaagagtcattgatttgtatgtttacatacacaaacatagaaaatgatcagagttcttaattattcattaaattctattagatttcgtgtctaaatggggatacttaacttgaggaattgctcccacaaaaaaaacaaaaaaacttgaggaattgttgaggaaatcttaagatattattttttgtcatatcatttaccaaatgaaaacttcagaaatattagccacatcatttagttattaatatttttaatttttttaaatggtattattattgttatgtttttagtaaattacgaatacttgaatattgtaaatcaaaattttcattaaattttttattagtttgggagatatatacttataaaacctttggccttatcaacataaacttttgaccaaataaaagtttaaaatattccagttcaattaactttgcccaaaaataagtttaaatgatctaagagttggaaaaaaattggaagtaaaaaacttattaatggtttgctaaaatagtttttaccaaagcgagattaaaaggttaaactcgatctcctacgtttgctaaaactcagcccaataggcccgtacactaattcggtttgggtccaatgataaaatcaatatttcttaaaccataaattgatctaatttggtttaatttagacttaaacaaatctttaacaaatcaaaccgaaactaaacccaaaccgaaactaaacccaaaccgaaactaaacccaaaccggattaaatgggtcaaagaaaactcagcccaataggcccaacagaacctgaaacgtcatcttcactctcacgagtaaagaaatttgctaaactgattgattctgtaatttcagcgagtcgtctcgtctagctctcacttttgttcgtctcttctgcgtcaaacatttccaccattttcgtttcttaaacctttcttcagctcttctcttcgtcaatcgtgggttctttcatcatctctgtaaattttctgggttacaatactttagggttttttcttgactcacatttccgataaaccctagttttttttttcagtgcgatagtggaattgaagtctcttcggtgagtttctttacta

SEQ ID NO: 1535 - DNA, 3000 bp, Unknown
  misc_feature (1)..( 3000): cDNA_ID_3062907_gDNA_ID_1620414_Annot_ID_156364 3000 nt of promoter + ATG
cttcaagaattagggtttcgttttgaatcttctctgattcccaaatccaaagatatgaagagatcttcagggagaaaggattcaaatttcatagaacaattgatactttacgtcgctagtgctgcattgagtagcttggttctctacgttggtctccgtcaacttgacccgaaccgtgacgccgctaaaaagtctctcgagcacaaaagagaaatcgccaaacgtttgggtcgtcctcttattcaaaccaatcaatacgaggtaattttgattctatacagttctctaattgattgaattcgtattcaaaatccaatcttttcaattgtttattgtgaaaacaggatgtgattgcgtgtgatgtaataaacccattacacatagatgttgaatttggttctattggaggattggagtcaattaagcaagctttgtatgagcttgtgattctaccattgaaaagacctgagctttttgcttatgggaagttactgggtcctcaaaagggtgttttgttgtatggtcctcctggaactgggaagactatgcttgctaaagcgattgcgagagagtctgaagctgtttttattaatgtaaaggtttctaatttgatgagcaagtggtttggtgatgcacagaagcttggtaggtgtagatttggagattacattacctgtctattggttgtgttactgatttatgttttcttcagtgtctgctgtgtttagcttggcgtataaactccaacctgctattatttttatcgatgaggtggatagctttcttggccagcgacggtcgactgataatgaagcaatgtcgaatatgaagaccgagtttatggctttatgggatggatttactacagaccgtgagttgaaattcttgtcctcattgttctgtttagccatgtgaactatgtacagtctgaggtttgatgttttggttttatagagaatgcgagggtgatggttcttgctgcaactaacagaccatcagagctcgatgaagcgatattgaggcgttttcctcagtcatttgagatcgggatgcctgattgccaggagagagcgcaaatattgaaagttgttttgaaaggagagagtgttgaatcagatattaactatgatcgtatagctcgtttatgtgaggactataccggatcagatatttttgaactctgcaaaaaagcagcttacttcccaatccgagaaatcctagaggcagagaaagagggcaaacgagtttctgtaagtgataaaccgttttttagggaatgtcaatgttcccttcatccacctgatttttaagtaatgacatctttgagttacctacatttcacaggttcctagaccattgacacaactggacttggagaaggttcttgctacctcaaagaagacacaagttgctgcaagcgagtacactggtttaagctctcaatcttctgtctggggaagtccaagcaatgccgatgaggtccaagcagctataaacggcatctccaagctttttgtctcgcagcttagaaacattcagccagattctcaggattcatatcaacaacatccttcagaaggagattcggaatagaagcaaactcttcactagagcttcgtatagtccaaaaagagtacaacccaagaatatacactttttgtaaacctcatatttctctgaataagttggagcattgttgccgtaagatgtttttagaaaatttaattcatgtctcgttcaagcaatgatctatacatttaccaatttggttttcttcaaattttgaataaaaatgttagcttttctttttcttctttgtaaaaatgacatctttagaatgtttataagatttatggatgtttatgtcagggaaaacggtcaaaatcaacttaaactatttgtatgcggtgtttttatacccagactctaatgtatggtcgtttcctatccgaagtgattaaatattcaaattcgcaacatgaacttatcaatattaggtcaaatcaacattgactttaacaatgttagtcaaccgttattattgcgatgatgtgatgttatacaggaaaacgtggcaaaaatctccaaaaaaatgtaaaattgtaacaagcatattcaaacctgcaacctcaagacgagaatatttcacttttgaccactcggatccagcaagttcttatgttactctgatgaaattcaaatttggttttacgaaaatgagtttttaaagcttcaaatttgggaataatcagatgcaaatcagcccgtataacaccacatcatcgtagcaatatatgcttagtcataagaaatcaatggtttactaacactataaaagtcaatgttgattttggcctaatattgataagttcaggttgtgaatttgaatatttaatcacttcggataggaaacgaccatacatttgaatctgggtataaaaacaccgcatgcaaatagttcaggttgattttagccgttttcctgtttatgtcaatggtattatctgggctttgatcggtacttataatataaatgggcttgtgtatcaagttgatacaaaagaaaagacttttttttttcgtgactctgttgatcgtctcgaacccaactgtcagaatcttcgtcgatttgatcgattcttcttcgtctctctccgattgaaataaacccttgatttcactacagaaaggtacacaatttcttagttgttcattcgaatctaaactttgtggatctcagtttggtctctatcaagtctggtttctcatcgttgaatcattaccatttgatttggtcttctctggtgtttgtttgattactttttcatgaattgagattagggtttatctctgtttcctaatttgaatcagctctagcttagaaaccaaacctttctggtgtttcaagttgaaaatgccactaattttgtctcatttgttggattcttatgctctgaacagttttttttttgtgatcgggaattgaatcttcttatcatg

SEQ ID NO: 1536 - DNA, 3000 bp, Unknown
  misc_feature (1)..( 3000): cDNA_ID_2046276_gDNA_ID_1620414_Annot_ID_156367 3000 nt of promoter + ATG
atctctcacaatgctaatatcaatataaatacgatagaaaatgaaaatgacatgttttattcttcaataactggtgtgtaaaaaagtatcgtatgaaaataactgaaagtgccattttataccaaatcatagttgcttggtgcgtatcgtttggcataaagtgaactataatttagatgtgaaggtccaatattcccaagaggcgaagacaaaaattgggtagacttaaaagagtcaattgatcaaacatgaactgaacttgggtaagatcatactttcaatcattagaaaggatccaccgagaggtctagctatgaagataggcatggtcaagctgagaaggttaggacgtaattagtaaatcttggttatagatagatagtcatatggttgatcttgctttctcacacttaacaccatcagttgaatccaatgttaaaaataggtaattctcagatgcagtacctcataaatgttgtaaaaaagtcataaataattattcaaaggaatgcatggaagaagtgaattacatatttttaaaaaaaatataggaaaagaaaagtaaagttcgtacaaaagagagtagtattattctctttttcttctccatagggcctcgtaatatctacttagcatacgaggacacattaatattcgatcatgtatatatatgcctacgactacgagacattcgaaagttattgtctagtggtttgtattcacacaatttccgtgttaacagttttagttccatttccttcatatagagatctaaatgatactactacatatcatttagtttaaggaaggacgatgtaagaaaataaaaatctaatatacgagagaattgtaacacgttcacttcataactagctagctagtggtacttaccagttactaccccaactctagtcaacactacattaaatactataatgtgaacaaaattattttgaaccaacggctgttacagtagtttattcaactttatcaaccaatgcattaaattgaacatatttctggccgattgaaataggttgggaacgatcttataaaattcagtcttaaacaagtcttggttttcaaaaatgcaaattcattcgtatgttcttggcaaaaaatggtttaattggtttgatctgatcttatcctatcacgcaggattggtgtaatataacgcaccaaattcggccaggaaacgtccgaatataatagtccaattctacttatgaatttgacgtgttgacgtaaagaatcaaaagtcgaacttattgaataatttattcgactttaattttcttttggggttttggtatgtttgtgaccacatggtatggagttgacatttaccattttcttgattgactacctaagaaaattttaattattattcacattatggagagttatgtttccatattttggctttaatattaatcatgtggtcaataaaataaagaggatagttatggcataagattgtccataatgtcatcatcttgtttagtaaaagacagtcacatgaaccggaatctcggtttaccaaacttttcactttttcagtttcacatgaatgtcaccagattcattgagttaaacatgtattttaatactataaaaggttaattagttatgatatcatatttatgacttttaaaagacttttgatattgtaatctgtaactagttataagttaaccatctcttataattagaacaaaaaaaaacttaattatggatgaactgattttaatggaaaaaatatttagaaatagaaatacattcataatttatatctaagtctaaccaaaacacaaatctaaagttacgaataaatcatttcaagtgtaattttactaactatttgactcctaatcttatttcatcacctaaactcctaattgttatatatttatgagagataatgacatttgttcctctacatactaatctaatggttgaatagtcatgtgtttgacaaacttataaagtttgatttttcgtatgtgacatttagttatacatccataaattatataactttcttagtgagatatatgaaggttatatatgtggagtatattcttaataattaattgttaccctactttttttcttttcggtgacgtaacttttataaagtttaaccccttaatgattattgtactacataaaccccaaaactcttttctcttttcttttttctttgtgtagtactgatatcaagtcaacgtgcggtacataagaacccaagatcccataaataaattcttcttggttttaagctttcttcttcatctctacttctctatataactttgagtagtctcaccaaagtccatttttaaaaaatcaactataccatttttagctattctttggtcttcgtttcgtgtaagcattcaatgttttttttcttttatctctttgggaaacgggagtgtggtcttcgtgtgtgtgtccctgtttcattaaccagttacgtttcattctcttcttttcttacgtttactacagatttcagaaagaaaaaaaagtgtttgaagcaaaagagattaatggcagattcttgagtcattaacttttttctaattcttttaattagatctctgaacataagagataacttgcgtcattattctatggttataaagattatgcacttgattaaaataatctctagttttcctttttctcatttgctaagcaactgtttctttttcttcttcttcttcttcttcagataattatgcttgggagtggaaagcaagaaaaattctaaactttatataaaattcccagaatcaattgatccaaaaagaggtaccatttttttcctctcgtcattttccataaaagtaagcttttgattgatatttaattattaaaagaatctgtcttttgggtttttgttttgacaaatttttgttttttcagtattgtcaaaaaagataatcaagaagaagaaactctgtttttttgttctgttcttggaaaaaa

SEQ ID NO: 1537 - DNA, 3000 bp, Unknown
  misc_feature (1)..( 3000): cDNA_ID_1020161_gDNA_ID_1620414_Annot_ID_156368 3000 nt of promoter + ATG
tccggaaggcacgaaagagcctggaatcggttggatgaccgctttcttgttctttacttgctttgttggtcttttagcattggttcctctaagaaaggtagagattatttaagattctgtctcattgaatttgtagttagagatgttgcggtaggccaaagtttgcgggtcagtccggcccatataagtgtgatatgggcctggccaaacccgctatagccaacataggacggagattaatattggccaagtttggactattaatcccctgttggctggtttgggtctacattgctaagtgttcattatgcttctttttttggttaaccagatcatgatcatagactacaagctgacatatccaagtggaacagctaccgcggttttgatcaacggtttccacactcctaaaggcaataaaatggccaagtattaactcgattttttggcagtctcttagctctctttcaccactaattctagagtttttgatttaaataaaatctgtttatatgcaggaaacaagtgtttgggtttgtgaagtacttctcatttagcttcatttgggctttcttccaatggttcttctctggtggtacagagtgcggtttcattcagtttccaactttcgggttagaagctttgaagaacacgtgagtattattcttagttctattgactgtttatatatcaacagatagaaacagaatcttgatgatcttgaaaaaacttgacagattctacttcgactttagcatgacatacgttggagcaggaatgatctgtccccatattgtcaatatatctttgctttttggcgcggttctgtcttggggaatcatgtggccactcattaaaggtcttaaaggagattggttcccatcaactcttcctgaaaacagcatgaagagtctcaatggttacaaggttccatacaaaaaacactagtactctacaataaactccgccctttctttcgcgtactttcgttcttaatttgttcataactctttaggtgtttatatcaatctcattgatcctcggagacgggctttaccaattcatcaagatactttttaagacaggaataaacatgtacgtcaagttaaacaatcgcaactctgggaaatctagtaagtatacaccaaaaaaactatagaaaaatcgtcatttcaataatgtattatctgatgttcaaacgtaaatcgcagattcggagaaagataagcaatctattgcagatcttaaaagagatgagatctttgtaagagacagcattccattatgggttgcagcagtaggatacgcagcgttctctgttgtctcgatcatcgcgatccctataatgttccccgagctgaaatggtacttcatagtcgtagcttacatgttagctccatcgttaggtttcagtaacgcttatggagcagggctaacagatatgaacatggcttataactatggtaaagtcgctctgtttatcttagccgctatggcagggaaacaaaatggtgtagtcgcgggacttgtcggatgcgggttgataaaatcgattgtatcgatttcttctgacctaatgcacgatttcaagacaggacatttgactctgacttcacctaggtcgatgcttgtgagtcaagcgatcggtacagcgatcggatgcgttgtggcgcctctaactttcttcttgttttataaagctttcgatgtcgggaaccaggagggagagtacaaagctccttacgctttggtatacagaaacatggcaattcttggagttgaaggtttctctgctttgcctcaacattgtttacagctttgttacgggtttttcgcattcgcggtggcggcaaatctcgttagggataggttaccggataagatagggaattgggttccattaccgatggcaatggcggttccgtttcttgttggagggtactttgctattgatatgtgtgtgggaagtttgattgtgtttgcttggaatatgagagatcgagttaaagccggtttaatggtaccggcggttgcttccggtttgatatgtggagatggtctatggattttgccgtcgtcggttcttgctttggccggcgttagacctcctatatgtatgggcttcatgccgagtaaatattcgagttaaagatagctttttacgagtttttacttttttgtgtagcgacaaaaaaattagctaaagaattgtggaaacaaaaaaaacagtttatataggaattgtactttgtaagtttgtatacacaataaagtaataaactagtctctcaattctatttaaaaatccatgtcccaagtaacttctccccaaaaagaaactcaatattttagaataaggtcaaatggaattaaattccagaagatatttgccaaaatagtgataaaaatacggttaaattggtatatgtttttactgacaaaaggcaagattcttctattttaagatttatttctttctttgaaatctgctaaacgttgttagatcacactttatgtgtctgtttttttttttgtcaattcagcacacgtcatatttgtatttttcaaagtaccaaacgtggaccaaaataaaatctcgtcaaaaatggaaaccaaattttaatttgatttgcacaaagcccaatttgatttgtttaaagtcaaagcccaacttgaccaaaactacccctgctcatccaaaccctaagcaaaatatcgagggtagtttcgtattttgtttatattgaacacaattaagtaggtgaggaacctctatttcttccgtcttctgctgatttctgagcttcggagctatcgaaaattctgaatctgaaagggtaaagatcccatctttttccaaaaatcgataagggaattagtatattcgttcattcatcatcgttctgatgatttcgatttgaatctgtatctagtactctgtattatcagaaattttgattagtagctttgatgtgttcttgttttgcagtttgagtgaag

SEQ ID NO: 1538 - DNA, 3000 bp, Unknown
  misc_feature (1)..( 3000): cDNA_ID_3594371_gDNA_ID_1620414_Annot_ID_156371 3000 nt of promoter + ATG
atcattatacaatcttaaacctaacgacacttggtttttataatgcctttaattctctgccttctctggcgtgtatggacactttgacaaaaagtcgtcgttcgcttttatatcaagaaaactcaagagcaaagttataacaaagagcacatgattccaactttcttggtaatccaacggctattactcatccatatggtcgtcattggtcatatcgtgccgacatgatggtccgcaaactttggaaccttcttattcttttcgtaattaattttaaccgaacaaaaccgagctgatgttaacaaaaccaatcctggtctcattttgtttctattgctaacacataatactggaataacgttttcttatttgattatgaaagaatttaaccaactaaaaaaaaatctgcataatatttatcaagacgcaaaaatgtagaatttgtatttttgtctaaaaatatatatattaaaaaatattatgcaaataagtgaatatacaactgtgtattttagtatatatttttcatttttcaaatttttttttgcaatttatgtcattatactgtgttactaatcgaagtatgagattgaggttatgcttgtgttttcaaaccagttcctaattgaaccaaactttatccgaaattttcaaaaccaaaccattataataagatgaaccggatgagaaccaaaaccaaagtgagggcaaataacccacgtgtcatctagttattggacacgtgttgatcggcgtcgtcgtatgcacctgaggagccgcgacatccgcttactcggcaaaggatttgtttgtcattttgcgcttaggttacgttacctgacgtgttatacttatactataagacaacagttcatgggtccacgtttaatgacgtgtcagagtctttgaccattcgcttcgaagaaaaaattcatggagatggaatttgaatttttacacgagcatgttcctatgaataatgccttccaccttgcctctaacctcaagccacatcttttcttttttaagtttggttaaaagcaaactacaaaattttcagaatgttggattgaatataaatatgtattcataaatcaaattggtttaattaatagctaagaaggcaatttaaagtcttctaatctttattttgcttggtgggattatagtacaattatgaatgaagttggttaaaagaaaaaaaaaaaacatcaactttttgtgtttaacttatttaaaatttataaacaagaacctaccccaagtgatagaaacattataatggagtataacttaaacccaaattcttgttttcaaatatttaatagcctgttgaatgatttcggactaatgtgattatgtgaataggcaaattctcgaatggatgctatatatctaacacgttatatatagtatatatacatatacatttgattttgtttttaatacggttttataccttaaagtatgacttcttaaattgatataaagtcaaatatattatagaaaaactaaacaaaatgattacgttctaaataatagaatttaaaaatatgtgtttatgggggatgtaatttcactatctctaagattaggtataggtttgacctttaaatctttaatcgtgtttatccatttacctttagtcacggtggccaaacatcaagaatgaagtaatgaaacacacattacttcaatctctattcagattcttttggaaaattttgacaatttattggccacgcttccgatttttttattataatgttaaagagagtcatacacataatatgtatacttttttatatatgattaattatccattcaatttaccgagtcgttggctttttgaaatgccaaaggggccttgtgccagacttgccagctgatcaaagtaaaacagcaaccaaatctgatttcatatgttttaagcttagcttagaaggtaataatgtaaaagtaaaacagcaaccaaatcacaaagatcagtattctttgaggttggacaattgcttgttatcttaagaaaaacgtatgaaagtttttttggattttttttcaatcctaacattcttttgatagttaattagataattatttatattacacatacgagatcaatatatttctaattgacctctacattttttgtaagctatggcattaaatattaaacaacaccaaaatattttaatgcagaaaacacaagatttttttttgtcaagaacatgtttttcatatataataaaagatacagaaaaagtacaatagtattttcatatatcaatagttctaatatataagtttttaatacaagctaaacaattaaattagtttccaatatacttaaccagttaaagatagatacttaaaatcatatatatactctcttgtttttacatcatcataaatataggtgataaatgtaattatgtatcaactaatggatatacacaaaaaaataagacataaaaataatcaggtggtgtaaacaaatctcctaaagtcggtaaaaccctaccctaaatactcctccaaacacgctcccaatttttaccacgtcaattccacctcattcatcaattaacaaaatagaagacaaagcctttggctctctttggaaatgtgcgcgttaagcaaaaaaaaacctacaccaagtagaagtagtatataaaagagacgtatatttcctaattccgaaaccacctcctctaaaaaaccaaaataaaaaccttttttctctcttcatgcttagcctatcatgagcaacatccctagatctctcaccgactcagatctttctctatttactctcataatctcttctgctgttgatccttggcctttttctatcaccgttttttagcatcaacaaaactcaccggaaaatctctaacaaccaccaccgtttaacacttctcttcctcctcgtcgatcgtttttaaaccaatctttgtgtttcttgtttggtttttcggtgaaaaagattccttcttctta

SEQ ID NO: 1539 - DNA, 3000 bp, Unknown
  misc_feature (1)..( 3000): cDNA_ID_2046272_gDNA_ID_1620414_Annot_ID_156369 3000 nt of promoter + ATG
cagcttcactggtcaactgcaagctacgcgcctctacaagagcttgttctttgggatggtctagtgcaaatgtacgaaaaggttgcttagaaaactactgaaaatatgaaatctctttaatgaccatttaagcacttggaaagttgatgataagcgttcctctttctcagggtttagttagagccgttggagttagtaactatggacctcaacagcttgtgaagattcatgattaccttaaaactcgaggggttcctttatgttctgcccaagtgcaattctcattgctaagcatgggaaaagagcaactagagatcaagagtatatgcgacgagctcgggattcgtttaatctcttatagtcctcttgggctaggaatgctaactgggaaatactcctcttcaaaacttcccactggtccacggtaaagtactaatagattgctcaaagatcgacaaaactagccgttgtttcttgttcttaactatgcttgaacactgattaacagatcattgctgttccgacaaattcttcctggattagaacctcttcttttagcactgagcgagattgcaaagaaacgaggaaagactatgcctcaggtattatttcaatttcataagattcttgggaagaagaagtgttgaaacttgtaagaacgagttatcatttgttacaggttgcaataaactggtgcatatgcaaagggacagtaccgataccgggaatcaagtcggtaagacatgttgaagataatttgggtgctctgggatggaaacttacaaatgatgaacagcttcagttagaatatgcagctaaagaatcaccaaagtcaatgattcagaatatttttcagacaagatgataggataagagaagatgcttatacacatctagaccacaaatgagaacaatgtgtataagtagaagttttaatctacttctttatatatgcacatattgtgaagaacacagatagttttcttataccattgttatgcatatagtgatcaaattcctaagcaattagtccttcttccagtgcaaccatttaaacgcttagatttggacataatacccacatttcatgccggtagacattgctagttgtgagagacacataaacaaagttatcgattgtcgtgttttctgctcttgaaagctctctctctctatccatagtgactaaacttatcattgcaatttctgcatttacatagacataacttatctttcaagcaaccaaatgtttatccctagaacgtaataatgttattttatacctacaacttggccactagtcttgcttgatgtcttctccatccaacgaactttaatttcctcatttaaactctcattaactttcttaatcagaatattatttaaaaacaattatagttccaagaacatgcaagtatattttcataaatatataaataaaatactactactagtagtgctttattattagaataaattcttttccatatgcttttgtaatttaataccaactatattccagatttggttaatgacatacgcggctagatttaatagcatatcttcggctttatgtcagtcaaaaaaaaaaaaggtatagttattttttctctttattccgttacactttagtaagactcacaagtcacaacaaaataaacaataaacatcatattaatcaaatccttttcagtctttgtttataattatgctataaacaagtttaggtttggcttagttcaaagtttaattttgactcggttcatagacatttattattactaatcggttttaacttgatccatttgaatgtgtttactaacccttttccttttttttttgtttattgaaaacatctacatgtaaatcatattaacttgtgtttccatcttataaatttctcttaactttttatttagataaatattgaattatttagttgcccacttttctccatatgatcaataatttcgaattgaaaactcattaatatagatgaaaagttgtcaaatgaattaatttttgttattctgttatctataacatcaaatcataaaaatcaatcctaattaagataaaccctttgactatattgttagtatttgctatggaaatttaatatatatcattatcctaccaaacaaaaactattccaaaatagagtattttagaaacacctatatatattcaataaccatcgttaatccaattcttaaccttaccattgagtaaacgtaggtccattaggtcaacattcttatgattagatttgttctctagtagacataaaaattttactagaaaatctacaaaactaatcatgattatgctccttaaaagccgcggtaaagtgggaacgtaatgaaaatcttttagcttttgacatttaaagcttttaaccatagtaaacacgtgtcatttcctctttggtcatacccgatatcgcgtaaaaatccaccaacgaagactaaaacgaaacgacgcagtttcataattaaaattcacctaccaaatcgcgtggagagttaaagcgcgtgtagcattaaagtaaacgcgcgagtccacgcgcttaatgtcttaaagtaaaaaaaaaaagacaagagctgaaaaagaaagagcaaagtggttagagaggcttcagttgttggatgcttttgctttttttccttcttcttcgtcttctttcttcgtctctcttctttttttcagtttcggcgtgctgaagaagacgatagagtaatcaatcacagtgagagagatttgagggtaaatctgtccttttcttttcttaaacaactcatgcttgatttctgctacggcggaggaggaggaggaagaggtttacttttgcttatcaccgggaaatttccggcggtgattcaccgtcgatgataatgggttttattaaaagtgtagatctttgatgaaagcaggagactttttgatttcgattttgattttgatttggggtttaggtttaagtttttagagaatcagatg

SEQ ID NO: 1540 - DNA, 3000 bp, Unknown
  misc_feature (1)..( 3000): cDNA_ID_3062911_gDNA_ID_1620414_Annot_ID_156363 3000 nt of promoter + ATG
cgcaactattgtccatgttttactcttcaacggaaggtatttaactctatcaactcctcagaactacctaaattttactttttaatttttttagctgaactagatatccgagagtagtctttggtgaaagtttctaattaatttccttgcaactctcttttattttccagggatttatggaaacaaacaagaggtgcttttcagaggaacaagaaaatggatttccacacgagaatcatgaagaaaaactatagggaagttcctatgtggtggttttatgtgatcctcgtactcaacattgcgctcatcatgttcatatcattctactacaatgcaaccgtgcagctaccttggtggggagtgttgctagcttgtgccattgctgtcttcttcactccgcttatcggtgttatcgccgccaccactaatcaggtatctacttaaaaccaaatatgaaagtaaagaaactgaataaatttctaacaaattatttttgtgaatcttgttttgctaactttataacaaaatcatgaaaacaatgcacaaattactctagaaaaacccttgaaaaaataatatttcattaaaagaagtttaaaagaagttttgattaaaatatcgatattcttttacaaataatatttcattcatctatgtctcattcattgtccttttactatttagagctagagctcttttaccttatttttttgtaagtgacaacttttaatctaacaaggctcctattgctttaggaaccgggtttgaacgtcattacggaatatgtaatcgggtatctctatccagaacgtccggttgctaacatgtgctttaaagtatatggatacatcagcatgactcaggctctaacattcatccaagacttcaaactcggactctacatgaagattcctcctagaagcatgttcatggcacaggttattgcatcttaaaccatcattagttattggtttaaacgcgatataattatatactaacacaacattttcaggtggttgggacgcttgtgtctgtggtagtgtacacaggaactgcttggtggttaatggtagacattcctcatctatgtgacaaatctttgcttcctccagatagcgaatggacatgtcccatggaccgtgtcttctttgatgcttcagttatttggggacttgtaggaccacgtagaatgttcggtaacttaggagaatacgcagccataaactggttcttcctcgtaggtgcaatcgctcctttctttgtctggctagcgaccaaagcattcccagctcataaatggatctcgaagattcattttccggtcattttaggagcaacctcgatgatgccacccgcgatggcggttaacttcacgagttggtgcatcgttgcatttgtgtttggacactttttgtataagtacaagagacagtggtggaaaaagtataactacgttttgtcgggtggtttagacgcgggcactgcgtttatgacaatacttatattcctatcggttggacgcaaaggaattggattgttgtggtggggaaacgctgatgatagcacaaactgtagcctcgcgtcttgtcctaccgctaaaggcgttattatgcatggatgtccagttttatgatcttgtcactattaagtaaaaatcctttagtttttcttttggagttagttggtttattttttatttggttttgtacagagctctacaacagcttgaatattatttatttttagaatcgtttttatgtatatataaaaataaatatgatggattttcatttctatgtacttaacaaaacaaatttcgtcctttctcaacataactatgatggattttcatttctatgtactatattattaagtacaaattaaaaagcctttagttttcatttggagttagttggtttattttttatttgttacatacagagcttacagtagcttgaatatatatatgttggaaggtgatcaataactaagtaatatgaaataagacttatttaaataagattgaagattaaataattacaatttttgtttgaatttagttaataagatatttaaaatatgaaataagacttatttaaataagatttaagattatatttcttaagaattgattatacatgttatacatataaatatatatttattaaacattaaagtttaataatttttggtttatttgattcagtttgtttcggttacagtaaagttggtttatgcgtctttatgtttggtatagtttgagaacaaatttcaatctggttatgctttgatcgagttagattgtttcgattcaattacggtttactcggtcctcccctttatgagtccttgaatcaaattttaaaggctctcttaccaagaatcaaaatttttgaaaacagaaaaacattaaaacaatatgtaaatgaaaattaggattagcacaaattctcgaagttttatttgcatcttacttcaacatttgttaaaatataaaggacgttcatcatttgcaaataaagcagatattttcttaaccaaaaccaaaagaaacatttctatccataaatttagaatatatgtttccttaagattatttttacagtcaatgctaatctgcaacaaacaaaaaagtcttattttgttgtgtatccgtagtatacttccttctataaaaactatcaataaagatttgataccaaaattaacaaaagaagattcattgaaatactctactatatttcttcacccaaatgtctcaaattataattcaatctggtttcattcaggatctcaacacacacaactagaggaagcaaaaacttttctctgtgagtatatattttgttatttcctctgttttgtttcatatttttaattgcaaatcttaagaacggttacataaacacacgatcacacaaacacataacaatccgttttttatttcatgcatatcatagagacaaaaacagaacaccaatcctctgtttctgaagaccg

SEQ ID NO: 1541 - DNA, 3000 bp, Unknown
  misc_feature (1)..( 3000): cDNA_ID_2046312_gDNA_ID_1620414_Annot_ID_156359 3000 nt of promoter + ATG
aatttgttataccaatatgcaaatataataacatcataagtcataaactatagaaatcctgcaaaaataaaatataatatggatggtcgtgcgctttttatctataatttaaactgttgcttttgatagcttacctagctggcaagccacatcagcacattatagatgctacacaaaacacattgctgacaaaatcaataatagttctctttttacttggacacgaacacttcttttttacttggacacaaaactcttttactttatcttacaaaaagataaggagataagttttggatttgaactttatgcacgatatgatgaaatttttgatggctgtcaataagccaacatgttccttcgtttcagaacatctctcataagttctaaacattcgaattgttgcaattaagctcatagttttcctcgattagtaacaaatctaataatatctacatacttgaaattgtcgcaacggatatataaatggagagaactagctatatgaaaatgttattaactaaccggttaaattatgttgttgttgctgttattaccttatacaaaataaacactatggatcatagaataatatgtgtacgcatattctagatgatctataatataataactagactcatatttcagctaattaaattgtgagatattaaacttttatcaaaaaaggtttctcagtttttgtttttgttttaccttcttacaaattcttccgaagcatttttatttgaaaaaacgattgtgtaactaataggagagaaaatcaaatatcacaaaaaagagaggcaaagtctagattcttacgtttattttagaacataaaaacaataaggtgcttgttcgaaaaaaaaataaaataaaatacattaaggtgcttgtagaaaaaaaagagttttagattatatctaatagagtctcagattctcggatgaagatgaaaatagtaggaggagaaaaccaagttgcccatagtgtctattttaatatgatgatgcatgcatactaacatcattattatcaagaaatcttgaagatcttttgtttaagtaacaaacaaaaatttaagactcgaaataaataattacaaaaatgtaaatgggaaaacagatattctctttacaatacaagcctgcatgaatccaggtactctgccttgcaactctaaaggcagtagtatttcatcattacattgttaattatttgcttaattaatttctacttgtgaattgcttcaacagaaagacagacttagctcagcaatgacggcctttagtcgtcaattatgttgataaataaaaacttgatatatagtacaattcgttttaatcttgtcggtttagtttgtatttggtccatttaaatgattagatatagataactcatataaatcacatcattctcttaattatagattaaaattaaatcattattcctaattgcaatttttaatttgataaggaacaacccaaaaatcatatcctatattttaatataaatctctatgatgatcacttaaaagagtaacaaatattccttgtgtgctgccaaacaatcacagagtgctaagaggcaaataaaaaagttaaaaagaactttagtttattagaagatgaataattaaggtatcaaacaactggaaattagattgttaatgtgacagataattgagatcaaaggactatagttagaatctgatcaaacgcaaagcgaatagggaacatgccgcgtagtcatcatgcaaatatgtgggctccaacaaagcatgtaccacaaaatattttcttcaaaatatcaaaaagaaactctacgcataaacgattaataattcttgacccttaaaactataatgtaacgaaaatgaataaaactctaaaataatatcattatatttcataaaaaataaaatttaaataacttaaaaaaatgtttcaatagaatcacatataaatgtattaattctcctaatcatatacagagggaatgatttattactgattagtagtagtattacagagagcacgaggagataaaaaaaaagatctaaaattgataacaaatgattataattaattactacgaaatatttggtcgtgtgattaatagatttaattaccgaataatctgaagagaagaaaacaaaattgaaataaagacagagaggttaaataaggcaaagcaaacggtcacacacaaagattcgtctccaaaaactctctattccctccggacaatcccatcttcttcttcttccttattgtctctttcttcacagatttcaataaaaatcctttgatccttcttctcttctcttttccctttcaataataaaagtttctctctttttacttttttacaattctctctggttttggtttgtgtgtgtttctttagactctctaccactgttgctacttctttgggatgtgtttgttccaatttcgaagaaacctcgtgaagacgaaccaacccatgtacgcaatttttaatctttgttaccaaaaaatttgaattggtgatgctcgtgctcacgcatttttgttgcggattttttgttgcttaggatctaaaaatgagatctttcactttgttgtgctgatttcagcttctctgtgtgctaaataaaccattttttcttctcttttgatgggtttttggtttcgttgcttacacatttatcgacccacataagttgtttgtgtaaatgtctcagagagactagattcaatgggttttaggattgagattgatgttaaactctttttatttctttttttaaactgatttttttatctcgaactctgtgattgcttaatttgtaaacttctttaaaatattattgtctaaagtattatatatagtttgccttgtaggttgcttgtttggaagcaaaactggcagttggggaaattcctcttttgagagaaaagcattcttcttctttaagctctgtttcatggattgacaatagctcaaggaataatg

SEQ ID NO: 1542 - DNA, 895 bp, Unknown
  misc_feature (1)..( 895): cDNA_ID_2046438_gDNA_ID_1620415_Annot_ID_156391 3000 nt of promoter + ATG
gatcttttttaaatgagtttaccttatatatattattattttaaaaaaacttaatgaagtttgttttaattaaatgtaaatactatgttaaattttaatcaaaccaaccataaatttaaacatagaaaatttggatttgaaatagaaaaatatttttatttaggctactgtttaaaatatgaggtggctatataaaaagattaattattcaaaatttagtcttagctttgtttgttttaaaatttaacgaaagataagtcgatatacattttaaaaattaatttatattagagaaatatattgttacgtacgtgatatcacatatgagttattataacataaaacatccataaaacttagttttacagttttgtaaaaatgtttacaacctaatggaattggttccacaattattttaggtataacactaaaacaaaacaaaatgaacagaaaatatgatattttacttttcatcaaaaatatgtgaaaatattatatattctctgaaaagtgtattttactttaattgtatatttttcatcttgacttatctgttttatctacttattatcctagatttctcaagtcaagttcttttattaacctactaatacaatgtgagctatatatactttggataccattatcaaaacctgcattaactgagacagataaagtacggcccaactcggcccaacgtggcccaatacataccttactcctcctttctcatttcctgcgcgtggatattctctgaaaagcgtatcttcttctctctcgcctctctctgaaattaacttcgctagggttttgattttgtgtgtatttcaattcttgcaaaaacattccaattcagcaaaaccccaaaatctgggtaaacaacaattcggttatg

SEQ ID NO: 1543 - DNA, 3000 bp, Unknown
  misc_feature (1)..( 3000): cDNA_ID_3062939_gDNA_ID_1620415_Annot_ID_156408 3000 nt of promoter + ATG
tttcggtgtatggatgatcacaacatcaggcaatggtgtcatcggtccttgtttgcccttggggtcccagtcaagcatgatcttcaccttgagaccaagcacaccctgcacatgtgattaaccagattcaggttacacaagatctcactaggtagaatgtgattcaagaaacaggtttccactgtgaagaactgacctgtctaagaagaacatgcctaactgcagcatcaatgtattccttggttggctgacctgaggaaaccatgtaaccatccttgaacttcatcgacttagcacgtgcagcacggagttttccactcacaatgacctgcatacatgataagaaccctatagaggtattctgaaagaaaggtaacagaaaacaaagaggtttgcactcacttcgcatcctttagctccactctccataacaaaccttaaaacaccatagcacgccctatacaacaaaatatcatgcaatattaacattctgagcataagagatcaaagcataaaagccatatttaggagaacagttcaaatttaaagtaacataatagaaagcctgatagactcgatgtgggtatctagacaactaaaaatcaaaccgaatgataatcacgagtggaataaaaggatttctaattacactgatctatagacgcagctaacaacaagtccaacactaatataacttcagcggcaaatcatgtttactaatacgcaacacttgttacacagtttgtttaatcgaaggatagaatacagacattggaccgatacatagcttaactacattaacacaaagtctacacgaacatacaaatagcaaactctaatttgtcccatgctttaagccatgtaaagaaaaatacagaaaatcgattcaggatacttcactacattaacaaagtcttaaactgattcaggacacttcacacaaacactattttaacgcagtttgttaatcatgcacagatagaaaacgacactggatcaccacctagataaactacattaacacatagtctaagtaccattatctcctatttgtttcatcaccattctttaagccaaaaacagaaagagacattaaactaattcaggatacttcactacattaacacacagtcttaagcatcaatctaacaaatcaacaccggaatgatagctacaaaaggatgcagcaatagaaacacgtcatacctacgaacagcaagaccaccaagaagcttgtaacgaagagactcagcctgagcaatagcacaaagacctctgttagcaaccttctcagcataaagctcaacactgtcctgaggaaatttgaatctcttttgtacaagagatgtcaattccctaatcctccttcccttctcacctaaaccaaacagagaatcatcaaattgatatcatagaaacaaaaaaaggtcgaatcagagcaaggttaacgaaaatgcaccaacataccgagaacgttttgagtacgagtggctctaatgatgatctcagtacgcataggagtgacgcgaacctcaacaccagagtaaccatcctcagcaagctctctggttagaacctcattgagttcagcgtaaaacacaccatcggctacgaactacaaaattcaaaactttttttgtgttaagcttagaatacgatacattggtagagagatagagacaggggagggcaaaagatatcacctttctcttcttgctgatctgggtcgccatgattgtttgcaaagcttgaggaggctagagacaaaaaccctagattcggagaagagagtgcgttaggagtgaaatgataaaattgtgtggttaaataaagttaagagcaaggcccggccttttaaggcccatttctattgacaagccacaatataaagggactgaaaataaaaccatttcacccgtattaaaattagtgacagtgagaattgaatttagctatcccgatcacgtctcatatctataatttccgttccttgtgttagcaagagtagtttagatagtatttttctgttcaaaaaaaaaaaaaaaaaaagatagtattttcattttccaaattacgatgatgttattggttcgtgattttgaaagagtttttagtgaattttaaaaagtattagacggtacatgtgctacgcacaatattcatgctttaattagtttatcagtttcacttctttatatatattacgaatttcaggtattttatttgtctataaatgtttatttgtataatttataaattttaagagtttcaaaatttattattggtatcatttgaacatggatactattataattatatatttaatatatatagttgtatagatagtatgtcaaggtttagtatattttattaacatgtaaattaattatcaaatttgacaaattaataagacaaacataaattttatcaaaatcagaattatagaagaaaaacttaaaagaattattaataaaaacttaaatttaaattcaattaagttaactaacaaaaattaatttcaacaaaaatgtaattaattttatttttaaatatttaaacagatttttatattttaattatcaaacataatagatggtctaattaaatgttttaacagttatttaaataaatttagaatattcaaaccaattcgaattcaaacacattaatttgatatttataatatcatatatataaaataaagcagatttgttatatttaattaggaaatgttttttaaattatcttattggattagtagtatttaaacatataatgagttttcatttaaagatgctcccaagcgacttttccgaaacggttttcgctagctacttcggaaccctagatctccttctgccggcgatctaatcctcctttccggcgactaccttccccctcagttccgcctcctcgcctctacccccatcttgtagtctcctttgcttaccgaaggctcctcagatctgacgagtttccagatctcctcgccttttcccg

SEQ ID NO: 1544 - DNA, 1179 bp, Unknown
  misc_feature (1)..( 1179): cDNA_ID_2046338_gDNA_ID_1620415_Annot_ID_156417 3000 nt of promoter + ATG
cttaaattccagaattaaaaaactaaaatcgaatgtaaatgaaccaaatatccaaacatctagaggatccgtagcgggaatctaaaattatgaaatacatcctctaaaaaaatttcaataatttatcaacttattcacatttataaaaatacaatatactgtatcattttgataaattatctacttactcaatggacatcatgattaatgaaaagtttaggccaaaaaagaaaaagaaaattgaaaaggggcaaaaccggtattctcagaaaattccacattatgtcatgattggtcttaatagtctcacgacacaaaacgacaaacattgtattacagaagaagaagaagatattattattatgaagaagaagaaaaaagaaactgaccatctcttcgtctctttgtctctctctcgctcgcagcctttttatttcctcaaacttttttgaacccacgaggatcatcttcctcatcatcacatcaccatcttcttcgtcctccataataataatcaacttcttctcctttattccaagttccgattagtttcagagtttttcaattgcttgcttaagtttctttgcgtaggtgagatcttcatcttcttacccttttggtcttatcttatttgtctgattactctctgttctgtttttttttttgtaatcccaaagttactttggtttttgtagttccttaagcttatcagaggtatcttcaaattcctatatttatttgctctctgagaagttcttgcaagtaatgtttcattgtgtgattttgttattctctttcttctgtttactgatttgcgatctaaatttagggattctaacactaagaattgaacaaattgatctaagttataatctcactaacgtcgcttttgcaaattatctgatttttgtcttgtctgtttgtactaattcttaatcaaaatccttaaaaggttgatttttggttatgatttattgctagagagtgtctcattacctacctatcactgtcttgaaatacttgagggaattatattttcctcaatttgagttatgtatcttcacttatggaccatattggtaaactaatatagataaagcatgatcctttaccagtttttaatcaagtgtggttgttactgatactgtgttattgtcttgtagtgttgagtaagttatg

SEQ ID NO: 1545 - DNA, 3000 bp, Unknown
  misc_feature (1)..( 3000): cDNA_ID_3062935_gDNA_ID_1620415_Annot_ID_156414 3000 nt of promoter + ATG
agtgagtttgtgaacatgaatcctacgttatacgatacgtatcataattatttatgttgcttagcatgcgatgctcattctaggttggggtgaagaacaaaactagcgaagttcagtcgaaactaacaaatgttatcgtcgtggatattctaaagaaccaggtcaatttctgcctttgctctcaatatcttttggtaatgatcttttatggtctcttctgaaaagcaaagtatctttcttagcagtcacatatttggtaacaaagctccatatatcttcatgatttattgatagcactaccttggacaattactagggcctgcacattttcacggtctatattctaatgacatttcaggttaagtcaccaagtatgccccagctgcctcagtatcgagacttatataatgcgctaagtccttatcactcaaagctcgtcggagaaagctacctagcaaagaaaagaccagtgtatgaatgtactgatgtgcaggtctctgacgctctctctatgtctatttttttaaaatctttgctctagagatttgctatgtaacgtgctattcctaaccacccatgtcgtcaattgtgtttgattatccaaaggtggatgctgcaaaaggcttcatggatgtcctaaggtcgtaccttgattctctttgctctaatctgcagtcacacaccataacaaatgtgcaatccaacaacgataaggttttttatctcccagtccttagttttagaatagagaaatgtgttttgctatcctcttttagatatgttaagcttgatattgttctctctttcaggtatcacttctcctaaaggaaagtttcatcgactcctttcccagtcgtcagcgcccgttcatgaaggtgagagccctttgcattctcattggatgcttcgtagtcaaatagtttccgtaaagactagactttactgacataccgcttttctgttatgatgcgaacagctatttgtggatacacaactcttctctgtacatacagatctcgttctttcctttatccagaagctataggatgactacatgtatacgtaaaacaagtcttggtggtggaaacacaatacctcgcgatgaaagtgccatcgattctgtatttgtaacttactgtttgagaatgttgtctatggaaaaaaagacttccatagatgagggtttgatacagagaaccatcatttctttgtatcctccaaccgcaaacacagttggtgttttaactcttaagccaaaagatcttttatttgtgcataagatagagatgttgaaacactatttacatacaccaatttgtgcaaagaatggtgcaacgtttcatatattacaagatgataacataggcagagtaacgtttttaaaagttcaaattcataggtggcagtttttgtaaactttgctaatattttggccataatataatatgtaagcaataaggcatgatataaattgtttagagcataatctaaagtacagacaccaaagtgataattaagaagaataaaatggtgatgattcaaacgaaaatcaccggttttaattttgtctgtatctcttgaaaaaacattcattttttttttctaatttttttctgtttatcaaaaatgtattcatctactctaggttaggtggattaaacgtggtaaaaagaaaattcagtatggtgtaaataattttgttaaatattttggtcttgggtaggaaaaaaaataaaatttgacaatatgtgaaatataatttacttctgatgttactcttgatgggaaaaaaatgagaaagattttctttattttattttcaaatgatatgtaccttccatccacgatgaacaatgtattattatttttggacttagacttcattcggttcatcaatataatatatttaataaaagaaatattttgtagttgaaaaaatgttcaatcagtttggttttatcttttacaattagaattaagtttctctgagtcttttacacaactctataaatagagattgtaatcacctatgtaaaccacctttgattttgataataagaaaacccaaaaaaagaggcaatctaaattgcccaaagatcttgtctttgtgtaggaccttaaggaggactctcaccttattccatttgcaattttcttcgttttgttccgtggttctcgtgttctctctctccattcgtgaaacagagcccacgtcttcatcacgcttctctctattaagctttcaaaacatctcttcatcgccactattgttttatagcttctgctccgcatcaataaatgaggaagatttttatttttggaatcttcattttttcaacatccccaatgcacaatgtaattatttttggaatttattgcagatataaccggttattgatgttggttatttccggttatagatgttggtttaatcttaagtatataagttgagttaatgacattgtaaatgattaagttgttaacattctgttttactcaataatgaaagtttgttagcttcttcactctcttctccgatttacttatccggtacattgtaccttcaatatggtatcagagcacaataacattccgcgatcattgtgttcatcggaagagagctttgttctttgtgttacgttttcttcttcgattctttgaagtttctgattccgattatccggaattttccgttctgtttcattttttctttcattttgaccttaacgttgacgattctcgttttcgattcatcaaattcgtcacgttttctttgtaatttctcattcttacactgagaatgggatcttatgtacctcaatctactattcgggtgactcgtcctccgatcaacaacaatggtgatcaatttcgttatccagctgatcaatatgagaatccttactatcttcatagtgcggatcacgctggactcattcttgtatcagatcgactaacgactgcttctgattttcattctggcatcgatcgatcttgatg

SEQ ID NO: 1546 - DNA, 3000 bp, Unknown
  misc_feature (1)..( 3000): cDNA_ID_3062943_gDNA_ID_1620415_Annot_ID_156407 3000 nt of promoter + ATG
tccacatgattctgtatcgaaggaccacccatttgtgcttcatcccgatgtggactcatgggatcctctgaaacatgatcctgatccaagattagtcttcttctggggaacgggatggtttgctggttgagaagtttcagcttctttgacttcactcctgccaggggctttggactagcacgcttgcctggaggtcttcctaccttccttttaggagactgcttggacctgactttcctcttgggtttaggctgattgactggacctagacgttgagataccggaactctctccacgctggatgaagtcacctcctcagggatttggactgaggtagaagaaggagctggttgagctgctctaaccatttgctcagcagttgcttcaagctctcctagagcctctgcctgtcaaactctttcgcgtctggccgcactctctgtaggatccgggcagctaacatactgggtcatgacccctcggagctcatccatagcagcattcagtgcatcctttcctggcgggggcctgtctttgtctctgtgacttgaagctaggccagagccttgcacttcctggcttcgacttgcgttatcctctagaacaggagagtattttctttgaacacctttacccttatcaataaggggtcgatagacagaagggcctgggtgggagtcctcttggaaggaatgtgatcgtcgattaactggggcaggatccgaagatctctgccttctggacagagaagaacgcatatcattctcagaagaagaaatagaatgtctgggggagagcactggtcgaatcctttccctctgaggttcatgaccatctcttcttcttacatccccaccagattcccggaatcgtctagagcagtccgtttggtgtctttgcctattacgggtgcggtggttggaggcaggcacatctcttctctgagaggaactatcctcagatatcctgaagattcttgaggcagaggacgagttggagcttttgcctctaatctcctcccacgagattggattgataggttcttctagtcttctactctcttttctaccaaggagggggcaggacagatgggaatgatccagcttgtagcaggatttgcaataatttctcagcttctcgtaaactagggaggcttccacttcactcccatcttcaaactccacaatcgtcttcaacacgaggggcttcagcccatttactagcaccctcattcgaaagaaggtagacgaaacttcagtcttctctagaactcccacactcttcgcaatactaaccaggattccttcagaccaaagatgaatcgacacaccttgaacattgatccagaaagggatctgggaagggaaatccttatcaatcgtcggctcccaacgttggaaaattatcatccattgcgaaaaatggtagggttgatactttagggctctagcaaggtcttgctcagtcgcgaattggaattggaataacccattcccaagatctgctccagtaggtcgggtggaaaacttccagtggtcggctaggaaaggcagtactgcccagacgtcttgttccgccggattggtaagtctgccgatggccgtgagggcatgtctgcgcaacaactcagagttgtcaaaagccgggactttaactctcggagggcgaggaggccggaaagggggatccagggtggatctgcgatcgctaggagagtaacgacgagacatcgggaaaaggcgaggagatctggaaactcgtcagatctgaggagccttcggtaagcaaaggagactacaagatgggggtagaggcgaggaggcggaactgagggggaaggtagtcgccggaaaggaggattagatcgccggcagaaggagatctagggttccgaagtagctagcgaaaaccgtttcggaaaagtcgcttgggagcatctttaaatgaaaactcattatatgtttaaatactactaatccaataagataatttaaaaaacatttcctaattaaatataacaaatctgctttattttatatatatgatattataaatatcaaattaatgtgtttgaattcgaattggtttgaatattctaaatttatttaaataactgttaaaacatttaattagaccatctattatgtttgataattaaaatataaaaatctgtttaaatatttaaaaataaaattaattacatttttgttgaaattaatttttgttagttaacttaattgaatttaaatttaagtttttattaataattcttttaagtttttcttctataattctgattttgataaaatttatgtttgtcttattaatttgtcaaatttgataattaatttacatgttaataaaatatactaaaccttgacatactatctatacaactatatatattaaatatataattataatagtatccatgttcaaatgataccaataataaattttgaaactcttaaaatttataaattatacaaataaacatttatagacaaataaaatacctgaaattcgtaatatatataaagaagtgaaactgataaactaattaaagcatgaatattgtgcgtagcacatgtaccgtctaatactttttaaaattcactaaaaactctttcaaaatcacgaaccaataacatcatcgtaatttggaaaatgaaaatactatctttttttttttttttttttgaacagaaaaatactatctaaactactcttgctaacacaaggaacggaaattatagatatgagacgtgatcgggatagctaaattcaattctcactgtcactaattttaatacgggtgaaatggttttattttcagtccctttatattgtggcttgtcaatagaaatgggccttaaaaggccgggccttgctcttaactttatttaaccacacaattttatcatttcactcctaacgcactctcttctccgaatctagggtttttgtctctagcctcctcaagctttgcaaacaatcatg

SEQ ID NO: 1547 - DNA, 3000 bp, Unknown
  misc_feature (1)..( 3000): cDNA_ID_3062962_gDNA_ID_1620415_Annot_ID_156392 3000 nt of promoter + ATG
catgtaattgggaaagggaatcggagacaactaatgattgaagaaaatggatacgttgaacttgctggaagtaaccaattgtcaaagctttcattaccactagcacgggtctgtctctcaaatggtatatatctgctcaatgagtctctctcgaatgattctaaatcagatcttggatcaatattatccgtggggatgaatgagaccaaagaaggatcatcctctgatcatgaggaaggtaacacgaacacagactcgaaagaggcaaaaggaggaatgagccaagaaataattcaaaactcactctctgcttttgaggatattcgtaatagagaaaagcagttgatgagacaggctctctttgccaatatggcttatgtagaattggagttggcgaatcctatcaaagccttgtcagctgctacttcactcttgcaacttgcagattgttcgaagatttatgttttcctaggccatatctatgcagcggaggccctctgcttgctcaatcgacccattgaagctggtgcacatttatccgcctatctactcggacaggatgattttaaactgccatatgcgcaagaagactttgaccagtggtggaagcacacaagttctgattgtgaagagacattggatccctccacgggaaatacccgggattcagttttccttaagccagaagaagctcgtggagcacttttcgcagaccttgccgcgctgcttgccacacaaggacatcacgaccaagcaaaatctttgataacgcacgcgttaactctcttaccgaacaatgtacaagctacagttacagcagtctacattgatctcatgttgggtaggtcacaagacgcccttgctcggttaaaacagtgtacccatgtgagctttgttccagggagattggaagtgagagcctcatagaagatttgtactctaaattggtatggtttgttcttttttgaaattcaagctttagaaattagttggttcgataaatatcagagaataaacttttgtacaagtttttttttgtttttaatttcttgtattagtactgtgagatgatatttgcactcgtgacttagatttgggtcttgagggattagtcgatttcttgttcaggaacaacataagattgttagaacaaacaccagtttttgtacttttttttaaatcttgtttaagacagacccccttattctatggctttagtagatttgtttatttttgaacaagaaagtgtggcgataaacaggcaatgaccaacgcttagcgtttagaacacttagttggggtttacgcgattttaggtggtttattcgtttacgatattatagataaaaattatgttaaactatatattagaaaatattaaatcgaattctaaataaaaatttgacaaaaaatttctttaatttatatcaaacaatatatgaatgtttataaccatgtgtgtagaagtaaaacttataaatttaaacaatgtagttagaaataagaaaaatatattaaaataaaatttatgttattttaggcagtcgatacggttttagccgtcagctgaacgcctaacgtatagtcggaatctaaacgaccgcctagaccactttttaaaacactgcttttgaatctttcaaacttcatccgaaagcaaaactaaagcttctagaacatgtgaaagcttgtcaagaaaccctagttttgaactcataaaacctagttcagaagagttataccgcagcattcttttttttttgtaatacaaagtctctctttttctcctttctaatacaagatgcaattaaacaaaatgttcctctagttataataatgtagaaaaatacgtgtacgctagaaaatttctcgaccaacgtaaaagagggtcctagaacggtcaacttcgacacgtggctcgtccttatgtctttctctttgtgtacagaagcaatgtaaatgcaagcaagcgtgtaagaactaattgagtcattgacacatgagagtgaaaaaggcaatcaaaagtcatcaacacatttctcttttaaatttggtatgcttgtttcgtggaagcatgtttggtgagggtagaacaactttggttttggttactccaatgatccatgcagcgaaggtgttcgatgaaatgcctagaagaggctttggggaaattacttcacctgaagactgaagtctgttagctataagggtttagtgattttgtcttgatgagaattccatttaacgatgataaataatgatgcgacctacaaagaatctttgccgccttaagttaccattgtttcttgtattagcgttgttgctgatgattggaacgggtaaaagatatacatgcatctaaagttgttaaggataaacagtgacgtggtggtcttgtcttttgataatcttgttactctttcctcactcaatggctacctcttgcgactgaaacggtaaacctgttatcactctggctttgtgtgtattcatcagtatctggtcaggttagaacaaatatattgcttattaaccgatcaatctgttgctgtcctgccctgcttgtcgatagtagacagtttctgtggtttagtaatactagagaacttattacatgagttaaggtactgtgtgtttactctcgaatttgcttatgttttatatcaagttacatttttgcaaacaacaggtttcaactatgtctcctgtctttatcaaaaaaaaaactatgtctcctgtacaagtggtagacaagttgttacaattattcttcatgtgtcgcatctaatttaataatccgcactataaaaagtatgatttatttaactaaaaggaatcactagagtctagaggtggtaatcgatcagtaatcataatatatattattgtttagaaatgtgagaaccctcagccatacggttgagttggagtaaacttttagctgcttctagatctaattttccgagctgatttatcgtaggtgattgtcgacgagtagtt

SEQ ID NO: 1548 - DNA, 3000 bp, Unknown
  misc_feature (1)..( 3000): cDNA_ID_2046379_gDNA_ID_1620415_Annot_ID_156405 3000 nt of promoter + ATG
atgaaaaatactcctctctccattttcaattaaaactataattttaatatattaaatgacaattttgtccaacttttaaaaagctgtattttaataaattaatattaaatacgaaattacacattaatttaaaattttgaaggaaaaaaaaagaataaactaaattcaaaatcttaattattaattttgactatttatgagataaataaaaattatttattttatatattaaaatctaacatgatattatcaaaaaaatattttaaagattatcacttcatatttgttaagatatataaagaaattaataattaataacttttttaatatcgataaaacataaaaatcaaatagatttttggattttaaatataaatatttaaaaatgattactaaatttcagtgaggacattttcttaatttgtatcccttttatatattaaaaaatagattatatattagaaaaaagaataaggtatttttcaaacaaaatctcaaaaaggggtaattttccaaatttttaatcttaagcgaccaacacctaaaactattcatcaactcaaatattaagaaaatctgtcacattgtaacagatttgttgtcaaaaaattaattactagaatgacgtctaacgataaccaattttttttaatgttataacagacttgttttatgttataagagatttttataattttacacaatatctgttgtttgatggcagatttgttttctaaaatattatattttatgttatgatagagctattttatgttgtcacagataaatttatattaccataaatctgtcatttgatggcaggttcaataaagaagaaaataaattgttggaatgaccttaaagatatttgatgttacgacagatttgtaatttgaaatccttataatgaccgatttatagtttcctttttccatgattttttgtaatagaataatactaacaattgtaacagtttttttatttagaaaatcatattatgacagatttgattttttttgtcaatttggttttagaaattcttttaaataccactaaaataagttttttccaaaaaaaaactattatgaattttatttttcaaaaatactacaaatctaaaactaaatcttaatattcaaaacgaatttctaaatcctaacactaaaccccacacctaaaaactataccgtaaatatacatagtcaatccaaatatataaaaaaaattacaacttcaaaaatcaatttttttttatgtttatggtattttaggaataaacttttgtggtttttttggaagaaaaaaacaaattgttgtattttcgaaaaacaaaaattgaaaatgtggtatatgagagaatttctcgttttttatctttatttttttgaagaaaatattcttttaagaaatatattaagtaatttattttgttggtaacggcagatttaatatatgtgtgacagttttttatgatacttgtcatattgatcgtcaaaaccattaaataaatagagtattaagcaatggttttttggacttttaacacaaaatttatgtcaatctagtaatgagtaaaatagagtgttaaactagttatttttagcttaatttgggttaaatgggataaatttcagttattatatatatatatatatatatatatatatatatatatatgtttttttccatttgtaatatactgacaaattagaacactaatttgcaaaatgattagcggggacccggaaatagtcacttgcgtgccatgaggcatcttctgtagggtttggtcgtcattgtaattaaaaataaaaatgatacggatgactcgttaatttgttcttaaaaatcaacgacctgtaatttagagtacatttttcttgttggcaaaacatttagagtagattagaattatttttgtttattttgacgatggaaccatatagaagatgtctactctaaatcattattattttaatctactctaaattgttttaaatggataccgatggctttattttaatctactctggattctcaacttctattaataccgatggctttattgcatctactctaaattatttttatttttatttttgattattttcttagttctatataagccataagttctaatatttatacagattttcgcaaattgtaatagttatattttagatcgatttggactgagtttttgtacgtaaacattcactagatctcccactacataaaccttaatgaaaaaaaagaaaaaaaaaagagaaattttataaacttataagaaactttaatttttagatcaggtatttagaattttcttaaacgtagtaaagcttatcgtgcatgcatatggatatttcatggagatgtttataaacattcagaaaaacttaatttatttttagaaagaaaaaattattaactttatcagtagaagaaatatgtacgtatataaatattgtgtaatatctactgctcagactatgaaagactctttaaatgcaaaacactgagtggattacgaaaataaagcataaatctaaaagatgtgttgattatttttacaaaatatataaatatttatcattatacgagtcatagtaataaactaataattatcattataaaattttaattttaagtctatgtatgtgctaaatctaaaaaataaagtactttttcgtgaaaaaatatggaaaaagttatatatgtgtaatttttcatatttcaatacatcaattcgaagattatccattagaaagacttggtaaaaatttcaagcaaatattaagtaactcgtggtggctactttcaaaataaaacaaaagcatgtgacttattttatgatttcaaaaagttgataggttcggacgagttcacaaataatggaactaatagatccctataaatacaaagcattattcttcgtttatcttacaaaactttaaacacattgctttctattttaagatctttctatctctctctctctcc

SEQ ID NO: 1549 - DNA, 3000 bp, Unknown
  misc_feature (1)..( 3000): cDNA_ID_3063012_gDNA_ID_1620416_Annot_ID_156423 3000 nt of promoter + ATG
ctcatcatccaaatatagacatgatcggaacaagttcctctaaatagtttttaagttttcaagaaaggttttttatgcctcgtatcataatgctaatgaagtcataagaaatatttttttcatttactttggctggcttctttgtatctcagaatatgcaattgcttctgaattctctcactttggtggtttccatcaaacataacaagatcatgaatatgttcatggaacacatcctaaaacaaatgtggtgcaacactaacaaaaaattgtaacccacacaactcggatttgtcaatacttaaaagcttaaaggaaaagagctctctggcttcatttactatctcatataatcaaaaattaaccaaagacctgtccacagaaatgaagaaatcataacgactcatcccccggaaagacaaagaggaatgaatgcatgatcaaggctcgtaaacttcaggaagacgaagccctacactggctgcagatttattaagcactcgtttcatttcttcagttctatcaaccgcaatgttgtatgagaacagcagatcctgcaacaaccagataacttatccatgtgagagactaaacacacaaatgcattgccaatgtgattaagagatcataaaaaagactgaaccttgtgagagtgaatgctattgagaagatatgtgtaatttcgagcaaggtttattttctctgagtttgcattctttcgaaattcttgcttaacaaagtctaagaaatgagacttgtgatcttctttaccaacatgtttcaccactgctttgagaaggtcacgataaactctagcagctaaaacaacttcaccactcatcttcttctttaccctatcaacacattttcaaaagagtgacataaattcgggttaaagactcaaaaatcgaatttttaaaacccaattcgttaataactattacttgagctatagattgattagaatcatcaaataatctcattttggtttagaactagcattattaaaaactcagaatcgaaacaaaagttggaatcggattgaacaaatcgagatagaatcagaaaaagcgcagtgggaactaatgaatccgaagattgggtcttttcgatagtatgttcaatagaagaagtgaagaagatcaccttgaatctcgccggcgccgatcggataaagtagactgagagacaaaatccagcggagaggagaagaaagtccgtattaggaagtgaagaagatggacttgaaaaaaaaccaaagtagtaattggacagcccatactttggtaatgggcttttgaaagcagtacaggcctacaatatgagataactgagacattttcaaataagttacaaatttataactaacattataaaaaattatacatcctttaatcagtatgaaataaaaataaattattcttaaaatgaatttttattttattttaacttttatatgtttaagaataaatacgttttgattttccaaaaaaactaatagacaattattcttaaattggaaatagtgaaccaaaataattatattttaaaaaatattgtgttttcatctatttttatttttgggtaaacaagtattttcttacaaagaaagttgtgatactattggaaaaacaaactagtgatggtatttttagaactgaaacttaaaaatgtgatattttagaaatatatttctattttttattcgaaatttataaatcaaatgaaacatataacaacaggaaaacaacgaaattaaaggcactaaatttgaggcccactctctttaaatgaatctgtaaaaggaggctcataaaagtagttccgatatgtgtagttcttaaatccaccaaaactcaaaaaccttcctctaaatatagataatcaaataataagaaatatatacattttgtcaccaaagatagtgtgaactaaaaactaatcccttttatgtaaacaaagttatgggcaggccgcagttggagctaccttctttctatttgtgtcggtcttataatttttaaaaatcagatcaaatcaattacaatattagcaagtgacttatgcataactcattaacttttattcctctattaactacggaaaactagttaattgtctattgtcgttttctatctgggaatttaaggaaatggaagtacggaataatggaaaatagcacatactttaaggactatttactattatgtttgtaatgattgaatatgatattaagttcataaatataaattgctagctataactataagacaaccacaaaagttttgatattatctttttgtgcggtatgtatataatttgttaaaagaagtattgcattatggtttctaagcatatcgataataagaggttgttgcaataagatctttacatgcaagagattaaacaaagaaaatttataactgatgtgttactacttactactaccttcacacctaacatgctaacactcattaattatttctctatttgacatgtactcgtcaaatagtttgaaagtttgatccaatttcattttcgtgcctcttaatttagctatattattacgatcaaagaaatttataactcatgtataacttactacttttacctaactacccatttctttttgacatttagataacaactaatagtcaaaatagtttaccacaaattttttgatcaatttcattgtacgtgactattaatttagctatattacgactgaagaattttacaattgcaaagattcaaataattaaacatacaagaaacaacaacattctttgttcattaaaataaataaccaagaccctaaaatctttgtatgattctatgcccaataaatatgtgccggtgaaccataaaagcttcctctcataatgacaaacgaaaagaggcttatgcttcatcttattatataaacctcatcaaacctattcttattttttgctctaatctaaatattaaagaatcaaacttaatctttcacccataatg

SEQ ID NO: 1550 - DNA, 3000 bp, Unknown
  misc_feature (1)..( 3000): cDNA_ID_2138218_gDNA_ID_1620416_Annot_ID_156436 3000 nt of promoter + ATG
tcacatttcgcttttgttataaatttttattgtgaaacacacacacacattatacacgcctttgaaattttgatttgtatgcataatgtattaaaaaaaacattattatactgccattatagtaataattaattggtcgggtaaaacgtctctctactcaattgtgttttgtttatatcaatgacaaaaaaaaaatcaagaagaatccccataatgtgagtacgtaaaagattccacttaattaaaaaatgttggttgtacaactttacataattcaatggctaatcaataaaataatcagtagttaagaaggcaaattaaagaaagtgttgaataaatccaagcaccggccatttattctcagcgtcggctaaagtgaaatgagggcacaccgtcagcatccatgtaacgcgaagcagaggaacaaccactcggaacttgtgttcgtgtgaggtcgcacgtgccgcaagtgtcggtggctgcacgttcaaaataatctgactgacccgagagagagagtaaacaagataaaaaagtacaaagtcaaaaggcagaaaagcgcaattctgatttttgtaaaacaattttttattttttcttctcaacttttatgctgtaaaatctacattagataacattgtacttgcttttgttttaaatttcgtattttgcttcgcgccaacactatgctagacttcaatcacaactactaaatcatgtagaagcatcgagtttttgaaccgattcggactaatcatcgatctaaactaagggacaattttgtactggaggatgaaaaagtttactagagatgtaaaagttgcacaacatgtcggctcattgaccaaaagttggatggtctctacagaacaattatataaagcactctgactcacttacttaaagagagtggaaacaaaaaacggaataatatccaatagcaaaaacaaagaagagaaaataagagaaagtcttcgatttgcatctcccggattatgggtttggagtttggtatatctaaaacaaaactaacttagtttagcatatccattaaaaactatatccatgaagtagcaaatttgttgcaatttactttcgaatagttaaaaactaaatttattcacttgttatgaaataataacgattaatgacaaattttcacatttttcttcatcgtcaagttatagccaaatgacaatagttttttttactaaaattaaatgaattcttaattggtgtacaaaaaccttaaacatcaaatagaaataaaatgaagagagcatataacttttatcatgactacatcttcatagccatttttctctaccaaaaaaggtagaagctaattaattagtaaataatacatagagattttttggtttaataataccaaataatttcttgtatttttcaacagataatggctgatggagattggatttgcataattaaattttataaaatggtagtcttgaaagaaacgttgaaccaaagcaagatgaagatgaaccaaaattagtcttgaaactaacgttgacaagaatttaccataccacataaaacgaggagtcgtggtgtttggttaaatagtaaatgaccgggaggagaaaagaatcaccgatcgatcccaaatggttcgccgtcgaacacggacacgtgtcgtaggataagaaccacatggttgtgctaaagaccaacgcagcgagtcaaatgattgcatccattttgaactttcccaaattgtcattagccatcaccacacgtggacgacaggacgactcgtcttctaatgctttacctgcacctcgtcgtacattaacatttccccaattcgtcttaagtttttgtttattttgttatacatataagcgtattgaagccattaggtgctttaatgcttcgttagctgcactttccatttctgttattcagttctcaacctctatattttggtgcttatatcacaggaaaatcaaacaaattattattattatttttagtacaattttatctaatttattgatacatgtactagttttttttttgttttgttatttaatcacaaattattttcaaattgtttgatcttttatggagaattaaatatagtgatgcctcatttgtaaatttttaaccactcgaacctactcccaccacaacaaatacgacattttcccaatgatcaaaactcaaaaggttaagctgaagtgaacagtaagataactataataatcagcatactaattgtttctttttttttgacccaatcaacataacacttctattttcaaattatatctttgtcagttcggaaaaatagtaaatccaatgcaaagttgcaaacccaaagacaaagcaaaatatattccgacaaaaaaatacatacaaattaaatgtatacatgtatgtaataacatatataaagtcacaggcacaaacaagaagcagaattagctggccactcgttattattcgttttctcttaaatacttaattcttttttttcccaaacagtttctctgaaactaagaaactctaacagagaatccggatgcttttctctgattcttctactctttcctaatttaccgattttctcgggaatccaaaatcccgtttctctttttctcgagttaaaaaactttcgatctgaagtcaattcagattcttcttggaagctcaaagaagaagaagagagaagagagagagactagtgatttggtttagttcgttggatcagaaaggtctctgctttgatctttgtagtacacgtggcgaaaagggtcggaatttggagttgtgttgatgatgttccaagtctcagatttcttgtaataacattctcttgtctttctccaatgtctttgtcttgattctcagaaaaagatcttcagatccgtttacttgaggggaaagagacgaatagttttttgttagctaaaaaaaattatgatgaagatgatgagaaacaaaccgacaaatcttccgacggcgggtatg

SEQ ID NO: 1551 - DNA, 3000 bp, Unknown
  misc_feature (1)..( 3000): cDNA_ID_2138237_gDNA_ID_1620416_Annot_ID_156441 3000 nt of promoter + ATG
ccgatgtgggacattgtccctaatacgccccctcgagatgatggctcttctagccattgatctcgatatgtttgggcatggatcggcgggccaagtattgggccgaaccgatgtggatcgggttgagtatgtgcggatcgggctctgataccataaaacatcataaaaatccaatacagagttttgataggaaacacacaaaaacataagacaagctcacataaaaaatctaccaaacatttcttcttccatggccattcctaagcgaaagagatccaagactcgaagacacatcctcaagcaaagcttcattcatggcatctcttagattcatctcatcagtagcatcatggaaacatccacgtgtcctagactcacttatcagtgttgcccaaatcgaaccacttagagccaaagttgtctcgttcccaatcacccataaacagtgtcttgctcgagtcagtgccacgttagctctttgacggttgttaagaaatccgacttttccattaccgttacttctaacggtggagatgatgataatgtcttcttctcctccttgaaaaccatctacggaccgaacattcaaagtgaattgctgacctgataaggaactgtacttatctccgattttctcttggattgctctcatctgtcctttgtaaggtgagaccactccgacactcaccttcatcctcctttcacatgaaactttgtaaagatttgatataatttcagaaatgacagcaacttcaaccatgtttttgggactatgtccatcaccaaactcttcttttccacgtccaacattgataaaagaaaatgagtcaaacatgtttcctttaagaaacctcttttgataaatactttctttaacattttcagcatctttgattctcccaccataaaactccttgttggggaaacgactaatagaaggatgcattcgatattgaacatcaagcaagtgtttgttgtgaccaagcaaaaccaatctctcaaacaagcttcttccgaatttcgccttttcacacatctcattatgaaccattgcaggcaattgaaactcatctcctattaaaatggcgtgacgcagtcccggaagttgcaatgcagcaactgattcacattccttaagctgagccgcctcatcaaccacaagcagttctacatttcctgtcctttccacgttcatttccgcagcacccgaggctgtgcagaggataatatccgcgttttgaagacaaaatttcctaatatcttcgttttctaacatgtctggaatctcaaaacgttttggaagtaagcgtagagccttgaggcaatcatcactgagtcttttgaagcaatcaaatctgaaatttccttcctcgaaatcaaccctagaagaattctccctcaagaaatatctgatacgctgaagagtttgacgagaagcaatcattttcttcacatcttcatatggaaggtaaaccttgggaagatgtgtatacaaatcaacgatgcatgtcttcacttcttcacttaagctattaaaattcttctgaacgaattctccaaaagtaggaatgttaacaacaacttcttccctttcatcttcttcattcattctttcaacttcttctaactcgtagacatgtctctcatactttccctcggggttttcaagaaactgtatcagtgactctaatctctgcatccatccagaaaatggtgaaaacagtttaccaagcttaccaatacgctcatcaagaaacacatcgagaagaacatgatcgttcttgttaatccccattctgtcccggtttccggataaaatgatattccctagcctgtaagtagcattttccgctgtcgagttttccttaaataaggataagagccttgatgtaacttgtacaatagctgtgtttgtaggagcacacacaactgtcttgcaccttagtttgagaagggcaaagagaagagtcgcgaccgtctttgttttgcctgttctaggaggtccccatatcagtttcacactgttcttatgggtacagtttcttgtctcaaggcagcccaagattgcatcctcttgggaagagttcaatttcgttgaacggattatatccaaaacaaggtcagatctcccatcattttcagaacaaaaacattgttctgtaccctcagtattagcctgaagcacactcttggttagagtcgatatgtcagcttcgttgtgcaaagcattccaaattcgagtgtttgttgttaaagtcattagaaaaacaccgaagctatagttctcaagaggtgatatcgatctagacaaatgaacagagattttaagattttaagatcacctctatagttctcaagaggtgatatcgatattagactgtgggcttccaacctaaaaccaattggcaataggtggagaggcgcatatcttatatataccacttaagatcctactcaacttccgatgtgggacattgtccctaatatcgagaactctgatcgcctgaaaccgagaatctgattctggactatggaaagttttgaaatttggccggaaaattgaaaccctaaattttttttgttttgagagagaaaacccctaaaaacccaagctctgtttggtgtatctctttcttgggaaacaagttcttttattgcattttttttccctatcctcgtattttccatacaaaatcaatgttaaattttaagtttcaattttgtccgcaaattagaaaacttggcaaagtaaccttcttagtgtaaaatttttagaatgccctcaaccaaattttaaagtgtttaaaaaaaaaaaattaaagtgtttaaaaaaaaaaaaaaaacacgaagagccaagtaaccttatccattcatacgcctcaaacagagacgacagcgtttgaagtagaagacaaaggacagtgcaagaatctcttatcaacatgagaaaaccatcaagcaaaaaaaagaaacacaaaagctatctccgaggttagagca

SEQ ID NO: 1552 - DNA, 3000 bp, Unknown
  misc_feature (1)..( 3000): cDNA_ID_3062998_gDNA_ID_1620416_Annot_ID_156438 3000 nt of promoter + ATG
agaaaattgttaaaaagaaattcacatactaactaatagagtatcagatcaaagatttatactgacaattcatcttcaaaattaggcttaaattaaaacttggagttccaaaaactatatcccaaagctgtttgagaattctgcttttcaaaagacgtttctcacacaaaactcgaccataatcacaacgagcaaaaggataaaaagagaaaaagtgaaatacctgataggactccacttcaagcttcagatctggaaacgtcacagagaaacagattgggcggcggcggctttaatgtatgggaaggggtcgtaagaaaaccctaatttgaagacacgtgtgatgtcctgagctgccacgttaaatgagtaggtggtgttaagaatcagatgacttctattgggctagatttaaaatccgtacgggcccaaatcatgtggggatggcgacgtgaataataagttgtaataacattcttgttttacaacgaaagctgcgttcaaaaaaatcattttactttttattatatttatttagtttggatgaaattcattttcgattacattgtattataaattcaatgattaatattttgctggaaaattgaaattattctaaaaattcaaacaaacaaatattattagataagagtttttttagaaatggttttttgagatttatctaattaatatcggttgacaaaaaaaatattatataagagttttattactagaaactatgttgaaataccacatttttaactttttattcaaaagtataatcattaatttattttactaataatatcccaaatttttgtataaaaatgtttgttacaactaaaatgaaaattaaattccattagagatgttaatttctttttaatattaaactaggttagtacctatgcttcatgctttaattagtttataaattttgctattctagcaaaattacttaatcaaagaaaaaaacacaccacttaactgaagttacactggacacttactaccacttagctgacacaagaggtcaaaggtatggacagaagcaaaccaaggcaaaactaaaccaaagcaggagagaggtaatcggaatcttttatgtgatcatataatgagtctgaaccttcccactatcatgcttactcatcccgtcccatgttgtttgttgggcgatgcatctgaaccctcttagatttgttggataaaactgcttcggcttgctcgatcaaccctctcctcaagccttatgaaaccggctaatcttggtcttttgattagaagattatctgcgctttgaacttgtaatcttatttgccgattgcatcatgcttactcctctaaggagataccttccctgaaaccttactcctctaaggagatatcctctctgaaacttgaacccggagaaaagtctcaaaccgcagcctcctctttggagcatttcaaccgcagcctcctcaacccaaatgcattgaatttcttgcagcgagaacttttcagaaaagcctcactctagatctaagttccactattttgacgagaaatcgctctccccaaacacacatattcaaaatagcccgcattcctcctgtcttcctttgacgatctgttctgagcttcggttgctccgcaagggatgacctccggtggctgtggtggtacttcggtgaggttccgatgacctctctcctgttcactttatcttggctgcgttttcttcttcgtcatctctacctctccttagtgtcgtaaaccagatctccctctctcaatacttcaccttcacggtggtgatgatctcttcttctcagcgagtcagcgacgtttcggcctccatctccgggttcttcttctctcctttcatcttccctttcacgatcaatctttccctttcatactctctcgcatcattcataggctattagggtttatttcttttccgtgcggcacatcttcacgaagatataataaacacaaacgataaaatcttttgtcgtcgttttaataaaagaatttagacaaatgggcttttcttagcccattaacagattgtccgtcttgattgaatgcgctaactgcagatttcaatgggctattttacgttttattgtctgatatcattctatcagttttcatttcaaacttttggcacataccaagatttgttggaattctatatcgatgctaggaagagattcttcttagacagaggacacatcatgatcatgcgacccctcgaccatttacaatgtctttggaccgttgacataatgaagttgtggtatttgtgtcatctatatttgagttcttgtgggactattgttttatagatagttcttgtgggacttgagaagacataactaaatgttttaatgaacatctttatacaactttgcatagaagacgaaatacaacagatggattgggtaagaatgttttggaagatccgatgattatcacatgaaattgtcgggagataagtacgtgacataattatatgtgtatatgtacgtatgtagctaacaaacaaagagcatgtattttggattcaagatcaacggctctgattgtatcttatcttgcatgcatcttcattataactttataagatatggttgtgtttaagatttagaatgttttacacccatataagcttcataccaccgtttttgctttgtttccctcttttgtcctcattagcttctctttcatctccattttcacattcacctatgattcagtggtcatacatgaaattggcatatatcatatcagctttagttgctgttgatatattgtttcaaagtgcatttgcacttattgattacattggcaaacgcaattattatttttaatagctaaacaacaatggcaaattgataaagcaaattaacgtgaaacacaaaatctatcgaggaaattatctctgtttttgatggttatgcaaaatgctcgggtttgagaattagtattgagaaatctactctctacatg

SEQ ID NO: 1553 - DNA, 3000 bp, Unknown
  misc_feature (1)..( 3000): cDNA_ID_2138189_gDNA_ID_1620416_Annot_ID_156425 3000 nt of promoter + ATG
taaaattcttcagtcgtaatatagctaaattaatagtcacgtacaatgaaattgatcaaaaaatttgtggtaaactattttgactattagttgttatctaaatgtcaaaaagaaatgggtagttaggtaaaagtagtaagttatacatgagttataaatttctttgatcgtaataatatagctaaattaagaggcacgaaaatgaaattggatcaaactttcaaactatttgacgagtacatgtcaaatagagaaataattaatgagtgttagcatgttaggtgtgaaggtagtagtaagtagtaacacatcagttataaattttctttgtttaatctcttgcatgtaaagatcttattgcaacaacctcttattatcgatatgcttagaaaccataatgcaatacttcttttaacaaattatatacataccgcacaaaaagataatatcaaaacttttgtggttgtcttatagttatagctagcaatttatatttatgaacttaatatcatattcaatcattacaaacataatagtaaatagtccttaaagtatgtgctattttccattattccgtacttccatttccttaaattcccagatagaaaacgacaatagacaattaactagttttccgtagttaatagaggaataaaagttaatgagttatgcataagtcacttgctaatattgtaattgatttgatctgatttttaaaaattataagaccgacacaaatagaaagaaggtagctccaactgcggcctgcccataactttgtttacataaaagggattagtttttagttcacactatctttggtgacaaaatgtatatatttcttattatttgattatctatatttagaggaaggtttttgagttttggtggatttaagaactacacatatcggaactacttttatgagcctccttttacagattcatttaaagagagtgggcctcaaatttagtgcctttaatttcgttgttttcctgttgttatatgtttcatttgatttataaatttcgaataaaaaatagaaatatatttctaaaatatcacatttttaagtttcagttctaaaaataccatcactagtttgtttttccaatagtatcacaactttctttgtaagaaaatacttgtttacccaaaaataaaaatagatgaaaacacaatattttttaaaatataattattttggttcactatttccaatttaagaataattgtctattagtttttttggaaaatcaaaacgtatttattcttaaacatataaaagttaaaataaaataaaaattcattttaagaataatttatttttatttcatactgattaaaggatgtataattttttataatgttagttataaatttgtaacttatttgaaaatgtctcagttatctcatattgtaggcctgtactgctttcaaaagcccattaccaaagtatgggctgtccaattactactttggttttttttcaagtccatcttcttcacttcctaatacggactttcttctcctctccgctggattttgtctctcagtctactttatccgatcggcgccggcgagattcaaggtgatcttcttcacttcttctattgaacatactatcgaaaagacccaatcttcggattcattagttcccactgcgctttttctgattctatctcgatttgttcaatccgattccaacttttgtttcgattctgagtttttaataatgctagttctaaaccaaaatgagattatttgatgattctaatcaatctatagctcaagtaatagttattaacgaattgggttttaaaaattcgatttttgagtctttaacccgaatttatgtcactcttttgaaaatgtgttgatagggtaaagaagaagatgagtggtgaagttgttttagctgctagagtttatcgtgaccttctcaaagcagtggtgaaacatgttggtaaagaagatcacaagtctcatttcttagactttgttaagcaagaatttcgaaagaatgcaaactcagagaaaataaaccttgctcgaaattacacatatcttctcaatagcattcactctcacaaggttcagtcttttttatgatctcttaatcacattggcaatgcatttgtgtgtttagtctctcacatggataagttatctggttgttgcaggatctgctgttctcatacaacattgcggttgatagaactgaagaaatgaaacgagtgcttaataaatctgcagccagtgtagggcttcgtcttcctgaagtttacgagccttgatcatgcattcattcctctttgtctttccgggggatgagtcgttatgatttcttcatttctgtggacaggtctttggttaatttttgattatatgagatagtaaatgaagccagagagctcttttcctttaagcttttaagtattgacaaatccgagttgtgtgggttacaattttttgttagtgttgcaccacatttgttttaggatgtgttccatgaacatattcatgatcttgttatgtttgatggaaaccaccaaagtgagagaattcagaagcaattgcatattctgagatacaaagaagccagccaaagtaaatgaaaaaaatatttcttatgacttcattagcattatgatacgaggcataaaaaacctttcttgaaaacttaaaaactatttagaggaacttgttccgatcatgtctatatttggatgatgagtcaaaaatggtaaacaagatttatgaagagaaattagaaaccataagggttttatccaaaactcgataagccatccaccgctagtgtttatcactttatctggttcttgttttgtattttttctatttatttatttagtggagacatcgatgctgacactttcattttcttaatcattctttaaggctctggtagctttggcttttgatctaaaagctgagagtcaatagagagctttgtgctgagcatagcagagaagagtt

SEQ ID NO: 1554 - DNA, 3000 bp, Unknown
  misc_feature (1)..( 3000): cDNA_ID_3063002_gDNA_ID_1620416_Annot_ID_156432 3000 nt of promoter + ATG
tttttttggtaatcaatcgcaaactaaacacttaatgattcgatagttaccactaattagcagtaatttattgtaacaataagaacggcagggtattatcaaattggtttttgagactttgtggttataagtggcttgacttatggatattctattcagccacacgaaaaaaggttacaacttgcaaatctcagattttgatagagtaactaataaaacagtagagagttgatgagacaaaaacatcttttccattgctcgaatgagcaagatatttgcattagatatctcttcggatataattatattctgttgataatactaaccagtataagttcttaggatttttttttaaagccttttctatagttattttctttaaaatcgtaatttatccagactaaaaacattttaggatgaagctatataactaaaccatagatgataaatttataatttgctaaaacgaaacagtgacatttctctatataaaatagtgtgctttatcgtggattttcttaaaaataacatattatcggacaatataacacgttatgttttgatcaaataaaaatcatgcgctaaaaatgaatcataatgtttacgaaaatgctacacaccagttttgcagtaaaaaacatggtggttaagttgtcttttaaagtttaaattgtcattatttgtgagttcacaatatatatttgtgcgtgtgaaagaatagataaacatatgattgtgaatgatgattagttgtcgtgatttttaaccacatgttagtagtattcaaagccttgaaccagaaaacggtcattgaacaaataaaattgttgtatatgagcttcctacttaattttctaacgcatagtggtattttaataatcccgtattaaagtaattggaagaattgaacaaatcagaactttttgttatttgggttgatagtggacacacctccgtatcaactccacataatgagttgtaccaaaaggtattttatactttcttttcgcttttgcacgtttagaaaaaataaactcgaaagcgaggttgcgaatcgaacacgtaccttgcgcgatttcatttcatttgttaaataaaatctaaattaagatgaaccaaaaaggcaataaaatgacagaaaagagagagttaaaaagtcaagatatactttgattggagtaatggtgagcacttaaggaagccagccaaagcttggtaagacgacgagtctctctatatggagaatgattgtcctacacgattttgtttcacggtaggactctcctataggcttgtttttatttcttttctttatattgtttcattattacaacaacccacaaaatcattcaaaaatgaaatgagatcatcctccaatcacccatgacccatatatgatatatgttaggttaaactattacaatattcaatcctataggcttgttttttttgtttttttcctttatggttttcgaacatttttaaggtatatctcgacacgagttctctactgttcccacaaaacatgtttactacataaatataataaagaggaattggcgaaaaagctagacaaaaaaaaatccattaatcctctcatagaaactagtttttgtgagattaaaaatgctcgatagatgatcatatgaaatcatagttggacgtatacacatgattacaattagagaaaatgttaagtgtaaaatgcatatgtagatatcttataacgaaagagtaagtactggttagaaaaatgggcatgcaggcccctacgcgttgtaccaacgttaaattaaagccacatttcaccatacgacaacctccggtcctttagctctttcttgcttctttgctcttcgatctgactaattactttttgcatgttttttgttgtccaatgtccatcatcacgtgctaatagcctatcatatgaacattgtcttaatagcccattaaacgcttggtgaaccgtttttgtagtaaaattttgggcatctctgccaacattttcgattatatttcttagagtgtttaaaaaaaaaaaaaatcccatcttagatatatggactaaacattgataatccatttcttcacattttatgatgaatatgtttgaaccaatacaatgaatatataatttagtttttttttatttttaggtttttttttggtaaaaagtaaaatttcataccatttttgaaaattttgacaaaaattacaaaagaaaacaaaaaaaaatgagaaacctaaagctacataaaccaccaaaattactacataagcataaaacagaaaaacacacactagcaaacacggtaaaagacttttactaaaagtcatgaataaacaccgattctaaacagtaaagatcgaacatttataggtagaaaatttgattgtcaagcttcattcatcaacttttcatcttcacatgcttccacgtaaacctcaacaagcttctcaagtagctaatttgattaagaaccattgtgttattcccaagaaccgcattataaccaaataagataaattttctggttttgctattcgtaaacttctccaccatttcttccacatccaatatctaaatcgcatttacaagtgtttaaaggaatcgaaatttatgtttgagaaactctcggataactttttcgatgatcggtaaatggcggcagttgtatcatgaactagttggtgtatatgttaatcatatgcttagaatcgtgtaattgataatgcaatgagatacgattgttcttagatctatatgcaaaataaaatttgagaatcgaccaaatgattggatattatacttgtcatgtttggtgattcatacatccaaatgtcaaaaacgtaaaagttccattgtggccattaacgtgcgttctcgccatcctcgtatatcgctaatgaaatctaaaccaataaaaaaacttcaatcttttttttcttcacaattatcgatccaaatcaagattttcttgatttgaattccttgcg

SEQ ID NO: 1555 - DNA, 3000 bp, Unknown
  misc_feature (1)..( 3000): cDNA_ID_2138357_gDNA_ID_1620417_Annot_ID_156457 3000 nt of promoter + ATG
taagctagcccttagggctggaaatgagaaggtaagttaacaaagattcttctttaattaaagagatccttcgttctattcattttctcattggttttggcttataagagatcattactccataagacccgcttcttactcataatagaacatgtttctggaatttcaagcaattctctcacattttcctttcttatttttattgtataggatgacgatgaggcagatactgttggttgttgtacattgaaagtaggaaacgtggagtgtattcctccaaataagttaaaggtatacacttgatctcaacctaaacaaaattgactgcagaatgtatctgcgagagtactaaaatgcctggcttattgatttgttgaagaaggttattttttattgcatattatagtgacttatggtattcgctttggcattttcagtttgacttccttggtaaagactctattcagtatgtaaacacagttgaggttgagcctctggtgtataaggcaattgggcagttccaagcaggttagttaataattatgtaggctatctaatcttataattgacctttggaaactggataaatgacttttggtttcgtcttctatccaggaaaatcgaaaaccgatgatctctttgatgagctagatacttcaaaactcaatactcatcttaaggagcttatggctggtctcacagccaaagtattccgtacgtataatgcatccatcacattggatttaatggtatgttttctattactcagttgtcacaatcctaatgatataggtttcttaagccgttttggatgatgttatgacagttgagtaaagaaaccagagacggtgacgttcctgaaaaagtggtggtttatcagcaagcgaacaaggaggtaatgacaattattctctctgctattttacagataagagaatatgatcatcttattcttttttgttaggttgctatcatttgtaaccatcaacgtactgtctcgaaatctcacggagcacaagtggagaagctggctgtgaaaatagaagaactaagggtataacataagcaaatcctagttaaatatgatcaagatacaatttcaactttctcactcccataatctttgtacttctctgcaggagcaaataaaagagctgaatattgatctcgacagggctaagaaaggaagaacaccgttaatgggatctgatggaaagagaaagaggaacttaacacctgaagcgtaatatctaaacctctcttcatatacattatttatcgcataagcatctcctttaaaacaactccctctttggaaaaacagattggagaagaagataatgcaaacgcaaggtaagatcgagaagatggaaagagatatgcaaacaaaagaagatatgaaaactgtcgcattgggcacatctaagatcaactacatggatcctaggatcactgttgcgtggtgcaaacgacatgatgtccccattgagaaggtaatatgtaaagagcttcaacaaagtaacagaattgcaaacacttgaaatttacttgtgttttgctattgcagatatttaacaagtctcttctggctaagttcgcttgggcaatggatgttgatcctgagttcagattctgttcaagtaccgatgaataaatacatgttcgttgaggccagtttcacctaactaccattcaccatacatttacagagatatagagagaaagagttaaaaagagaagaagaatgatagcaagaccctgtaaaagaggtttcttctctcttattagtaaaccaaagactaatctatggatgttttatagaaaaacagttacaattttttactccaataaataaataattcaggttaataatattaagaattatacataaaatggtagtacctttctttaatctatatactatggatgattaataagtttatgcattaagtaatgaaaatttttaagttttttttgtgacaaaattcattttaaccttttttagtacttgaaataactttaataatttacaaattaactttcaaatggttaaaagttttgatgacacattgtttcgtatatctaaatagtatctaaatgctaaattatccgttgatacgtaattttatcccataagaatgtggatatccaaatgctaaattatctatcgacacgtaaatttttctgataaaaaatcttaagagcatccaaacgttaaattatttgatgatacataattttatcggataaaaaattggatttctttttatttctgattttatcccctattttatttacttaaatatgcttcacaatttagtaaattaaccgatgagtcaatgtttaatcaattttttcatcttaaacccaaaaattaaggggattttggcaattaaaaagtttacggtaataagagtgaaaaaaattgtctatggcggtaagattaaacgatttggcgcgactcaatacgacgtcgtaacgaaaacaaaaccctcaaggggtgaactctctaatctaaagagagtctccttatgccttagtctcctcgtccttaaaacgatagaaaccatcgaagcagaagagaagagagaacagagagacggaggagagagataggcttcgctagacaatttcttcaatctctggaagaaggtagcttcttcaatccaacgtcaaatctctgaaatttgattgtattaagcttaatttgcatcattacccagttatagcacaaattagggtttcacatacgtaattggggatttgatatttcaactacactggattcttcaaatgttggttctttgctttaagattctctatttatgaatctcagtacttcattctctgtagtgtaatcattttgttgcttgtagttgtaaacttgtaatggtgtttgtttgcctttccttgggaaactctgacatttctttgtggtttgttttgtgtcttggtcagaagttggtctgagccttcatcaacgttgttctttcgggaatg

SEQ ID NO: 1556 - DNA, 1218 bp, Unknown
  misc_feature (1)..( 1218): cDNA_ID_2138435_gDNA_ID_1620417_Annot_ID_156486 3000 nt of promoter + ATG
cctttaggctaggttttgcctacacacaagacaagttggtatttaggtccatttattctccttccaatgaactatttttgttttttttactccattactgttttcattattttattttaaattgcactaaagtgattttaagatgtcaggatacaattcagaatctctgaccactaagttagattaaggcgctcaagtattaaattttgtactatgtacatgtacactgttttaattgttttaaatgatagaatggtaatgttacaaaacaattttaaaagcaaaaaaaaaaaaaattgaaagaagaaaaatgcatagagcttgtaataaaaaaggtatttggtcatcatcgactcatttccaatattttattatcatgatattttcttttgagaatacaaaaatattggaaagagttcgtccaagagtaaaaatcacaccattttaaacaaaattgcaaattgcaaagtgttttataaaataaaataaaatatagtttaaaagttttctattgtttatttgaaaatttaggtaacaaataaatgatagggatattatgggtctccatgatcatgatagtagtaatagtctagccttaaatcaaaaattatatttaatctcaactatctaccaaaaaaaaaagatgcttaaaccaaaagaaagccaaatctcaaatattttgccccattatattattattaagattattattattatatgtgagactaactattgttctctgtctctttttttctttttaattatcaaagaaagaaactctttcttaatggaaaccatttacagataaaaaaaacattaaaaggaaaggtttttaataaagcctttgagagagaagatgtttattataggatgaacaaaaacatcctctgtttctctcttttcatatttttctccacatttcctcatctgggtcatctccaaaaatggtgcttttttttaataattcttcacgtttctgggtttttggttttgtgatttgatgatgctttttttttgtttttttcagatttgatgataacccaaattcgcaatttgattaggacaacaacaacaactttatttatctgattccgtctttgattttcagacaagaaaagtatgttgtttctaagtcttttgatttttttcaatttcatctccttactcgatttttttttttttgggtttctctgaattggagcagaaaaaaaaaagatg

SEQ ID NO: 1557 - DNA, 3000 bp, Unknown
  misc_feature (1)..( 3000): cDNA_ID_3063055_gDNA_ID_1620417_Annot_ID_156470 3000 nt of promoter + ATG
tgtctcgatgttgcaaatgggaatgcttctagcttctttcaccattattgcagccgttaaaaccatcgcaagagctgcaaattgcatcaggatattgttcctacacattctctcttttttaatcttctctctctctcaactctattgtaaaacccttaaatctaatgagcttattttttagcaacgttaatgctaagtggaaactattaaaagcgactcacgtgtctttttagtcaagtcgtcttttgagttgaaatgtacaaaaaaggggacaactatgggagatattttctcaccgatggcttttggtcgttgtattttgttttgtccttgtcaagtcactgtcttcttgtcatgtaaggacaagtctatggttttgtgatttgcttccgtattatgcaagtcaccaatttcaaaagagctaaagaaagcttgtgtagcactatccactgctagtgaattgtgttgcctatcttctattaccacaagttagcaatcagatttttaccaagaattatggtttataaccatgacacgtgaacagttctctgtttttcgcagtttcttagtatgattctcttcatggagaaaggcatgatggtgagttaggttttggatactcgaggacaaaaaaaactagtacttaacctttttgattaacgtatagcacacggttcttctacatacacaaggtgaatctaatcattaaaactttgttatttatttggaacagaacacttgaaaacattgtaaattcacttttaacgaaatataaaaacattgtaacttcagatgcaagacaagatcttgtcaagatccagcgatgtttgcagccccatagagagatttgtcctcagcttagttcttcaaactgcgcgaataaaaaacgttacactctgtcattaattactctcaagatcttactacaaattcaaaaatcacatgaaaataccttggcaagaacgagggactgttgtaacaccacatttagctacaagagccacgactttagatggatcaattcgtaaaattgggagataaaacttaaatctgcataagcattcgaaattagctttccgaaccactacgcagcaatcattgacgggaggtgggggattgtttccagtgatggctgggcgacatttctgcatatcatttatgtccatgtcacaaatggacatgcttgtagcttctttgaccatcatcgcaaaggttaaaaccattgcaaaagttgcaaattgcataaggaatttggtattgttcttacccattctctcttttctctagactctacttgtgaatccccctcatgatcatgagcttgtttataaacaagttaaaatgctaaccgaaagttagtagtaatttaagagcgtaacgtaaagataagtgtgggtgatgtgatcaggaggcttttgagttgagatgcgtgaagaaagggacaaatgtgagaaagacttagttgttttgcatgccatagtttctgggcggtgaatgacaaagatttttttggactctttgcgtgaccattgtggcgccgttggttttgtccttgttgatcatttagatggatcattagcactgacatgaatttgataattattggcttttaatatggtaattatcatcaagtttcaaaagttttattatcacttgttaaataaaagattggttttttaatgattttgtatttatgttgtttaaaataaatatattaatgttgttttgcacctctcaacaaattaatatcttttatttcaataaaatgttataaaaagatcaaaatactgtaacatcttgaaacgatgatttgaatattttatgatcttgctttaaaaaatatttagacggcaaaagttatggaaatcttaccatacagttgatttatagtagacattaatttttgtttgactaaaactattgtgttattgtgtaaagcttttttacattttctttcgaattgtacacagagagatttgcgttctaataaaaatattaaattcaatatcacctatagttattgtcacaatttaaatagtaggccgtcgtgcgtaccacacatggggtttaaaaacaaatcagcaaaatatttaaaacgtcggtggagaagatctttgtttcgttcataaaatctaaatttccaaaaaaataagtaaacaaaaaaattagggtattttgcaataaatatcacttgagaatatcaaatatcttccgaaaataactcagctatatatggttagtactgtcatttttaaatttatgtaacgaactaacgaagtaaatacatagaaaaacatttaagagtccaaaagcatacaaattttttgtgtagtcttcttctctatttagaaatgacacctacacaagtcgttaaaccgtgaggtccactgtttcttccacatgtcgtcatcagacagcgagtatataaaaccaaacaaaaccctactcgcgattctgattaagcattcaatttcacaaccagaaactcgttttctctctctctctttgtttgctctcgcacgaagcaaataacgatcctctcttttctctgccgtatcatcttcgttcacattgtggttcgattcttgcttcctagttttctggaagaaagaaacattatcatcgattaaaatatacacattgaacaactttggattattgattctaagcagagaagaatctcatttcgatacattggggtttgtgttttatttttattattctcctagatttctggattttgtgtaatcgaaagtcaccggcttttttcctaatctatctggaaaactgttaaaagtttgaatcttgctgtaatgttttttgattagttaagaacaacattgctattttaagtaatgaaatctttcgatcgataaaattggtttcttttcgttttatctcaaagttttgatttttctgattctttcttggcagggagaagttcctacattggtgtgagtttgaagattatcttccccgtggattgtaacgggggagatg

SEQ ID NO: 1558 - DNA, 3000 bp, Unknown
  misc_feature (1)..( 3000): cDNA_ID_3063040_gDNA_ID_1620417_Annot_ID_156477 3000 nt of promoter + ATG
aacaaaagatgttattagccccacctgcaagacattcacagttctaagattactcatgatatgcttcaaacagagtaaaaaactatgccaactcaatagcttacaccaattccgagaagtgtgcttgttgagaagaggtacaaaaagttcccaaatacttgcagcgccgtccaaccggttaggctttcaaattgaatcttttgcacggcgttgaacagtacaactgaggttgcatcattcaccactccttctccaaagactaagctgtatagcaatggtgtttcatcttgatggagaatctgtaaaagtttaagatgcaatgtaagaaaaaacttttaatagaagaagtagtaagacaaagaatcttctaaatcaagaacctgtagagtgcaaacagtatcagttgatgagaaaatcgttcctatggctgaatcaaaacaagaaagcattcactctcgcaaactgataagtaataaccatctcaacaagaaatgaaaagaaacatagatcagtgaaaaatcttaccaagatagtctctagcactcaaccccttaaatcccaacttgggaaacagccaccaagtccctggttcacattataaaaacaacaaaaatagagatggtaacaactccgagataatcaactttaaatcatatagtcaagtcattcaaagattaatgaaatattttttaccaaacgagataatgacagtggagatgaaaactccaatcacaccaaaggacatgatggttaaaaagttgtgaaaaaacttctttttcttaacttggaacctgccacaacaaaccaaaaaatcttcagtcaatcaccatcatagtgtaatctaacccattaaccacaacatagtaaccaaaaccatagtaagcttacccagcattgaagattattggaggaagaaggtaaatgaagaagagttcttcatcaaacaccaaaatatgtgaactttttcctttactaataagtaagatcactgttcctgatgctgctccctacttgcaacaaaaccaatcaaaaatagtgataaaattgttctttaagagcagaaaagctcaaaactttagctaaaacaaaaaaaagaagaaattttgaagaaaattactactaaaatggcggtaatagattcattaacccatcgattctcttcaagcaagtggccgataactaaacatagacagagaatggcgatgaacactgagattggtatcacctgaggatgctcagctgctagtttattcgtcacaaactctgttaatccgatactcatttttcactcgataatgttttcgatttcgtcgattttgaaaacaccaatcgcaaacgaagaaggcacacagagaacgatagagagagagacgaggaaagagtcagagagtgaggagagatttgaactgcgatgaacaaggcggtggttacaggtggcgaggagacgaaagacacgtggcatgtttccaacgtcatcagactgagtaaacgtgaggctttttggaattgtactgcatcttgggcctttttagggcccaaaactaactcatcatgtatttttttcttaccggatttggggatttttttcttttttcttttttgggtctaactaactcgcgtaaattgttgttctttttccttaatttatttttacctcttgttctttattctgtttatataaaattatgaaacttgaaaactcaatatttattacaacgaattatttggtgaagactcgaaccaatcgaaataaaacactctactgagtaacggtcccggttgcaacagccaagacgctagaacgtgatcgtttcgtttggtcgtgttttgatgacgtaaaaagtgactcagcgacctatttcaccacgtgtaatctttaacgaccatgttctaggacctacctgacttttaatcgatcatccaccaccgccttctcaacattttttaagatactagtatcattatagctataatataaattaagaaacttgtaaatattataattaacgtgaaaacatagaattcggatatataatgtgtatattagataaataataaatctgctcatatgtgatatgtatatgcatatatcatatatgtaaatgtagccattattggaatgcgtattgggtaatgggtagtatcactagaatgatacaatttttcttatatacagagaagagaagaggaaacaagaaaaacaaatacgttccccgcagtagactttttatttgttggtaccgtagaggaaaacagatatacaccaattactataggagtgattaagggagaaattgcagggatataattgatatctaatagccgtttctacactaatcctaattataacaagaccaatgattgacacatgtatattgcaattgcatgcattatatagtttattattatgcttgcttatagtttagctggttttggaaacaagtaggtagtaataaagaaaaacaaagagagagtaggtcgtaataaatgaagaacgcataactataaaaaataaatacacaaatatatgtaaaacaattgtttggtttctctaggttggagacaaccaatcaaaaaattatattctaatttaaaataaaacttatttagttatcccatgaaaattaaactcttgtattctcaaaaaaaaattgagtcaaaattacactcccaatattttctgtctgcaataaagatatggagacacattgaaaaacattttagtttatttatgaaaaaccaaaaaaataaaattttagttgatgttttctttttaaagtggaaaaatgtgtcaaaaacaaaaagtcgaagttcttttgttttcccttttaaaataatcaacgatcatataaattcgaatcccacaaaccaaaaagctctctctctctctctctctctctctctctctgagtaaatctcagtttttggtcgaagttggtgaagtcgccgccgggacaactcaggttgttacagatgataaacatgcgagataatccaaca

SEQ ID NO: 1559 - DNA, 3000 bp, Unknown
  misc_feature (1)..( 3000): cDNA_ID_2105044_gDNA_ID_1620417_Annot_ID_156480 3000 nt of promoter + ATG
atagggattttggaatatggtcacttaccaatgtaaagccttggccttatgatataagtttgttttgtgcttgtaaacatgtagatgacaaagattgacaagaagtagatgacaaaggcttttatcactcgcgactcgagaagcatcgcattgtgcaaagcaaacagcttatccaaagctacaaacatgtttgcttgtttagcctcaaacgctacctgcaaaaacagattgttatatattgattttatgtgacatttgcttgtacagcttttgaatatttgttaagatttgggaggactgacctgggcttccaacattgattttgaattttcaaacaagtgatcatgaacctcctgaagcttttcttgccgctttgcaagatcttcttgttgctcctgactaaattctttcaaacgttgcaatgtattcctacaaagttgcagggaaaacagaacacaattagctcttggagaaaagtgtcttgcctttgaatttaaactgataaaatgtgtatttgaaacttacctactctcttgcagtgcctcagactgaaaccgggtaagaaactgaataccgtcaagagccacggtttggccgtctaaaagcttctgttgtttatccaacgaactacgagtctttgttccgatgtcatcggttgtactctgcaaatctatcattttggttgataggttatttccaagtacacttatttccacctcaatctgctctgtatcactcttcaacttatctactccttcttggatgttagtatacgcatcgaggaacatgtccattccatctttcaacgtttctttcatctttacttgaccgtccctgagagctagctgtgattctgcaatgttcttctgttcttgagagatttctactgtttgttgagataatccactcacactagtttctaaggtgtttgtcacactagccacgttttgaacccgaacatctagtgaccctaaagaatcatgaatcatgcttgaggtctgtattaaagcatcagatttactctccaagatatccaatttatcttctgtatactgagctgtattcttgagctcattcacaagcctctctatctcatttttgaacgcattactcctgccataccaaaaagaagcaaattgagaatccattttggcaaacaaaagtaataacagctagaaaaatattcatggtaaattgtttttcttactgtaattgttggcagatggtgttggtttcaagcaagaaatcgagatagatcttatgctcatgatcatcaagcttcttgaggcaactcatcattactgattcatctttacaggttggaaacgccggtcttcccgagtctttgatgaagcaatcgctcaaataccaagcaaatctctttctcttttcttctgtagcaatcgtttctttgcagccagccaagaggtaactataagcattttgccagcaactggttagaccaacaagcttgttttcaaggacttgaaccgccttctgatcactgaaaacttccatggagaagtcggggttggatttgcgagaccgagaaaaagaagaagagtatggatcttctgctgaggaagaagaagaagagaaccatccccaactgtggcatgttaatggagaatctaaaagtatgatcaatagaagaaacagaagacattttctgctgaaacgatccatttaatcggatttgagatcttcttcttctcgaggagccttgtgattgatcacctacgaacaaacaaaagagacagaacattacattctgagaatgttgttgtttatataacagaaaacttggagcgcaagaaaaggaagccccttgaacttccaattagataaatggaagttttttctttttttggtatcatcgtcataaataaagttcataaagtttataaaaaaaaagattattggcaaatcaagttgcagatttaaaaagaagaaaataaatctcattaaaatcttcagaaaacaatctttctaaaataaggaagaatctgtatccactttgtttttcgttttctgagattaatacatgcatttgaagtcgtatcaataaagataaaccaaaaaccattattactaagaaacaatatcgaaaaatagtctgaaaaaatcacagaaaaaagtacaatccaaattttatcgtaaaagagaacaagaaaattacacgacaaggttaacttcaagatcgatattgggagaaaaacatataagaacaaaaaaaaaactaaaaatagttatatgacttcgaatcagagaagaatctctacgtttttgtcagtcaatttcataacagagaggcaaaacaaactaaagtaccaaaaataaacacgaaaaacaatttcaattctaaagaataattttctcaaaaaaatatttgcatgaatgaatgatgaatctaaacaaaacacttactttaacataagtttcaaaccaataaattaaagaatgagaatacagtgatacaaaaaaaaaacacaaagcttaccagaaaacagaagaattggagattgtttttgagtcggtgattatgaggaaagtgagaaatgcaaattataaagtaacgaacgtgtttgacaaaaagatggaaacgtttcgggaacgtttggtttacttcccggtttaatttgattttggttatgtgattaatttattttcggttcggtttaattgtatttggttcattggtataagaattttttagtcaaaagcaaaatgccaaacaatacacagagaggaatgatggaatcttcagctttaataaatctgcagactctcaaaattccgattcatcttattgaagaacaattttccggcgaaacagccgatgaagtctcgcctgaatcttctgtacctttcaccggcgattgacttcacttcagaatcgagagagaagaaatcgatggaaaactaaaaatagaaagagtttcaaattctcgctctctcttcaaaaccgcaaatcaagggaacgagagacgagagagagag

SEQ ID NO: 1560 - DNA, 3000 bp, Unknown
  misc_feature (1)..( 3000): cDNA_ID_2138431_gDNA_ID_1620417_Annot_ID_156485 3000 nt of promoter + ATG
atcgtgccacaggtcgtgcacgtggcttcggcttcattgtctttgcagacccctgtgtctcagagagagtgatcatggataaacacatcatcgatggccgcacggtttgtgatttcaatcatttctcaatctttcagcagaacaaacaaagttcagatcttattgcaacttcctcaatttgcgtttttgaatcatctctcaatctttgtttctcaaagtgtaaagatcaaatttatgttttgcaggttgaggcgaagaaggctgtgcctcgagatgatcagcaggtgctaaagcgacacgctagtcctatccaccttatgtcacctgtccatggtggtggtggaaggacaaagaagatcttcgttggaggtttaccgtctagcattaccgaggaggagttcaagaactactttgatcagtttggtactattgctgatgttgttgtaatgtatgatcataacacgcagaggccaagaggttttggcttcatcacatttgattcagatgatgctgttgatagagttcttcacaagaccttccatgagctcaatgggaaactagttgaggtcaaaagagctgtacctaaggagatttcccctgtttctaatatccgaagcccgcttgctagcggtgttaactatggaggcgggtctaataggatgcctgctaatagctactttaacaactttgctcctggtcctggtttttataacagtctaggtcctgttggtcgtcggtttagtcctgttattggtagtggtagaaatgcggtttctgcttttggcctcggtttgaatcatgacttgagtttgaatttgaatccaagctgcgatgggacaagttctacgtttggttataaccgtattccaagcaacccttacttcaacggtgcttccccgaaccgttacacctctccaatcgggcacaatagaactgagtctccttacaattcgaacaatagagacttatggggaaacagaaccgacactgcaggtcccggttggaacttgaatgtctcgaatggaaacaacagaggaaattggggacttccttcttcttctgctgttagtaatgataacaatggctttggaaggaactatgggacaagttctggactttcctcgtccccatttaatggttttgaaggttctataggggaactgtacagaggcggctcagtctacagcgactcaacgtggcagcaacagcagctaccatctcagtcttctcacgagctagacaatttgtctcgcgcttacggttatgatattgacaatgtaggttcagacccatctgcaaatgacccagaaacttacaatggaagctacaatgttggaaatagacaaactaatagaggtaacaaaaaaattcatctcaataaaacttgtaacttggatacattttgatcgcaatcgaaatgttctgatctgtgttttatttacttgttgaggtattgctgcataggttatcaaaaaccaagaaaacaaaaaaaaaagttgagagatttgtagattgaaagcaaccaaatttcagttgcagagtttgaacaggttctcatgacaaagaaaccaactttgttgatcacagtgccaaagattatggtttgctttctcttttgttagaccaaaaaaaaaaaaaaaaaagagaaaaacaaagaaccgtttttgtttttcttcttcttacataaagatcagatcgtagcagccagacaaccaaagatactacaaggtggatttagatttgcttctcaaaaaagtttttttttttctttcatagaataaccaaacaaagatcgtagaattttcgatcaaagattcttcagagttctgtgctctgttttgtaattgtactttttttttcttgtttacaaaatgaattgttcatgaaaactttgttttcttaaaaaaaaaattagcgtgggagaaatattgtgtaagagagggatatgactattttgttgcatgtatccctaatgagatatatatatatatatatttttttaaagctatttttgtttttataatttgtgcctttgtggaagaaaagtttgtgaaaactcttatttatatttatatctttcaaaaaaatgaaaaaaattcatatctttcatgtagttaaacattaatattacacactcgtatttggaaataaactaaaagtaactaggtcgtagtcatatgaccaaactatattttgagaaaatttaccaccattttttctttcttttttggtaaacaacttttattttttttggataaaatgtacatttttgattaatctagaattagtaaacaacgaaatcaatattatgagtttatgacagacatgccgtagaacatttaggtcccattaacaagagtcggtccaagacttttgccgttttgcgacttttaggcctccttcttgtaaaagctttatacgtgaaagtttatttttaccccagtaaagtaatttttattccacattgcagaattttacgagaaattttactaacaaatttacgataattttaattttcttcatggtcaataatttttatttgttgatgataaagcacttgtggatttgtttcttatatacacacactatctataccaaattataatgtccagaaatatagaattttatttctttataattatgacaaaacaacttacatatttatatctctagctatttttgacaaaaaaatatctctagctattttaaaactttttatttaagtttcatcataatgtaattgatatgtaattaattatcaaaacattacaaaaagaactacttgtcaaattcttataatacaatgtattaatatttattgataaaacaataatttagtcaatattacagtggctcaacaagtaaaaaataaaagtcactcaacatttatccaactcatcaatatccagattgtgtattaaattttcaaaataaaataaaacacaccaataaagaaacaaaaatcctcaactttacctttcttctctctgtctaaagatg

SEQ ID NO: 1561 - DNA, 3000 bp, Unknown
  misc_feature (1)..( 3000): cDNA_ID_3063028_gDNA_ID_1620417_Annot_ID_156482 3000 nt of promoter + ATG
ttctccctaaagaatctactcaggtggattcatataacttaagatctttctataattagggttttgatacattttgattttacataatttgttgtctttagttcctttggatttgaagttattgtttccgtctctgagttttaaattgaattacaacagtttgaagcgaagagtgtactcgtcacaagagctaactcaatggctaatgagattacagaggaagatgattcattgggtcaccagattcgtgacctaaaggtttgaattttttgtcacttattggttgcgtatttgtgtttgtgtgtaatgttgggtttatggtttataggaggaactaataagaaccaagtctgatgggtacaaacctgatggaagcaagaatggttactttgtgagggagagtttgagtcaattgagaaacagcatcaacaagtctttagtcatgtcgtgtgaaaacagacaaggttcagaaaaggaaacaatgtatgaggaggagtatgatgatgatgtagtggaactgagtaaacacattaacaagtttcacactaactgtgattctgatgatttgagggattctattcaatcctcctttgcaagtgcttcaggctgtgaagcagattcaatgagtggagacgagatttgctctgttgataaacacaaggatcacaaagattgtgccttggctgattctggtccaagcgcagtgggaaatgggatttctatcagtttaccacatcaatcacgtattcttgaagagcctcctttgtcagaatctccaaagattaggaattttaggaagagcgtggctgcgtcgacaaagtttcaggcaagtcctaggaatgtaaccgagagctcctccactggaaacagaaagcctttaagtcctacagattctctagctgcaagtctccagagaggactaaatattatagactgtcaccaacggagctcactgtcaaacagatcttctgtttccttctcgtttgggcatctctctctgaagccttgcgatgaagccgatgataatcttagtgcttcggttaaattgttacagaaagatagaccaaaagaaggtggatcatcgattctcctctgtctttcttgcagacagaaacttgaccaagaagctcaagtatgtctagaaaccctgagatgcatttccttttgttcattttcagtttctttagtagaaggctattcgttttgactattgtatcttttatcatcagggaggatataaggcaatagaagaagcttgcgtggacgagaagcatctcaagaacatgtgtgtcgagcaggctaccaaaattgagcagcttacttatcaggtaaataacttatggtgagactagtgagtgttatatgttgaacttgagtttgctgacactttgtttttataattcttcagttagacgaatacaaaaagaacgctttgcaggagtcaagtaaggtaacccaacaggttatatttcaaagaaaacaagcacattagtaaattgtttgcaagacatggataatcaactttagctatgcttatctgtttgtgcagctaatgaagtctgatgatggagaagatgagacagaggtcgtgaaggaaacatatgaaacaaaccaacgtagtgaagagtttgggaaagtaaggattgatctcagtgaaaaggaagctcttctaaaggagattgcagagctcaaaagcaagcttcagcctacaaaatcaacggataatgttagatcttcgttgctgttacggtctttccaaatgaggaagagcattgattttaccaagaacactgagaacaacagcgaggcgctagaagaagaacgtgagaggtggacagaaatggagagtgaatggatatctttaacagatgatctaaggatggatattgatagccatcgtagacacgcagaggatctagagatagagctcaagaaggagaaaatggctacagaggagttaaatgatgctctaagtagagctatgcttggtcacagtagattcatcgagcagtacacagaactgcaggagaagtacgatgaattagatgagaggcatagcgtgactatggcaggaatagttgatgtgaagaaagcagcggctaaagctgctttgaaaggtcgccacgggaagcgttttgcaaaagctttctcagctgaacttactgctattagagctgagaaggagaaagaaagagaattcttgaaaaaggagaacaagggccttaaaattcagctgcgagatactgttgaagctgttcaagctgctggagaattacttgtcagactccgtgaagctgagcaagcagttcaatcctctgaggtaacttttactttcaccaactaaaaaaaaacctttggacacttagattctgcattatagattctacatgctgattcctaaaaccataattgcaggaacgtttcggcataatggaagaagagaatgacaagttgaaacagcaaatggagaagttaaagagtaagcacaaaacagaaatgagcacaatgaagcaatatctagcagaaagcaaattaccagggtctgcattagaggcatggttcaaggagaatgagcaagaagaggaagaagagcatgtatcatcatcagaacacagaaccggtgttgtgagctatgacaactatacagacgatcaagcatggagatctgagtttggagccatatatcaagaccatgaccatcactactgattcatgttacaaatttatcatttcatttcaagaacaaaaaaacttcttgggcaatttctgcaatttcttgcccatcttgggcaggcctgttcttacattttattaaaaaatctatatatataagtttctgcaatttcttcataacatataggcccaagtgaggccgaattgaggcccataatgaatatagtgtttggctacaggtaaaaaagcaaactctgtttctaatttttgaagattaggtagaaaacgaaagtgtgtcttcaagcttcaaagaggtcttaagctatg

SEQ ID NO: 1562 - DNA, 3000 bp, Unknown
  misc_feature (1)..( 3000): cDNA_ID_2138384_gDNA_ID_1620417_Annot_ID_156468 3000 nt of promoter + ATG
aacagatcactcattagttatgaaaatgtttggtattttttcttaatgttgatggttgagattgttgactatgcaggacgcacaggcctatgcttacctgcttaatgttctcgcaccagagcattgtgatccagcaactctaaatgcagaggatgatcttgaaagggctaacatggtcctcgaacacgcagagagaatgaactgcaaacggtatttgactgcagaggagatagttgaggggtcttcgtatttgaatctagcatttgtggcacagatatttcatgaaaggtcggtaaaagatcactaaagatagaatattttcttatgtactggtttcttacacactagcttctctgtacctgctgcaggaatggccttagcactgatggtagattctcctttgcggagatgatgactgaggatttacagacttgcagagacgaaagatgttaccggctatggattaacagcctcgggattgagagttacgtcaataatgtgtttgaagatgttagaaacgggtaagcatttggtatgcaaaataatttataatcttttggtcctgaaacgtattataagtttttcaatactgaatatttctgatgcagatggattcttctggaagttgttgataaggtctatccaggctcagttaactggaagcaggcttcaaaaccaccaattaagatgccgtttagaaaagtagagaattgcaatcaagtcgtgaagattgggaaagagatgagattctcgctcgtaaatgtagctggaaatgacattgttcaaggaaataaaaagcttatcctcggtaattactcttcttagctagctaaaaaatgtttattttgttaagatgctcaacagtcttagaaattgtataacactaaaggtgtgtatacatgtctcaggcttcttatggcagttgatgagaacacatatgctccaacttctcaagagtctaagatctcggacacgaggaaaagacatgaccgactcagaaatcataagctgggctaacaggaaagtcagaatcatggggcggaaatcgcagatcgaaagcttcaaggttccatcttttacttttatcaaaactcaaaaaaaaaaagttcaactgaacaagcttatgttgaacaaaatctgtcttgctaaacttcaataggataaaagtctatcgagcggattattcttcctcgatcttctatgggcggttgagccaagagttgttaactggaatcttgtcaccaagggtgaatcaggtccttactctctctaactacactcacaacctcttcactctctttctcttctctgttcaaactgaatttgtttaatcgttattttttcgctatggaaactttgtaacagacgatgagaagagattgaatgctacatacattgtcagcgtagcaagaaagcttggttgctcggttttcttgttgccagaagatatcgtggaggtaaagaacggaatcaaatcttccgaaacaagaaaacaacatacatcaaaatgtaaatctgatgtttttaaatgtcttttgttgcaggtgaatcaaaagatgatactaatcctaacggcaagtataatgtattggagccttcaacaacaatcatcatcgtcagagagttcaagttcgagttcagactcatcatcaactcatagcacgacgacgacatgcactagcacatgcacgagcactgatgcttcaccagctccatctgtcacgggtgaagacgaagtctcttctttaaatggcgaagtctcaagcctaacgatagaagaagacaatgaagtctcgagcctaacgatagaagaagacaatgacgcagacattttgtcagatatcacctccatctcagaggaagcagctaacgaatagagcaacaagactgaactatctttgccggaacagagttgctttgtaatattttttcacatcacctctgtttgtgttactactactaaataaaaactatatttgttaccacaataacaataaagataaaaagataaaaatattttatggagtaaacattaaaatgtcattgttttttatcttcataaaataatgtcatttaaaattataactgtgctgaaaaggaatgatttgcattcgttttgtcggctaaaacacaaaaaagagatatttaagaatacctcaaatgatttatatttatcgacttattgtttttgttgtttggtgttgcttgctcttctctctctctctctgctgatgcctggctcgagcgtcgaaccagtcacacgttgcactttgcagtgccatcgcagaccaaacgtgctacaagagccaggcgcatgctttcttgcatgacttgttatttaaacgtacctgcttcgaataatagttatccaataaaaaccctaaatagagaaatctatacgaaatattaattaaggagagggatataatattctcggtcttattcgtattttatgctgaagatttgtagaacgaaatttaagggaactaaaaaaaacgaattatgttaagaatttgtcatatttaaaaaaaaaacaaaaacacaatctcagcggcgttgcttgcacacgtgcgcgagtatataaacttggaaaaaaataatgacgacgacgattcttactctttttttttcctcaattcttactctcttttgattcaattgcgtcatagtataatctccatcaacacacagagacgataattctcataggtttttatcacttctcttcttctacttcgtaatcaattcattcgcttacttcttcaattccgttttctcaatttctcaatttttggatgtaccaatctttgaaggactttaaatgtccaggctattcgtcttcttcattgtccaattcatgttcattgtgtctcctaaaacgaaaccctaattcgagttttgaatttctatttcttttagggtttaggagaaagttgtgtcccgtttgatcgtttgtgttttgaaacgtctctagggttaagggaattttgggattgaatg

SEQ ID NO: 1563 - DNA, 3000 bp, Unknown
  misc_feature (1)..( 3000): cDNA_ID_2138361_gDNA_ID_1620417_Annot_ID_156458 3000 nt of promoter + ATG
taaattggtttggactttttgttttgtattttgtaagcataaaaaagctggagatatagtgggatttaaattatattaaacgcatatgtcaccaatcttgatcataaaatgtatagatggaaatttttttaaatatttatcttttatttccaatttccccttaataaaatttacatgtttatttatcaaagttgttttgttttcgctaaactatcttacaaataaattaataggtgttgaagacaaaacttcatttttcatctatcctaaaaataaagaaacctgaaaaatatggcaaatttactaaaaatattccggtagagtagtagtctttttgaataatagtatttttcgaaaattggtacatctaagattcaaaaggggtatttcatgaaaattcctcatatatttgtctatactaaaaatataactttataataatttgatgaaataaatcggtgattaatatttttggacagttaggtatactggtctagtgttaaacttgacttgaagttgaaccatgtgaattctcccatacggagaactaccaccttacaccgatagtctcaactaaacatgaaccataaactctttgacaatttctcactttctttttatttttcttctttactttgaatattaattagttggctgttggcacgcttttggttactcatctaattcacactatatcaaatcacattacagagaggcgtttgaagagttctgatttttatttttttttatttttgtgtaaacagagaaaggagtcaaggactgattctaatactgatataacggaagtagtgggtaagttgtagttgtagcaaaaaccaatgttacttgcttaaactcagcaacccattaacaaaaaaaaactgagagatggaggaagaaatcaagagcttgatcaatgtagggtttttaacaattatctcagtatcttactgctactgcttaccaccaagaatcaaatctggtgttcttcgattactctctatttttccggtctgtgttttgttagttgttcttcctctgttcttctccttttcaattttcacttccaccacagcgtttttcttatcagctattgccaattcaagactcatcctcttttcctttgatcaaggtcctctttttccactaccttcaaatctattcagatttacctgctttacttgcttcccaatccagcgtcaacaaaaccctaaatctcaagatcatttgtccacgtatgtttttcccgttaaaattgcaatctttgttgtgttgttatatgtgcataacgacatacaaaaccttcctcgtacttttctattgtgtctccatccactgtatgtatatttgttacttgagattctcttaacgctccttagaattctaatgactatcattcttggttgtgacctagagccacattttcacgaaccatacttagccacatctcttcaagacttttggggtcgcaggtggaacctcatagtctcggcaagtcttcgggcaatcgtctacactcctgtgcggcgtgtctgccaacgagtaatgagctctgattatgcaatgttgattggtgtttttgcgacgtttgtaacctctggtgtggctcatgaagtggttttcttttatataacccgtgcgatgcctacaggggaagtcgctttattctttctcttacatggagtttgcacggtggcggaagtggcagcgaagaggacggcgtttgtacggaggtggccggtgagaccagtcgtatcttggatgttcacgatagcgtttgtaaatgtgaccgctggttggctgttttttcctcagttgattcggaacaacctgggggagagatgctccaatgaaatctccttgctcattgatttcttcagaagcaagttattttattttccccagtgaattacatttctaaatggattccgtagggttattgttaacaatcacattatttaatgatatacttacaaaaaatgcagctatcacattatataagaacttagaagttaacttaaaaattaagttgctatgtatctcattctgtaagttaatattacaaaatctcaaatttgcattacaagactaaacttaactatgacctcaccacacgcaacacccaagttataacctagatcagtgattgaaaaacgccaaaaattcataacaaaaagaaagtctgagacatggaggaagaacaactcaagagattgatcaaaatatggattctagttgtaatctcagtatcttattacttacttatcaaccagaattaaagctggtattatcaaaatagtccggattctattttccaaaagtccatggatctccaaaaatgggccttcatattaacaaagcccaagtagaggttgccgaagaaaacaatcccattccctaaacgacgtcatataagcgataaagtcaaaaggggtcaagactcgctgacccatggagagtctttcgttaacttagcctctacaacacaaaaaacggacagaaatcaaaggcaggtaagaaatccgtgaggcgtgtcctgagattcatatctgcttcatcgccgatttcgtcgtggcctcaggtagttgcatcaatttgataattcttccagatttcgtttgaatttgaactcaatttcacaaattcatttttgatttcaaaattagggtttctctttcccatttgggaattcgagttttcaattgtacaattgagagctttgttcgtattcatttcattgacatatcagatttatgaattttgactcaatcgatttttaatgtatatgttattgggattataattgagttgttgaagttcccttcagaccaattgaaatgtcttgatgcatatctgtgtttggtttgcaaatttaatgttaaagtatgtatatttattaattttagttttgttgcaattctagataattaagtatctttccttttttgatttttgttgatcaacagttttgcttgtgaataacttgccttgttgggtatg

SEQ ID NO: 1564 - DNA, 3000 bp, Unknown
  misc_feature (1)..( 3000): cDNA_ID_3063131_gDNA_ID_1620418_Annot_ID_156495 3000 nt of promoter + ATG
aatcacaatatttcttaaacttatattactaacgtaatacattttgtggatttgtaataggcgtcaaagtatctggagaatgataatttgagagatatgattgatcctacactaacaacgtataaagaagaagaacttgaagctatatgtgacgtggcacgacattgtctgaaacttgacgaaagccaaagaccaaaaatgaaatatgtggttcaacaattgaaagaagtaataaacatatctcaagaacaagcaacaccaagactctctcctctttggtgggcagagcttgagatcttatcctctgaagctacataaccatgaacaagaacgattctctctcctcctctctctttctcttcgagtcgtcacaggttcacacactcttgctctctctgtttactgtaaacgtcgtcgttcataaatgttcaaaagttgtttttttcttcttaattctttctattaaatttgttttggttttgatagtgtatttggaatccagatgatataacgatgtgtttgtataattgttgtatactatatatcatacatatacctattacgtataattgtacgtattttgtgatgaaaagttgtttatatattgacttcggcttctttttaacccattttatgatattttttaatttgtattttttgtttagtcatgtcttttttttcttgtgtagcaaatgatcttttgttagtacaaaagtaagactaatttattcaattaacaacaatggaattaggtaggctacatttacatgttttagaccaaattgtttgtgcatgcttcagcttaaattaaacctatttttaagtaggagaagtcgaactcatttagatgagaagaacctatactagtagatcaccaccactactataccaaaaacgtttctctcaaaaacatatattcttgtctacatttttaacccaagtaagaggaggtagataagattgaattaaacccattagatatatgaccggataggtggccaaaggtctaaaaacctaaccgcaagatttaaacactagttgttgttacttttgcattgacaattgataatgcaaattacccgttaatgttttttcttttatgaatcaatgtaaaatttattcgaaaaactctttgattacaatatatgcagctttaagcagaatgttttttctgaaaaaaagtattcccattaagtgatcttgtgttatcataaaaaataaataaaagataaggtcatatgtcatcataacctgagcctaaaggtaacgactaacgacaaccgtgacatactttttcattaagcacgttacacgacgagactagcgtagtacgtgtcgaactatcctcatacgtgtttgattcactgctataaatagaaccaataataacgatgttaatatttggttcttaatcaagatattgtggaccgcttgtccataattccctcggaaaaccaaaacaggtattatattcaagattcgacctcgtgattttgaggtgcattattttttgtagaagatttccatcttctttttttcacggctctcaaaggtttccttgtacacaagttacactacactgaataattttctttattgcatcctttaaacaaacttttgtatattattttgatattgaaatccaccatatatatgtctttttttctctgtcgcttcctatttgatgcatgtgaataattttcactactatataaccagttttctaatcattttctccgtagtaaaagacaaaagtaaattaacgaagctcgttataataatttagtacttaccaaaaaacgtccaaaagttggagataactcgtttccaagatattctacacctcttcttaagtctctgatccccaaagaataataattatttatacgaaaatatatataaatataacatactgtacaatccgctgtctcaggacatccaaaaaaatcatttatatcagtaacaaaaaaaacatatcgtgaatattaaaaaatcatcaaataagtgataccaatgaattagttgttaaccacagtgatttaaaagactgatattttaattgatgaatcctaggaatgaaaagttgataattgtatgatctaatctccaatttctttcctctttaaagaggtaaaattgccacatggaacatttaacaccattctgaatttctgattccaggaacgttgtcgtatcatatctactcgtgtaagtcttagatcgatttagaacttagaagaacaacacttcttgttttatcctaattaatactataatatatgcatgtaaaatcttgttttttctatatcgggtcaatgtgaattgatatattagtttgtgagtgtgtcggcttccgtaacttacaggaagggtttttacttttctttttcagataattaatgaagaagaagaaaatacaaccaaatttacacaaaaataatggcaaattaaactattttggaacaacaactcgcactctctattagtcctccacgtaatgcatgcatgcgttatttcttttatttcctcggaaagcacgtactaatcttccaactttcaatactaatactcgttttaatatgtgtccaagtaaacattttctgtccaagttcattttcaacttttgagttgtcaatgtttctatttttcctctttatttttgacatttgtcattgtttccctatattaaatttaaacgataataatttggttcggttaatataacgctactaaatatatatttagaagaaaatttaattgtttaatcataattcagtttattcgacatttttatccataagtattataatgtatagtattatttttagagataatcattaatcagagaataaaatataattctggtccatttaacttttaactatatataaacccaatgaaatgaaaacaaaaacacacaaaacacaaacacgcaaaccaaaagagatcaaaccaataatcaaaatactcctcattatatcagaaaaaaaaaaaaaaatg

SEQ ID NO: 1565 - DNA, 3000 bp, Unknown
  misc_feature (1)..( 3000): cDNA_ID_3063117_gDNA_ID_1620418_Annot_ID_156507 3000 nt of promoter + ATG
aatttcgtacgtatccctcttgtcgtctaatgattatttcaatatttcttatattatccctaactacagagctacatttatattgtattctaatgacagggaaactttcatagagattcagatagatgaaattggtgggaaacatcattgaacaggaaacttttagcaaatcatatcgatttatctacaaaagaatacttagcgtaatgaagttcacttgttgtgaatgactatgatttgatcaaattagttaattttgtcgaatcatttttctttttgatttgattaagcttttaacttgcacgaatggttctcttgtgaataaacagaatctttgaattcaaactatttgattagtgaaaagacaaaagaagattccttgtttttatgtgattagtgattttgatgcatgaaaggtacctacgtactacaagaaaaataaacatgtacgtaactacgtatcagcatgtaaaagtatttttttccaaataatttatactcatgatagattttttttttttgaaatgtcaattaaaaatgctttcttaaatattaattttaattaattaaataaggaaatatatttatgcaaaacatcatcaacacatatccaacttcgaaaatctctatagtacacaagtagagaaattaaattttactagatacaaacttcctaatcatcaaatataaatgtttacaaaactaattaaacccaccactaaaattaactaaaaatccgagcaaagtgagtgaacaagacttgatttcaggttgatgtaggactaaaatggctacgtatcaaacatcaacgatcatttagttatgtatgaatgaatgtagtcattacttgtaaaacaaaaatgctttgatttggatcaatcacttcatgtgaacattagcaattacatcaaccttattttcactataaaaccccatctcagtacccttctgaagtaatcaaattaagagcaaaagtcatttaactttcctaaaacaatggctttaaaacatatgcaaatctttctcttcgtcgctatattttcatcattctgtttctccatcactctttctcgtccactcgacaatgaactcatcatgcaaaagaggcacatcgagtggatgactaaacacggccgtgtctacgcggatgtgaaggaggaaaacaatcgctacgttgtgttcaaaaacaacgtcgaacgcattgaacatttaaatagcattcctgccggaagaactttcaaacttgcggtaaatcagtttgctgatttaaccaatgacgaatttcgttccatgtacactggtttcaaaggtgtctcggcattatctagccaaagccaaactaaaatgtcgccgtttaggtaccaaaacgtttcttctggtgctttgccggtttctgttgactggaggaagaaaggagctgtgacccctatcaagaatcaaggcagctgcggtataactcaaatctttattcatatatatataagtgaaatcaaattgaaccaaccgaaatttatgtattcaatcaatttgagttaattcatagtgaacaaaccgatccaaaccaaatccatagtgtaactgaccgaatcgaataaccatatttttattaaatttttctatgttaagttatatatattttgtttcataccgttttattgagatatgtagttagacacatgaaaatatttatgatagtgacactaatgagtgatgtttttgtaggatgttgttgggcgttttcagcggttgcggctattgaaggagcaacacaaataaagaaagggaaacttatatctttgtcagaacaacagcttgttgattgcgacacaaacgattttggctgcgaaggcggtttaatggatactgcgtttgagcatataaaagcgactggcggcttgacaactgagtcaaattatccttacaaaggcgaagacgctacttgcaattccaaaaagaccaatccaaaagcaacttctattacaggttcactttagttaaagagctggcatataataattaaacagattaaaccgatttttaatcatattatccaaattaataaacattactatactagataaaattcatattttgaatcttaaaaagctcatgtacgttcacatatcataggttatgaggatgtcccggttaatgatgagcaagcactgatgaaggcagtggcacaccaaccggttagcgttggaattgaaggaggtggttttgatttccaattctattcgtctggtgtgttcactggagagtgcactacgtatcttgatcatgcagtaactgcgattggatacggcgaatctactaacggatcaaagtattggatcatcaagaattcatggggaacaaaatggggagaaagtggatatatgaggattcaaaaagatgtcaaggataaacaaggactatgtggtcttgccatgaaagcttcttacccaactatatgaattcaaaaccgtgttaagcttttaattgtgtatgtttgtgtgggattgatgtctaaaaataatttgaattgttttatgtaaaaaaattgtatttagactgttgtatgcattttatgaaattgtaagcttatgtaatgcaaaggattgataattttcgaaatgtttctttcaaatttcaacggtattagctagggataatttgaagcatatgcacaatcaaattccaccaagtaaaaatgaaaatttgttaaaaaaatgaagtttgaaaactcttaaccatttactgagaagactgtaataaaccgaatttggttcagtttgatttttatggaaaaagacgaaccgtccggttaatgctttttacttttttaaaataaaccggttttggtttgcttggatataaagccgacccgacccggattgaccatgttccttgcacgactcctttttctcaccgttctccgtcatcgtcttcttctttctcacattcattgactctcctccataataaacattgcaatctctcagaaagataagatcagcc

SEQ ID NO: 1566 - DNA, 3000 bp, Unknown
  misc_feature (1)..( 3000): cDNA_ID_2046448_gDNA_ID_1620418_Annot_ID_156512 3000 nt of promoter + ATG
ccctaaatttcctttatttttttagttttgtattcttttctccattctccatcatcaaatccatttcattatctgcaacctccatcaatgaacgactgtgaccaacaaaaaaagtaacatcatcgatttctccttttcgagacgaagaagaaggagatccttactctctgctaccgaactccctcttcccttaatcttcctctttttctggttccatgctcttctctcttgtcttacttacggtttctggtttcgttgtttttttttggtaaaaggtttctttggttttgaatcataaaggccaatggtacatgtgattcgttgattctagcttaggctttaaattgtaaatctttaaacttttttttttgttatgggttctagattttatgattttatccttcaatttaaatttatttttgttagatctgttgaatttattgccttgtttttgaattgaaaaatgtttggatgtcatttgcgtagacgaaaagtgattggacgcataaggctgggtatgtggtggttatgcaagaagattggttgatgtttatgagctttttttgaaactttggtccatgaggctgcggtggccgccgtgagctccagtgtcttgtctggcaactccatacttatgtcgactcatggatgtcaagaaaagtttacgagaaaacacgaaatgtatatccatttgttcggcgctaggtggatacaccttcatttgttgcactatatccatttggtcgatgtttcatggatacaactctacttctaaaaatcatagatgaacacgtacttgccgattgtcagctataggaatccgtccattactcttcgaagatatgttatccaactaatgaaatattcttttatttgattttggtgaacaatgtttacatttggtgaacaatgtttagatttggtgttattcatctttcgtatatttgtttgtgcagataaaacattttaatgtaaaaactgtaaaatataggatcattcctatggtaatattcgtatgattatattcaaaaatggttcatacgagtgtgtaaaccctctacccttaacgctttacactaaatcctaatttacttaccctaaaattaaacccaaaccctcccatgatccttctccactaaatctaaaaccataaaacaaaactctgaaccatacaaaaaatgataattttaccaaccaataaaacacatttgaagcaaatcaaagacatagttgtccattgatgactatccaagcggtttagtccatgtggtaatctagtgactcatgaggtcgtttcatttcaatacacaagtttatacatgaatgataatcaccaattcaaacacccattcaaagtacatcgtctatttttctttaaccatttattcacttgtgtatggaaactcccaacattataaccaaaattgtctactaatcctagatataacaagaaacagatttacttatatagtgtataaaaggagcataatatcgatgtttgcgtctgaatggacagattcccttggatgacattaacaagcaggcgtccagctgaccatatatgtttgtactatcatctatggtcaccaatcatttgaatcaagttgaattcatggatgcacagtacgtcagtttgtgatgtaaattaatgtaatgcaaataatcatctgcaaaattgaatcaaagagaatataagatcaacacaaaagcaagtgtttggggaatcggatgcatcataacaagcgaatatctactcaaacaagtttaaactcaattcaccataacattcacacccaataaaaaaaaactcaatatgaataaatcagtgtggaaagaacctgatacaaagctgctccatcaatggaaaatcttcaaacactccacaagaagcaaaagcatccactaatcaagttttttttatctctctctctcaagctaaaatcttaaaccaccaatatagaataaatgagaaatcgtttactctaaggaaataaaaactaattgaaaattgagaaaagtgctatataagagaacacaactttgattaaataagcccaaaattttctctcgccgctgtgattatcagagaagtgggagaaccacgactgatgatttgccaccaaaaaccagagaaacgagatcgcggcttctactgctacacgagatccttcactcggtcgctcgttcacttattctttcttttcttttgttctccatattttatggtatctgaaattctaagatctagcaagtgaagaactggaagaaaaaaactgcaaactttaaggttttggagcaattgaatgaactttaggtagaacgcatgaaactacaataacatgaataaacacatagacaacaaaattatcagggtacagatttttaaaccaagttgtaattctagcaaacccatcaaccatcatcttccgctggattttgtgttttctaaagaaaaaaaagagatagaaaaaggaaagagacaagagattgtaaccgatgtaattaaagggtaaataagtcaaattgtccatacaaagtgcctattccttgaaaagtgtttaatcacgtaaatatttttaaaaaagtgctctacactgtaatattctcattaatttatccaataactaaatacgacgtcgtttagttacgaaaggtaatttggttcggcgtcgttacaaagactaaagattcacatgaatgtaactgttttttatccatatcaattttcaaaccaaaccaagaactgaactcgaaccattttttatccaaatccaaaccaaaccgaaatttaattggacctacaagcccattatatattcaaattttacaaaattggcataatataataatacaatgtttaataaataattaaactaaactgagtaaaagagggaaaatctacgatcctctctatctccttatccaacaacaacaaaaaacgaattctcgaagagaaagacactgaaatcgaaaaatctatagagagctcactcactagca

SEQ ID NO: 1567 - DNA, 3000 bp, Unknown
  misc_feature (1)..( 3000): cDNA_ID_2031118_gDNA_ID_1620418_Annot_ID_156515 3000 nt of promoter + ATG
cggttaggagaatatatgttcaaattatttgattaacctatctttaacccaaatgatttagattggtttgaaaccgaaccaaaccaatagctcaatcatgaataagatgatttagtgtagcttggttgtatttttcttttcaaatatataagtgaaaatatgtattaaattcaaagaaaattattagaaaatatataaaaaccaagaaaataacttattttggatttttttttttttttttaagtgaactcgaacccataatttttcttagtcagtgttcttctattgattttctttattttgataaagattattattctactgatttacaatgaataaaataaaaaagagagtagatctgtttccttatccacaataattcaatttggtagtgaattacaattatacgagtaagtaacagtcgatcgtgagagagcaagagatatagaaaagtgggtgatgtgtctaataaatataggtcacacaaccacctaatcttacgaatcattctactctccatatttaaagttatatagcaatcaatgtcagctacattttcttacgtatcttttttttggttataatatgccatgattcttgaaaattttaattcttgattcatagaattgtatactaaaggttgggatttatcataataatggaaacatgaattctatattaatacataatgaactggattctagaataatacagagatttgggtactggattaaatcgaaaaaataaaactatactgtttgataggtacatttagataactattgtcctggtattattttttaaattttttatttttaaatctgtcgcattttgtttttcctcaagtattaaaaagtaagaaatggtatccaattttgaaccgaaactgcattaaataaactgacccgaccttgtgtgtgtaaatgtatagagtagacacacattaatagttgaaaaagggcaatgctaattgttagtgaccctaattaatactccggcaaggatatatgaccattctctaactgttatgttccaacacattaggtgacctaaaactgtttggaaactttcatgtcacttaataagtaataacaaagcccatgtcaacatccttttttatgtgtttttccccaacattttggtttaattaatcactcattattatatattacttacctgatgaattagctatctgatgaaagtttcgttagaaatatttacatgattaaacacttaaagattaaaaaaacaaaaaattcgatgagatatcagctaagaaaagagagaaaaagataaggctaaaaagtttatggctgtaatataatatataataaattaaacagaaaaaaacttgaaaaaatctaagaggagtaattaatattgaaggaagacagatgaaacaattgtataaaaaatgaatgatagaaattatttatcaactataatctttttttgaaaatctattgtttgtagattataatgaacaatatttcgtttctattaaggtaaaaattacaacaccatagagaggacaacttagctaaatgaccatcaacattgaataaattaggtttgaatgattaaatcctttaacaaaaagtaggtaaatgtttatggaacattcttattaaaaaagcatttttattttctcaagaaatataaaagaatgatatttcttttctttttgcccaacactatgtttttataaattaaatgtttgtatataaaatagtcccaaacaacaaactaggcgtacaacggcatgttattcaaataaatagcactctgattacgtgtttttttttttgcaataaaaaaattcataaacttaattaactctctcaaaatggttacatatatatctaccaacttgacttaaaaggaagaatgatctgacttctgagttctgaaattcatatttaacaaattatccataaatgatgtgttggacacctattaacaaattagcctctagtgtacatgttagacaccgacgtattacttcttggtctctatccaataaacatttggcaaggatcttaaatatgtataactatttgatgtataagtctgttaattgtgaatgttaagaccgagagtataaaagagcttgttaccagtttaagtcattatttatgtatctttattcccatcatggccaaaaatggctgcgttaattactccaccgcaacacgacacttaaacctaatacttaaatgatagtagataagttggatatggaataatggatacaatcctcacaaaataaatacaatttagaacagagaatgtttgattgcttgatgttttaacattttataaaattctgttctttggcaaaagtgtcgttcggtggtttactttcactttattagtaaagacggtgacagtaatttatatatatatatatatatatatatatatatatatatatgactttctaaatttggaaggttagtatgaaatttggttcagaagaagctacaattcatctagtcggtgaaaataattgttgttgtagtcaaaccaaaattacttacatgatttcatttttatatagttaaaagttaaagtttgttatattattacttatatgttcggatttagatctgaagagagcagtacggatttaaagcccaaaattgtacattatttcacgaatataaatcccatatatatgttttttttttctcaaggaaatcccatatatatgtaagataccataaatagattatttgaaagacaagaaaatcatgaagatatgatatatcaacaaaaaattaacacaagaagtcaaattaaatttctctgttggccactttacattatgtctcaaccaacaacagaacgccaagctgtccaaaaaaaaaaaaaaaaaaacccctcaagagtctatatatataacaacattctcaacacaaaccatatgacatttacattctctcaaaagaaactttctacataatataaaaagtcacacattctctctattaattaaac

SEQ ID NO: 1568 - DNA, 3000 bp, Unknown
  misc_feature (1)..( 3000): cDNA_ID_3063127_gDNA_ID_1620418_Annot_ID_156497 3000 nt of promoter + ATG
gactgactctcagtctaaaaaatgggagacgattgtgaaaacatcgtattcacaccatgatcatgttcgctattcagaggtatgtattaatcggtccgagtttcaagaaatctcttaagaatctttctctttttggtatgtttggtttcaataaatttggatgacgttcaattgtgcaggggcttattgttgttcatcctactcgtcaacacaaattctgaaaaccggaatcgtttttactccatacagagtttccttttttccggtacataaatatctattagtacacatatatgtattttgtacatgagatcatgatgtcggataaattctgtgtcggaccggatcgggttaggtttgaaatagccacattattttcacacaatatcaacatcaatccggacagttttagaaattgtgtttgatccaaacatttggtatgagaaaattgtattcgtttaaatatttagaacgaattcctttaaaattatttcatgttaataaatttacatcattataaatatataatgttattgatattatgttaatgttattggatgtcacatcatcatcacaaaaaaatgatatgtgtctttctacattatttaaattaaaagattagaaaatttaattgaaagaaataaaaaatttattttgttaaatcctctattaatctcattcttagctaattttttacaaacaaacaaaatcatggtaatgtatcaatcattactattattatactcttcttgtttcgttaaatgtttctatatcaatagtcattactcgataatgcctaaaaaggttaattgtgttgtaagttagatgtttgctacttaatcttttattaatttaataattttcttttgaatcttttttatcattacgttttatgaatatgacttaccatattgtcttctttcttttcatttatgtgtcttatggtaaattggtcatattgacatgcaaatgttttcatgtaatgacattttaaaatgttagacatactaaaaatattcaagacacaaaactctctcttatatgactatatggaagaagaaagatttaaaatgagtacttaaattactatcataatgtagttgaaatagtagatgaggagagaaaatacataaaaaaaattgtttgtttaaaatcaagttagacaagtttcaaaccacattataagtaaatacgattgtatcaatgcatcatatatagttattgtatgaattcatgataattaaaaatactaggatcttaggtatataaataattatatttaaaaaacatataattgatatttcgagttaaagatgaatctaattataaaaaccataactatataaaatgaatatgactttattatttacataataacacacataaattacaacaaaaaccataaaaatattttttatatagcaaatttcaaaacaaaaacccacagataatgtgggtattcacctaatctgatatgaattatgaatgatttaggcttctatttagattaaagcccaactaagagtacatcaaatcatattttttaaataagcccaacaaatgcccacaattttcatttataaaaaaaaagaagtctaaatcatatattagatgaagcatcaactaataacaccaatatagaaaaaaaaaaaaaattcataaacaaatcaataattatatggaaaaactaattaaggttgactacacaattaaaaattgattaaaatataaagtagtgggtgacatgtactactactgtatagagcacatgactcgaaaactaataataatctcatgtaacctccctcccttattatattcgccacgtcactaaacagcaccgttgatcatcacactaagtaatatttaacggtcgtatattggcatcgcagctccaagtcaactctaatttagaattaatgttaaatatcttaattaattttttactaatctttcgcgccatatatatgttcacgttatttaacaacggaaggaataaaagacgaaataatgaactaatttcttgtttattttcttagtttttttaatagtttaatttatgcgaatacaaacatttctataattatggaaaatctaaaggaagttaatagggtcttactcattgataggatatttttttaaaaaaataaaaaaacagagacagttttgtgggggaaaaattgttaaaaaagaattaaaaaataggaaaaaaagattcgacaagagaaagagagagagaagaggaagaaaaaggaaagagagaggaaggagagaggaaggagagagaacccaccaccctttggccctggagagaccaaagatggtcgaagagagaaaactctgagatcatcatcttcatcatcatcatcctgtaaaaataagggcaagttctacaagaaatcagaaaatatcaatccaatatttgtttttaaacagaaattctatctttttaaaagtttttttataatcattttctattttctggggattttttttatatttaatttttcatttctcaaaccctatacccaattcttggtgaagaagtttcttctttgaggtaattattttgcaatgttcttcatttatcaagagaaaacaaatgtttttttttgtttggtgggttccatgttttcttcatattgcttcttcaagagggttattcttattctttatttttttggtttaattattattggtatacatttgttgttaaagttttgatatatgtttgtttgtttcttgttggcatttgtttttttccaggattaacaagaagaagagaattaacgtacgagttgttgactcattaggacatgaacattgtttttagggttttatgagtttgcaaaactggaaacaatgagagaccctgaatgttcaatcatcaacctcgtcgttcttctcctaccaaggattctgtgaagtttgtatttttatattcgttcatttaggaaaaaatctggcgattttgtatagcattggtgtatacctaaaatg

SEQ ID NO: 1569 - DNA, 3000 bp, Unknown
  misc_feature (1)..( 3000): cDNA_ID_2025243_gDNA_ID_1620418_Annot_ID_156506 3000 nt of promoter + ATG
aatgtaaaaaataagataaaataaatagaaattagttcaactataattagtttgcttgagtggatggaattttttttttgtgtggatggaaaatttatcatgtggatcaagatcacggatcaacttttaagatgtctgaaattttcgtcattttgttatgaccatggtaaatgtttaaatggaaaaatattcgacaagctatagacctcaagaatttgtttcggttaatttataattttatatatcctttttgatctaagagaaaaggatatattttggaaatttgaatctgatcaatgttaatcttagaagctgatttacgaaatatttgaaaaaatgtagtcaaggacattgcaatactctcattcgaatttagaaactgatatatttattttatgacagtgcttgcatcctctaggctctaacatgcaagatagtttgcgtgcgcatgcatgtatggccatctcaaaatgataagtttttttattaaacgaaaatattctcttaaaaagaaacggttgcacgttgtaaattagccatgcacacatacatgtgtagaaacatagatatacgtgcgtaaatatgttaccttcgaggaatttgctgagacgggtaacgaattggacacggcaagtgtcacagtaaactgatccttgaatctggaaacgatcgaagtcgtcagcatcagcggcggcgaaacctgccagagaagacaaacacacggcggagacgacaaagaaagagaagaagatagctttggaagccatttttattagagatttttgttttgtttttggtcttctcttctttttgatatctctttttatattcaaacaataagttgagatatgtttgagaagaggacaactattctcgtggagcaccgagtttgttttatattagaaacccgattgttatttttagactgagacaaaaaagtaaaatcgttgattgttaaaatttaaaattagtttcattacgtttcgataaaaaaatgattagtttatcatagcttaattatagcattgatttctaaatttgttttttgaccacccttttttctctctttggtgttttcttaacattagaagaacccataacaatgtacgttcaaattaattaaaaacaatatttccaagttttatatacgaaacttgttttttttaatgaaaacagttgaatagttgattatgaattagttagatcaatactcaatatatgatcaatgatgtatatatatgaactcagttgttatacaagaaatgaaaatgctatttaaataccgatcatgaagtgttaaaaagtgtcagaatatgacatgaagcgttttgtcctaccgggtattcgagttataggtttggatctctcaagaatattttgggccatattagttatatttgggcttaagcgttttgcaaagagacgaggaagaaagattgggtcaagttaacaaaacagagacactcgtattagttggtactttggtagcaagtcgatttatttgccagtaaaaacttggtacacaactgacaactcgtatcgttattagtttgtacttggtacctttggttcaagaaaaagttgatatagttaaatcagttgtgttcatgaggtgattgtgatttaatttgttgactagggcgattccttcacatcacaataacaaagttttatagattttttttttataacatttttgccacgcttcgtaaagtttggtatttacaccgcatttttccctgtacaagaattcatatattatttatttatatactccagttgacaattataagtttataacgtttttacaattatttaaataccatgtgaagatccaagaatatgtcttacttcttctttgtgtaagaaaactaactatatcactataataaaataattctaatcattatatttgtaaatatgcagttatttgtcaattttgaatttagtattttagacgttatcacttcagccaaatatgatttggatttaagtccaaaatgcaatttcgtacgtatccctcttgtcgtctaatgattatttcaatatttcttatattatccctaactacagagctacatttatattgtattctaatgacagggaaactttcatagagattcagatagatgaaattggtgggaaacatcattgaacaggaaacttttagcaaatcatatcgatttatctacaaaagaatacttagcgtaatgaagttcacttgttgtgaatgactatgatttgatcaaattagttaattttgtcgaatcatttttctttttgatttgattaagcttttaacttgcacgaatggttctcttgtgaataaacagaatctttgaattcaaactatttgattagtgaaaagacaaaagaagattccttgtttttatgtgattagtgattttgatgcatgaaaggtacctacgtactacaagaaaaataaacatgtacgtaactacgtatcagcatgtaaaagtatttttttccaaataatttatactcatgatagattttttttttttgaaatgtcaattaaaaatgctttcttaaatattaattttaattaattaaataaggaaatatatttatgcaaaacatcatcaacacatatccaacttcgaaaatctctatagtacacaagtagagaaattaaattttactagatacaaacttcctaatcatcaaatataaatgtttacaaaactaattaaacccaccactaaaattaactaaaaatccgagcaaagtgagtgaacaagacttgatttcaggttgatgtaggactaaaatggctacgtatcaaacatcaacgatcatttagttatgtatgaatgaatgtagtcattacttgtaaaacaaaaatgctttgatttggatcaatcacttcatgtgaacattagcaattacatcaaccttattttcactataaaaccccatctcagtacccttctgaagtaatcaaattaagagcaaaagtcatttaactttcctaaaaca

SEQ ID NO: 1570 - DNA, 36 bp, Unknown
  misc_feature (1)..( 36): cDNA_ID_3063171_gDNA_ID_1620419_Annot_ID_156527 3000 nt of promoter + ATG
aagcttcagtctatacactttggagagagagaaatg

SEQ ID NO: 1571 - DNA, 3000 bp, Unknown
  misc_feature (1)..( 3000): cDNA_ID_3063154_gDNA_ID_1620419_Annot_ID_156547 3000 nt of promoter + ATG
acgagctgttgggacgtggtcttcagatctcttacggcaacgacatgatcttctccagcgaagaagtcaaggcgacaggtacagacgtagatattccggcgattaagatctttgtcggttccttcgcgtcggaggaggaggatcatagctccaagaagattacggtgaatttagtaaagcgtaaagagaatatgttcaggagaaagattcgcaagtttctcaaccatttggtctgaagaacaaaactcgagtttgttgtgttagaatctaaggaacatttagagaagcacattctggtaaataaatatcattatccatatgatgtgaaaatgatgaagatgattttgtctatataacaaattcagtagaatatgatttttgttttgtgaaaccttaagtctataatttgattatattagtagtctatatagattgtctcaagagtcaagtctcaagtgatttgattatgaagatggcaataaaacttacattaatctacatgtagtctcttagctttggagaattaggattggttttcacaggaaccaccttgttgtgtggttgcgcttagttcagggcaaggtgtggggttgaccttgtcagcggctcctacgacatctgagcatttccatattggagacctttttgttccggtcagtgtaacattggagaagcagagattggtgaaaggtgaatcttttaatccctgaaccatgccagcacgctcgactttgatgccccatacgttcttgatcgttatgcctcttactatgggaagagcggatgtgttgaatttatcgtctggatgatctccggtgtcgccagagatcttaatcccggtccggactttttctaggtaaaccccggagattgttatcccctgtatgcttcctcctcggccaatgtttgtcttgatgtggatgccgataccagaattgtagagagtgatgttttcaactgttacattttggattccgccagaagtttcgcttccgatggctattccagcaaatggggaagatccagtgatgcggcggatggtgatgtcacggcttggacggttgtatgcaatgccatactcgtcccaaccgctcttcaccgcaacaaggtcgtcaccagtagatatgtaggagtcttctatacagacgttagagcttgaatctgtggtaattagtaaacacatcagtcatgatttgaaacgtaacaacatgattaagtagaagagagaaactgataaaaaaacctggatcaattccatcggtgttgtacgaatcagttggagcgaggatagtaacatgatgaacaacaacattactgtaagaaaaaagatagttaagtactaatggccaagtgcatattaaagttcatgagagatttgtgaacctgcaataaaccggatgaagtgtccagaaaggggagttctgaagaacaacatgagagacgaggatgtttgttgagttgttgaattcgatgagaccaggtctggtaaactttagagttccatgtctccacatgttccaccaaggttctccttggccatcaatcgtcccatttctgcctagcaaacgcattgacagacaatctgatttagaagatacatttccacgacatctaagctgacacaaaaaaaagtaacaacctgtaataacaacgtcgttgagtccgtctccgtgaataaagctgatatatcttcgtccaggatgctcccgtcctcttccataagacggcaaaggatcggtcaaaggccatttctccgtatcctaaagtaatcaaacaatcagaaatcgcaatgtagaaacaaacaattcctaacaatcattgaatcaagttatgtaaattagtaatcattcacctgaacggctttaataacagcaccatcggcgaggtataaagtcatgtgactcgtaagattgaagctttgagtcaaatacacaccacgaggcacataaagaagagttccttcgttactgttattggagtttcgtatccgatcaatagctgaattgaatgctttggtgttcaaggtcttgccgtcaccgacagctccaaaatccgaaattgatagcatctcgtttctgtgtttcattggaactataccagagcatgtaatcggagctcccagtgagagatggtgaggcaaaacagtggagagcaagaagagtacgaaaacagagatcggagcttgagaaatcttcatatctgagacgagagactttggtagagagtgaagaagagagagagagagagagtaaaatctcaatggaaatttctcgccggagaattttgattactgtggatctagctagagagaagtaatggcacggacgaagaaagctaaaaagcagggagattgttaacttacgtttttgtccttctcttagcttaaaacggtctgataattaaacttcgaatctaaacaatttaatattttacagcataatcccagtttaactgtaatctaaacaaggccaattaataaatatgcaagcccataactacagtttggcccattagtttttccccgcgccaaatttgccctagttcctttcttctttcccgctatttccaaaatctcccaaaaggtcaagttccagcaaaatgacacaatctttgtaatcaacattgttctccgtcaagcttctccttcaaaattcgtaagctttctgttctctaactctttttggtttcagtatatgaatcaatccgactttggaatctctacttaaaaataaaaatcgatctttttgctgcccagatagtgaataaccttaaaatcgatgacgagagaggagactgaaaccagtggagaggatatgatgattgatgacccaaaacccaaaatcgaaaacgatttcaatgttcattacctccgaatttactacggcaagttttaatctttatcacatttgggtatatgtctcttcataaatcaaatctgacttttttcgctcataacaacatatatgcaggaaatctatttccttacactgatattcacaa

SEQ ID NO: 1572 - DNA, 3000 bp, Unknown
  misc_feature (1)..( 3000): cDNA_ID_2141585_gDNA_ID_1620419_Annot_ID_156546 3000 nt of promoter + ATG
gaaaaccagacaacattcatacattgaactaagtatgaatatgagagtaattacctggtaggatatattcaagaaacaatgaaagggacctgtttttggatggacgcagaagggtgccttaagcaaatggttcatttgttttgaaacctgcaataaaagaagaaaccatacaactaaacagtcacaaaacttgtcagttgctataagatctaatacggcgagggaatatctaccataatagcacaatgggtttatgaaaattgtagcatagagtagaacaaacctccaaatcaattcgaggatacgtaaaggtgaagacaatttcttctacgcacgtccgcagtgatagagcctaaaacattatggatacaagattgaagatgagcaaaactaagattcaagttcatcaagctaaaagctgagtgaaagacaaataaggttttcacaacacttaacatacatgttttgaattcctttaaaacattacacaccttgtttctcttcgattgaagagctttcttaagttgttcccaccttaaaaggctggtggcttcttctgatagagatgatctcgcagaattctcccactttcctctgaggtctgcttgaatatctgtcatgaagatgcaaatcattgtaaatgacacaaactgagattaggacgtcacgtaggcggaaaaatacatcaacactctttcataccttcatctgtaatcatcccaagtatcttctcatacttttctttgcttgagaatatactttgagttgcttgtaactcaccctcaaagaaactcttaataaagtccacatatgatctcctgaaaatcccagaagaaattagtaacaaagacagtgtttttgaaatcagaaaggcagaggtgatggagaaacccttacgcaagaaacggatgaagagaatgacccatcagatcgaccttttttgcattgttttcatttccctgtgtcacataggcaataattgaactcagacaatttcacaatgccagaaaccaacaaaataaaccatcgttgagctcttgagaacactaccttataaacacgaaagtattcagcaactgctgatctttgttcattagtcaacctgcaggatttaatcacacaacgtttcatttcataaaacagaagatgaaatgcagaaagtgattcatacaccaagcgaagtgaaaaacaatgttagtaattgtttcaccttcgagctttagcatcacaaacccaacagtgaactccacgacgtccactgaagacccagaggatgtgtttgaaaccaaaatcctctgcaattgacaagaccagaatgagtgactacaagtttgttctatgataagaccaagcagtcttgcacattgacaaacactagatcaagaagtgaactccacaatgacattcacgttacaggggctataaatattacaaaaactcatagggatggaaaatctcaggaacactacaaactctagttgtatcatacatttgagagttaagaaaacatttttgatacctcttaaggaagtatcaatgactttgatagcaactgtcattaaaggccagcatttggagcaaacatcggctcccgaacaacagtatctaacatcatcataatctgttatatcctgaggaaacaatatattcaagtcaagcaacaaactacgtaagaacaaaaacacaaaaccaattatacgaaattcttaataagatattaaaactcacaatatcaaagactaactccctctccactggagtaaacaaattggttccactttgagcatatgcatgtctcttatccggctgaaaaaacacatttacaaaactcaaatgagtaaatctagtttcatagaccagcaccaaagcttgaaaaacggatttttgcaacttacatcaacgctatacacagcaccaatatcaatcttgtatggaaaattcgatttgatagcagcttccataagtgaagcattcttgaaagacttataccgcaaataaacatcgttttcaagcgtaaacgagaattctcttctaccaaagtaatattcatcacaaccaggatgtttcccatctacagattcacaaacacagacaaatatacaattcatcacaaccatttctaacctttaaagagtgtgacagaaagaaagaaagacaagtaaacaaacaagtaccgtgcccataagaaagccatttgtgaatatcagtgtaaggaaatagatttcctgcatatatgttgttatgagcgaaaaaagtcagatttgatttatgaagagacatatacccaaatgtgataaagattaaaacttgccgtagtaaattcggaggtaatgaacattgaaatcgttttcgattttgggttttgggtcatcaatcatcatatcctctccactggtttcagtctcctctctcgtcatcgattttaaggttattcactatctgggcagcaaaaagatcgatttttatttttaagtagagattccaaagtcggattgattcatatactgaaaccaaaaagagttagagaacagaaagcttacgaattttgaaggagaagcttgacggagaacaatgttgattacaaagattgtgtcattttgctggaacttgaccttttgggagattttggaaatagcgggaaagaagaaaggaactagggcaaatttggcgcggggaaaaactaatgggccaaactgtagttatgggcttgcatatttattaattggccttgtttagattacagttaaactgggattatgctgtaaaatattaaattgtttagattcgaagtttaattatcagaccgttttaagctaagagaaggacaaaaacgtaagttaacaatctccctgctttttagctttcttcgtccgtgccattacttctctctagctagatccacagtaatcaaaattctccggcgagaaatttccattgagattttactctctctctctctctcttcttcactctctaccaaagtctctcgtctcagatatg

SEQ ID NO: 1573 - DNA, 3000 bp, Unknown
  misc_feature (1)..( 3000): cDNA_ID_2141597_gDNA_ID_1620419_Annot_ID_156549 3000 nt of promoter + ATG
gctttaagaagagtcagcttatcaattagttgacttcaagtgtgtacaagggttttgttctgttagatactttagagaattaaattcatattattgtaactaaccgttaaatcaagcacatttatttctaattacgtagtactcgctttcactatttctgaatgaataaactaaggcagggcaatatatatataacaaatactaattattgttattattttttgtaaaaacatatgcaatgttttaaatctattacttgtgattgttttttttgaatattgtatcagatatatatatggtcgaatatctaacaagctctaaagtgaatataaacaaaaaaaaaaaaaaaataagatctatgttctatgtcgcctctaaaataaacatattacatacccacaatatcggaaatggttcgaccattagtgaatcttcccgtgggttggccgttggaaggtgcaaaatcgatgccataaggcgaagaatcagcttttgacaatgtgaagatatagttgttgtttccaacatctaccaatgagtctccaaatatgaagtttgtgaacgattgagcagcctgaaaatgtgatagccaaaggagaagaaaagtgcaattgaaaggcttgagagaacatctataagtgaaatccatttttaactttctcaaaatatttgccaatgtggtaggaagaaacgaaagagacttgtttggttaaataaacttgattacgttaatactttttgaaccattccttttgcttacgtatgttacagcatgacttgttcaaaagatagcacatggttcttctacgtacactattattactttgttggtcgtgtaacacaaaaattgtttcgtcttgtgtgcacatatactcgacttatatgacattaacatgatctcaaaaataatcctaagttacttataaagaatatctcgatttttgacttccaagtttgtaatcaatgttataaataggacaacaagctaggctaggctgtcttttagatggttaatagtcaaagagagtgatggcaaagagcttaattaatggcacatgtgactcatcgaacacgcttcttcatatcttcttcttctcaaacaacactacagaaatttgtctccaaaaaaaaaaaaataataataacgctaaagaaattttcttttaatatacctctattgttcaatatatatatttggcagcctctatgttcaatatatataatatatatgtgggttagtttcaactaaatacaatacctgactatgtcgggattcaaacaaaacccaaacatttaaactttacaattataaatttaaaaaacctttaaaatgcaactaaaaatgttttcttggtaagaaaacacacaattaatgtttataaaaaataaactaaggatggtatttatttgaatgcttttgttaaatgttatataaatagttttaaagctattgttttaccaaaataaactaaatgtatattataaatactaaatttattggatttaatttattttagtaaattatcattatatatatatatatatatatacataatgttaaaacttaaaagatgtttaaaaataaaatttggttattcatgtaatgactatattcaagttgtgacacatgtatatatcgaccccaaaatagacctcttataaattgtcattccacgtcacttttatccgggattccaggttatatgtaaaaaaacaaaaactgatgttctacatcatttaatagaaaactgaaatgtgatggcacatacataatgcatctcccaagatggtacaaaagtaatcattgtccttattcttcagattcaaccttgagactacccaatctccgtggaggggtttgagcaggagattcaaatatccccaaataacttggaaaagtaattaaaatttcatataagagaacaagtgtgtaagcatgcaattcaatcgagctctcacgatatccccaataggacgaaggaggaactcagtcggaggcggaaagaaaattgacatgatgcagctattcctcgatccgacagatcgtttggaaagaacaatgccttaaaaaccaaacacgttattttttaaagaagaaaaacacattactttaaatatatcataccaaagcaatatatgaaaatcataataacagaagtaacaatatgaaatactgtaacgttcaaaccaaattaggtttgtgtcgagaagttaatttaaaaaaaaaaaaattatcaaagcttttatcaaacaaacgtttcacttgatgtaaaaactatattgtttttttgaatttaatttaatattagattcaaaaacaaaaaaaaaagaacgttccaatactcaaaaagaattgcattggaattatctctctgtttatctgatcaatactcaagcattaggttgtattctaatttaactgttaaaggtccaccggtgtcttcagtgacgtatacgaccttggtacatgtttttttacttcacatgagccaatataccacaatctccaaaagataaacgcaagatgataaaccacaaaattttacatgaatagtaaatcatattaaagagtactttttatttcaaggtaaacagtacttgttattcagactttagtatatgtaaaacagtattttcataggaacaaatatataaactagtaagtcatagtagttacctaattggtacttttagacctcaaaagtctctcaaaccataaattaatatagtacattccaaattataaacatattatgaaaaagtttaattaaaaataaatatttaatttaggtttgcaaaaaaaggttcaacctccacccaatttcatgagtttggacagcaaattattttaaatgaaacaataaattcatatatctgtcttctactataaattaccctctctctctcttatcatcatcatcaatttatataaccctctcaaaacacacatttttaagattcaaataaaatcccttcttcaacattcaccaccacaacatc

SEQ ID NO: 1574 - DNA, 3000 bp, Unknown
  misc_feature (1)..( 3000): cDNA_ID_2141547_gDNA_ID_1620419_Annot_ID_156535 3000 nt of promoter + ATG
cttgcaatatcccagccagctcttgacatgcctgagctgctttggaaggtaagttttttaagtcgaatacattcatagaatcgagattcctcagacttttgaaaccaattggataattgaaattctatattgtttgtggcaggcatacattgattttgagatatcagaaggggaattagagaggacaagggctttatatgagcgactcttggaccgtactaagcattacaaggtgtgggttagctttgcaaagtttgaagcttctgctgcggaactagaggaagacgagaatgaagatgaagaccaggaagaagatgttattgaacacaagaaagattgcatcaaacgtgccagaggtaactttaaaactacacattatatcagttttgatgattccttgcaacatgttataactgtttattctctctatatttcttctactcagcaattttcgatagagccaacacatattacaaagactccacaccagagctgaaggaagaacgagctacgctcttggaggattggctgaacatggagagtagctttggtaacctcggggatgttagtattgttcaatcgaagcttccaaagaagctcaagaaaagaaaggcgatcactagagaagacgggtcaacagagtacgcattgcgtatatataatatctcgatttttaatatctttcgaatgtgattagttaaatgctaaagcttaacgtgaaaaattgtttgaatgtttaaacaggtacgaagaatacatcgattatttatacccagaagaatcgcaaacaacgaatctcaagattcttgaagctgcatacaaatggaagaagcagaaggttgctgcttctgaggatgattgagattaagcttttttcttaagttatatcaaaagtcaaaactgtgaaatgtgttttgtattcttccttagctctttgtacacatcgtttggtttagcagtaatttttgttatccaagaacctaacaaaactcaaatttgtcctgttatgttttgttttggttcgaattttccggtttagaaattaatcaggatacttcttcattccggtttatgttctgatctctcggtttgtgatacgtttgaaacggaatctagtttaatctatatatatacattttagtttaatctatatatatatacatttttgctgtgaaataaataatggagttggaacttatttataatcgctggcttattcaatgcaaaaattaactaccaaatcaaagcaaatcttattcaaaacaatatgctcttattctatggtctaattatttttgctaaaatggttaaaatatttaaaaattaaataatcatttgaaagaaaactttaaattgatttaaattataaatcttttcataaaaatattattaataaaaaaaaaaaattcaccgaacatgattagatagtaagactagatggtagggcgtgtttataatattataatatataaactttataacaattaaataactatttgaaagaaaatttttaaattgatttgaattaaatattttttaaattaaaatattattaaaacaaaaataacaaaataatgtctaattttactgaacggggttagtggtaggacgagtttggtcgatagtattacgagacggtataccacaagtgaaatccattagatatgtttaatttcactgtggaggattagatggtatgacgggttttgatcgataataatacgaaacgatatactacggataaaatcctagatataacaattaaaatctatatacacattattttaaacactaaacaaagcaaacaatattaataaaacgaatatctacatatatattttattccgcgggtcaaaatctagtagctggatgaaatggtgtttatatattacaccaactttggttatattcaaattaccgaataatcttctactaattttgtttattatttgctttcttttcacttttgagtcggctaaatggctaatcaaaccttcgttaaatactcgaaaaaaattaaggtcacttggcaacttgcagatcaagcaatagatgtatgtcacgtggcaagattacagcttcagctaaacgagtggatattggaccaatcacctcctttggcaaaatatcgagagacgacgacgagaaattatgcaaactctttcgtttgtgtgtctggttatttccgtaattattaacgaaattcaatggcatttagataacacaggtagtgccaaattttgcattccctctattattaagccaaaaaagaaacctttaaatataacaatttattagactaaaaaagacacaacccctcgttttatctgactctgatcccattttgctaaaatcttctctttatttttgttttgttttaggcctctcttctttttcgttctttctttatcagcttcctcagccgcacggagaaagaaaatttgatcctgattttttgccggtgataatctaaacctattaatttctctgcggaaccaaacattgaatttagggtttaaattgcatcattggtggaacccagatgttttctcctcctatattaatggtcattctcggggtagggtcatgaccatgaccttcgtttagtttacatcctcttacatgttcttaattattcttccatttatttttccaatttctaaattctctgatatgttattacctatggaaccataatgaaagttacatatgttgagtctttataattcttctagtcaatcttaacgaaagaattaatttttgaaagctttcttgggatacaaggaaattatggacattccatttagggtcatgctgttttcgttagcttgcatgctaagttaaagttgttttttttgcatgaatttgatcgatgttgttaatttgtttctttgtgttttgcagagctttttgaatttgagctctttgttggctttcttttgtgcttaagcggagagttatagacaaataagcttcacgaagaaaacgaatctgttgcaa

SEQ ID NO: 1575 - DNA, 3000 bp, Unknown
  misc_feature (1)..( 3000): cDNA_ID_3063163_gDNA_ID_1620419_Annot_ID_156539 3000 nt of promoter + ATG
tatacaaaattatggtcagttcaattagttgagaaactttcagcattaatagatctaaatttggccacatgagataattatgtattttactagaaaaatgttaaattagagccaaaaattccaaaatttcaaccaaaaacttagaatttttatttgtctttcactaagaacgtcgttatcgtgggattaaatatttaattaataaacattagctgcaatactttcatgttcatacatatataaatgttaaatgatcagaccgtgaagcccataagaccattcataattaaccaccaagtacccacttctctctctctctccatacatatactatattatagataaatatcccatcaatacgtaacaaccaccgagatattacaattcacaggtttctagctattttatatagttattgtaaaccaaaagaaaaagatttttggggatagatcaatctcttgcgttcatttttcttctctttggtacgaaaatacaaagatggagatcaaagtcaaagcaaaagatgtagagtcgacaatgatgtcaactaaagaggaggatgagatcaagaagatgaaagagtgtgtggtgattcagaaggcagatgaggaggttactaaaggacaagaaactatgaagattttggatggttcaagacaaaaccaagatgaaacaagacaagctgattctaagaatattgactcaccatcatcatcatcacttgagatgaagaagaagttggaaattggtaagtttctaatctttttgtccctttatgtttgataaaacgtcttcttcttatccttttggtatgactaattcatatattaaaccaactaagttatgcttacatgtaacaatttgagacaaaaatataacaaccccttcgaatttttctcttacatttatataccaagtcttagaaatttgggtgaaaaagatataggaattacaattttttccaattttttaaaatttttttattcatttacctgttaactcttttgggaacagagattatcaaaagttaagtagtgtttcacaaattttgcagaccaaaaatttacgagtcaaaacgaagaaaacaccaaaaaggaagaggagaagaagaaagagaccaacaataacaatctttctaacatgaagcataagaagacgagttcacacgtatgggactgtgggagcactctctacgactcgttcgagctcaactcgttcaaacgtcaactcgactcagccatctctgcttcctccgccagaactatgtccatgtctcacctccctgaccgccgtatcccttctctcagctcactttcgccggagtactctcctcctcttcctcctccaccgacaacttcttcttcctcctcctccggtggaaagaaacactcgaacaagatctctcgttctctacagagattcttgaagtcaatgttcaaacctaaacagcaccaaagcttaaccactccttcttcgccggtctacaaggcggtgggtcacggcggtggcgataaagatcgatactacgtcgtttacgacaaatcgggttcgttgacaactattccagagtcaacggagaaagaagtgagccccgagatcaactctcttgttaggaagaccgtgtccgagagattcccggcgagtagagtcgttggtatttcatgtgcatgattataatattaatctaagtcgtatatttgatataaattaataaatataaacatgttatatgacttatgagattagagttattttttttttccctttttgtttttataaaatatacattttggaaatgaataatcgtgttgaaccttggacgtatgtgaatgtatagaagttttttttttcttttcaataattaatgtgtagaattgaattttgatgcatttatgatatgcaacgtacgtatcgtaaccgtttagtgtagattttatctacctttgaatgtgatgtataacaatagcaagggttataaaggaaactacgtgacggttttgtgttgaagttgaaaaatatgtgatggagttacgttcagatatagtggaatatatttattaacaattcatatttaatgagtcattttcatggtgacttgtgagtattgaaaattaggtgtggactcacgttatgtttgcgcgtttgatttattattgattttgttatgaattttaactacttcatgtaagtagacacaaagttaaaatacaaatttttgttataaattttgtgattgatgcacgacatgaggtagggtctataggataagtcaattaaagtgttccttaataaatgaaaggtagatataataatagtatatagtatacaccttggttttatttaatgcattgcaacgtcttcaataacgttgatgttttgatgagatatgtctcctctatctatgtaccataacctcgatttatttgcgtacggcgaaaataatgacattatattatacgttttgctttgaatctacggactacgaaaaattgataagtcctataaattcattttgtcttatttcatctaattccactaaattaaaggttagtcaatgaatgattgtaacgatatgtgaaaatgatgaaagatgattagttgttctgttttgctctgtttcttgatcgttctcgaagattttagtctgtataataactctattaagtgcagtggcgttgcttaatatatagcaattcataataatgaagaaagtgtcatccattccaagaagtaaacactgagtgctaattttcttcagcagtctagaagaagagagacaaacaaaacattatcaccattctcagtcaaaagaagaaagcatgtgtttaccaaaaaacaagaaagcatgttcgtaattttcaattgaaccggtatcgtaatttttgattaaactcggtttactcggaccggttcctttatataataagattgttgtttttaggtttccggtgggaaccctaaacaagaaaacgtcattgtgaagcaattccctatatctca

SEQ ID NO: 1576 - DNA, 3000 bp, Unknown
  misc_feature (1)..( 3000): cDNA_ID_2141571_gDNA_ID_1620419_Annot_ID_156542 3000 nt of promoter + ATG
cataaattatagttttgcaatatttccataaattatgatattatttaaatttaaaattcattatattaaaagatattttctataatatatatattgaaaaatgacctcgatattttcaagtaattatctaatttttaattaaaaatatactttgacaagcaaaacaataataacacagttacaaaatatgaaaatatgaatgattctatggtgaatttttaagaaataacttttaataatacttttatttttgaaattatataaaaaacattaatgtaagaaattattatgatccctataaacaatttttttgcctccaccactagcctctctatgagtctcttactaatataattaactattagtgtttttaatgtaattaaattgtttaattaaattctaaactataaaaaaaaattataaccaatcataacaggaaaaatgtaatttggattttttagagtttgttgtttaagagagtcttcctactctttctcctcactaattacaatttttcatactcttattgatgggtctctaattaagaagaccatcaatgaaattcactttaaatggtcatagtataatttataaactaaattaaataagtgaaattcttctataaaaatactatttggtttctatatattttgaaaaactgggtgattggttcgtctgtatctgtagatttattgcaataaaaactttattttagctgtaatgattgtagctgtaggttttatttatgtagaaattaggtagtatatttttactaatataaaattattatataagtaaattggatttagcaattaaatttggattgtatgtatgtatttttaaacaaaaataaaattggtaaataatagttatgtgttatataatattattctcaaatatcaattttataaattatgatatacataacatatatatgatgtatttaagaaacgatctgacttatatatatatatatatatatatatataacccaataaaaagagttatatatatatatatatatatttcataaagaagtttttttgcagaatacttatatccacaaaaataaattttcataatatatatggatgaaactataataattgttttaaaaaaaaaacaaagtggaaagaggaagaaaaaaatggtacatcccacctaaataccataacattgtattctaaaaaattgtacttacaaccaaaatataacaaaaatattgtttaggctgtgaaaaaaataggaaagctaccataaggattgtagcttttttgttggctttattaggcttgggcaaaaaaaacgctaaccgaataaccgaaccgaaccaaaaaacatggtttggttcgggtttggatagtttaaaataaccggctggatattatatgtcttagatttcggtttcggttaggttagtaaccgataaccaaaggataaccaaagcatatatgtatgatagataatatatcacatatattgtatgtattgagacttaactatgttattctctttattagtttgcaagttgaatttcgtgagttgtgaatcaggtgttttaatattatggagagtatggaccatatttgcatctttgtgagttgtgaatatgtctttttttacgtacgttctatatcagttattggtcaattgttttagttgtttcgttttttagtcggttatttcggttttggtttatttatggttaccaagtttaatatccgaaccgaaccgaaccgaaaaatatctgaaccgaaccgaaccaaaattcctcaaatatccaaatggttcttatattactataaccgaaaccatacgcaaccgaaccaaaaccgaatacccaggcctgtccaaatggttcttatattactataaccaaaataaccgaaaccatgcacaaccgaaccgaaaccgaatggttaaccgaatgcccaggtctgggctttatacatattctattgcccaaccaatcataccccaaacatttttttaaaaaaatattaaatatattgctcaacaaaaaatattatatacaataaaaaaatgaaatcagcaagattatccataacaagggacatgcaaaatatcatggatctgagttttgatacaattctggaaataggtgtccaaagcttatggatccaaattcagatatttagatattttatatgatattttctgttaacctttttactcattgaaataatagttaatcttattttcatctatttttttgcagatatgtatagtcgcatatattggcggatctagatcttgaaatttgttttatggatctaacggatccaaatccggatagttggtttatagatccagatccggatagttggataatggatccagtggatccggatctggatagttgtttcacggatcatctagatctgggtagcccaaaatttcacggaaactaattcgtgttcatctttctatctacgaccggaaaaaaaaacaacttgagaaattgaaggagttcgatgatatgagattattacctgtttgagtaaagcacggaatatctcgtctccagattactaaggacttttctcgaacaccgtcgtcatgtcctttggttgttttgaaaagtaaggagaaaaaataggaggccgagcaaatagatttaattaagattatgttatagaattcagagtgacgtatatttatataagatggtcaatatattgtgaattctagggttttcagaagatttatttcctaaatgtaataagtttttcgagacaaatatttaaaattttagtaaagacatttgtttgataaaacttggaaaaaaaataataatgacgaccgactatattgttaaacaatatcttactgacaaaattgaaataatcgcccatcagatgtttaaagtaaaatatttcaaataaagttccatagaaactattcctggaaactgttctccggagaggtccatagtcctatgcggagtgaatgctggtcctccagaagtggcacccagaa

SEQ ID NO: 1577 - DNA, 3000 bp, Unknown
  misc_feature (1)..( 3000): cDNA_ID_2141575_gDNA_ID_1620419_Annot_ID_156543 3000 nt of promoter + ATG
aatgtaacagttgaaaacatcactctctacaattctggtatcggcatccacatcaagacaaacattggccgaggaggaagcatacaggggataacaatctccggggtttacctagaaaaagtccggaccgggattaagatctctggcgacaccggagatcatccagacgataaattcaacacatccgctcttcccatagtaagaggcataacgatcaagaacgtatggggcatcaaagtcgagcgtgctggcatggttcagggattaaaagattcacctttcaccaatctctgcttctccaatgttacactgaccggaacaaaaaggtctccaatatggaaatgctcagatgtcgtaggagccgctgacaaggtcaaccccacaccttgccctgaactaagcgcaaccacacaacaaggtggttcctgtgaaaaccaatcctaattctccaaagctaagagactacatgtagattaatgtaagttttattgccatcttcataatcaaatcacttgagacttgactcttgagacaatctatatagactactaatataatcaaattatagacttaaggtttcacaaaacaaaaatcatattctactgaatttgttatatagacaaaatcatcttcatcattttcacatcatatggataatgatatttatttaccagaatgtgcttctctaaatgttccttagattctaacacaacaaactcgagttttgttcttcagaccaaatggttgagaaacttgcgaatctttctcctgaacatattctctttacgctttactaaattcaccgtaatcttcttggagctatgatcctcctcctccgacgcgaaggaaccgacaaagatcttaatcgccggaatatctacgtctgtacctgtcgccttgacttcttcgctggagaagatcatgtcgttgccgtaagagatctgaagaccacgtcccaacagctcgtggcatggttggcgtttgaaaggagccgtcgtcgttaacggacgtctagggaaatgacgattgatcggatggaagttgacgaaattcaccggcactgtgacctcatcggattcggaaaggcttgggtttgtggaatctggatcgggttcggctgatgaagtggtggttaggcttttgtcgatgatgtcatttcccggcgttgaagaagcgacggagagagccaacgtgaacaaaagaacggtgacggtaacggtaacggtaacggtagcggtgggggaggccattgttttgggaagaaggaaatctgaattgtcaaaggtatgataaacggtgttaactatcattaacgttttctaaaatcgacaaaaatagttatgggcctgtttttagttcagaagcccaagttttagtggcccaattaatttggcgcgaaagtcaaatcctatatcccattttccttggggatttgagtcaactgttgtctgagatttccaggtttctcgatggcttcacggaggaaaagaagaaaggtgaatgaagaatcagagattccatgttcgccggtcgttatattcgcgcacggtgccggtgctccctcttcttccgactggatgattaggtaactactaatcttcttctgagtttattcacttagtctgaatttgctcaatatatgtttgtgggtttgatgtagatggaaggaaatgttaaagaagacattagaagctgttgaagtggtcacatttgactatccttgtgagtgaattttctgtgaaatcataaatttttattattcatactttaaagcttaattcaattgtggaattgatgtgtagatcttgctgacgggaaaaaaagagtagctccgaaagcggagaaattgatagagtttcatttgaatgttgttaaagaaactgctgctaaattccctggtcatcctttgatattagttggcaaatcaatgggttctaggtacatttcttcttgtgtccagctcacacacgttgttttgtttgggtatgtttcaatgtttaatgtgatgttgttatcaccttgcagagtaagctgtatggtttcagctgtgaatgaagatgttacagtttcagctgtgatatgtttaggatatccacttaaggtttgagatttatgtccgtgaaaagttgattcctgttctcgtgaatgtatgaatgagcaatttaagggtatacgttgatttcagggcgcgaaaggtgcgataagagacgagactctactggaaatgggagtccctgtgatgtttgtgcaggtattttatgcaaaagtaacataactcttatgttgttgcacatgaatgaattataattgggtctttggattatgaatgtttttgtatcaaaagggaagcaaagatccgatgtgtcctctgaataagcttgaagctgtttgtaataaaatgaaagctgtgactgaggttcatgtgattgatggtggagatcactccttcaagattgggaagaaacaccttgaaacaaaggagttaacacaagaggaagtcgaagatgtcgctatgaaagcaatagccgcttttgtctccaaatctcttgctcaaagctcataagcatagtcaaggtttagaggcttgtgctaaactacattttcttcgcttgccttgtacatagcttcattcaactcttaatgggctaatgctttcatttttatgccaaatctagttttcttaatttgtaatggtaaactggagttttggttaggttgtgtagactattttaactaagcatcgctcttggctttgttcttcctttaataacttgtgtttaatgctttctccttttgactcagaatggtgatcatcttttgtttgtctttcatcttcttaaattagtgcatataagatgtatcatgtatttaacagattaaatctgtatcttggtttcatcaagtttaatcctcatggtggattaaaaaccgtgcaatgaatattctgagaaaattgactcattcaagttgtaattgttgatcagtctctgtctcaagatg

SEQ ID NO: 1578 - DNA, 3000 bp, Unknown
  misc_feature (1)..( 3000): cDNA_ID_2141551_gDNA_ID_1620419_Annot_ID_156536 3000 nt of promoter + ATG
agtctctgaaacccaattcaagaaaatcaaggaaatggtggaacaagggcttgctggaccagagatggcgataaagaagctggaagaaagcggggaattagggaaccgagtaacgagattagctaaagagatcgattcagcgagaaagtgggtgaaggagaaggacaacaatatgaagcatgaggtggaaactctagaagcgaagctagaatgtagagaagcgcaagaatctctgctaaaggagaagctatcgaagctagaggctaagctagcggaggaaggaacagaaaagctgagtctatcaaaggctatgaggaaaattaaaaagcttgagattaatgtgaaggagaaagagtttgagttgttgagtttaggagaagggaagagagaagccataagacaactatgtgttttggttgattatcaacgttgtcgatatgatgatctcaaaacttccatttgtcacgtagctcttcaagcatagagttcacttcttcttctccttttgggtgtaaaatgtaaatattatatgttgcaagatttgggtattttttcattaatggttgtaaactaaactaattttttttgtaaataacacattttaactttattttttttgtaaataacatattttaactttatttttcaaatattcttaatattgaacatcctacgcgttttataaaagtctccattagtttgttaacttttttttttttttgtaaaagtctccattagtttggtatgttttggccttcatatatttaatcatccttttgttggaagttaggttagtttgtattaaaatgttttaagttatcatcaattatagctcatctggtcaccactattttatagaaagaaatccagagaagaattatatatgaatgaaaatctggtaacaattaataaataaaaaagcataatgtgaaaaccctattaataagaacaaatcacaaataaactcaaaactaactactaataaataggagaaaatgaaagaaatataattgaaatgaaaattactcctaagaaaaaaagaaataaatcagtctcattttataatgtgaagataatgtagtctaaattaggattacgtaagtaaaatcagtctccttgatagatttcctaattaatagtatagatataagaaaatagagtcatatttcttttgacaaagacccaccaaaaaaaggcgggaaacgcacttagtgattgtgaggcattaatcatgtgttataaagttaagtacggcattagacatgctaaacaaaaaccaaaatccagctaatttgtatatctccgtggcaaatacgtaataatcttgaacattgataactacagtcaaatgatattttgaccggtgttgacgagaatttgaagagaaaataaaagcgtgtgatggcagaagcgtaataatctgataaaagggaggggtgtttgtggtaagacgaatttccaaaaagattcctccagtcttcgtctttctccctcaaaattgaaaacacacacaaaagttgagctttcataactgttctctcctctcaaataactccaaaaaccaaatcacctttttttttctttcttcttcaatctctcttttgcttcgatttcaatttcgtaatcttatcatctctgtagccaaaaacacacacatcagaccagagagaagagcgagagagagtttttctttggtagttttctggactttcttcaaatctcaggagcttccgtaatccgtatccaggtaaaattctaggttacgaaatgattttgttggcttcgattattgacttttgaagtttatttgattcttcgatcagcttttagtttacgctttcgttgcttagtagtgttggatcatgacttcatgagtagaaacatctgatggttttgtttgtttgttgatgtgccttttactggggaaattatgagtttcttgttatccagttcatcttaagtctcgttgaggttttgatgatttgcatcagattacctattggattatcgttgatttggttcgttagaaatagagtaatagggtttatatcaggtgaatcaaggtcatgagctgcaatttccaaatttgtttattattattcaagtttttgcgattgggatttcatgtttaggcacagtaactagatgtccttagattttactatcaagtcatctttagtttctcatgttagtagattttgtaatttaagcttctatcaactgctgtgtaatcatcaaaatgctaagtagaattcttggtttctatacagggaaacacgaaaaaccatagaaatcgattctggaccttaaaggaaattcgagagataaagtgtaagtgaaactagaaactctactcctttccttgtatttacagttttactagtaactttctttttaagaaagcgttggatgatcggatcgagattgttttagttgaaactgtattgttaaagccttaaaggtagtaagtaacatataagaacaaaaagaaacaactcacattttcctgaggtatgaaaattgaataatgatagctgtcttttatcggttctagaggtatgtgctttctggtccatttccaaaattgctgaggtggctccacttgagatcttttgtcttagccaatgccatcagattccaaatttagacccggcactaaaaagtgattagctttaatccaaactcgaaactctaatcaaattggcatttgttcttgtaacttctgttgaagtaaaataataatatatcacttggtaagacagttactcattgctgcaaagattttggatctatgatgatgttctttgcgggtcccacgaattctattattatctgcgtaccttgtcagagtacaattgctggatctacttctattattatattctctttatgttgaatatcaagatgcttaacctatgatctggattctgtaaaagccaaattattagtattagttttctaatttgttagtattatatacgaaacaaaaatgtgaaaagg

SEQ ID NO: 1579 - DNA, 3000 bp, Unknown
  misc_feature (1)..( 3000): cDNA_ID_2141543_gDNA_ID_1620419_Annot_ID_156534 3000 nt of promoter + ATG
ttgttttggaatcgtttattaaaccgaaattgtggagttggataaaggtcacgtgattgaagtttttgagtttctaaactgagagatttaattaatctaattaatcagttcttaatcaaggtttagaatttggtttggatattagattaaatcatagattataattgcatttaatcttgatcgtttagtctaaaccaatgcagcccgagattgttcctgaagccgtttttgttgttcctagttcaaaaccgaggaatcaacccattttgttaaggtgaggacgcgaccttgttttatttgttatatgaatatatttagttgattatttagtttagagttaagccgaatatatctatgagttacatattgtttgatgtgtgtctatgactgcttgtcttaggtttagactttgtgattctagatatatttatatatggaaaatttgtgagctctaaggtttaccttcaatgaaaaattttagattgctcacccctctcttttttgcaggttggttaagttgagagttcgttttccattattaattggtagttttgcgatgaaagttggttttgaaccgggctaagaagtgaatacgttgaccagctccttgtaccagattcgggtcctttcatttttaatctccataattaaaccagccgcgagtcttgaagaagaagtatgcagtcgatagtttctttcttccagagaatatacatcgaagcttgataggtaatcctaagaaagtaaggatcgtagtcatatttttgtcttagaacggattcttaaggcatctaacaccatcgccaaatttatctctcatgacagttattaggtttcaaaactctccaagattatattgaattgcacaagaagcatgtcggaagttgaaacaaaagtaatgttgctgatctaagaataaattttgggcttgacttaattgtagcccattatataacattcaggtcagtgtataaatcattttaatttattttctttccaaaatcatatataccacaacgaaagcataaaaaccacaaaaaaatattaaatgaaaaatacacattccaagaagaaggtaaacaaatcgtgaagtgttttgtgggtttaaatctctaccaatctcactttctttttttctgagagaacctgaattttttttctgataatggacatagcgagtaccaaccggtttaagaagaaggtttgtgatggttgcagtgaagctatgccaactgggaaaaagcggaagaatgaaaggacgttaatgaacaaagatgtgaatgccaaaagattgaagaaagatgtgaaaaggtgagttctcaaaggttagagtggagtgaggaagacgagatccgtgtgctacaaggtatgatggatttcaaagctgtaacagtacaaaatctttctaatgatatgaacgtaacttacgaaatcctttaggaatatataagcgttgatgtttgtagctatgcatttgtagagaagatgaagagtatgaaaaagaaattaatggagaaaatgaggattaacgctaaagatttgtcttcttcggttccgagttgttgaaacttatttggggatgtgatgtgaaattggcttgttctatcttaagtaagttatactcaacaacagatttcacatcatatctccaaatcagttttaacaactcagaaccgatcgaagaagacagatctttagcgttaatccccattttctctattaatttcttcttcaaactcttcatcttctctacgaactcatagctataaacgtcaacgcttatatattcatggaggaagttgtaagctccggtcatatcatcagaaggattatgccttgttagagctttgaaatccatcataccttgtagcacacgatctcgtctttttcacttcactctaacctttgagaacttacttttcttggcattcacgtttttgttcgttaacgttctttcgttcttccgtttctttccagttggcttagcttcaccagaaccaccacaaacctccttcttggaccggttggtattcgctttgtccattatcaaaaaatgttttaggttctctgagaggaaaagagagcgagaattggtagaaatttaaaccaacaaagcacttgactatttatttacctttttcttagaaatgtgtattttttatttaatattcttttatagattttatgcttttttgtgatatatataattttgaaaagaaaataaattaaaagaatttatatagtgacatgaatgttatataatgagccataattaagtcaaacccaagattggttcgacaattcgtttttggttaaattgatagcaagtgtgggcgtgagtggagattctgtgaaaagaagatggagtttgttgcacacaaacaagataaagatgattgaagacaaatggagagtcttgatgaccaaagaagataaatttgtgttgcaaaagatagagcttttgcatgaagtggtttctctgatcatttacgttgaagcatttactcactagatgcaaaatgtttcttgatttgctttttttgttggatttttctgtccaagtttttgctttatattatgtcattgttgcttctatgtttagaatctgacctctattaaatgtgaaacttcattagtatttttggttactatgttgctctttcgttgataacaactttgaaatgttagtcgcaccaaatttagtaaaaccgttttcttatacatgttacaaagcttgcttgaaggctataacaaaagatttcaaagggtttaacaaattaaacagatactaaatttgtgtttattacggcccattaagaacccaattaagagcgatattgggctaagactgatattttaatattaaacctattacggcccattaatagcccaatcaatatgtaaacatatgcgtcttcgttccatgtctccaatcttatttcttcttacccttttttccaaaatccagaaaccccagagaaagcaaaaccgcgagctctc

SEQ ID NO: 1580 - DNA, 2465 bp, Unknown
  misc_feature (1)..( 2465): cDNA_ID_2141151_gDNA_ID_1620420_Annot_ID_156561 3000 nt of promoter + ATG
aagctttatccctaatatgtaagtcatcatagctgatttttaatattttctccaccttttcgtcaagactagttgtgagccttcctagttcaagtttccaccgatccttgctctttccgcgcatatgagaacctaacacacggagacctaatggaagatgaccagaaagctctgctacttcaaccaccacatccatgaaatcatctggtgccacattttgcttgaaagcatagaggcataagatctcaagtgctgtttttctgcatggtaatttgacctcgtatatatggtttatctcatgtcctaccaatatctgtttatctttggtggtaacgatgatcctacttccaggaccaaaccagcgtgtctcgttagctaaggcttctaattgctctaccttatccacatcaccaagaacaatgagaactttttgcttctttagcctttcttctatcttccatagatgatttatcttcctatctttttggttgaatattatgggcaaaaactctttttgtaaacgagcctgtaagttgtactcgccgccactatcgacaattctttgatagtttcccctaacgttctccatgaaaacagtaaagcggaagtcaccagaaaagcggctgtgtaaaacccttgcgatggtggtcttaccaataccagcgggaccccaaatcccaaccatcctaacgtcatcatcgtttaaacataataattgaaccattttctccatatgggattcaattccaattatgttttcaaaatcatttgacggtgtaccattgagtttggccaatatatctttcgcgatttttgtgagaaaatctgcctcatttttcctgcagagaaaacaataccaagcctaaagttttgtctagaaaaacctatgttataaacgttctaaattttgtgtgaagactattttttttaaatactggtatttgaagcctaagaaatttcaccgcctcttaaatcatgttcatttgcttttttttttttttgtgataatgtgatttatattaagaagggtgcaccaaaaaaataaaactctaaccagctttgtgaatcctctcccgctatatttgccgcttcggtcaaggctgccttccatttattttgtgtctcatcattcttcccttcacaggtttctcggaagcctctcccaaatttcccggtctgatttcttacatcggatggattcactttgtagaaaatcggtattagcctcctctcctccttgcactttaaaatttcaaccaactcatccaaacaccagcttgaagaagcatagttctttgagaatatcaccacaaagatcttagattgtcttacggcttctttgagctccaatccgattgtctggcttctttcgattagatcatctttgaatgtaacaattcccttgctttcaaattctttcatcaagtggctgagaaagtttccgcgaacatcttcccctcggaagctggggaagacgtcatacttccaacagctactagagccagacgaagaacatggagccatgggaataatataaaacaattatttctatgttccttgtgtaatttctatggaacataatacatggagctaacgaatgacccttcttgtttaatttatacggaattaggtgatctatcgactatgtcagcggtttgaaaagttcaaaagtaaaaataagttaatggaggggaaaaaagttgtatgagctaatacatatcaaattttgaatgtgacatataattatttaatgttttttcttagttcaataataattgataagccaaatatgattgattcatattatattttaccattcttaaggacttgacaaaccttgcaatcggttttctaatattatcgtggacttagagaaattattagtctttagttaatcatttatttatgtttttttttgttgtgaaatgttaaatctactattcaaaaaaaaagaatatttacaacgaaaagagaagaagaataaagctcaactaaattttgaatttgaaaataaaaccacgaccttacaactacatctcttgtaattgtagttaagatatgagtttttaaaaagaaaatctaagctaacattaacgggatattatatatgttcttattgttttagacttgaaatcccaacagttcgcaaagcctttgacgttgatagccgctgatgtgcactgcatgtagttttttaaatgaataaagtgaaaaaacaaagttaaaaatcggtttagagtggttttcctccacgaccgcctcaaaccgcaataatggaaatcaaacggtttctattggacacgtgttatactttctatccatcgatcaaataattcggaagataaagaagaaacaaaaaaaaactaaaaaagtaattttcgaaattcaaatccccaaacatcacagcagttggcgctttcttccccctaaaaaacttcgatcgtcgcagtttctctttatcaatg

SEQ ID NO: 1581 - DNA, 3000 bp, Unknown
  misc_feature (1)..( 3000): cDNA_ID_3063185_gDNA_ID_1620420_Annot_ID_156583 3000 nt of promoter + ATG
caatttcggtggcccatctatatcttcatcgtttactactttcacaaacatgatttgtcaaatacttttactagtttcaaagcacgtaatcatgtgttgcctcaactcccactcagcttgatttgctaccacactagagattacatttcaactcctatgagtgcttgaaatttttgttagaccttaccatgatcacgctgaggactctccaacattcaagtaaaaaccggattttctacggtgaaagcggagagcatcctcgtttgcttatagcttcatcaaaccggatccaccttcttcagaatcttctagtggaaatgtgaagagagtatttttagtaattgtcatatatagctatcaaaacgaaaattatagtactcttacgtacaagacctagctcaacaatcggattagatgttgttgggtagattttacctaattagtagttaggactagagcgtagggttttgcataatttaggttgcattaatttgaagaaaatggactgccttgatcagaagaacgttctaagattagaagaggcaaagtcctaattaatttcttatttgaaaacatgtagtcccaaaagcaaccaaaatgtgactttgaaacctgactcttgagggcttatatattacttatcttcctaactaatttcttatttgaaaacatgtacaataataagtattaggaaacctacactattaattctgattatatatttgtttagtataaattttagatttaaactattatcattattagttatggtttaaaaaatagttaagtgaaacacaataatacatgcacttgcaatgtgggagagttgcatcgtgagtggctgtataaaaaaaaattgtaacttaaagaaaaaaatttgtaaagaaatattgaaaattgattaaaataacaatatatgttagttgtcaaaagaaaagacaaataaacgaaggttagttgtaaaaaggaagaacatgtaaccaaaaaattagctgaaagcctaaaaataaatataataatcgactttggattaaaacccctgtgctttaaggctcgaccagtataagccatttgcctttaagaataaaagaaatgaatttcatgagcatactacactaaaatcctttttcttcttaattttcagtattgtcttgacaattttctacacttcatcattagtaaacaaatgcaaataaaacagtggaagaaattcaagattcccttcaactttaccactaatttaaatatcacagataagatgaaaatatatttctgagttactaaaacactgaatccaacattaaacaacgcttcttccccttttgtaagctgaacaagagagccctgttggatacgaggatttaatttacactggctgttttgaaggagatattgagattctcatcaacaatattaatagttcgtaaaaaattgcgaaatagcaaatttacttatcgactaagtttaagtttaagttttcatccatatgtattagtttcacaaaagtttggaccataatgtagctcataatcttgctaaatttagttgtattcactcctttttctattccaaaaatgtaactcacccgcggtggcttagatactttttatctcgattatttgtattcgttatttaatttaaatcaaataatagtatatataatatagaaatagtcgaatcaatttacatgaagagacgaaaaaaacaagaaaaaacaaaaagagagtcgttggaatattcctactacattctggatgatacccgaattaaccgacccatgtatgtaagtatgtaagtatgtaactattactcaataattaaatcaacttcttcttttttttgtcaaagaaatcaacaacttcttatggcctaccacaagacaaaacatgtccacttacgaatatggaccatgatcttccacattaacgtctatgtattaacatagccattgtgaccgactctaatactcattagacgtgttcgtttcatagactagtgttctgattttatacgctgtagtattaatgttttttgtcttagcaatttctgattcgaatccggatacataaacggcctcataattgtactcttaggcttcaatcagatatcttataatgtaaatagtatacacctaatttattaattatactcccaaattaattaatatgtacaactagtatatatatatatatatatacattttgagttttgaaaactaacttaagcaccattcaacttagagaagacatgcaaaaatcctccaagtgacaaaatatccaagatcaatctcgtacgatctaagaaaattgcaaatcaaacaatgatcctattttttttttttaaacccttaatctaagaatctaacaatcgtaacttgttggagagaacggaaaccacaatcgtttccaatcacaaccttaacgacattgtttacgtcaaggttaaattaacccccttttaaaaaaaaaatatgatcgaggttttattgcagtttcttaccacttcaactattaaataatttttaccacctactgaagaggtgaaccaagtgaagaaaagaatgttgtagacacgctcattgaatgcatatacaagtaggtatatgcgtatagctacattacatgtacatgtatatgcatgaagtacgtatttaggtataaaagtatacatagtaataaatatcttgtaatcacggaaaaagggtcgagagggagggaccaaaggttagaaggagaggtacgtggagtgtcttatgtgccgatggtttttaggatggacaatacataacttttaattccaccgcaacgtggttcattccttcacctatacgaagtcattttcaaaccttactatctttctcccttttgtcctctcctatattaatcacctggatggtttctcctattctcactaactcactctctcactcaagggtccaaaagtgttttctctttttcagtttctctttctctttttgacagaagagaccgagaagcaatg

SEQ ID NO: 1582 - DNA, 3000 bp, Unknown
  misc_feature (1)..( 3000): cDNA_ID_3063208_gDNA_ID_1620420_Annot_ID_156568 3000 nt of promoter + ATG
atctctgtactagtagaaaaaaagaggtctttattctgtatactaattactaattagagctaaatcaggatgagtccatcgcaacttgtctaattactgttagccaagaccaccctagagtcaatatcatatgttaacaatgatgtaaaccttttagtattgaaggccaaagtagtaattaatccattgactaacttcttttaaaccttgagacagtgaaatactaactcattcaacaaaaatggatcaagaacaaggaaatattctgattaaagccaatgtagtaattaatcgactgaataactaacaattttatgattctgattaaagccaatttattcggttatattcggtttacatatttgatttagaatgtttagttttattggtttggttcgagtagaataaaatattcactgttcgaacaacaacaaaaaaaattccttcatttctctctcagccctaaaaaagcttcacgccggtttgtttcaccgccgttgtgcttcttcttcttcttctacctgggttctctctcaaacaaacaaatctccgacgactcattcgttcctcccaggtaagcttcttcgaccaattttactttcgcatttttctccgattcacagaccctagctgttcccattaatcaggatttagccagaaacttctagggatctaattgtttttgaatctgaatctgtatttgagtttaacgttttgtctccttgtgtagaatcagaagatttagtgaaatggctttttgcaataagctaagccgtttcgtgaggaggcagagtgagaatgcttccatgattggctctctcaggtctttctctgctgatgccactcaccatagattccaccaggagactcacaattttcttgagccagaatactatattggtagctgggaagctccgagtgatccgaaagatgcagagagaaagcttgctcagcttaggagagattatgctaagaaagttcgagtgtatcgtaaagagtacattcatgagattgagatgcttcgtgttgagaaacagcgtaaggatgaggctagattgttggctgaacgagctgctaatgaagagaggcgactcttgaaggctgaggctgctaaggttagagctgaggaacgtaagattgctgacgaagagttcaggcaaactctggtgagttcactttctctcttctccgttctttgtttattgtatagaaaccatggtggatgtttgatcaagtagttggattagtgtgagatgattcttgagtaaataggagaatgggtttgtctggataaggttcatctagcatgtggagaatcaaattgttgttttcctcttgaaaatttggaaccttttcctagttatgcatcagggtgtagtagtattatatagaagagaacttcaaggtatagtattatgtttgtgattggaagagaactttagattagagctgatggagatgtatgactaagagctttgataaacgttgcttagcatcaagtggaggttttgatgaatcctgtagttatcattgtctccttacattagctgttgttgttctggttacagctttagcatcgtacctaacaatcaaaaataagatggattttgatgctggatcttgatgcttttaatgggaattcttttgagggcagtgaaacttgttagttagaagcttcctttgttcgggctgtaggtagatgagacatcgcacacacacacactgaccaaagcagtattcactgattcattaattgatttcacgtacttatgtctgcaaattaattcagaagagtagtaccactcctaggtttctatttctagtttgagttcctcatgtttcttggtcacagcctcagagcagtaatggtcatagtgcttttcttcttaaagttgtaaaactgattcaagcttgattcactgactggtttatgtgtttaataaactgtagataaaagaaagagcagaaaagctagagatgtggaagatgatgggccaaaagagggaagagaagatcaaagagagagagaagctactgcgtgaacagagttcactatggatcgagcaaaaagaactggagaggaagattacagaagccttggttgacaacgttgttctctaaaccaaagcttctcctctgaatctttgtttaagaaacaatcactttagtccttttgttgaagacaagtcttttttttttcttagagaagaaagcgaaggctgttttagcctttttgcatcaagcacataatgagaattgtggtcttgtgaccaatctcttgtttgttgtggttctggtgtcgtaatatcatcattaataagaagttttctcttgttgattgttatcagtagaagattgttttttggtaaatcatcttcctcattggtttcgaatataatgaacctaggcccaatagttaatcgagtaatgggcttagtaggcctatcagcgtgacatgttttgtaaatttatacaatgccatgagggacaatattgtagttttctataggaaccgaatttgtaaatttctagaggcccaatagttaattcgagtaatgggcttagtaagtctcttcaatgtttgatcgacaagtacaagaatctttatcaacggttcgtaaaaattgtctacggtgatagaaaagatgaggctgtaactagggttaaagtagatgatagcccgcaaaaaacagagtcggataagatcaatttggagggaaaaaggaagagaggaatgttgctggaccaacctgagagacctctcaagaaaaggagaaaatttgctataagctaatccataagaaaaaacaaaggccggtctcatcaaaagtactaaacaacacttgtgttgtgtagagttatgatatctagggacataaaaatctaaccgatatcgaggaagatatgtacaaatgcgaagatcagatgttcgaggtagatatattgatgggagctctaacaagtgtagtggagagtgcataagaagttattaagggagag

SEQ ID NO: 1583 - DNA, 3000 bp, Unknown
  misc_feature (1)..( 3000): cDNA_ID_2141183_gDNA_ID_1620420_Annot_ID_156569 3000 nt of promoter + ATG
ttgttctctgacagtttttttttttgtttggttacaaataaagatgccagtaagtgtaagtgtctttttataagtttagttctgaagtctcttgtctttcttttactctcttgtccgaaattgcttgattctcgattttgacgaagcttgaaaaacaaacccagttcgttaatggtttctgggtcttcgtcatttcactggatccgttagaaaaatgattcctttttgttatctattgattcccgatctgaatttgaagctcttagtatgtttttattcaggtggcactagttttgctgttgacattgagcagtgtgattctgattaatgggagaagttacggcgtcggaaacatatgcgatcgtggtcggagaccgagcgagagaccacacagtgtcaaaatcactgattttggtgctgtgggagatgggaaaacgttgaacacacttgcgtttcaaaatgctgtcttttatctaaagtctttcgctgataaaggtggtgctcagctttatgttcctccgggacggtggctcaccggaagtttcaacctcaccagtcatctcactctctttctcgagaaagacgccgtcatacttgcctcacaggtctgtgtgtgtgtctctctctctctctctttgtctaaagtcttgatcattctaaagagtaaagatcagagtttgcagcttaactgtttcatagacttctgattagcttcagagaatcctgtttttgaattgatgtgtagaaacccaaatttggttcagtagttaggcattgtggcttaggatgacctctggctccaattgctagcaagattggggattataaaaggatatatctcattgcgctggttttcagttaaatcaatatatatatctaccaatgttccatggttctgcattgttatcagtcagaacatttgtgtatttgtttctcattttgtcttttatttgttgttcttacctcaaccgtgtgaaggatccatcgcattggcaagtcacggatgccttaccgtcatatgggcggggtattgatctaccagggaagagatacatgagtttgataaacggtgacatgctacatgatgtagtagtaacaggttatatacatattttgttccattcatttcattttgtttgctaatgctaaataaaaactcactgttgtataccatattcattggcttaggtgataacggtaccatagatgggcaaggccttgtttggtgggatcggtttaattctcattctttagagtacagtcgccctcaccttgtcgagtttgtctctgccgaaaatgtcattgtatcaaatcttacattcttgaacgctccggcttatactatccattcagtttattgtcggtaaaaatagtttgaaaattccctcttattattatacctcctttggttttgaaatcatttggtaacctcttgactcgttttgcagcaatttatacattcatagagtaacggctaatacttgtccagaatctccttataccatcggtattgtcccaggttagttgttattatccagatatatgtgtaatttgaaacaatttgttgcagcactaaaatctcaaactgttatttttttcagattcttctgaaaatgtgtgtatccaagaatctagtatcaacatggggtatgatgccatttctcttaaaagtggttgtgatgaatacggtttatcgtatgcaagacctactgctaatgtccagataagaaatgtttaccttagagcagcttctggttcctccatttcctttggtagtgaaatgtctggtggtatatctgatgttgaggtcagtgatgctcacatacacaactcgttatccgggattgcctttagaacaacaaatggaagaggtggttatattaaggagattgatatttccaacatccatatggttaatgttggtactgcatttctagccaacggtagcttcggtactcatccggattctggtttcgatgaaaatgcttacccgcttgtgagtcacatcaggttacatgacattgttggagaaaacataagcactgctggatatttctttggaacgaaagagtctcctttcacttcgattttgttatcgaatatctctctgtcgattaaaaactcggcttcccctgctgattcttggcaatgctcatatgttgacgggtcttcggaattcgtagtccctgaaccgtgccttgagctgaagagttttgatagttactatggtagagctgaggccttatgaaaccaaacttcattaggaatgatgattcatatttgtttaagagagagcaaatggttctgattcttttcttttccccaaaaataaaccacagtgtgtagaattattacctgttccttgttggtgttgttgtccctgttatttgcagcttgtgagattaatatatcttgtacaggttcatttcttcattcatgtgtaaccaaagaaattttgtattagcccagtaaccagatattaatttttttaaatatttgggcctcgttaaaaagcccagcccaataacaaagagctgcttcgtaaaaagagacgtcacgaaaccattcgcttaccaaaccacacagagacacatctcttcattttccaaccatcttcttcttttcgccacacccgtaaatatttactttttctcactatgttcaacttattattattaaattaactaatttagtgtatgccactagaattatttttatataaaatatttttcatcaccttcctgattagataataatataatcaaaaattcacccatttccttcatcttccccaatctctctaaaaccctagaaactcacttcctcagtttctccaactctgtacttcgtatcatcaagcgaaaccctaaaagaagcaatctttagtctcttctcttctttattttttctggggagaaagaaatttcacttttttttatccgatttctgcttcatctgggttttggatttttgcgatcgattttgagaaattagcaaaca

SEQ ID NO: 1584 - DNA, 3000 bp, Unknown
  misc_feature (1)..( 3000): cDNA_ID_2141187_gDNA_ID_1620420_Annot_ID_156570 3000 nt of promoter + ATG
cctattcctatggttgcggagtgtatgcatagctttgttcacttcgttgcatatagtcactgcaaaaatacacatcgccattaatatggagagatctagtccaaagcatgtcatggcctcaaatataggtcaaaatttgggagaaatgttttaggttttttttttgtcaacgactatatgaaaaggggaacaaaactttttcatacatttgaaaatgttagaccagctttgaatatagacttaaataaacactagatcaacttcgaaaatggttaaatagctaccttggtattgaaacttttggagatgtctctccaatatcagaagatacgatggatcttcatcgaagactaacactcgcaaaccttcaggaaagttgcttgaaaacatatcatagaagtttgttagatttctaaatggaccatcatcaccgtcggtcaagactccacggtgatccaatatctcagccatatttaatggctgcatataaacactctgcgtgtttttgtgaaggtgtccggccttttaaacgaaggaaatctgaagaaatctgttttttttttttttttttttttttttaaagattgtgatcaaattttgatattatcttatacaaatattaatgtcatttttaagagtaaaattaggaggtggaccccaaaatcatcatcttgttaacagatttagaattttgaaaaattaaaatcgtaacaattaaaaactataatgtgttaaaacaattaaaatcctctcctaagataacacgccaccatctattcgttttaataaaaccgttatcacgatcttcatctctttttgcaaagcttcttcatgatcataatttgagtttttcaaaattaaaatggatcctctaagcttttatttatttatttaatttatatagttagatccaaagctaaacaaaggtaaaaaaaaaaaaaggaataagattcttacaatttagaaaaactataaacattgtgaggtaaaaactcaactaattaatgtatgtctaactatcaaatataacaaactaaacattttgctataaaaactcaaccagtcagtttaaaacactcataaacataaaattgctatatagagaaatgactcttgtgtcaaaattaaattactatccaaattttccttattgatttcaaaaattcaaaatttgtaattttgtttcatgtattttcttttttgaatttttatttaaaatattttagtggatttatcataaggagtttcgaagttaacattagtgatatgaaaatatataaagagaaaaatcaaacagaaacaaaagtttaagagatcggatgaaactaaattggtcgaaatgaatagatatttaatcaataacaaaaggaaatagctattgaaaattgtgaaaacaaatgacagaaaaatggttttgagaaatatgtcaacaaaaaaaaagagttggaattaagcatcaaactacttctataaaattttaatagagatattcttcactaattactccaacaacctttaatttttataacaaattgcagtttttaaaaaatcataagtaaatgaatgaacgatgaagtatcacatttatgttaatttcagttcgaattatgaataaaaaaccaaaatacttgttaagaaaaaaaaaccagtttgtttttgttcttaacaaaaaaaaggaaattggggatctttttgtgcgtgaccataagtatttttactttacaaaatttgcatgcataaattttagtattaaaataatatatttactttataaaaactcatatgatattggctctaaaaaaaataacaagactaaattaaaagtgaagttaaccatgataactgtaagaaacattgttaggattaaaatcttataaggtaatatcatactttaatttatgaaaaaaagaaagtcttagagagccttacttattaattttttaaataaaattctcttgaacaatatcttccttttcaaatattaatgtaaaactttttttttttttaataccaatattaatgtaaaacttatgtaaaccaaaaccttctacatcgtcgttagcaaccggtttaacaatttttatgagttgctttctttttttaattatcactttaggtgactctccttttcagttgcttttaaaccttgtactgttctcccacttctccttgcttatatattgatcaaaagctcttgaaatgtaggaaaaatacggttcatataaaacttccttaatcaatcttagaagaaaaatcggaaaacttttttgatcagaagtttcgttcgatatatgtcttgagctctagggtatagtttcaaagattctaacatgagatatggtcgaagtcaaagtcaaaagaccttgggactcaacacgtcaaatcacgaagcttataatagtatgtccgatcaagaaaagatacaatgctcgatcaattgattttaatattttatattgtaaaaaattatataaaaaaaacacattcctctccataaaaattttgtagtagattaaccattatcaaaaataatagtagcataattaaaaagcttaaatatttccccaacatcaagaaaaccaaggttgctaatatattttttttgtcagaatttttaaaaaaatagtggttcatgtcaatgtcatttgctatccacttttctactaaaaccaaaacttggatacaaaaaattagatggaaaaaggaaggaaaaaacaaaaagcacacgagccagaaaaagtcacacgtgtgaaagtgaaacataatgaacgcagtacaaaacacaactaccactagtttcggtttggtcaagactgtaaatactcaaacaaactccgaaccagtagtagtagttctggtcacagctctttgtttccactctctctctctctacctctcacatcgttctacttctagggtttggctaatttagattcaacatctcctttaaaattctctgttcttttgtattcctaatctttaacaatttaagaagaaatg

SEQ ID NO: 1585 - DNA, 3000 bp, Unknown
  misc_feature (1)..( 3000): cDNA_ID_3063192_gDNA_ID_1620420_Annot_ID_156578 3000 nt of promoter + ATG
ttgacggtggtggaggagaaggtggcggaggagatgattggacaggactacatggattgtcgcatgaagaacacattgtacaagaaacaacctcgtcttttgatgtcactgtcggtgtcactgacactagcagcataacaacaagtgtagacaaagtgtataaatggtttgtttccattgtcagaaactggatttagaaacttaattttgtgcgaagaatatacagaggaagtagatgagagagcagaggagggagaaagagtaggagtgggaaagaagaagaagaagaagaagaagaagcacgttcagaggaggagtgttcttctttttatcgatggcttttacaaataatttataaataaatattttcagcataaaaaaggtgttttaataaagaaacaattagtaaaagttcggtggagtgtattaagaatttatctgattcttataaaatagagtttactggagattaattattggagattcttgggatattatatttatcaatagttttgtgtgtgaaaattataattatccattgcagatacaaaattattgtaatttttgtggtgcatgattttatttattcaaagcatgattttagtagtcgaggacgtagaattttttggtaaataattttaatttagaaatcacagtgttttaagaaaagaaatgaatagaatgcaagaaaaagttgacgcggacacgttaacctttttaaccaaaggtcttgtaataaagcaccggaaatacgcggatgtcgggggcaaagacgtcacgtaatctcttgaaatgtagaaattacgatgatacctctagtcccgtggcgacctcgtggcggctgcgtcgacgagccaagtagggttggggaaataaaagagaatcttcaacaaaagtcattatagtggggcttgactcttttgcaagctttcacacgtggacgtaattcattggttttttgttttatgacgtggtagctttagaagagtagacgtgaagatgacggaagtcccctacttaagcgattagtgtgaagtagcgttttttctcatcaacaacttctttcgtttcgacaataaaaacatatgagaaatttcgttgagtagcaaacaaaagcaaaaacattcctccatatataagacaaacaagaaaagttcaaagctctactaattagcgttgtgacttcaaatgtataacatcaagtttaaattagctctaggtttaaccatggtatgatcagttttatccagtctagacaatatgcaagtagaatatcaagttatgtggtatttttttccaaacaaatttcattattaacattaaaaagtatttatttaaaaaaaaaaaaagaacattaaaaagtaggcaattttacgaagcatttaaaacatcggatcgtcatgattataaatggcgtaaaattgggttacgtttttcttatttcataatcaaattaataaaattgggtcactgtatcagcagtgagagacttggaacataccacatgttcggatgttatgtcccgtattgagatgtcatattttcatagcaaaagaatatgtgaacattgtggaagagaaactaagtcacgaaacctagtggataggtgttgagcacatattttttgcattctataagaactcattttatcaaaaatatcataatcgaagtaaaatgataccgctaaaacgactgatttagttaaaaaagaacaagaaaaaaaaaaaaaaaatgtttcctgtttgtcttaatcttttaggtacttaaaataagatgataccaatcacaaaatctgagcaagcttagactcttagtttataatcaaactgaacaggcgattgaagatgatcacaccatgcttatggtgatctcatgattaaagttactctgctttttaaaagataaatattttgcttgcttttctgactcaaatcaattgttaatgctaaaacattttcatgttaacaaagaagaaaaaaaaaactggaaagtcatacaaaatcttaaactaatctctaaagtttgcaaagtatgtgaattttgcaatggctaaagagaagatgcgttgcagcgttgggttgagaattgaactctggcttaattagattcaaaatagcaattcaccatcctactagttattcgtttcgtttaaagacaacttttatatttcatttgattgttgaggaacaaaagttggttatataagtgagaactttttgctttttgggtttcaattgaataaaaacaaaaagttgtcgtcgatctgtgaaattcaatttatatctatagagagcatttcttctatttattgggccagttcttagtggcccaataacaaaaagcccaataaccctattggagaactgtattactctacagtcatgagaaacaccgctcaattcatcaccggaattaacaaaaagagtttgaaattcagaattgtcatcttttgtttcgatcggattccttattcgtgtatcttctccgattcgatgggaattggctctcatggcaatggtaatcaagaggtttcgcgttaatcaaaaggagtgaaacgatggcgttttgtatttggtgtttaagcaacttcagttcttaccgttttgagtgttgatcatttgtttggcagagaacttaaaaggttagatctttcttctgaaatgatttcattattaattgtctgcttgtacttgaatcatgttaattatgactgagcttttcttcttgaggatgaggaaatcgtaatggctaatgcatacaatttgtctactaaagattagttgaagttgataatgctaagcacgccacaagtatatgtcattatcatatgaatgttttgtcacagaagatattgacttcgtataatatatattttctaatgcaacttggtaatattcaatgtcaaccagtagtcgtagtccttgtatatatctggacaacatcaaacttttgcaatgtttttgaatctctgattgctatttatcttttgggctcaaacca

SEQ ID NO: 1586 - DNA, 3000 bp, Unknown
  misc_feature (1)..( 3000): cDNA_ID_2141196_gDNA_ID_1620420_Annot_ID_156574 3000 nt of promoter + ATG
tatataataaatgtgtgaataattatattttcatgcaggagctgttcccaaaaaaatattagatgttatgaaggttgattacatcagtcgagaaaacgtagccagtcatcttcaggtaacgtttcttatatacaacataattgttcattttcaacaacatttttgcttttattcttgaatagcatctccattttttttatacttcaaaatggagtaagatttcaaatctatttagttattgattttcagaatgaccctttataatttacttatgaaaattacaaattcaacccatatatttgtaattttaccttagttatgttatactctgatccctcatcattataagtgatgtttaaggtttctacacataaattatgaaaacataaatctttcatttaatatacctcttttacatagaaacaaaactaaataaaatgaattcaaccaatttgaaaacatactctaaaatataattggtcgaaaaaaacaacatttagatattgaattattgcatagaaacatgagagcatcacttaaaatgaaacaaaataaattttcttaaacatcacttaaagttatacatagggagtaggtaatatatgtcattttaatattaaaatattagttaaccacataattaacattattgtttatatgttttaactatgagatagtagcaaataactttatttgagtataaagtaaaaaaaaactataatttaatggattgagttacaaatttttttctataaaactaaaaaaaaaatagtttttaactaaaaggatagattaaaaaacaaaaaacacaccacgaacccttccaaactttttacctcaccttgcatcggtttcaggttgctcttcagatccaatcgaagaaggaaggatgagacattgtgctcttcccttctcccactctttccctgcatctccttggacactcccttcagatctgcttccctttgtaggaaaggctacgaacccctggaacctcaacacaaccacggtcagagtctgccccattttggcatcctgaagtgaacctagggttttccccagtggacctagactcttctgttggcccattacctataataaggtccaagcccacctgctggtttaatcattctaaggcttttaatcttaggtctgaactcattattcttatgcttagcccattactttctttgtgtcgatctcctctgttctatggtcatggactccatgtgaaagagacatcaacattgacggtttgggttttcatttaccttatgcgaaccttggttttagctacctttaaggctttatggtatccttataaagaattgaagattgttgtgctaagttccttgaatcgttcttattgttgtggcatttgtggtattggattattctttttcgttgctcatttgccactaagcagctcacttttcgtcttcaaacactgtaccctctttatcatctccatcttccagaccatatgcttcatagtctttgccgctattgaccggagagatcctcattcgagttggtttctaaagccaccctcacctgactatcgcaccatagtctcccgaatccttggtatcgtgttactgtgggtaatgaagcttgctccggcgagattcatatcattgatccgtttgtcaatgtcactatatccttcgactgtgactaatccgtcgtccttcgaactcttcgaggatgatctctcgatttaccgtgacctctcatggtgcattgcgcttccttgccttttccaaaaatgatattttcacaatttctctttacaatttcctttttttttttgtggtcaaccgattttgcatgtttttaattagatgatattaaaaatgtaacagattagaccatggtgttaccagtatgtttttatcagctgaatatcttagtcatcattacccatatttttgatcactctactaatagagatgttaggagaaataatagagaggtgttcacccaataaaatgcttatagatcatcttttgttagttattttattttaaagttatgtgtattagtgtgattttcagatttcttctgataacagtcacagaggttttccgtttttttaattgatattcatatatagttcatgacctcttacttattgttttaaatcatgatacagaccatactaagacatacttagtagttaaaattttgtatttgctttctagtctttcttttttgggaactttaattcatgggtagattccattcaactattttcttatttagaaataaagtagttctttcttttcttttgttggtaaaatattagcatgatttagctctttctttctttttttggtaaaattttaacatgatttagttcttattgaactgttggggataaataagtaagacaataagacatcatatacataaatcagagtatatggatgttaatatactagttatattatcagaaagctcaactaattaaactacaccaaattaaatatggttgacacaaatttagagtaaaatacatttaaaaatgtcaaaagataatccttatttggttatgttttaatatatatatatatcgtactaattttcttttgtcctgaattgggtgtgtagaaattccggctcatgctgaagaaggagaatgatgaaaagattaagaaagaggagatgaacaaatctttaataaccccacaaaatggaagaatgtatgttggagaagatccatcaaatttctacagaggaagaaatgatcatttcccaacacatcatgtcaacaatattcctcaaccttcttatgtgccgcaacacaccttgaaccctaacaatctcaacacacagctcataccatctctcggacatcattttgatcatcgaggctctattgtggttcccgatacaaacctagagatgaatcaacaattttttcaccaccaacagacctcggacttcacgccagaagagaatcttggtgataacaactttactgaggaagatttaatg

SEQ ID NO: 1587 - DNA, 3000 bp, Unknown
  misc_feature (1)..( 3000): cDNA_ID_3063220_gDNA_ID_1620420_Annot_ID_156563 3000 nt of promoter + ATG
cagatgatctgaagaagtgtcttgataactttgatgggttctcaattcctcagattgaggactttgtcgaagatcttcgtgtttggcttagtggctccattgcttatcaacaaacatgtatggatacgtttgaagaaactaactcgaaactttcacaagacatgcagaaaatctttaaaacatctagagaactcactagtaatggccttgccatgattactaacatctctaaccttctcggagagttcaacgtcacaggtaaaacattttatatacatgtttaagtcttacacaagaattatgaatgaacaagactacaatttttggtggcaggagtaaccggggatctcggtaaatacgcaagaaaacttttgtcggcggaagacggtataccaagttgggttggaccaaacactagacggctcatggcaacgaaaggaggtgtgaaagctaacgtggtggttgcacacgacggaagtggtcagtacaagactatcaatgaagccttgaatgcagtgcctaaagccaaccaaaagccatttgttatctacattaagcaaggtgtctataacgagaaagttgacgtcaccaagaaaatgactcatgtcactttcatcggtgatggaccaaccaaaactaagatcactggtagtctcaactattacattggcaaggtcaagacataccttactgccactgttggtgagtccaattctgtttctaatccctaaaaattcccacatttcaaccacaaacataattatcaaaaatttgataggacttaaattttatatccaagttggtaaaagtgatatgaagacatttagtttgcaaaatacccctatgttgatgaaaattgcgagctttatatttcatggtttcattcagtgacacttttttcatttttaacatgctatttttcaatatgtctcccgtaattactattttgctacttgtttttgtgcgatctagttaacccaatttaacatgcatactttgttacagcgatcaatggtgataacttcacggcgaagaacatcgggtttgaaaacactgcaggtcccgaaggacatcaagctgtggccctaagagtctcggcggatttggccgtcttctacaactgccaaatcgatggttaccaagacacactctacgtccattctcatcgtcaattcttccgtgactgcacagtctcgggcaccgttgacttcattttcggcgatggtatagtagtcttacaaaactgtaacattgttgtgagaaaacccatgaaaagtcagtcttgcatgatcacagcccaaggccgctccgataaacgtgaatccaccggactcgtgctacaaaactgccatattaccggagaaccagcgtatattcccgtaaaatctataaacaaagcatatcttggaaggccatggaaagagttttcaagaaccattataatgggaacaaccatagacgacgttattgatccagcgggatggcttccttggaatggtgattttgcacttaatacgctttactatgctgagtatgagaataatgggcctgggtcaaaccaagcccaacgtgttaagtggcctggaattaagaaactatcgcccaagcaagctcttcgatttactcctgctaggtttttacgtggtaacttgtggattccaccaaatcgtgtgccttacatggggaattttcagtagattccaattggtgaattttccactttctgtgtgctctttaaaaaaaaaaatgaaggtgaataatttatatgcgtgtcttgtcttaaagtcctgacttgccgaatctagtatcttactctcagccaagttactacattgaagataaaaggcttgtcgtgtgctcttaggacaaaattggtcaggcttggatctatgtttttggtacaaataagttgatcagtaaaactcatatagatttgtggttgatcattggccttatcattgtacctttattactaattggtaccggttcctcgaggtcaacgtgaagaaccagcagaattacaagcttgatgttattgatttttaggttcttgtttcttgtaattttttgatttgttttgttttattttagtacagattctagtttaatcatttatttttcgggtgcgcattctttaagattgagtttgaatgtatttgggaatggactaaccgaaaaagaaggtggaaagtgacaagagagtaaagactgaagagagtattaaatcaagcaaagcacctttactcttggaacccctaaccgatgtctaacaacaaatatcctagtttctcgatatccaaatccactactttcagtttcatggttttttatcttcttcttcttccactaataaatcaatgtaactatattacttcagggaaccactaataatataaacttttttgataaaagtattatttaacttaaaagaataaaagaaccatttaatacaaagttctagcatcctgaattttaacctagttcttgtattaaagaaccactcgtttggagtaaagtgtcatatgctttttgtgaaagtcatctcaaattcttaatggttattacataaacatagtaaatgtgtggaagaataaatgatgagaaggacccatgcaaattccttggtagtattaaatgttcaatggatcttaagattttcaaaacaaaagatatagtattacttttccgtttctagtgggtcatatatacaaaagcaaaacaaaacaaaaatcgtcaaaattacgacaatgttttgtataataagaaaccatacccatgtgattggttacagaatacaattctaactttttattatttttaaatacggatctccatttttttttttaaatagcttgaaagtatttgggatatagattatagactaaccgaaaagaaggtagaaagagacaagagagtgaagaagcattgaatcaaccaaaacactaacactagaacaccttttctcttgaaacactaaaaactaaagtcacttcaccaatg

SEQ ID NO: 1588 - DNA, 3000 bp, Unknown
  misc_feature (1)..( 3000): cDNA_ID_2141155_gDNA_ID_1620420_Annot_ID_156562 3000 nt of promoter + ATG
acagaacacaaatagacaaaaaaaagcactaactgtatatcttgatttagtttttgtgaatctaaagagaaccataccattctacaacacagacagaaaatttcacttaacctaatcactttgaaccatcatctaagttggttaagcttgtttgttattatagttgaaaaatccattcacagtagctagagttgtttttgttagtgatgactataatggtaaactttttctccctcaatctatacgaagagtgagaattctcttattccctccatacacatatatacacaacctttctgtaaactaagtttgggtttgcctttacttattttggcagaggatcggagagatccccgagactgtggagatggagcgtggtgatctctacgttacaagattgtataaagagcaatcgaatctggccaaattgacttttgtgtagtgaatttttatattgtacgagcttcctaatgtcttgatagaaacttttactctgtagatcgtgcattatcgaattttgttgttgttgtcatctgtgtttctattaataatgccattaaaagatataagaaggaactaaataagtttgcgaaaaaaaaaaaatccccacaaactatgctcaaaattgaaagataaataagtatattaatttgaggttttcaatgtatataaatctgattaactcatatgattattcatttaatagatttactagatcataacccgtgctatacagcacgagcattaatattttgtataaattaaattgtatactttgtttgaattacataaaaaatagtatagtataaaagtgatgccataatatttttcaatgttttactatttacatataatgctgcattagattgactttgtttaaaaatgttattgttataataaatacaacatatgtagttttaagtaaatgtgtaaaatttgtatagaagttattttggtaagaaacatgtttcctttgtattagaggatctaatttttggcctaatttagaattagtttttgtatagtattttggttatatttgtggacctaattggggcctatattagattatctttaatagggctgacgaaaaaacggacccgataaccaacccaatactcgaaccaaaaaatcgggttagggcgggttaaaattttaggaaatttccttattgggtagagttttagtaaacccgtggatatccgattggaccggaaattacccgttatctaaaaagagtattcaaaaacccaaacattaatttaatatccaaaatattaattatatgatattattttatttgattttaaatatatagtaaactgcgagttgtatatgttttcttgatattatttatattgtttagtgtttaaaattatacacttgtattttgattgttaattttagagtttcacctgtagtataccatcttatattaatatcgatttaaacccgtcaattctaggattttccagcttgtattaaaaattgaatcacatcatacacataaaaaaatctaatatgttattaattattgttgtatataagattataaattcttaaaataatatgcatgaaattgaatataaatatttaaattatgacccagtacttagtaataaatttttttaaatctatttttgacccgttataatatttttttatgtattgaacagtttatattcgtttttaaaagtttaaattatggcatatgcgaaaaaactctaattatttttttataacgatgatattattttttcgcaaaaatagaatcatataaagatgagaggtgaactataataattaataaaaaattaatatgataatttagatattaaatctaatttgttgattttaattggttaattttttggaaattaataatgtatttcattttttaatgaaatttaattaattaaattagtatttgactttttaatttttaaagagatgaattactttactctttaaattttatttctaatggcatacatatgtaattacttacaaaaagtaaggttacatttaaaatgtacttcccaaataatatagtaggatcatggtaaaatgttagttctcgaaagaaaaaatattgttataaatcataaacctaacgagctaactaaaatagcggcatcctaccaatttgagatttttcgtatatatattaaaattatccatttgataaacacttcatgataaagtattagttttgaaaataaaaatattgttcttgttataagaaaaaacacacacataaaagtattattggaggatctcattgttaagttgttaaccctcaacatttcgtctaaaaatcagacttttttctatcaaaaaaatatctatactttgtagtcaaataaaaatcttaatcaaaataatactcgtatactttgactgttgactgatggaaagatattagaatataaacattagagatagaaacaaatctgtaaaaatcttaaaattaggattatttatacggaatattccccaaaagataaaatcattgaatcataaaaagccatttatggtagccctaaatattcaggcgcggctttttttcttatttcgttttcattttaaaaaagtttttagcgccgtttattgccgcgcgtcgttttcgctcctcgtctcgtctccttttattattaccccctctctctctctcccactcttcctctcaaatcacacatcactgctttcttcaacctctctatctctcagaccaattagggtttcgcaatcttccagtagatttcgcttctcaacgtaagtttttctctataatctgtgtcgatttcagtctaactacagtgattgttaaaccctagactcggaaattttcctgggctttgttattatttgcgtcggtttagtcaatgcgatgtagtgaacgcttcgattacatagatttgtgtgaaaattttatagtccaattgcgttatagtgatgattttgttggtaattttgattttgaaactagggattttgaaa

SEQ ID NO: 1589 - DNA, 3000 bp, Unknown
  misc_feature (1)..( 3000): cDNA_ID_3063260_gDNA_ID_1620421_Annot_ID_156594 3000 nt of promoter + ATG
ccttgagttgtttcttcttctttatagccaattcttgattatctaatcctctatcaaaactttcttgcagctatctggctcctgagtatttccagcatggtaagatatctgacaagaccgatgtttacgccttcggggttgtgttgcttgagctaataactggccggaaaccaatcgaagcaagaagagcatctggtcaagaaaatctggttgtttgggtatgtcatctaattttacaacttgaatgataatgtgaccatatcctaaagtttgtgtcaatacatttatgattgttttggaaaaagatttatatgtattctttctataggcgaaaccgttgttggatagagggatagaagctatagtggagctgcttgatccaaggctaaaatgcacaagaaaaaactcggttcaaatggagcggatgatccgtgctgcagcggcgtgtgtgatcaatgaggagtcccgaagacccggtatggaagagattgtctcaatcttgaaaggcgaagaaggtgtagagccagaaacacattcaagcaggaaaactacaaatatttcgggtatgattgactcttatacacaattgcaacaaaccaaatccgagatgaaatgtcatcttgatcttgcgatgctcggagtaaccgagtttgaagatgatgatcatgtgtacggccgataaaagattctaagaaatggatttaaaagtgtgtaaataggtatttatgaaaagtttgaaacagagttcttagtttctgaattagtgatttgctgtgtgtacattggtttcgtttttttttttggtttctactttggagaaaaccggtttaggttttgattttccggtttggttatggagacagccgattctccggtttcgttttcagttttcaatatttttgggcttttttttttgagaaatccattaaaatgagggttggaattgttatttatttgattaccttttgtgaccacgtatttgaaattgacttaaataatataggaagtattaaaaattgcaatcgctcaagtcctaattgttattgttgttgaatttgtgtttcctaaacctatcaggactatgactagtattttcattatatatagacagaacaaactaaaccttctaaacattctatcacttcaaattaaatcgatcgaccattagttcaacatatagagatgatatcaatgaatcgtctatcgattctcctttttgttttcgcctttggtcttaccatgatgagtaacacagccttatcgtacaaacattccgtgtggatcagaaactttcttcatgaaaaaaacgatctcataatccattgcaaatccacgaaccatgatatggtataccataggttgcatccaacaggatcgtaccatctgctagttgatgatgattccgactatttttggtgtcatttatggcaaggacctaatttcaagcatcaccaagtttttggtgttaaccatggagacgtatgggaagctagggaagacggaatctacttctcgcagataaaatatgctcgagatctccgtcagcatgtgttcatgtatgggtggaatgttcctttgaccttgtcaagagcttcctcgttgggattgtgttgtgtctctttaagcttattactctcttccttggttttgttttatttttatctagttttagttttgaaatttattttttttattatgaattttaaaaatttaatttttatttgtgttggaatttttttattttctttgtaacctatatgaacttggatattttttttctttcttacattaattaagtacgtaagtttcgacaatcaagaatagggttttgttgattccaatcgtgttacccaaaaattagaataaggtttgtccaacaatttattaaatttggtcttagagttgtatacgagcctacgaggtatcttttagatatgccgaagagatggtagtgcgaagaagaaaagaaacctcattttccatggtattaaggatttcaagctattcaaacttttgtagtgacccaaatacgtgtagaactggcccaaagacaaatagcttaattaagattatcacctaatcttaggtattggtgataggtgattcgctcaagccttatgatcaatattagctccatattatggagagtgagcagcacatactcgtagatagaaaagtattgttgctcgagtaatatttttctgatgataattgtgtttcgaccactgttggcatctttcacacatgaatacatgatgtacatgtacgacatgcaatctttctcttaacgctcgactgctgtctgctgtgatggatcatcacaagtaaactttgtgaagcatatttcgtgagccaaatgatgttagaaaacaatcgtgtgagccaaaggcgtgagagcgcttgtagaaagtggtttatgttgtagttaaaataatccgaatattcatcttccggaaaaaagtgaagttcaacctctcaacggtacgtttttatacctcaactaagttacattgtgtatatcaacatcagctaactttttattaatatttcggttcacaatatcattatctttttcaaaatttattaagatttcttttgctcattttatttatgtgaattttaaaaataaaataatttttataatatagaaacaaaatattactaaaagtaatttttaaaaaataaataaaattaatgtcatatcaacgaaaaattcatagtttattaaagtagtaaatataaaagtaataatattttaattattttggtattaaattatacacttttattaatatatgtattttcttctaaaaattaaaaattaattgggtttttgtttggaatttttccgacttaccttttctccttctttttgtcgttttgcttagatatttgtttgcatcattttcaaagagagacgactctgaatccaaaaaaaaaaaaaactcattaagtaaagacaaaggaagagaagaaagacgatttctcgaagaagctatg

SEQ ID NO: 1590 - DNA, 3000 bp, Unknown
  misc_feature (1)..( 3000): cDNA_ID_3063243_gDNA_ID_1620421_Annot_ID_156607 3000 nt of promoter + ATG
ttacagtttataattgttattaagtaacggtataccacgaatccatgagacaattgttaaaaaactgaagtttaacccctattaaaacagcatattaataatattttaaaattttataaatattgattcaaatacatccaccatataacccaattccaaaataaaacccgttctgtaattcctttacccgtcccgtaatatttttttaaagtaataatttttaaaatttaagaattatttattatatataaaagttttgcaaattgtatcattctctaacacatttatattttatagtttaattttatatatagtaacattatacataccacataacatttttggttttatataatcttttctaaattaggatgatttgatatgtttaatattaatggtcttaaaaaataataaattaaagatttaacccgtattcaaacagtggattaattatattttatttttttattaatgttgattcaaaaacccgtctctccaaatccgtcttgccaaaaagccatttattttattaatattaattttatttatgatatgactctgaattataatctgaacattttagctaataacataggagtgcaccatatttatttaataggagaatgtaccatatgacccgaatgcacttttatccaaatccaccaaaaaagtcttgcaaaaatactgtagagataagaaacgatagtcggttttgataggtataagattagcaaatatattaggtagcttaaattagttaaagaatacaaattgaaaaggtatattacactttattcgaatataatatcaaaacttatataacacagagatttgataattgtttaattgttgaatacttttttgtgctaatttttatgtgattaagatttaattgatttcgtatataaaatattaaattgttttacgaacttatttgtttataatttggtaacagatagatatttgaatattcagtgtattttgcttcagtttaggaaatctttgatgacccgtctttagatccaataaaccttataattaagagatgaatattgttgttaaatgattttggtaattttaatgacgtcattaaagatttttgtttttgattaaatttttttaatggcattgtcatgtaattaattacaaaaattaaggttacatttaaaatgtacttcccaaataatatagtaggatatgatattctataatatttatacactgattaacaatcacgacttaaaaaattcctttaaaggtagtaaactttgtacgttcacgtgcatgcatgtttgattaatacaacgtgaggactcgaagatatgaagattttttttacttccaattataaatcacaaatattctttgtttgtgttagttttttttaattcattcaattagttcaattctaatataatctggattgatgagaatggtccaaactattttatatcgtgtaattggtagtcattcattattgcaggaatctttgatagtttgtaatattaatttaggaaacggtattttttaatgtgcaagtatgactatcaatattattcgtaaatctactcgaaatctgatgatcttcaaaatatatactactttattattctctactaattcaattaaaatatcatccagaaataccgtttataactaacactagatattaatcccaatatttttgttaaattttttttttataaataatttataaacatatgctattgttttgtttgatttaaatgtatgatacaccgtgataagataatttataactaaatatataaaattttaagttgtatctattttgttaatattgtttattttatttagtatttaatactgcattattgtattttgattgttaattctagaatttcaccgtagtatatattatgttatatcatctaagattgaaaattgtaaatgtttgagagaatttttgaccaaaaactctaccaaaaatatatatgtatatgtaattttacgtgaaataactgaagtaactttacagaattctatttagtatataatttctatgttattttttgtttttaatggtcaatctacaaaaagaaagaaattattagaacagtaagatttacatctataagatttaaaacagtataatcttgatgtatatgtaacaagaatcttgaaaacacatttccattgagatcagtcatctcttgaagtgattcgctcaatcggttaaaatgcatagcatcaagcatgggtcgaactttatcgatggtcctactcaaaataaactttcaatggcctataaatttttagatcataatccttggcttatgttatttatgctctaacccggcctacatagcatccaggtctaaaatatcaaatttaatatcaactataatgcaattaaaagagactggatgatgaagaaatcaaaccaaaacctcatcaagaaacacaagccggaatcacttttagacttgcaccagaacgcaaggaacccaatggtcttgtcatcaccaaacccaacatcgttttagctcgataccgaatacgagcccaataatgaaacaaagcctcaaacattctaacaagacctatataattggatcatccctacaaaggtggtttgtttttttcaacttttttttttggtcaaacattctacttttgttatacaatctgattttaacaggtctacgactacgtagtgaggaaaaataataactcctacaaatgtgcaactccaactagactcccattttagcatcttttacccatctccacataacatatgatcctacttttcatctgttgcatccaatcacaagtctactattccaaatcattagattcaatccaatacttctgtgattgtttcatttaaggtatatttcattttaaaaaaaaactctttatcactaaagttttcgtttattttttctttctgaaataaaaatctctccattcagctttaggaaaaaaaaaatttgtttctaagaacaaatccaaaaa

SEQ ID NO: 1591 - DNA, 1544 bp, Unknown
  misc_feature (1)..( 1544): cDNA_ID_3063235_gDNA_ID_1620421_Annot_ID_156609 3000 nt of promoter + ATG
taccggagagttatgtccggtaatatacatgttggcgcaaaggagcgtttagagatgttaatgctttcaaggagaacggtttctgatgttggtgcagcaagatctgacgtagtaggagatgggcctgagcttggacatacgagggtgaggttaaggctgcctaggtctcagataacaaagttaatggaagagagccatgatgcttcggaagtggcagcgaagattatcagtgcttatatggagagttccggtgggatacaaggcggtagggataacgatggccttcgccagagacttggaattgcggagataaacaaccattacaaagcacgagaggtaaatgtccgagaaaattacatgatcgaaatacatttgaagttatcaatcctaaggtcttatatatagcataagtgcataactaaaacaaaggtcttatagcatagctaaatatttgaaattacgttttttttccaacaacatgcattttatccgatttgaatataaatggtgacacatcaacaaagaaactattacaaaccaataaactacatgcaatagtcatgaagacattaatatttatgctactcaattgcctaaagtttttggaaccagaacgtatgatgaattatcactatgtatagtatatgatcaaacatcaaatccgcatttaatgtactttgggtttcgttgtttcaaactgtaactcatattttttttatattttttttgccatgaatatatttgtgaaatgaacacgcaaactaaaggagatctctttgtttgtatttgacattttataaaacgttgttgttccaaataaaatgcagaagcatgtgagtttcgcagagaaaggaggaagaggagagatcgttgttctatgaagtacaaagcaagagtagccagcaattacatattgtccactacttcaaaatgcatttgttaggattcttattttttatttgtttttaggactcatatatttttatgggcatatctagctatcatctctactatgatgtcaaaaacgaaatgagacatttaccaccaatttttaatcaacattcagaaagttcgagtcaaatttttactaccgcccatgagctataattttaacatgcgtccaccaatgtctcaattaaatatgcttaagctatccaatcccaatatatatcatagtgtagtagctaattacgctaactcaatcctaatgtatcaaactttattaggctaattagatccggatccaaaattcaatcggatatccggatgcgatagattcgaatctgagtaatagtaaaaatcaaaattgggatatcacggttattggcctactttcgcgctaaacccaatatcctgatccggtctaatagataaacatcgcacattcacatagtggtgggcttaaaatacagatgatgtacctatctactaggaaattcgagaaaagatggaataggaaagacgtgtttccaaataatcctatgactaacctagctcaaaaattttaggacaaaaaacggaatccgcgggataaaagggggatg

SEQ ID NO: 1592 - DNA, 3000 bp, Unknown
  misc_feature (1)..( 3000): cDNA_ID_2141249_gDNA_ID_1620421_Annot_ID_156595 3000 nt of promoter + ATG
ggagataacaatgacaacaacaacaatacaggaatcaaaacccttttgaaaagaatgatctttgatttgggtttcgcttgtttccttcctcctttaagctcaaccgaaaactccggcaacaacaatggaggaggaacaagcggcggcggaggaggaggaggaggaggaggagagaataacaaagcttggctattggcggaaacagcaccggagaatatgaatcctgatcctcattcagttcattcatcgtttagattcagtctttgttcacaaatcgagcttgagaaaatgaaaggtgaagaaccgtccttgtctgcttcgtcttcttgtcggaatttgtcggtttctggtggttccacgacggttttgatggttaatttggagaatggtgttaaggagactactgggaatgcgactgatgatttgcggtggactagagctaggtcgcttgagaagagtatttctccggtggctaatactttggttcggtttagctacggtgagattgtggcagctactcgtaatttctctaaaggtaaagctctaaattagtcattaaacatgaaatttgaaaactatttgtttggtaataataagattcgggtgatagcgggtacgggtaaggatccgatacgggtaattagggtataaaactattatccagagtaattagcgagaaattacgggtagagtttggttaattcgcatatctaaaatcactatagcactttctaatttcgtaaggattggattttagacctgatttctagacattttgggtagattttagctaattgtttggtaattaggctatatccgatatcgacaaacgggtacgggtcggataattcaataattcaataaggccgttgaatttgaatcatatatttcattatttttttgataaattttgtgtaattatgagtatttttgggtatttcacttcagtaatttgtaaaaaaattggataattatgacaaagtaccggatagaaaatgcggatcgggtatgggtcgggtcgggtcaaccctatttggctatttggaaataggaattagggtgaaaatgaaaatagtgtttgacttatttattcaatggtttatatatagggagagtgttgggaagaggagcttgtagctatgtgtttagaggcaaaatcggaatgtggagaacggctttagcaatcaagagacttgataaggaagacaaagaatctcctaaatctttttgtagagagttgatgattgcaagctctcttcatagctccaacattgtacctcttcttggattctgtattgatcctgaagaagggttattcttggtttacaagtatgtctctggtggtagcctcgaacattatttacacggtaagcgaatggatatctcatttgtgtttatatacagagatagttaaagacttaaggattgtgattttctgtttgtaatagataagaagaagaagaaaggcgtaaaagccgcttttggtttgccttggtcagcaaggtacaaggtagcgttaggtatagcagatgccatagcttatttgcataatggaacagagcaatgtgttgttcacagagatatcaaaccctccaatattcttctttcctcaaagaaaataccaaaggtaaagattcgcgaaacgaatgatgtattcgataattatcggtaagcaaaccaatgatttgttttgacctgttctttttcagttgtgtgattttgggttagctacttggaccgctgcaccttcggttcctttcctctgcaagaccgtgaaaggcacattcgggtattgctcgaaacttgccttgagttgtttcttcttctttatagccaattcttgattatctaatcctctatcaaaactttcttgcagctatctggctcctgagtatttccagcatggtaagatatctgacaagaccgatgtttacgccttcggggttgtgttgcttgagctaataactggccggaaaccaatcgaagcaagaagagcatctggtcaagaaaatctggttgtttgggtatgtcatctaattttacaacttgaatgataatgtgaccatatcctaaagtttgtgtcaatacatttatgattgttttggaaaaagatttatatgtattctttctataggcgaaaccgttgttggatagagggatagaagctatagtggagctgcttgatccaaggctaaaatgcacaagaaaaaactcggttcaaatggagcggatgatccgtgctgcagcggcgtgtgtgatcaatgaggagtcccgaagacccggtatggaagagattgtctcaatcttgaaaggcgaagaaggtgtagagccagaaacacattcaagcaggaaaactacaaatatttcgggtatgattgactcttatacacaattgcaacaaaccaaatccgagatgaaatgtcatcttgatcttgcgatgctcggagtaaccgagtttgaagatgatgatcatgtgtacggccgataaaagattctaagaaatggatttaaaagtgtgtaaataggtatttatgaaaagtttgaaacagagttcttagtttctgaattagtgatttgctgtgtgtacattggtttcgtttttttttttggtttctactttggagaaaaccggtttaggttttgattttccggtttggttatggagacagccgattctccggtttcgttttcagttttcaatatttttgggcttttttttttgagaaatccattaaaatgagggttggaattgttatttatttgattaccttttgtgaccacgtatttgaaattgacttaaataatataggaagtattaaaaattgcaatcgctcaagtcctaattgttattgttgttgaatttgtgtttcctaaacctatcaggactatgactagtattttcattatatatagacagaacaaactaaaccttctaaacattctatcacttcaaattaaatcgatcgaccattagttcaacatatagagatgatatcaatg

SEQ ID NO: 1593 - DNA, 3000 bp, Unknown
  misc_feature (1)..( 3000): cDNA_ID_3063256_gDNA_ID_1620421_Annot_ID_156596 3000 nt of promoter + ATG
gaaattgttagagtatgtaaactttaaatataaagtatgtaaactttaaatataaagtatgagtagtttcttttctaagagtatacttcaaatataaagtttctaaaatgtgtgttttgtattatagtccttatattgtttataattattttaaaactatataacttttataaataactctaaaacatacattaaaatattacacataatcttaattaacaaaacaatacatttataaataaaatacatataaataaaaattaaaaatacataaattaacttataaattacaaattactcaataaaattatttccgtaatgctcctatatataatcaatcaatgcattacgaagagatatatgagtctctttatttttaatatgtagattacaagccaaaaattgttgaaatactttgaatatataaaaatttaaggactaaaatgataaacatagtaatttgtaagattatttatgaaatattgaattttagggacttaaatacaaataaaaagatgaaacttcaaatttagagtattgaatagtgatattccaaatatagagtgtcactatttaatactctaaattatgaagtattagagtatctcttggagaacctaaaactttatatttgaggagatagagtatctcttggagatgctcttaagaatgcttttccaagactactcttttttaattatgtttttttctgttggatatttttatttatattttcttttaatttttaatgattattttatctctattttgaaaaaattttaggctaacaaaataaaatttaattttttctcgtctaaaatattccgaagaaaattttccctccaaaaaatattgaaaaaaaattcacagcacttttcccgcaaaaaaaaagaaaaatgacgggaaatatatttaacaggttttttaaagatttaaaaaatttacaagagtttttaaaagatttacaaagttttaaaatcctttaaaaattcttataaatcttttaaaaatcttttgtaaggatctacaaaagttttaaaatggttcaaaaagagttaaaaataaataaaatatttataatttttttttaagagttaaaaaatgatttttagtaatgttttaaaaactttataagaatttcaaaaatattttaaaaagatttacaaaggttttactaatatttacaattttgtttattaataagaaacgcatcgtattatccataatactataataggtacatatatccatatgccgctttatatggaaacaaacacaccatcacatgagatttgtaaacgcactagccaaaaacaccaaaacggtcatcattatgtccaaaagaccgttgactcttggttggtacttttggtttgtctttggaatcgctgaatgtgctatagcatatcgcggcctacctccaaaatgcaacgataatggccatctcttgaacgtcaagatatatttctagtttataaaccttttttaggcgttcttgtatactatgcgtttttgaagtaagttcagtctgtatgaaccaatgacaaacattctttggatattaacaccacacaaattctttttttttttattttttttttaaaatccataaagttctaaggcgaagtccgtaatctctccatacctgaaaccacagcatataatattagttttgtcccaaacatcgtcatcacacaaatttaataatatcccattaccattactagagaacattttatgagtttgtaatacatacgttaatattgttaaaacaatcactatatagccaacagttacatataaaaaaaatatgtaagttaactaaacaacaacaaattatatgtttttaaaaacaattaagaagaaaaaaaaatcgctagtgatgctagatctccaatgataagtgttataaaagattctaatttgacatttaaaaaaaaaaatatttttagtcaagtggtaaaaagattcaccactgcagtctgcatcttttaataccgaaattcgattacagccttacaagaaccaaaatttaaatagtagcgttgtcccgtttaataaaaatgggatatagatctaaatacaatgttaaagacaaacaaaataaccttaccaaaaaaaaaaagacaaacaaaataaattccttaaaatctgctttcatatctctgtcttctttcattctctttgaatttcttgaatattttgtaagtttttaattatcatacattggtcttataacaaaatgattgtttctcaccatgtataaattctttcttttaaaataggttcatattaggtgaaaaagaagattcctataattaaaagcgtttctaaatgaccaaagaaagaaaacataatcatgaaataaatagtggcctgacccaagttcttaccaatgttgtcaaatatttcgccacatgtacgaatcagaaaacacagagaataaaaactaaaaatagtaacacttgaattatatttatttcgatagtaacacttgtgaattttataacttctccattatttcagagaagcacaacctcgtgggctctgcttttgtccccttttaagtataagctaacagcctttacccatatgacctaaaaacattttaaaatcattacataataaacacttgtttgattggttttgtaacgctcacaattattttaaaactcaataattcaaaaccaaaaagaaaaatcattaattatacctaattaattcccccttcttctcttgttttttcttgcttaagatcacaccaacaacttaacggtataagaaaaattaaaataaaactaatgtttccaccttccaccactaatcacacattaatttaattaaatcttcttcttcttcttcttccaattataaactttataagaaaaataaatacatattctctttctcttccatcaagcaaagcttttcaaaaagaatcaaacttttcgaatctttttgcttctcgagatctgttcatagagagagagataaagaatg

SEQ ID NO: 1594 - DNA, 3000 bp, Unknown
  misc_feature (1)..( 3000): cDNA_ID_3063285_gDNA_ID_1620422_Annot_ID_156616 3000 nt of promoter + ATG
gatctacaacaattctcttcaaggaaatcttccggattcacttatcaacctcaagaacctcacaagaatcaatttttcaagcaacaagttcaatggttcgataagtccattgtgcggttcaagctcgtatctctcgtttgatgtcacggaaaacggatttgagggagatatacctcttgagctaggtaagtctacgaatcttgatcggttaaggctggggaagaatcagttcacaggaagaatccctcggacatttgggaagatcagtgagctttctttattggatatttcaagaaactctctctcaggaatcataccggtggagctcggtttgtgcaagaagctgacacacattgatctcaacaataactatctttcaggggtgatacctacatggcttggaaagcttccattgttgggagagctaaagctttcttctaataagtttgttgggtctctccctactgagattttcagcttaaccaatattcttacgctatttcttgatggtaactcactcaacggctcgatcccgcaagagattggtaacttgcaagctctcaatgcgttgaacctcgaagagaatcagctttcaggtcctctgccttctacaatagggaaactgagcaagcttttcgagcttcggttatcgagaaacgctttaaccggagagattcctgttgagattggacagctgcaagatcttcaaagtgctttagatctcagctacaacaactttaccggacgtataccgtctacgatttcgacgttacctaagcttgaatctcttgatctgtctcacaatcagcttgtaggagaagttcctggccaaatcggtgacatgaaaagcttgggatatcttaacctctcttacaacaaccttgagggaaagttaaagaaacagttctctagatggcaagctgatgcgtttgtaggcaatgcaggtctttgtggaagccctcttagtcattgcaacagagctggatcaaagaatcaacgaagtcttagtccgaaaacagtggttataatctctgcgatttcatcattagcagcgattgctttgatggtacttgttatcatcctcttcttcaagcaaaaccatgatcttttcaagaaagtgcgaggcggaaacagcgcattttcatcgaactcttcttcttcacaagctcctctatttagtaatggaggtgcaaagtcagatataaagtgggatgacataatggaagctacacattaccttaacgaagagttcatgattggatcaggagggtcaggaaaagtttacaaagcggagttaaagaacggcgagacgatagctgtgaagaagattctttggaaagatgatttgatgtcaaacaagagctttaacagagaagttaagacacttggaacaatcagacatagacatttggttaagctaatgggttattgtagcagtaaagcagatggtttgaatctgttgatctacgagtatatggcgaatggaagcgtttgggattggcttcatgccaacgagaatacgaagaaaaaggaggttcttggttgggaaacaagattgaaaatagcacttgggttggctcaaggagtggagtatcttcattatgactgtgttcctccgattgttcatcgcgatattaagtctagtaatgtgcttcttgattccaacatagaagcacatttaggagatttcggactcgccaagatcctaaccgggaattatgacaccaacacagaatcaaacactatgtttgcaggctcttatggctacatcgcgccaggtacggtacatacatgtctttctcgggtttcttaactacgattcgactattaaacctaacgtgttggataccgttcttttttcgcagagtatgcgtactcgttgaaggcgactgagaagagcgatgtttacagtatggggatagtgttgatggagattgtgactggtaaaatgccaaccgaagcaatgtttgatgaagagacggatatggtgagatgggtagagacagttcttgatacacctccgggttctgaagcaagagagaagctgattgattcagagcttaaatcgctgttaccttgcgaagaagaagcagcttatcaggttcttgaaatagcacttcagtgcacaaaaagttatcctcaagagagaccttcttcaagacaagctagtgaatatcttcttaatgtcttcaacaatagagctgccagttacagggagatgcaaactgataccgataaatgattttcgagacgtgaagctaagtaaactcggaatatatcttttttttgaaaactctgttttggttgagtagattgatgcattatttgcgtagtatcattttgtgataaataacgtaatcaagtatgtattgctttcttatgattcttgagactattaacaaagaaaaaactactattgcttaatttagagattaagtactattcgttcatataattatgtacccagtctttagtatttagatagtgtacaatattttaacatagaaaatctcattataaaaatacaataaaaatacataaatcttaccaagtatacacagttttattttcttatataaaaatatccagtgagagcaagtcctaaagactcagcttcttctctagatatatttcttcttaccctgttcttgcctctttgatagtcctctgttttgttcttctgtttcaagttttcagaaagtaaatttctgttatcttaatatccaaaagtttttcgagaaacagaggactaaagaacaggaaaaacataacaattattattcgattttatcaatttctctgttataatctttttttttcccatgttctactcaattttttttttgttctgagcgtctgtagaaagcaaaatcattttttttgtagtcgtttgcgattatagtttctctccttccttattcttgagtgtaacaaaacaaagcaagtttaaaaacaaagcatagggtttgttttgatctttatttttttatttagaaaatg

SEQ ID NO: 1595 - DNA, 3000 bp, Unknown
  misc_feature (1)..( 3000): cDNA_ID_2141433_gDNA_ID_1620422_Annot_ID_156629 3000 nt of promoter + ATG
gacacttttaaaggcttttcaggttttggatgcgatatacctaatacctaatttctttgacatgattatactataacattaatttacatttgacttaatactattattgtatgtttttgtaaattaaactcaatttttagatatgaaagatgcacacgagattataaaggcaatttgaattgaataatattagtttggtaggtggttcatgtaccaaacaaagcttttgatgcgtgttttgtaatttttggcgtataaaaaatctcttgttaattcttaaaagaaaaaaagaaaaaaaaagaaaaaagaagaaagaattattttgttagtagattactttttcttatttcattatcctacgaaaacgtacaaaaactatatatgtgaggtttgctttcagaaaaaaggaaaagtgtacaaaacgaaatatgacaatcttatataattattttaaaaagattgcataattgatgtctttggttactcaatttctaatgttattttttttttcgtttttttttttatttttttttatttttaaatgtactacacaatttgtgattactccattgggaagctatatgtactacatatattttaccgtcactcttttgaaagctatatgtactatacaaattatgttttaaggaaccatgaattgtttttaagattacttgaagtctacgttttaggtcttgacaacaaacaaagaaaaaaagaaaggaaaaagactaatagtctaatacatttaggtcaaagcttatctcttgatctttcttaagtggaaggttcatattgttatctttgcctttgtttttcttgttttttatttgttcgtagaaagcataatgaatgattcagacagagagaaagtatatttggtgtattagcttttgataagtggagtggaagtcacattccaacgaaagaaaaagtaaactaactattccaatgtttcagaatttggttctctgtaatagttccgagtttatatcataccaaaaaaagaagaagaagagttatagataaactcattagatatgcgattttggaaatacaatagatataaaatgaagaaaaccaaaaccaaaaccatagctatatttttttaagaatatccaatggcaatagctagtatcagaattcttagattaacgcacatattattagcttcacattgcatgatatcattcgttacaattactatttgattaatctaagaatataattaatatctaatggcaagagctaagaattagaattcttagattaacgcctatattatttagcttcacattgcttgttatcacatggtacattagattaattgacgccatggtatactcgtttccagtactattagactaacttctatcatagtttttattttgacttttgtctttgttagttttttttttgtaattgttttatgcaattattttaccaatcaatgtttttttttaccaactctagtctactactatgtttagtagtctatattagtcagtaaagaaataaactatacatattaatttttcaatgttttttgtatgcatttttattgggtaaaaaaatagttcaattggtaaattttgtatgcatttttttcaacaaactaaaaatagtatcattggattttcttaaagatatctaaatgatactattttgatacaatatttttttaacatcatcttgaatttgaataatactaatctgctactaaaaaattagtaaaatattggcaaatcatatatttgttctaaaagtcatttataattgaaaagattcttataatttgatttaaaattactgacaagttacaacatgctatcaaaaactagaaaatttatcgaaattagatttcaaacatatattattgcatttttttcctcattttcaacgtttaagtataaattaattataaacaatgggtgcatttatttgactactactactatttaaaaatataaataggtctcacgagtctaccactcctcgggatcagactaggctacatccattgaaccatagtaaaattaccgtggaaaaaacagtacagctgtaacttcctatataaacacaaagatccatgtgcccataaacatttactactagtctactactatcgtattttttttccttcgtctatgactacactaggttgtttaattttggaatcaaattaattagtagacgacgacttcaaacaataattatttaacatacacgttttgaacaactgtatgcaataattaaaaaatcaacaagaccaatcaaaatcattaacaaatgctgtaaaaaaaaccattaacaaatgtcatttaacatgtttctaagaatatttaatgaaaaaagtatagatcaaagctctagtgctctagatttttcattaaaaatctattaatattttcagttttttttttaaatgttttcagatattttaaaactctattaatatttccagattttttgttaactcttgaacaagtactattaatatttcctttaattacatacgtacatagtaataatagatttctcctataaaatgcttttctttttttacttcagctcctatataaaatactcggataaatagatcctaatcaataaataaatagattcagtttttcttttgatttagtcgtgtacaatgacgatcacaacaaaaaagcccataaatataatttactcaaagtgattaagggtaaaattgtcattatctgatacgtgttttagttgaaaaattgctatcttccaccttcttctatctctctacgaaaataatatttttgagttttgtttttactttttgtttttttttttaaaatttttttttcttcaaaaattcctccattgttattacataaaggaaaaaagaaaggtctctgagattttcaaatcaccatcatcatcatcgttgaagaagacgaagaagataccttcctctttatcttctccgatttctcaaccttcccgtctgcttgtcgtaaagaaatg

SEQ ID NO: 1596 - DNA, 3000 bp, Unknown
  misc_feature (1)..( 3000): cDNA_ID_3063281_gDNA_ID_1620422_Annot_ID_156622 3000 nt of promoter + ATG
aactagagcaactgatagcaaagggaaaagaagtgcattgttgagattctactcttacagttgagagtgacttcaaagcacgaggtccgggaaatgtctttccagaaccatgacttttggggagaaggcgaccttgcacttcttctccactgatccctcttgctatattccataaccaagtactacaagtcgggggaaaaatcagaaaaacgtattaatagacaaacaagcacgagttgcatgtctttaaatttctattatcaagcaaataagcaactattgggaatttagtatgctagaaggtactaatcaaataatgaacaatctacaatagcctacgagtccaggacaacaaaaattctatcttttccaaagctattacccagtatttactccgtaatgttcttgtagcttcgtttcagaaaattgcagcaagtcccctactgtgtcaactcccaagtcagtttgcaagctagtgcccagctttcctcccagttgtttcctgcacgttatgtctaattagagctcaatgattaccagcactaactgaaaattttatgatcctgggacagcgataaaagatgcaatacacaactttggactgtcttacatcttataaaacacagctgtgttgatactgacgcaaatatttaagtgtattccgtagaatgtgacaaatactaaaagttctcctacgaaaatatgtgttgtgatcaatacactattgaaacttacttacattttctttattggcaaggaacttagtaattcctgtacagctgcatatggtacaactgtctgctgcgcaggtttgttcattccactagcaagtttggctagcatctgcttgttgaagttatatgttattactcgccatacaagcgataaaaggaaaacaaaataaaatagcttcttgccttgttatgggctatgccagcagaacaagtaaactcagtctccttaagcacctgtttccggagttctgcaacaatgataattccacaacttaataacttatcacgtcgatcagcatcttctcgacaaatccaattgcggacactctccttgaaatcatctccatcctgaaagtaaaataaataaattcagatcataatattgactatcgactatacttttgttggagactaaaagacaccaaaacagacctctctgttcattccaagaatatgggatttaagaacttcctcatctatcaattccaaactctctggaggtgcatcagcaagcatgctttctgctgcatcagtgaggtcaagatacacttcatcaatcgaagccctctcacattttccgctttttgctagaatcgaaaccacctgcagcgacaacacatagaatgagatgaatttagcaaatgtcattgtttagacaaacacaaacagtataataataacttccacttccatcaacctcagaaccggcactgcgatataaattaaggtcagctttaccacgagccacaggaacttgaaccaattgaatctgaggacaagcagctttagcctcatcacctctcatcgacctgaacattaacccaaaacacaatttttccctatcctcaaaagattgatacaattgggggaaagaagcatttctgtaattacacactaaccgctttacgccacatttacgtgcttcgtaactaacagcaatcaaaccaccaccttgccattcattgtactgtacaactgcactaggcagtcctcgcaactccggttgcttcctctgctccactaatcactcactcataaaaaaatcccttaaccaggtaagtaaaggagacattttgataaaatagaaacaaaaaagcacactttttggtatttggtaatttcccaaatccctaaaacaaacgccaacgagaaaaaaaaagaaaagaaaccgttattaaaattcgattgaaacccaaaattccaacaaagctaaaaagttcaaaaaaagtgttaaaaagctttgctttctctcactaaagcgtctagtggctgaatacaattcgggttagagagagaaggaccttgaacgtagaagcaatccatgtcgacatgagcgataactctagcatccgatgcttccggtctcgctaccggcatttctatttcagaaatctccgcagaaatcagagggagagagagagagagagagagagtttttaccaccgaaagaggggtttcttggggatgatgactgatgaatagcgcgcgaaaataataattaggagaaaaagcgagacagattaataaaatgagaaagtttcaaaacgaaccctcaaagaaactaaactttgcaaaataacccgtttagaacacaagtaatttgacaacaaaacatgaaattcattgtaatgatctcaaaccctaaatatttctccaaatttgccgtgtcaaattatttgtaaaaataggttgaagattgacattgttgtttttagagatttagtgtggtaacaaaattatggacatcaagctgcatctttcgaattatggttgatcgttcggtagataaacaaaaagtatagataaaatatttaatatttattcattacataaaatttttattgagtttatttttatttatataaaacaatcataaaaataatatgggtcatgtttttttcatccattactatttgttcactactattattaatttcactattattgtgaaatgtcgatttttattgctcattaaatttggctagataatcttcactaactaaagatttggattcaagaaaaacaattttctctcaattatgtttatgattacaaaaataaaataaaaaaattaggtattaaattataactgtaaaaattaaaacttatggggatttttggaagtatatacaagtttaagtactaatctgaaaatgtttgtgttttagtatataaaccactcacaggttgtgactttacaaattggaaaatttcgttgaatgcttcttcttctccgtctcgttgagattcctccccaacaacaaca

SEQ ID NO: 1597 - DNA, 3000 bp, Unknown
  misc_feature (1)..( 3000): cDNA_ID_2105010_gDNA_ID_1620422_Annot_ID_156618 3000 nt of promoter + ATG
gctgaagttgaatcacaccgtgttcatacactctatagaaattcaattgactctaccatctatatactaccatgaaagagacaacaatggattacaaatgcttttattttccttttacttaaatgataaatacagaatattttgaattcttgatcatagtttaacagttgatgtaatcatgagcggatctagagttatatttttactggatgcatataatttcttttcgaaatagatcggagacatttaaaagagcttacattattttattttatctgttttgtttataattagacaggacatgtggtacactggtatttatgttcatcttagagctcctcaagatcacgagttcgattttaacttttaagagtagattagactagtttaacttcttcttatctacgatccaaaaactaatgaatccttgttaaagtccaaggcttcttgattaaaaaacaaaatgtcttctttaacaatattttagttatatatacgagtcaattttctagtaagaaatcgtattacccgttagtctaaaatcgattaatttaagtatcaattgatgtgaagatggtgatacgtcgtattcattatggtttatttgtgtgaaatgttaaagtgtacaagtcttatcttatggaaaaacattctccttttgtataaatgtgatgttattcctgaaatatgatcagtctcaatttgcatagttaattaatcgtcttattagcttgtggttgtgcctattaatgaaacccaattgctaacaattcatcttctttcttcttttggctcctactgaccaaacttacccacatataaaactataggtaatcaatctatctcaaagcattgggccctttgactactttcaacgtgtatatctaaatgttctaaaacttatcaatgaagcaaaacgttccacaattttacatatttgaaataaatcggtttttcaaatgaaaatacttaatgtttttttgggatttatactcaaactaagcatcgctaagccaatatatatagactaataatttttaagaaaatgacaaacatatatttactaaaaagttatttctcaaaactaattaacatattttcataatattcttttattcttttattgtagtacattgacagcgttttaaatattagtactgacaacttggagattctttaaaaatctaaagaatttgtttggcaaattagtcatttccggagaatatttttttttctttgactaaaatatatactttatattcaagattttaaccagatatacaaaaagttaggatcaaagacaatcattctagatcaaccacattaagtattacactaagcaatactactttctttctcaaaaagatgtttcagccaaaaaggaaacccgattgctacatacgattggcggcgatcctccattgtcacgctcttggcaataagatgagctccaagattagagcttcttatttcaccacacaatctctggagaatgttctaaatgagataatttttgtggacgttgtgcaaatatcacacatgacaaaaaaaataaaaattggtataatcgtatgaatgatctttcaaactgtcttttattcgaaagatgattgtatatgtggatagatgtcaacacaccaacaaacattttgatcctatctgtatagcgaacaaaatatttgtgagaatattgaaccaagtcttaacaatgggaagattcatatcttagagatcagtgcaaaatttgagggatcaaaagattaacgtcaagtgtgtcatcagacgaactcctacttttatgatacccataatctttcaatctgttccgatttaaaaattttaaatgtaattactgattgtttgtaattgataataaaaaaaaactatttcatattttcaatttctaacattattgtttattgtttgtaattaataaaagaaaaaaacatttaatagtttttcatttttgacattatactttcttcaaatctaaaactaccaacgatgatatttatattttattaatccatttattctttgatattttcaaaaatgtccattaatgttttcattgttactattactaagtaataaataatataaataaacactgacaaactgaagttacagactataaataatttaccatactaaatgtaacatcaaagctttcatagctcagttggttagagcacccgtttagtaagcgggaggtcttgagttcaactctcaatgaaagcatttttctccttcttcttttttattgaacccataccctcgaaagctttttcttttgttattttttgaagtctatttctcttttcactgtctctcgcaatctccgactctctccttcttatttcgtcgccgtcgctactctttctcgtcggtaagttcccctctgtcatttccttcttctccaacatctaatcttattgtcgattgtgtaaattgctatgttttccagttatttactcgggcacgaaacatgttcgatgaaatgtctcaaagagtatttttttagactcataacgaaactgcttatctctttgcttttgttcgtgattttgtattgcggttctaacgttaatatgaactgggttagctttcaaattgtaaaaaaagtttaccagattcgtctggatctaatgctcatgttttagttttggaataaaaaatgtccagtctttagaaactattgttaaggaaacggaacctagttttggagaatcgttagttagagttgatcgcattgacatagcaaccttaattttatggtctcatagtttgcagattctcgtatttcagaagctactgtatttcaacatcaaagtttgtacctttctatgatgcatttaccattttggctttgaagaagatatatctgaattttgattgaaatgtttacgtttttttgttaaatctatcagactataatgagtgattttgtttcattgtgttgcttacgttaaggtggtatagtgtcaactttcaaggaag

SEQ ID NO: 1598 - DNA, 3000 bp, Unknown
  misc_feature (1)..( 3000): cDNA_ID_4256554_gDNA_ID_1620422_Annot_ID_156619 3000 nt of promoter + ATG
cttatttcaccacacaatctctggagaatgttctaaatgagataatttttgtggacgttgtgcaaatatcacacatgacaaaaaaaataaaaattggtataatcgtatgaatgatctttcaaactgtcttttattcgaaagatgattgtatatgtggatagatgtcaacacaccaacaaacattttgatcctatctgtatagcgaacaaaatatttgtgagaatattgaaccaagtcttaacaatgggaagattcatatcttagagatcagtgcaaaatttgagggatcaaaagattaacgtcaagtgtgtcatcagacgaactcctacttttatgatacccataatctttcaatctgttccgatttaaaaattttaaatgtaattactgattgtttgtaattgataataaaaaaaaactatttcatattttcaatttctaacattattgtttattgtttgtaattaataaaagaaaaaaacatttaatagtttttcatttttgacattatactttcttcaaatctaaaactaccaacgatgatatttatattttattaatccatttattctttgatattttcaaaaatgtccattaatgttttcattgttactattactaagtaataaataatataaataaacactgacaaactgaagttacagactataaataatttaccatactaaatgtaacatcaaagctttcatagctcagttggttagagcacccgtttagtaagcgggaggtcttgagttcaactctcaatgaaagcatttttctccttcttcttttttattgaacccataccctcgaaagctttttcttttgttattttttgaagtctatttctcttttcactgtctctcgcaatctccgactctctccttcttatttcgtcgccgtcgctactctttctcgtcggtaagttcccctctgtcatttccttcttctccaacatctaatcttattgtcgattgtgtaaattgctatgttttccagttatttactcgggcacgaaacatgttcgatgaaatgtctcaaagagtatttttttagactcataacgaaactgcttatctctttgcttttgttcgtgattttgtattgcggttctaacgttaatatgaactgggttagctttcaaattgtaaaaaaagtttaccagattcgtctggatctaatgctcatgttttagttttggaataaaaaatgtccagtctttagaaactattgttaaggaaacggaacctagttttggagaatcgttagttagagttgatcgcattgacatagcaaccttaattttatggtctcatagtttgcagattctcgtatttcagaagctactgtatttcaacatcaaagtttgtacctttctatgatgcatttaccattttggctttgaagaagatatatctgaattttgattgaaatgtttacgtttttttgttaaatctatcagactataatgagtgattttgtttcattgtgttgcttacgttaaggtggtatagtgtcaactttcaaggaagatggctagtggtagcctgaagagccttatatcttcagcagtgggtcgaggtgtgaccgaagcaagagcaaggattttcggacatatgcttaacccaacgggacagagatctcctcataagatattaaggaagaagcttattggtgataaggttgcagaatggtatccatacgacatcaagaatgaggatcccaatgtcttggctagagaagaaaaagagtactttcctaaacctctcttttcttgtttactttccaattgattgctttgtttatcatagaaaactctttgagtgggattgagctggaacatgtttccacaagctttttagttcaattgctatttgggggttagtatccaaaatcctagacatgagaaagaaactagatgtagattgtatgagccttcttgtgatttgtggagcttacgcagagtcatgttctttggtttctggtgtaaaatgcaacatagtcacgaactaatcttatttggcaaggatagtactgtctttgaaattcacttacacttggttttatattcactgcttatgttatcattgttttctctctgttgagaggcattttaacttaagtttgggtgttgttgttgtaggcggatatcgaagcttgagatgttgaaacgtcgtgacaaaggaccaccaaagaagggtcatggaaaacgtgctgcgaagcgtaacaagtagaagtaataaccatagctacaaaaaattctctgcactcttagagtcaaactcttctggttgaatcagatagaacttataagtgaaaatttctcctacttaaaactgaattggtttccaatgatgttactatgttgagacatagttgaaagctatttgcttcccttttgactaaaaatgtcaatggcttttgtttctcttctcttactcttttagtctttagagttttttgagattaatattggtgagatgtttgtacttttttgatctagtttttcttatctcgtgatagatttcaaatcctctttgtcagtctttgatgttggattgaaagtgaatttatagatttttaccttttcgaatttaaatattaaggtgactaaatactgaagtggtaggtcggccattctaattctgagtactagttcaactattctgaggtggtaggtcgaccattctaatactgaaatggaacgtgtcacttgttacttgttcttattgagaattgattttttacagggatcctaattaccacggatttacttgaatgagtttagtccatcaaaaagttgaaaaagaaccaaatattaaaagatggttggtgtaacctgtctgcttatataatccacgtgtgaaaaatgcataaaactcaaacgacaacattttgaaaacgatggcaaattcttgaatgattcttctttttatgttccctttttactaaagctaaaaggattcattagcaagtgtttgtgaaagggagagagaa

SEQ ID NO: 1599 - DNA, 3000 bp, Unknown
  misc_feature (1)..( 3000): cDNA_ID_2141421_gDNA_ID_1620422_Annot_ID_156621 3000 nt of promoter + ATG
tttcatgctaagatagctattgtgctgcgggaaaatgcagaatcgaagaattggccacggctttcttttatttcctttacttttagaaagcagaagataaataaaatagcctagattgaggaaattaccaaatcaatgtggataatggttgacttcttggccatttcagctgtattctggcctgaatctgcccatttaagtccattggaagagccatgaaatcttttacggtacctgttcctccatgttccaataaaatgcagccttgaattctgcagaacaaaaaaaatacatatagagaaagcatcttcagaatcttcattggaacaatactatccatccaattatttgtagttatataaactggcaatgagactcttactttcagctgaaaggacttttaatacaggcgtactatctcaggcagagatcattgtttatttttcagaagaaaccagcagataatgaatctattgtaagttgtaccttaaagtagttttctacaaaattagggtcctcgagagttgaatgacgccttgtagaagatccagcagcagttgcaattgatttgccaccattcttcccatttgcatgaacggacttgttgtctgaagtggaatgaagattagtagtggattgaagttcactactaacttctttttcttctatgtcataattaccaagtccttctgcattcatttcagaagatttcagatcaccagttcctgtttgttctgtcagttctggagtagtgttctcgatataaacgccatcaatttcatcatcgatgtggtcccttgcttcctctgaatcatctgctctaattgaacttccttcttcagcttcactgtatccagtatcaggctgaaaagatgtaaccggcgaagccatctgaggggtcaaatggcttctgggtgcaaaaaaggcagacaactttggctgggtatcatttagttgatctagctggtaaggaacccctgtgatgcgatggcattgaatcagatgattaaatagattgtgtgcaagataaatgaatgcatacgaagttgacagtagacaatgatcaaatccaaacatttatacttatgtctacatgatttaactgaaactaaatcatcttgtatagacttacagcccagaagtctgttggcagagatagagtccactatccatgtaggtttcacaacaggtaatcctctgctgaatgtcctgattggaaacaaaaatccattataagacacgaacttgcaagaaattagcgaagaattttaaagaaacaactaacctaagattcttgactttactatctggaaggttgctgcaaatgatatgtgtaacagaacgcctagaaaagtagttctcaaatcttccaccatacttcatcatgtatcctttcaactcctacacagatctagacactgttaaatcacatataacccaccagcaaaactgcactacaacaaattctaaggtttattcacctgcaacagtttgtacgatataagagttaagccatttcaaatcaggaaagaactagaaaccaacaaaattgaaaatgggtagaaaccaaagcaatagagcttaaacctgatgagaaggaatagtgaacccatccacaaagattgaaaccccttggaaaataagtttctcagaacccgaaacaccacgagaagcagcagaagcctcagtctcaaattggttctgaagtttcctatttttcacttccatgtaactaacatcaaaaacataaaaaaaataatcaacaaccacgatagtataacaatgcttaacgcatcttacttcattctaacttcataaaatttccaaaattcaatctttctcagaacatcacttttcagagggaaagtttcaacttttacatgggaatttcaaaatctaaccactacccaacactaaaatggcagagaatgatagaaagaccttccgaaatcggagaaaggagaagaccggaaagaagaacgagaagaagcagcgccccatgccgcgcctagggttttctgattgctcggattattattcttcttagacttcttgttacttccactgccactattgtttgaagaatttgaacccaagctacgcttcattgttgttgttggggaggaatctcaacgagacggagaagaagaagcattcaacgaaattttccaatttgtaaagtcacaacctgtgagtggtttatatactaaaacacaaacattttcagattagtacttaaacttgtatatacttccaaaaatccccataagttttaatttttacagttataatttaatacctaatttttttattttatttttgtaatcataaacataattgagagaaaattgtttttcttgaatccaaatctttagttagtgaagattatctagccaaatttaatgagcaataaaaatcgacatttcacaataatagtgaaattaataatagtagtgaacaaatagtaatggatgaaaaaaacatgacccatattatttttatgattgttttatataaataaaaataaactcaataaaaattttatgtaatgaataaatattaaatattttatctatactttttgtttatctaccgaacgatcaaccataattcgaaagatgcagcttgatgtccataattttgttaccacactaaatctctaaaaacaacaatgtcaatcttcaacctatttttacaaataatttgacacggcaaatttggagaaatatttagggtttgagatcattacaatgaatttcatgttttgttgtcaaattacttgtgttctaaacgggttattttgcaaagtttagtttctttgagggttcgttttgaaactttctcattttattaatctgtctcgctttttctcctaattattattttcgcgcgctattcatcagtcatcatccccaagaaacccctctttcggtggtaaaaactctctctctctctctctctctccctctgatttctgcggagatttctgaaatagaaatg

SEQ ID NO: 1600 - DNA, 3000 bp, Unknown
  misc_feature (1)..( 3000): cDNA_ID_3409564_gDNA_ID_1620422_Annot_ID_156620 3000 nt of promoter + ATG
tcagctttccgaggaactaagcgagcgcctcggttctgacttggagcagaataagcggattgcaagcacccttacccttcatgctagcgctttcagagtacctacttctcttgttatatatcatttttctctgcgaagactacgacttaaaacatatttttcctgaaaaatattgcagtcaaaggattcagattctcataagaaatttccttcaaaatcatgtcctatgagatatggagtaaccaagatccaagaagatgcctttaacttgttccaagctgccttacgtgagtacatgggatccttcgggatcaaacctcaaggaaataagctagagacatggaggataacaggtctttctgtttcagcgagtaaaattgttgatataccatctgtaagttcttagagccattaaatgtcttctacttacttatctctttcaaacattggttggtttcttcactgatttggtaggagtgatatcttattactgtagggaacaagctcgatcatgagatattttcaaagtcaacctactgttccttctcgttcagcagatggttgtgttcaaggaaatgtagcgatgactgcttcaggtattctagagtatttctgtatattttcagaactttctacttctcttgattctggtacttaatgtcgtgatctaatctgcaactggtgcagctagcgaaggatgttcagaacagaggtcaacagaaactcaagcagcaatgcctgaagtagacaccggtgtaacttatactttgcctaattttgaaaaccaagataaagacattgatctagtctccgaaaaggtatcagctctcatttccctttactctaaagcatattttaggcctttcttagaggtgtgatctagcaaaaaggctaaacatatttaggctcaattacgttctcagtttcaactttcaaaggagcttctttagtaattataactggtaacgaagtgattggttaggccctgtagtgtttgaatgactcaagagcttatatatatgttcttaaattgtgtatccttgaagaaccaattccacacattccttgtcaggatgttgtctcttgtccatcaaacgaagcaacggatgtttctacccaatcagaatcaaacaaaggcacacagacaaagaaaattgggcggaagatgaacaactcgaaagaaaagaatcgggtacgcaatatattgctttgtttggtgcacgaaaagcttctacctttactgagatttgtttgcttgtttgttctcagggaatgccttcaattgtcgatatctttaagaattacaatgcaacacctccatcaaaacaagagactcaagaagattccacagtgtcatcagccagtaaaagagcaaagttaagtagcagcagccataatagtcaagtgaatcaagaggtagaagagagtagagaaacagattggggatataagactgatgaaatcgatcagtcagttttcgatgaattaccggttgagattcaacgagaactcaggagtttcctacgcaccaataagcagtttaacaccggtaaaagcaaaggtgatggttctacttcaagcattgctcattattttccaccattgaatagatagatctaagctcctttgtctctgttgttgactgtatatagtgtagtccttgtctaccttagatttggtcttgtatcttgagtactacagatatattatgcttaaatcctattaaaaatgtcatttttgagcaatagaaaaactaaatatatatatatcgtctttaaaatccatcgagacctcttgttttttatggtatgcacagtgatagaagggtttttttttttttttggtaaacatgtgaagaagtgatagaaggtttatcagaagtttgtatatctttgctcaaccacggaatctcatgaaatattcaaacatcctacctaattgctctagtttctctagtatgagttctttttggatcaattctatatcaaacgattacattttattttcaaaagtcaaatcaatcgaaatgttaattacaacttcgcctaaatatgacttttttcttaactaacttatttttcatcctactttctagaatagaattctctaatattaattgacctaacataagttttttttttggtaaggaggatttttttttttggtaaggttgaactaccataagtttgtttgctatcaaaacatttttacttcattttgagcgtaaaaacggtaaaaaagaaaacacaaaattcgaaaacctgaaaccgtttttggggttaggacaatactgcaggccactgtcatgccatccaatgggtttactttttattattgttcctcctgtgtgtaaaataccctaaataccctcgaacttgctctccaaaattgcaattaatttacctttaaaagcttaattaagagtgtccgatttctcaagaaatctatctaacaccaagattataatttctattagctgcctaaaatttgtctgtgtgcgcaataatccacacgtacacacgcatctactgtattcgatttcgtctctatatataaaaacacaaagacagtcttcttcgtgatctctcattttactgttgtcttaaagcaaacacaagataagaagaaacaaacaatggcgatttctttcatttagatattttcctcgattcttagcttctgggtacttcaaatctctctctctccttcacgggttcttccaaatttccatactttttaccttgtttcctgcgaaaaaaagctatcttttttttatttgtgaccctacattgatatatgactcaactgctgaaaaattgatactttgcctagattccatcatttattgtttcttgggttaatcaatcaccactttttagcaaaaaccctgaaatcgaatcagttttttctctgtaaatttcatttcttttctgcagaaattagcctatttgagctcagtttcgtgtatttgtgcagattttggtgaaaggatttgaaatg

SEQ ID NO: 1601 - DNA, 3000 bp, Unknown
  misc_feature (1)..( 3000): cDNA_ID_2141417_gDNA_ID_1620422_Annot_ID_156617 3000 nt of promoter + ATG
taaaatcttgaatataaagtatatattttagtcaaagaaaaaaaaatattctccggaaatgactaatttgccaaacaaattctttagatttttaaagaatctccaagttgtcagtactaatatttaaaacgctgtcaatgtactacaataaaagaataaaagaatattatgaaaatatgttaattagttttgagaaataactttttagtaaatatatgtttgtcattttcttaaaaattattagtctatatatattggcttagcgatgcttagtttgagtataaatcccaaaaaaacattaagtattttcatttgaaaaaccgatttatttcaaatatgtaaaattgtggaacgttttgcttcattgataagttttagaacatttagatatacacgttgaaagtagtcaaagggcccaatgctttgagatagattgattacctatagttttatatgtgggtaagtttggtcagtaggagccaaaagaagaaagaagatgaattgttagcaattgggtttcattaataggcacaaccacaagctaataagacgattaattaactatgcaaattgagactgatcatatttcaggaataacatcacatttatacaaaaggagaatgtttttccataagataagacttgtacactttaacatttcacacaaataaaccataatgaatacgacgtatcaccatcttcacatcaattgatacttaaattaatcgattttagactaacgggtaatacgatttcttactagaaaattgactcgtatatataactaaaatattgttaaagaagacattttgttttttaatcaagaagccttggactttaacaaggattcattagtttttggatcgtagataagaagaagttaaactagtctaatctactcttaaaagttaaaatcgaactcgtgatcttgaggagctctaagatgaacataaataccagtgtaccacatgtcctgtctaattataaacaaaacagataaaataaaataatgtaagctcttttaaatgtctccgatctatttcgaaaagaaattatatgcatccagtaaaaatataactctagatccgctcatgattacatcaactgttaaactatgatcaagaattcaaaatattctgtatttatcatttaagtaaaaggaaaataaaagcatttgtaatccattgttgtctctttcatggtagtatatagatggtagagtcaattgaatttctatagagtgtatgaacacggtgtgattcaacttcagcagctagaatacttcggcctttgtttcaaagatgacatctacaaaatcttttatttattaatcgggaaaatatcaaagagaatcaaattagaactaaccaatatgttgccgagtttggggtgatgacaaaaaatatggatgagagaatgcctttgacctagcaattatttatagggatgattgagcaattttctttttaaagataatataaatttaaaagataggttacatgtaaatttgaggaaatataagagcattttgtttagattttagggttcaacattttaaaatctattctttatatgttggactattttgtcaatctaaaaaatttagactccttgcttaatttgctatgaaatttaccctctttaaagtttatcaaatatgataaatatttagcttatcatatatactcaacaatatatatgtaatatttaacatattaattccacccatatatttgtgtgtgaaattttctataaatctaaaaacagaaatacaactgccctcttttttgatgaaaggacttaagtaatgagaaactaacacacttcacaacaaaagcagaaattaaagaaatgtcattcaaccaagtcatcgtctctcatctcaaccactctctttgcttggccaaggtcaaagccatatcaatttatatatgtaaaccattatcatataacttatttatctcattgtcataaatctcttttctcattaccattacttacacgacttagactctcatcaaactgaacttctgtaaacaaatagagagacaagggttgaaaaaaggacaaattgaaagactgcacaatatttttactgtatttcaagtttcaaccaataaaatttatggattggaggcaaattcatcgaatctacaagatcacaaaattcacaaatttttattgaatgaaataaaaaatcattaaactattttaagaaattgatcacttaacatacaaaatacataaattgttatttcgaaaacctataggcttcataaaatatcgcaaagtagcatataacccattccgagttccgcatattatcttggtataagtaaatcaaccgatgcgatatcgacccatcaaaaaaggttttaaaatccatatttcgatcattagcaacggcttaaaaaaatatttgtttaggtctctggttcgaaagagattattaggaagaatctaaactttttttacaaaactaaaatccaaaacaatttaagtactagtactagaaaagaacataaatacacattggcatagccgcaacataaatggacacttgcaattgcattttccaatgtctcttctctgaccctctttgaccttcttcttctctttctcattactctccttctcaatgaaagatccgaaaacagaagagatatatatataaaaaaaaacactctatatatagttctagcctttatagccgatcccaaaactttatcctctgcatttacttctcctcctacttaccacatcaaacccaaacacacatacttagacgcgtatacagaacagagatacagagatagtccccatgcaccgttcttataaccaatcgtcttacttcatccaaaaccaaacagttgtcttaaattctctatgtttccaacattagtcgtctcactaccacaagaactcgaagaagcttctttcattcactattactctcacagatctcttgtttcttgaagaagaagaagaagaaaaaaaatg

SEQ ID NO: 1602 - DNA, 3000 bp, Unknown
  misc_feature (1)..( 3000): cDNA_ID_3063323_gDNA_ID_1620423_Annot_ID_156643 3000 nt of promoter + ATG
tattaatcaagttgtcattgtattatgctatttcgctaattataaggtttgacatctgtataggagactttgacatttgggattcaaagtttaggaaataaaagtatttagacgcgctttggtgtttattattctaagattaagataacttgtagaaataaatattctaattaacatccgagttttatagcaactagggcatatccgcataatatatatatgtgtgtgtgtagagaggataaggtttaatgaggtcaacgtctctaagtctatgctaattattatctaatttatcttgtgcaacttccatttgataaggttaattggtttaatatagttttgagtaatatattgtcggttgtctcccctcttctcaccaaaaaaaaaggttaattggttaaccatagttttaagtcttaaaacaaacgaaaacttctgtacagatcaattccctaccaaaaaaaagaaagcaacaagaaaacaacatgcatagatcaaataatgtgaatataaacattcaagtggtgcttcaagtgatgatgtagtgagtattctatataaactacatgcaagcatcattatttatttatatttttcttaaaactgtatccagttcaatcaagggaaattaagaaatgctaatatatatgcaagatctaaatttcaaatatggttggaaatttgatcatgtattggaatattattaaaaactttgacggtttaaagatagtgtcatccccgttagaaaagtttcaaatctatgcagtttcaggtatatatctttaaaagtcgaaaaattctttttctgatttcgttatacaagagtctccaagtttatcatcatttattactaatttagatattgaagatgctgcacaaaaagtaaaaaaaattgattaatacttaagggtttttgtcacttaaatctcttagttaagggttttttcattaataatatagctgagggctttaaaatggatttatcgatacttgaggggtttttttcgtttaaatctcaaaaacttgtttttttcttttttttttggtaaaacaatctcaaaaacttaataccaaatcttattaataatcaggttacaacttaaaagacttttgtttataagactttgaagaataatttgtttctatagataaaaactgaaaggtgtttgttcaaaaaaaaaaatgaaataaggtgatttaaagattttcttattaataaataatttaagcaatttataactaaaagatatacatatgtagaaagagtttggattgattcgaggcatataagaatttaattgatttggtcatctttaagatcataagtattaataaggaatccaaaagtgatttaagattttgttagaaaagcaagataggcatcatgagttagtatatatataatatagaactttttgatatttttaatcaaattatattatatatttattagttcctcgaattaaatattttaaataaaatgtgggcatcaatagtaatttttgaaatctaaagttttaaacatgtaattgtttgcacttattagatgtatattactatttataccaatatataacagattttaataactaaaaaattataattttaaaacaaaaacaaacgtaatatgttactaaattttactttataacaaaataaaacgtttaactgaaaattaactctttatataacatatttatctacagagtctataaatatgactaaatattgctttaatactccagagcaaaacaaaagaaaaacgattcacaataatatttaatatattttctttgtgatattggttaatttctaccaagaaatgaagttgcctattatattcttaactctattaatttttgtttcttcatgtaagtttaaattatttaattaggataatgtgtcagtattataatcattacaaaaactgtttaagaatttgatatatcttttgaaaatttgataggtacatcagtacttataaatggatctagtgatgaagagagaacatattctttcagtccaagagcaagtccttttgatccacgctcactgaaccaagaacttaaaattgggagaattggttactgttttgattgcgcaagagcttgtatgagacggggtaagtatattcgtacatgtagttttgaaagaaaactttgtcgttacagtattagtgatattaaataaggtattgtaattttgttaaacattaataaaaaacaaattatattactgcttaatgttcatccatgcccttctttttacaataatgaacatgtataataatctaaaaattttatagtgtgcacttaacataaaatttatctggaaacataagtcattgaaaaattaaaaaaatgttgaagatgacataattggcgcggatcctcatttgtaatgaccagttagagtaaaagaatccaaacctaaaatacaaatcaataatcaaatattggatgttatacaagctatggagcaattaaagaaggcaacacgaataaaatatttgggtcgaatccagtcctttggattgagaaaactgaagcgaattaaccgaaaactcagaaatctaaaaacattaactgaatttcaacaaaaaaaaaaaaagaaaaaggtgttggtagattttatttttatttaaaaatagcagatatccgaaccaaataattttttatcataatttcggtaagatttttgaaaaagcaaaaaaatcgattaaccaaattcgcttacctaattttaaggtttgcaaaaggaaatactctaaatatcctgcaaagaggcaaaattttacacataaatttggtaaattaacggcgagatttacagtaatttcggctccaaaaaacaccccgccaattttattaccaaacccattcacttcaattcgcgccaaaactagaatcccaaaagaccaattcctatttaaaacccctacgccccccactctcatcctccattttcgcctctctcttccctctcctcctttcttcccaa

SEQ ID NO: 1603 - DNA, 3000 bp, Unknown
  misc_feature (1)..( 3000): cDNA_ID_2141345_gDNA_ID_1620423_Annot_ID_156649 3000 nt of promoter + ATG
tggtggatcttgatttacaatcttgaattctgatagcttcacttttcgttttttagctatcgtgttagcagattcctgaattttcttgatcacggtgtttcttctcgcttcatcgatatcccttgtatctttgaaagaacacaagaaaaagaacttagtccaacgatcaaaccaaaaaaaaataggactactctcagcttcctcaagagctcagataaagcacgttatatttaccagactttctctattagtatgtgtaatgaaacataaggaattaccgatttcaagatgggatttgcttggaatgctgttgattgccccaggatgtagctccagaataccttaaaccacaatgattcattctgtgaatacgttctattgagagtaagttctttagaaattagtgaggcaaaacttaccaacagttccaacagtatctattgactccgactctaatacatgtttctccacggcaagagccaactctgcagctgcaagcccggcatcatttctaagaaatagtcattatacagtgatcagtatactagtgcctagtggttaaacagatggttcagttgcataatatagctcacctatatggcataagtacagcaccagcatgacctccattgccttcaaattccaccttcaaacttgctggagcagcaatggcggttacaacaccgatatctaaacctgtggtcaaaaatgatcttattaactataatgaaagagagaaaaaacacaaaattcttccacgcagaaaaggtaagttaaccggaccttcgtcttcaagtataggtccctgttcaatatgcaactctagaaaagcaaaataacttcctttcttcaagaacacactcgataagtcgtcatctttgtcttctgcgtatcctgctgatctagctgcttctataaaagacacattttggccatcaacaactgtagtctttagtgcttctgcaagttctttgcttccagcaagcaagcggctgtatcaacaacatgtacaagtaagacaaaaagaaacagaacaaggattttttctctgttcataaagataaacacaaagggtaccttcctaaacaactgatcccaaatcgggtcggttcttcagatgtgaacaagattatctccagagacctcttcggtttaaaccccgaccttaagaaaacaaaagaaatatccaccaaaaaccatcaggaaacacaatcttagactttactttccattatccaaagatccttcataccttttcaaaacattgatagcttcaatcgcacctaaaacaccgacaacaccatcatatttcccggaatatggaatagcatcgatgtgagaaccagtggctacagcaggcagatttggctctaaaccatccctaagttagagaagtcaaaacaacacacctcacatggataacataatcaaacctatcttcttaacgaaacaattagcaacagagagcgagaaccaaaccatttgccaaatatgttaccaacagcatcttctctaacagtaagaccagcaagtgccatcaaattcttcacatacctaacaaaaccaatcaacttagcttcacaaaatctaatctttatgattactcaatcaagtaaacagattcaaattaccttcgagccgagacatctttgtcagtataaagaactctggtgactgatggagaaggagcatcagagaaactagatagctcatctatctaaaaccaaaaacaaaagaacttcatccatcaaaatcaaagttctaaactttagttatctactgttccactttaagaaattgaacctggttttgcagtcctggagcatcaacggagagtgaagaagcgagattgatggaaccgaattgacccggttcgtgaattgggtatccggaaaaatcttccattgttctgattgattcatgttgttgttgttgagctaagcttgaaggtagaagaagggagataagaagaagcgcaatagagcagaggaaacgtttcaaagattccatttttatttttttctccttcagtgttttgattctgagagagcaatactattcattcataatttggtaattatactttggggaaacttattaattaaattttgagcgttatcattgtccaaatttgttttttggggaatcctcaaaactaagtgggaatctgacagagtgttttgttgtactctattgattctgatctcatctcatatgtaaaatactactatttttataaaaaaaatgaattaaagtttatatgttttggaatctttgtattttgtatcattagagagttagaaggaaaaaaatccatcatttatttcatagaggcccgtttcatcatctgaaaagcccaattcgttggatcaattgttaatcatatcttacttattgcatagagcctacatacaaaatattttgttcctgattgttttaagaaaaaacatatctttcataaaagtatcatatgctgtttttataaactaaaaaatatgatacactagctttataagtcatataactcgtctgcaaatttttctacatgtatttgcaattttgcatccaccatttgaaattagtcatactataatgatatgtcattttcaatagattcttcaaaagatttagataaacattaaagtaatcttttattttaaaatatagatttatatctcgacttcgtctcaagaactagttgttccaaggttattataataattaataacaaagaaaaggtccaaactaaaatcacggttagcacgaatgtattaagaaagagtcttatcgatcccaaaatttgtcgtttcgaatctcccactcatttagttgtgcatttttataatatacacacacatgtgtatataagacgaaaatgtatagaattattgcattgatcttcttcttttttttttggtttctaaaccaatttttagatttaaacttttacaactcaaaagaaaaacgagtcattaactaagtatggtccagtggttgatg

SEQ ID NO: 1604 - DNA, 3000 bp, Unknown
  misc_feature (1)..( 3000): cDNA_ID_3063311_gDNA_ID_1620423_Annot_ID_156651 3000 nt of promoter + ATG
ataaaaaaccaatttattaagaaaaaactaccgttgtaaattagtgagagaggagaaaacaaaaaacagtctccaagctacttggcctaataaaagagcatatctttagaagaaacatgcatgaggccgtaactaaaagaaagttcagaagagaacttctccctcttaatcatctctcatctttttctcattctctcttctctctctgtctttctgagccaaaagttcaggtgaatgatgcctggctcgagaccattcaatctcatgatctcatgattataacgatgatgatgatgatgtcggaccaggcttcattcccctcaacttacacgttttgcttctcaatcttcaagaccaatcgttagccgatcacctaattctctagtaagccaagaaagatgaacataaatggtgtatccgtgtatatcatctttttttgtatgtatgcgtctttcatcatcaatccgcagcaatgtatataatatggtgtatatcaaaaacacattaggcatatctattaaaattgtttccttaatatatctgttaaaccttgctgattaagagaaataatataatcgaaatttcttttgacatgcatgcatatatataagagtaacagatcaccgagtaaagttgaggggaaggaagcctggtttaaaatgttatcaaatgctatattttctgaagaatgtaaagcatgaaaaaaaaaacaagaattgatgatgcagcttgaagctgagttggtcaattttgtatatatattataggatcaataggtaatcaaaacttcaatactattgttttcttaatttgttttaacatcgtactttataatatggacttaattttaggtctaaattaattgtaggaagaaaggtatcgtatcgaaattaaagtcagctttaattagtgaagggcgtctctttttatctttaccaatttcgttgaaatatcttgttgtaatcagtgtggaaattggctaaaaataactgtttttcctttctttctttttgactatttagctttcaacatttcgtatgtattatttccacttgtttctagttgattaatcaagaattatcctcataagattaattaatgtagtctatttactgaggaaatagttaaacttttcaaagatatatcttacggtttaatatgatatgtaatgtaaatactatatagctaaaaaagtcttatataaaaaatggtcgatcaaatttgtaatcatcagaagagaaaataatcactgaaatttgatttttcgtgagaatgtgaaaaacgttgttaaactgaaatgtgacgagacaaacaaattcattacacatgataaatacaatttaaatatgcaataattagtgtatttatggttaaattatagagccaaacaaaaaggccgtaacatatattatggatgcctgcataattatttctaaataaatactttcactttccttttcttacttgaccgcataattattatattttcttttgctttctctatggagcaaaagatatgcaatgtgttcatagatatactccatgctttggaagagcttagtatacaaattgtttagaaatcgaaactgtgttttttttttaataatgtatctttctcgaactaggttactaacctcgcgcttagtgttcaaaattcatatattcaataaatctataaaaaattattttccttatatatataatatttgaattgatattgtaagaagaaaaaatgaccatccacaaatgcatgccgccgcaaacactatgggaaaagaaattttgaaatatagcgatttaaagtggtctgaaatggtttatagcgatttgagtgatagtatgttgttaaacgctaatctgcaaccacccacaaatgtaatgtttttgagtagttgcatagaaccaatgtaccctttaatgacatttctctagtttcactaattatattattattgttattcaactagcattcactacttataaatctagtttctttcttcatcttgaataccagatgatcacaaatgtttttttattacaatatattaaccttgttggttgttcatcaaaaaggtcgtttccatttgcacaatagcattatgttactatgttacaattagaagttttgaatataaaacatgacctgaaaagaagtaacataatcaatcagtctccaccatgaaaacataaaaagcttgatagatttattgttcaaacatggatagagttctaatcaaaaacagcaatgttgtcaaaaaacaatcaggtcttctgatgaaaatgagggagactgattcgccggaaattggtcatcacccaccaaagactcattgatatcacattcttggttcatgatattggtcatttgattttgctatatttgggatgtagcttttgtaatactgtctaaagcaagactggatgagtactcttaatgctgtagacatattttgctgttgagtacaaaataactttgatgagtacaaaataattttgggctgtggaaagactttacagcaacaaccaatcatcccttttgttgttgttttttagatctcctgttattcaactaataatttctaattaaatatctttctaaatcctatgttattaaacatgaaatttatttaaagtcattcaaaaccatttataatctcttgtaattcaattaaacatttataaaagtcatactacataaacaagaaattgaaaaatctgtcacaatctcaaaataaatgatataaagataagataataaactaattgcggttatattaacgttagtcttgtcattattacaacaatcctataaggatatatgcgttatagcattactataaaagatttatttttccaaactattgaaacacagaacaaaaacatctatagaaatataagtctcattcctcttcttcaccttgtctttaagagacaagcccagtttttttcatctcctccctcaccaacaccaaacacaacctctaagacaaggtgaagaag

SEQ ID NO: 1605 - DNA, 1810 bp, Unknown
  misc_feature (1)..( 1810): cDNA_ID_2141382_gDNA_ID_1620423_Annot_ID_156658 3000 nt of promoter + ATG
cttgcctcaggatttcagatcacaactaaaacaccttttcttctgcatttccatttgcagctctttgttcagagagatgcaaacttatgacaacgaattccgagactggtgcggtcaatgcgcccgtgaaaagaaagaaaagaaaagccagagtcttgcttccaaaagaaaggttaagaaaagaaaaaaggacatgattttgctcaagtttataagatgttttgtttgagcatggttatgaacctgtgggggtccttattgcaggagatgattaggataatagagtgaagccgaagcccgctgaaaaaaatgaagtctatgctttgaattttgactctttacttggaaaataacactgagtatatgtagaatcatttgatgtaaataggtctttgtgtcttcgaatttcttacattactactatgtacatgaaagttaccagttacatgtttaggatcggctatatgtttacagtttactcgccgtatcgaagcagtgttcagtgtcagctgaaaaagagtacatatagccggtccattcggttagactcatgaaaaccggtttagtaatcatatgtttacagtgtcagctttttttttgaaatgtatgatttggttaaccggttttaaaattgtgaaccaattcaattgtgcaattccgaacactagcgattcgaagtagagaaagtaacattgtaccaagctaaaccaacggcgatgaatgctagaaccgcgatgtgatgtgtgattaaagagaaggttaggaggaagtagaggatgataaattgattcggaaatgtgtgaggttttgtgtgacgcgtgtggtggcgtcggcgatggactagcggcgctggtgattggttgtgcggtttctttaacgccggagattacttgattcgccaccattgttgctctggattctagaaacttctgaaaatcctaaattcgttgggaaaagaggagaaagtcaaactgattcatgagaagttaagaaagcccaagcccattaaattgagtatcacttaattcgttatttatactaaaaaagatcgttttctagaatcgaagttggtagtgtaaaagaaaaagaagttgaagaagcaagaattttccatcgaagtggtcaattatccgagtgtagtaaagataaaatctcttatcagaaaataaaataatcgaagttggtcaatatttttagtcaagtcattcacacgaggaaatttcccacccaagagttaggatacgtggaaagaaaatctcaatgactaatgtgttacaataattagacgaagaataaactaatgccacacacacacacgcacaaattccacttgtgatgactgatgaacttaattattattattaaaccctaaggtttgataaaacggtatagggccggctcttttcttttctccacggtgttgtgttttttgaactcacaaaggagattttgtactttaacttcaaaaagaaaattggttaatttgaaaacaaacaaacaaatagttatagcttttacgcgtcacgtaatgtctaaattttgttgccaagacacgtcacttgactttctctagagttcacctttgatacatcatttgactgtctctggttttctcctatatacgtcacttcatctaaccaagaagctgagaaaactattcattgaccacgttctcaatatgtttcacgtgtgttaaatcaacaaaaccacacgtgattaaatcataataggtatatagacacaccacacaaaagacaacatcaaaaatcacacaaatcaagattgtcaaacacactaagagagaaagatg

SEQ ID NO: 1606 - DNA, 3000 bp, Unknown
  misc_feature (1)..( 3000): cDNA_ID_3063303_gDNA_ID_1620423_Annot_ID_156657 3000 nt of promoter + ATG
gtagaagagatactctctagggttccattaacatctctaagcgcggtgcgatctacttgtaaaacgtggaacgctgtaggattaacatctctgtagacttatattggtatatggtttatgcgtaagatttctcttttaaaccttttaaaagaagaatcttttattttgttaggtaacccctcgtcggccctttaagtttcttacaccacgtgatcggttatcctatgtatatactacgttcgtgaatgacctattgggtatccaatgcaaatcacaaggttagactaatactgtttggccccatttttaatgactctctaaagcacaagcttcacagttgcaactctatcaattatagtgatactttacttagggttgaagtcttgaagaggctgaagtagagctacatgtgtccacaatcaccgagaggtaacataaaccatagagtcgcacctgtgaatctacatgtgcccacaatcttttttcagcaatcttaaaacttctttcacactgccatatatatattctataataaccaatatgaaatcccgaaacaaatcaggaactaatggagacccaaaagccaaggtgactaggattctattacgtagttgacataaacaagaggtcggtataatacccataaccaaaccattaactatttgggacctattgctagctgttttcaatcaagcagctttcaactttaagtttataaattcttcaccaagttaatacaacctcttatttttatttatttctgagaatattaaatgggctacaagaaagatttgtgacttgtgagtgatagatttttttttagaaaatgaagacaaactttgagacaaggtctttatgatgaaagaaactttattagtccgtgatgtttcaaccccaactgtttcattgttttctttttttttcccttcttcttcttctttattttttggatcataagaaattaaggaatctattgcataaggttggcatgttgtagatatataaattaattagtctccatatatatatatatatatctaggttatatcttcaaatttgttgttgcagacgaaaaatacctacaacattcaaaacttcagttaattgtttaagaaaaacacagatatgaccaaaaaaataaatatagagataattaatagaataatcttatctacatatatatttattaaaataatcgttatagaaatgttcttttgttcaattacaaaaagaagaaaaatatttatttcgttttataaattaaaatatttattaatattctctaaatctcgcatggttattgaactacaactgtaaaatacaattacaaaaagaagtaaaatcttttgacgaccacctacaaaatgatacgacggagacacacaaagcgagttcaactattaacattaagctcagattattgaaccaaactagaataactcaaataagatatgttttcgattcggcaataaaatttgattcgagatattttagaccaactaatttactatccgacaactgagtttggggtaaaaacccgtaatttattaaaaacattgaaataaataaaatcatttgatatttctattttctcattgttcattaattgtaacatgaaagctcataatcttcattttatagactcaaatcaaatgctctttcaaactaacccaacaatgtagtaaaaaaaaaaaaaaaaccaacccaaaattggaaatcataccatgttttagatagtcaaaaacaaggctaaagaacggaaaaatccaaaaaaaagaagaagttatttatgaaaaaaaaagatagaccgacgttaatggaaagaagaaaagacccaaacatgtggcctatatacccatgggacttatacatgattaagattggcatatacatcaatgtttttcttggtaaaacatatacatcaatgttatgccatcaacattaaattattttaaatagaattttttaaaatatatgatattaatttcttctaagctaagtgaaaaaaatatcaaagcagccgtacagttacagaatcaaacaagaacttgacagcgtaagaagacataactcatcatactttctttttttttcaaacaaaaactacatttacatatttacgtaattttcattattattataaaaaatttctaggctcataagatttttaggataaaagagaaatttgcaaagaagaaaactagtgtattaatttatgtatatgtttgcatttgaatgataagaaaatatctcgcatgactacaaatctttggatatcattatcttactatttatacactaacttctatatatcattttatcgttttatagccaaaatcagaaatattgcaaatcttattttttaatatggtttttaatatttgagaggcgggaaatgtatggagaagaatgtgtacacgtggcggtctggggaccttgtaacaaaaatgcaattaaaaagcttttgaagcaagttagccatagccgcttggcgctgtgtcgtcttcgtcttcttcttccttcttcttcttcatctctctctttcgttttctcagtaagtgaaggatttgcagaagtagatgattgaatatccatggaggtaatttatggtttctaatttggttttaattctttgaaagtttgatttttttatgttatgagatttctgggtttttgattctcaagtttttatggattttagggttttcagtaattgcaaaactttattctgaagattgagtgattgcttgagatataggttatcaatttcctttatccctaatattccaaatctcgaaatttcaaattacttctctaagttgttctatgagtttatgatcttagaaaataaatctagtgttttgattactctgttttgcatatttttgatgggtttgtgttacttgttttgtaagctaagtgatattcatttttgtggttgaggtcaatagtgtatggattctggttctttatgtctcagggtgattggtttcaggaggt

SEQ ID NO: 1607 - DNA, 3000 bp, Unknown
  misc_feature (1)..( 3000): cDNA_ID_3063315_gDNA_ID_1620423_Annot_ID_156645 3000 nt of promoter + ATG
acttacgaatcggctcgatggctacaaggagagaaaacgtcgtcgttgaaggaaatgaaatcgatttggagctgcgtcttggcttatgatcatcaacttcttaccctctatagatgtataataatacgtttttttggtgtatattatatggttttcgaggttgatatatgtaatctaggaaagcgtatatgagactataatatgtcaaggtaagatatttttggtgggtatttatttatgcatgttttgtgatctatctatgagatatatataaatcttttatcttatatcatattattttcattatagtttttttccataacatagtgaaatctgtcccataattaattaattgtccagatcttcgcattctatatataaaaaaatttggcaaatagaaaatctgtcccctgtaaacggattaatatgctgcacccgtggttctaggattgcggtttttaatcccaccactggcggtttggtggtattgccccatgttaaagccaacggaagagacatctacacacgtctcggatacgatcctgtcgatgatcaatacaaaattttgtgtgtgatgatgttccttaagtgtgacgacggccatagacaatacgttatagaacaagagcatctggttttatcactaacatcacactcatcgtcgtggagaaagatcgagatctcgggagatgcttactcctacttagaaggtgggatttgcatcaatagtgctatatactatggtgttggacatacaaagatagctagatttaatattagatccgagaagataatgtttattcaagcaccagaggattataatgcaatctcatgttattcaacccttacaaattacaaaggaaaattagcatgtgtaagctatgactcctattgtgaatctaagttgcgtgtatggattctacacgatgttgagaaagaagaatagtcaagcatcatgacttgtgttgtgccttgtgacaaggagctatctttgtgcagtggagagagtcataacaacgaggttgtagtggtatctagatgcttaaagtcatctaagcacttttttgtttactatttcgatatggtcagagagagtatcatcagaagaattgaggttgagattgatggaatcgccgattatgagtttagacatatcaatggaattggtaaacatgctcctaggattttgtgtttccctggtcacattgagaatcttatgtacttgtaagttctaagttctactctaccataagttcattagcttctattttcatttttagccgtttcaaatcgttttttgtagtttggttacttgttcatggactccttttagccgtttgttttctcgaacgccacaactacgtctaccattagtcatggactcatggtgatcacctaatgtaaatgaagcacgagtttaccaaattacaatgactgtaaattaatattttcattcagtttgaatggtcaacgcaaatacggcatttctttagatgggcttataacgataatgggttacgaacggcttatagcccattcaaagttcttatctttcaatttcaagtaatttgctttcaagcccttcgaatctaccaaattccaatgactgtaaattatttttttttcccctcaaaatacatatttacaaatattaatttacttatgtatacagacattaaaaggcactaaaataagctaattatcatgatataaaagtaactcaagaggaaaagtaactaagcttacatgtaattcataattaggtgacatcaaatttactattttttaattttctgctgaatttttttatttattaaatatacttattaatatcgagatgtctaataaatatgagagagtgtttaaaaaagagtttagacatcgacatgagacaaacaaaaaatgaaaaatagtggtacaaaatacagatatataacttgaaaaaataaatataatttatcaacacaaatacaagtcctaatctgttatttataaattaataatctcaaaatattactttgatataaaatcagtgttcgtgtaatctatcatttatgcgattttttaaagagataacaatttttttttctttagtgaaacattaatataccgtttatttagtatgttaagtactttaataaaactctttaacaaaacaaaacaaagttaagtattttttaatatataagatatttctctgcatgatccaggtggaatttttttaaaagttaacaatagttttttttttatagtaaaacatgaattttgtttgattattccattagataacaactatttttcttcttgacaaaaaagacaaattttttttaagtaaaacgttaatatctcgtttgttttattccgttaaataattgaaatatataaaatattttcccgcatgattcacgtggatttttttaaaaggtaacattttgttttcttaagtaaacatgaatttcgtttggttattccgttagatgcttttaatgtatacataataattatccgcttgatttatgtaattttttttaaatgtaacaattgttttctcttaagtaaaatatgtatatctcgtagatttattccgttagataattttgatatataaaatattttccgcaaaatttacatagaatattaagaaaagatcacaaaaaacagaaattttgtttgtttattccgttatatacttaatatgtaaaatattttcctcttgatatacatatttcaaaacgctaatatctcgtttggttattctgttaaatactttaatatataaaataatttttctcggatatatttttaaatatacataaaatttctcttttaagttttaagtaaaaaaataataaatctttcgtttgcctttttatgaaaatatagattaaactaattgatgacaagaaaagacattagttttcttattaccatattgatgatttcatctctttctcttgtaatacaaaatggataaaaaaagaacagagcagaaatgaaaac

SEQ ID NO: 1608 - DNA, 3000 bp, Unknown
  misc_feature (1)..( 3000): cDNA_ID_2141458_gDNA_ID_1620424_Annot_ID_156664 3000 nt of promoter + ATG
tcttattaaaggttattgtaaagaaggtaattttcatcaagctcttgtgatgcatgctgagatgttgagacatgggttgacacctagtgttattacttatacttcgttgatacatagtatgtgtaaggctgggaatatgaacagggctatggagtttcttgatcagatgcgggttagagggctttgtccgaatgagcgtacttacacgacgttggttgatgggttttctcaaaaggggtatatgaatgaagcttatcgggttttgagagagatgaatgataacgggttttctccttcggttgtgacttataatgctttgattaatggtcattgtgttactgggaaaatggaagatgcgatagcagttctcgaagatatgaaggagaaaggtttgagtccggatgtagtgagttatagcacggtattatccggcttttgtagaagttatgatgttgatgaggcgcttagagtcaagagggaaatggttgaaaaaggtatcaaacctgatacaatcacctactcatctctgatccaagggttttgtgaacagagaaggactaaggaagcgtgtgatctttacgaagaaatgctgagagttggtcttccaccagatgagtttacttacacagccttgatcaatgcttattgtatggaaggcgatttggaaaaagctctacagttgcacaatgaaatggtcgagaaaggagtattgcctgatgttgtcacttacagcgtgctgatcaacgggcttaacaaacaatctcgaacaagagaggcaaaaagacttttgctcaagctgttctacgaagaatcagtccctagcgatgtcacatatcacacactcatagaaaactgcagtaacatcgagttcaaaagcgtagtatctcttattaaaggattctgtatgaaaggaatgatgactgaagctgatcaagttttcgaatccatgcttgggaaaaaccataaacccgatggaacagcatacaacattatgattcatggtcattgcagagccggagatatccgcaaagcgtatactctatacaaagagatggtaaaatccggattccttctccatactgtgacagtgattgctctggttaaagccttgcacaaggaagggaaagttaatgaattgaatagtgtgattgtgcatgtattaagaagctgtgaattgagcgaagcagagcaagccaaagtgcttgtggagatcaatcatagagaagggaatatggatgtggttcttgatgtgcttgctgaaatggccaaagatggatttcttcccaacggcataagttaatctagtgagtaaaatcatttacatgggcaatggatcaaccatgcaccagcaacaatgatgctaatcgtgggagatttttcagaataccgcggtttcgtagctgctattcaccgtttgaagttgaaatggtacaatgttatctttgcagtttgtgtaatatatataaggcaaacaacttaattattgtaagacattgtttataatccatcatcaaagaatgaagatagagaaaccattgcaaattgaactaagagaacatcttataggttttggcttgaaggatgatctgtctcgctccacctattggtgctaacaccgcgattaggactccaactattatcgagatctgtaaatcatcaaatatgttcaagagttaactttttaattagcattatgttataacatagtcgatatatatttgtttggaagaaaaggtaggctcatttacccaagatgcaatccaatgaaagctccaacgtttttgttgtttcatgaccaaccatataatgcatggcaactgccagaaaacaaaacaaaatattattttgttatattgaaactgttctatactaacataacattcatatatatactcatgcataaacttagttttaggtataaacttacgaagtaggacgttgaggagaaaacaagaccgccgaaaaaatggaatatatactgctataaatcccaccaacgctacaaaaacaacaacacatatatatacatgtaacatgttacataaagtaaccgtaatctaattaagaacttaactacgtacgtacgttttagtaaaatacatgttttggttacataccaacgtatgaagtacgtcccacaatacgaaggcatgtggaaggagtgaacttgagattcttcaccagacacgactctattccatcaaatacgggcattgcaaatacctgtttacatcattatactacttatctctaccagtcttgcgaagtttattattcaaagagaatagttggcgttcaagaaaaaactggatttaccataatattggaatgctagaaatcagcttattcaaactaaataagaggttgtaaacgtgaggtgccagacccttgttgagagtgggattataggccaaatgcatcgaaaaccatctctactgtgatctctaaacatttgaccggaaaatgttcaggagtgacgatacaagtttaaaaacaaactgttgatatatacaagggtaactcatatttgaatttgattagattgattaaattattaaaaagagacgtacctataatgccttttttttgccaaaactttagttataataatgttctgaatttgtttttccctttaaagacattgaaatagcagtcttcaagaaaaggaatatccgtgtcgcatatttaagataacttatcatcattgtaaaaacaactttaattagatatgtatccaaataattgccgacaaattagaagaaaacaaaaggaacacgaaggacttgctttcatacactaactggtgtcactagtcgtcgaagactaacgctgtcgtaagaaaatcagttccacgtgttccgtacgctggatccgccaactgtttagatttttatttttcacgttattatataaagtcaaactctaattagagaacatgaaaccaaacttattataagaaagaaaaaaaaaacagaaacaagaacggtggaagagacaaag

SEQ ID NO: 1609 - DNA, 542 bp, Unknown
  misc_feature (1)..( 542): cDNA_ID_2141504_gDNA_ID_1620424_Annot_ID_156681 3000 nt of promoter + ATG
cccatatagattctactctagaaaaacgtttgacattagtcggtcaaagtcgtatcatcattaagtcattaaccatatagttagattttttttggtagaatgcatctataagatatcgaaacaaaggaagaaaaacgtttccatatcatattttcctaaagataaaccacatacgtaatgtaagtataacttttcctatattgttcgactcgtccgtagcctcgatttcacgaagtacgcaataaccttgaagtttgaatcttctcataagaaaaataataattttaacggcaaaattcaagattcataatatctttcttgtataaatctcctcttattcaagagacattggtcttatacctacgcatcactttctggtccaattatcgtttccctatgaacccatttcttcttctctaagaaacttcttccttcttccccaaacttactctctctatctctataaatctctctgtttctcttcatcaaattttggtatcccaaaagtactaattctgtgtgtgttaatggttctagttatg

SEQ ID NO: 1610 - DNA, 3000 bp, Unknown
  misc_feature (1)..( 3000): cDNA_ID_3063350_gDNA_ID_1620424_Annot_ID_156673 3000 nt of promoter + ATG
gttgttctatcaaatcttgatgctcccataaactctcaaacccatttgtatcttcttcttcttcttcctctgaatcagaaccagaaccagaattgtcgcttttacggttttgtcctttcttcagtgatgtttctgcgaaatctgaatctgataaaaacccatcttcgtcgttgcttgtgaatgtctgacttgaatcaacaaaatcagagtccgactccaaaaaatcttcctctgttaaaaatctgatttttttcttcttaaaggatgaaacagagtaatcctctgtttttactttatcctcgccgtgaaaaacagagtaacctaaatcctctgttttctcttgcttctccttcaaacaatcttcaaccctaaaagtcgccgcctttgggttttcgaggacaaaggtgagatttttcgccgacggtgtctcgtatttcctcgccgccgccgtaaaaatcaccggagaagaatcagaagacaaaaaactgctctcgctctccacaccgcaatcatcactcaacgatctataaccttctctgcttaatctctcgaaagtttccgtctgaaacgcgaatttaaaaaccaatttcggcgattcactaacttcttcttcatcttcgattccagaattttctaattcaatcatcttcgcttctactgattcttcgagtacagataaaaatcgagtctttgttgtgtcggtttcaacaattgtacctcttcgaacactgtgtttatatttaaagaaaagttaaaaagtttccttttaattacgcgtattttttattaacgcgtctaaaatgatatatagtatataaaaaaatatcacagaaatggaaattaaaataaagtacctggagatgaagaaagagagagcaaaaccagcatgatgatgtgagatcaaattctgaaaagtaaaaaatggaattgacgagaaatttcttaagagatgacatataaatggattagtttttgctgacgagtcgttgttaagtcggtgaagatgttattttttcaatgaaactgttattatctaggttgaaaaaaactcatgcagaagaaagtgtaaatttgcagataaagagactttttacctaaaaaccaaaagaaaaaacgtttgtgaaatcgaaagatgatgacgatgatgcatgaatgaataatactaataataataataataataataggatattgaagtgagaactaacagatgagaaatttaagggaaaggaacaagtgagcaacatgtaattgtcaacaaaaaaaaagacaaatctaaagtgttgttctttgagctaatcttatggttgctttgaaccatggatttctccactctgttattggatgccacatacccatctatcactacaagtcacttttttaaaaaaaattattcacacaatttttactttaatttttgtcgtaattgaaagtcttttatataaatcacccaatgccacaaaagtatatttttatatgaatcacccattttgacttttttcggtatttgatgtggtcattttatttatatttgatctttaataaaatcaagaacatcttgccgtgagccacctctctccgccgtgaaatttccgatttgactgtaacgatgttaccccggtttatataccttaatgtgagctctagaaatgttttcttatgtcttagagtgttaagaataggattctaggcttaggttagccttaaactcccgggaaccaccacggtcagtgaaagtcaacggcgttgactccggcactgactggaaatttggtgagttctccaggcatgaggaagcttttcagtggccattctgatctagaatcatcttacgttgagataagttgggtatggttgattcaaaccaaaagtcaactcggtttaccaaccaagtcaaagtcaacaatcttaacttttcctaaaccggtttggtttaggataagtgcctcccccgtgtggttcgacttgatgaaattaaataaaaaccggcccagttttgatttcattttggtttaacttggattgagatttcaaaaccggttcggtgtaattaagaccaagattcttttcatatcgaaaattttgaaaattggattaagccactgtttcagaccgaggctcttgactagtcacgtcatgacgtcactcaacgcattttagtcaaatccccaatttttgaaaattctcaacaaaacgcctaaaagcacttatcaaacttctccgacaaactaaagatcaaacctttacgagaaatttctcgcttttttgtgtaacgaatgtaagcaatgcatcaaggaatttgatagattgaaactttttgaagtgggtagtgatgattgaccagagaagggtaatgtgtccaaaaaaccaaggtttagcagactatgtgttgcagaagaagcaagaaaaacattgtttgtactggggatgcaacaataataatatacgagattttgggaggtgaacggagctggttctttttattaacgataacaaagatcgagagattacaacaagttagtttcgtcgcgggggttatagactatcctccgagccgagacttaatcgtaaaagcagaaagacaaagtgcagaaatgggcgaggcgacgatttcgggctaggcggcgatgtcgtgttaggcaacgatttcggacaaaacaacaattctgggcaaggcaacgatttcggacaaggcaacgattctgggcaaggcaacgattctctttgtctctcagctaatctcctctggatttctctccttcccaatagtgcttctgagtatttatagagaatctaaatcctaaaatcccttatgtctcctctgtaaattacatttttgcccttccaagcttaatgggcatttttagtagttgaagccccttttaaacttgtgcatatctgttttgggcctcttaacatataaggggcaaggcccatgtccaacaatacgcccgcccttagtttgttgtgcgagagtttgattgagctcggcgggatatg

SEQ ID NO: 1611 - DNA, 3000 bp, Unknown
  misc_feature (1)..( 3000): cDNA_ID_2990578_gDNA_ID_1620424_Annot_ID_156665 3000 nt of promoter + ATG
acttaactacgtacgtacgttttagtaaaatacatgttttggttacataccaacgtatgaagtacgtcccacaatacgaaggcatgtggaaggagtgaacttgagattcttcaccagacacgactctattccatcaaatacgggcattgcaaatacctgtttacatcattatactacttatctctaccagtcttgcgaagtttattattcaaagagaatagttggcgttcaagaaaaaactggatttaccataatattggaatgctagaaatcagcttattcaaactaaataagaggttgtaaacgtgaggtgccagacccttgttgagagtgggattataggccaaatgcatcgaaaaccatctctactgtgatctctaaacatttgaccggaaaatgttcaggagtgacgatacaagtttaaaaacaaactgttgatatatacaagggtaactcatatttgaatttgattagattgattaaattattaaaaagagacgtacctataatgccttttttttgccaaaactttagttataataatgttctgaatttgtttttccctttaaagacattgaaatagcagtcttcaagaaaaggaatatccgtgtcgcatatttaagataacttatcatcattgtaaaaacaactttaattagatatgtatccaaataattgccgacaaattagaagaaaacaaaaggaacacgaaggacttgctttcatacactaactggtgtcactagtcgtcgaagactaacgctgtcgtaagaaaatcagttccacgtgttccgtacgctggatccgccaactgtttagatttttatttttcacgttattatataaagtcaaactctaattagagaacatgaaaccaaacttattataagaaagaaaaaaaaaacagaaacaagaacggtggaagagacaaagatgtgtagttccgattctcttcagcttcacaatgtcttcgtctatggtagctttcaagatcccgacgtcatcaacgtcatgcttgatcgtactcctgagatagtctccgcaacactcccgggcttgtacgtacctttctctgtttcttcttcgattgagttatttttctgtatagacttaagatttaatggccggttttggttttgttcatcagtcaaaggtttaggcttaaaggacgtttgtatccatgtattgttccttctgagaaaggagaagttcatggcaaggtttgattcttagatgattctttggttttaatttgtgtatgaaatatgggattttagggttttgatttgggaaatttggtgaattggtttgtgtaggtactaatgggagtaacaagtgatgagcttgagaatttagatgcggttgagggaaatgaatatgagagagtgaccgtcgggattgttagggaggtaaaagtttaaaggttgatgattataaattttggaacatgttggatgattataaattctgattttgcacatgcaggacaattcggagaagatggcagtgaaaacatatatgtggatcaacaaggctgatcctgatatgtttggagaatggaatttcgaggtttgatgatttaaacaatgtatttttagcttttgtgaactcattatgactggaaaaatggtacattgtttcgattcgcttcttaggaatggaaacggttgcacaagaagaaattcatagagactttcaagaaaatcatggaatgtaagaagaaacctcagggacagggaaatgatgatattagccatgtcctacgcgaagatcaataggataagactccatcgtcttggatggacttgtgtttgagtatgttctatatataaccacctttgttaaattatcaacaacaaaaaaccttcgtttttaaaaatctaaaataaataaaacgtagagagtgttgtattgatgtaagatttttgtttttgtataaatttaaaatttatttaacaaaaaaacggttttacaataaatacatcgttactgaaacaagtataaactgaataaaagagctaacgacaacaagtgctaaaccaatatcgtagtccgccttcgtagataggtgaacttgaagtaactaaaataaactaaaatacttaaccgattccgcatattcttatcgaccattttggcaagagagagggctggaatggatgactcgccatgccttcttccatttctctctttctaaagagctgaaacacatatctgaaaacaaacatatgaatttgcgtcaaggccgaatttgtagatagatcaaaatatcatgtggattatattattatatatatgttatacttgcaagtatttagagatttttgcatcttacttagcttgtgtgtgtttggtctatttgaagtatttgcagaaattctatcccacaattttgtttgtccgcctctatccaaaactgatatgcgttcaattattctgataaaaatttagatacatacgcaattaatcatgagtatttaaatccttaaaggttccaccatctaaatgactaaaaccaattagtaatcaataccaattgggttagtgggttttgggaaaatttaaagttttgtactcaagttggtgtgtctaattatttattatttactttatgaattagcataattaagcaaagaacaaagaatattttggtcaaatatataaaaagattaacatccatctgaaaaatcttttacctatagtttttgcaacttgaatatttacctcaatagataaaaactagagttatttttttttttttttgtcggcaaaaaactagagttatttatcaaagccaagttagcaaaataatctactatgatgacaaaaatttgtaactaaagaacataattccacgtcgttcaccgtttcgtgttcctacgtgttattcttttttttggtcacgttataaaacctcaaaaagctctagaggatcagagaaaataacataaccaatcccaagaagaaaaaaaaaacagagtagagattgataaaaaaaaa

SEQ ID NO: 1612 - DNA, 3000 bp, Unknown
  misc_feature (1)..( 3000): cDNA_ID_2141474_gDNA_ID_1620424_Annot_ID_156671 3000 nt of promoter + ATG
gatatattatttatcaaaattttaaaaatttaactataacaaaaaaatgaagctatattgcatattatttttgatttcatacaattattttgcatttttttagagatagatgataaatttgtaaaaattgacgtctttgaaagttatttttgcacaaaattccttttataaagaaaaagaaaaaaatttgttttgagacaactcttaagattaccttacaatacattgatatttaaaaacaaatttatatgaatctctagtagctatcaccctagttacattggctaatggatttctcataatagttttggatcctctaataatctctagttttggatcctctaataatctctagtatatgaaggacggaatttcgatcattgctctcaacttgttcatcaaaatctagcaaaattgacattttccgtcgaatatcacccatataaacttaaccatagtggaaacctaaaaattcacccccaacttttacaagaaagtgatctttctcattccttcatttgaaaggtttgaccttaacgtttttgttgtagtcgaaggagtatctttcacaacattgctgatcttagaacaaatgtaacccattattaccataagacttattttttctttttcagttttgacttgtgcctttatgtttaagacactagtagccacatttattacgctttttcaccgcaaaatttaacacgcactctctttgtcgatcccacaaactccatctacctaaccatggttaaaaatcatcaaaccttggttcccttgattaaaatatccctaaatccaagtctctttattatttcatttaaaatcataaatttagtttaatacaattgtcctttttcaaaatattatttctttatttgcttcagcaacagtcgtcatagtcatcatatcattttcttcttttcctcctctaaacgaatattaccaataaaaaatcaagtggaaaatatgtaatattaaaaaatctccaacagcttaagaagttagaacctttttacttatctttatttcttcttcttcttcatttttctattcacattctctgaaactcataccatattttcaaagctcttaacccaaaaaccctaagtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcgtattatcatcgttaataactttctattaaatattaattaagatctttagctttgtttgtttttgcattattattagttttgatttaatgttctttaccacgtcggtgtctcgctcgatgaggaataataccataacaatgttcgaattatatcatttgttgtaaacatttctattaatgaaccctgaaatgtgactaagtactccaataaatggtacacttttgatgtggtaatcttgtttcggatgaagaaacaaaaagattaataaacgagtgaaacatgattagttactataaatattcatttggtttcttatcttttaaagtactcttcttaattttatttgcaaccaaactagatgtagtaggtgtactttttttctttcttagatcctcttaattttattttatttttttattctatatcaaatgattagccatcattagtatattagtagcattgttgttaacacccagtgttttcacgtccgacccggaccgtccggtccgaccggttgaaccgtgacccgaacacttttccggtttgggtttagtattaaaatccaacaagttcaaaaccgaaaaaacccacaaaaactcatcattaacccgtgacccgatgaaccagttgaactggccggatgtgggttttaaaaaattctcttgattttggaataaaatatgagattttagactttattcaatcaatttttagatatttttcagttcttaaacccatttgatgtttaagattttgatgaagacttcacaatgccgccttaaaaa

SEQ ID NO: 1613 - DNA, 3000 bp, Unknown
  misc_feature (1)..( 3000): cDNA_ID_2141464_gDNA_ID_1620424_Annot_ID_156666 3000 nt of promoter + ATG
aatggtacattgtttcgattcgcttcttaggaatggaaacggttgcacaagaagaaattcatagagactttcaagaaaatcatggaatgtaagaagaaacctcagggacagggaaatgatgatattagccatgtcctacgcgaagatcaataggataagactccatcgtcttggatggacttgtgtttgagtatgttctatatataaccacctttgttaaattatcaacaacaaaaaaccttcgtttttaaaaatctaaaataaataaaacgtagagagtgttgtattgatgtaagatttttgtttttgtataaatttaaaatttatttaacaaaaaaacggttttacaataaatacatcgttactgaaacaagtataaactgaataaaagagctaacgacaacaagtgctaaaccaatatcgtagtccgccttcgtagataggtgaacttgaagtaactaaaataaactaaaatacttaaccgattccgcatattcttatcgaccattttggcaagagagagggctggaatggatgactcgccatgccttcttccatttctctctttctaaagagctgaaacacatatctgaaaacaaacatatgaatttgcgtcaaggccgaatttgtagatagatcaaaatatcatgtggattatattattatatatatgttatacttgcaagtatttagagatttttgcatcttacttagcttgtgtgtgtttggtctatttgaagtatttgcagaaattctatcccacaattttgtttgtccgcctctatccaaaactgatatgcgttcaattattctgataaaaatttagatacatacgcaattaatcatgagtatttaaatccttaaaggttccaccatctaaatgactaaaaccaattagtaatcaataccaattgggttagtgggttttgggaaaatttaaagttttgtactcaagttggtgtgtctaattatttattatttactttatgaattagcataattaagcaaagaacaaagaatattttggtcaaatatataaaaagattaacatccatctgaaaaatcttttacctatagtttttgcaacttgaatatttacctcaatagataaaaactagagttatttttttttttttttgtcggcaaaaaactagagttatttatcaaagccaagttagcaaaataatctactatgatgacaaaaatttgtaactaaagaacataattccacgtcgttcaccgtttcgtgttcctacgtgttattcttttttttggtcacgttataaaacctcaaaaagctctagaggatcagagaaaataacataaccaatcccaagaagaaaaaaaaaacagagtagagattgataaaaaaaaaatgagtagctccgattctcctcagcttcacaatatcttcgtctatggtagctttcaagagcctgacatcatccatgtcatgcttaatcgtattcctgagattgtctctgcaacacttcctggcttgtacgttacctctctctctcgatcttgatcttgatctcgaatgataattctctctgttttttagatctaaggtttaatgccgattttgggttgttttcagtaagagatttaggcttaaaggacgtttgtatccatgtattatcccctctgagaatggagaagttcatggaaaggtttgatttcttgagatcattctttgtgtgttgatcttgattcttgaataattttagattttgagaatttttttggtgaattgtttggtggtccaggtactaatgggattgactaatgatgaacttgagaatgtagattgggttgaaggaaacgaatatgaaagagtgtttgttgaagttgtaagaaaagtaagtttcaagatttattgattgcatcttcaaaaacactttttagtggtcttgatgaggttatgagaatatatatgcaggacaattctgagaagatgagagtggaaacatatccatggatcaacaagaatgatcctgatattggtggagaatgggatttcgaggttcgatgatttaaccatttttgttttgttttgttagctctttatgaatgatgaagtggtgcattggtttgattcgcgtgtttttgttaggaatggaaacgattacacatgaagacattcatagaggcgttcacggagatcatggaaaggaagaggaatccacaaggaaagggtagagatgatttcagcaatgtactcaaagaagaagatcccgcgaatgctccatcgtcttgaatggatttgtgtcgagtatgttctatatatcacctttgtgtctaaactccatattaaataaaaaaagctggagagtctagctaggttattgtggagactaatgacaagaatgtttttgtcatgttgtattgtaagatttgagttatatatcatgtggattgtattattgtgttatacaagagtctttaagagattttggcatcttacttgtggcgtctattgaattaagcgtgtatggattaagtgactgaaaagagaatttgtagtaccgaccatgggataagggttttgaaatatcctcaatggttaaagaagcatactataaacattggaaaggtatgtaacatcttttggttacacaagaaagataaggttcttgaagacttggtatgtaataagaagttaagaaccaagtaagaagtgaaggagagacgaaaatggagaaattcacagagtacttgcaaattttataccttttacataatttacaaatattacactctcccaaagagtaaagaaaaattaagtgagagaggacttaaaggcccaaatataaagcccattaggcctatatttaatataaccaatctggaccgttgaatatttattaagcccacataaatcgtgtccgttgattagaagagcccaagagaactctagggttttgtcttataagcttgatctcgcattaggtctttgcgcctcttgccatcttttgtcactcatcttcacaggaaaca

SEQ ID NO: 1614 - DNA, 3000 bp, Unknown
  misc_feature (1)..( 3000): cDNA_ID_3063391_gDNA_ID_1620425_Annot_ID_156695 3000 nt of promoter + ATG
aagcagcagaatcaaacaagcaaagaaacaaatactgcaccaagcaaaggaatcaaagaaacaaataaggaagcaaacaatgaagtaagcaataaacgcacagaaggaaacaaagctaaataaacacattgagcatgtaagcaaaggaatcaaagaagcatatatacatgaatgcttatgcatgaaaattacttgggggaataagaaaaagtttcgaatcttaaacagttccaggattatgaaaattctaaatatataattatttttaagctaatatgttactatatactccctatggatccttattaatgtattttgtaggattttcacatatattaagaaaatatattaacaattgattgtaaatgtatctttttgtgattaacaagtttctataactccaaatcaatagtattcaaatatattttttctgaattttacaattcatcaatactaactaataaatattgtataaaaaattgtaaattgtctttttgtgaaactacttccttttttagataatacaatagtaaagaacaaagagagtataaattatgaatttgtgaaagataatgtcatcactaacaactcataatgataaactcaaccaaacaaaatctcatatccaccttctcttcaatgtttactatatgtatagtgatgatatatgtgacgtgctatgaaaagtttcaacaagatgaagaaccattttcaatcagaggtcctcttacgacaatcaaggtacaaaacaataatgactatttgcttggaatccactgtaaatctaaagatgatgatctcggtttccacattcatgtcaatctaggagattcaacaaattttctgtggatttagccaaggacgagataataaaggcgtgttcaaaaatttataattccaaaatatatttttatagatgtaaaaattgtacacgggaagcaacttgcctcagacagttatatggttttttaagtggttaaagtagtattaaattctattattgattcaaatataaataaaagaataatttaagaactgtataaaatttgcatatgatgttcttaatctggaaaaaaaaaattattgtgaagtatattagagcaaatttttgtaagagagcgaataagagatgtgagctcgtaactcaatatttagaaccttgaaccgtaagtcaacattttttagtgaagttgaagaaaataaaaagggcatgagagggatgcgtaagaaaaaatttattcggaggaatggattttcttcttgtggatgataaggtacaattggatttaaaacttgtgagtatcttcaaggttatttagtggaaacatctattcttttatatattaattaatgttatttccaaaatattaattttaagaaggataaaatttggaagtacatagttgttttggaggaaaaaatcttgattattgtgggttatttaaacaacttccatttattgtaaatatgcggatatatctagtgattttttgcctaatttagattaatcaagataaatatgtatttaatttaaatgctgatatatatcactctgaaaaatttacaaatcacaaaaagttattattaaccaacaatcatgataaactcatcgagagtaaatctcaactcttatttttgctcaattttcattgtgtccatagttgtgatatctttgatatgttcagaagctcttcaaattcaacaaactaaagaaccacttcgaggtcatcttacgagagtaccattgtcaatcagaggtcctcttacgacgatcacggtacaaaacgataatgactatttgcttggaatccactgtaaatctaaagatgatgatcttggtttccacattctcaaacaaggtgaattatatggttggaaatttcatgtcaatctaggagattcaacacttttttctgtggatttagccaaggacaagataagaaaggagtgttcgagatttacaattccaaaatagatttttatagatgtaaaaattgtacattggaagcaaaaaaagatggtttatatggttatagcaacttgcctcacacagttatatggttttttaagtggttaaagtagtattaaattgtattattgattcaaatataaataaaagaatgatttaagaactgtataaaatttgcatatgatgttttaacctggaaattaagaattattgtgaagtatattagagcaaattttagtaagagagcgaataagagacttgagcttataactcaacatttagaaccttgaaccgtaactcaacattttttagttaagttgaagaaaataaaaagggccggagagggatgcgtaagaaaacaaattattcggaggaatggattttcttcttgtggatgataaggtacaattggatttaaaatttgtgagtatcttcaaggttatttagtggaaacatctactcttttatatattaattaatgttatttctaaaatattaattttaagaaggataaaatttggaagtacatagttgttttggaggaaaaaatcttgattattgtgggttatttaaacaacttccattatagtaaatatgcggatatatctagtgattttttgcctaatttagattaatcaagataaacatgtatttaatttaaatgatgatatatatcactctaaaaattttacaaatcacaaaaaagttattattaaccaacaatcatgataaactcatccagaataaatctcaattcttatttttgctcaattttcattgtgtccatagttgtgatatctttgatatgttcagaagctcttcaaattcaagaagctaaagaaccaattcgaggtcatcttactagagtcacgattcaaaatgataacgactatctacttggaatccattgtaaatcaagagatgatgatttaggctttcacatacttgcaaaaggtgaattatttggttggaagtttcatgtcaatttctgttattcgacgctctatttttgtggttttagccaaggacaa

SEQ ID NO: 1615 - DNA, 3000 bp, Unknown
  misc_feature (1)..( 3000): cDNA_ID_3063370_gDNA_ID_1620425_Annot_ID_156708 3000 nt of promoter + ATG
gaaggatctcgtgtagcagtagaagccgcgatctcgtttctctggtttttggtggcaaatcatcagtcgtggttctcccacttctctgataatcacagcggcgagagaaaattttgggcttatttaatcaaagttgtgttctcttatatagcacttttctcaattttcaattagtttttatttcctgagagtaaacgatttctcatttattctatattggtggtttaagattttaatttgagagagagaaagataaaaaaaacttgatcagtggatgcttttgcttcttgtggagtgtttgaagattttccattgatggagcagctttgtatcaggttctttccacactgatttattcatattgagttttttttttattgggtgtgaatgttatggtgaattgagtttaaacttgtttgagtagatattcgcttgttatgatgcatccgattccccaaacacttgcttttgtgttgatcttatattctctttgattcaattttgcagatgattctttgcattacattaatttacatcacaaactgacgtattgtgcatccatgaattcaacttgattcaaatgattggtgaccatagatgatagtacaaacatatatggtcagctggacgcctgcttgttaatgtcatccaagggaatctgtccattcagacgcaaacatcgatattatgctccttttatacacaatataagtaaatctgtttcttgttatatctaggattagtagacaattttggttataatattgggagtttccatacacaagtgaataaatggttaaagaaaaatagacgatgtactttgaatgggtgtttgaattggtgattatcattcatgtataaacttgtgtattgaaatgaaacgacctcatgagtcactagattaccacatggactaaaccgcttggatagtcatcaatggacaactatgtctttgatttgcttcaaatgtgttttattgattggtaaaattatcattttttgtatggttcagagttttgttttatggttttagatttagtggagaaggatcatgggagggtttgggtttaattttagggtaagtaaattaggatttagtgtaaagcgttaaaggtagagggtttacacactcgtatgaaccatttttgaatataatcatatgaatattaccataggaatgatcctatattttacagtttttacattaaaatgttttatctgcacaaacaaatacacgaaagatgaataacacaaaatctaaacattgttcaccaaatctaaacattgttcaccaaaatcaaataaaagaatacttcattagttggataacatatcttcgaagagtaatggacggattcctatagctgacaatcggcaagtacgtgttcatctatgatttttagaagtagagttgtatccatgaaacatcgaccaaatggatatagtgcaacaaatgaaggtgtatccacctagcgccgaacaaatggatatatattttgtgttttctcgtaaacttttcttgacatccatgagtcgacataagtatggagttgccagacaagacactggagctcacggcggccaccgcagcctcatggaccaaagtttcaaaaaaagctcataaacatcaaccaatcttcttgcataaccaccacatacccagccttatgcgtccaatcactttccatctacgcaaatgacatccaaacatttttcaattcaaaaacaaggcaataaattcaacagatctaacaaaaataaatttaaattgaaggataaaatcataaaatctagaacccataacaaaaaaaaagtttaaagatttacaatctaaaacctaagctagaatcaacgaatcacatgtaccattggcctttatgattcaaaaccaaagaaaccttttaccaaaaaaaaacaacgaaaccagaaaccgtaagtaagacaagagagaagagcatggaaccagaaaaagaggaagattaagggaagagggagttcggtagcagagagtaaggatctccttcttcttcgtctcgaaaaggagaaatcgatgatgttactttttttgttggtcatagtcgttcattgatggaggttgcagataatgaaatggatttgatgatggagaatggagaaaagaatacaaaactaaaaaaataaaggaaatttagggtaaacatagattgtgattgtgaattttgagataacctcagaattttcataattttgtaagaattattgagaacgactatgatgtgaaagaggaattgaaaatgatgaaaaacaaaagaatatggaaaggagaaatgataaaaaaaaaagaaaaaattaggttctcacccacacgatctcattaagaataagtttaaaaattattgtgttttcatcacttcaggggcaaattggtccaatttcctctaaaaaagatggttaagtgccctctctcttacaagtgcctcaaacgtaaaaagattctcacaaagtgcctaataatgtcacatttcctaaattttaaccccggttagtgtttccgttagcaatgttaacagacgttaactcgtaaatgttattttatcaatttttattaaatgaaggttttaaaaggtaaccaaaattaacttaggtatttttgttccaaatttagtattagaggtattaaacggacaaatttaaaatagatggcggatttttcaggtttttccctccagaaaactagaaatacagaaaatatcaaaagggtggttctctggggaaggagacaacagctgtcattcataaatgccaaatatattcagattaattatatatatatggctgaaaatagttcaaactaattaaatgatttagccactaagatatttttaatgcttgatttgatccaaaacatttttatgacatgaaagaatatttctctaccaaagaataattcccaagcgttgttgtttaaatgggttttatggtgaattcgcaaaatgaaggtggtgttggtggtgaccattc

SEQ ID NO: 1616 - DNA, 3000 bp, Unknown
  misc_feature (1)..( 3000): cDNA_ID_2141688_gDNA_ID_1620425_Annot_ID_156709 3000 nt of promoter + ATG
ggatctgctactgtcttctttgcctacatcgggtttgatacagttgcaagtatggcagaggaggtcagtgtcatttattgttgcagtatcatattttcaagcactggtatatatacttatattgctgtttcatatgcaggtgaaaaatccccggcgggatttaccgctcggtattgggatttcgctcctgctttgttgtttgctgtacatgatggtgtctgttgttattgttggtttagtgccgtattatgctatggaccctgacactccaatatcatccgcattttctagtcatggaattcaatgggctgcgtaagtccgttaatcggttaagatgcaaactattcattggcaggacttgttttgagtttgatttgtttttcccctgccattctgtcttatagatatttgataaatttaggtgctgtcatggctctctgttctgcattaatgggctccattctccctcaggtaaactagaaacataattcaagtgtttagatctgtaaaattaaggatttaacaatgagaattttgaagaacatatacacgctatgtggatttcttttgtaccaacttattcaccaaagagcttattcgtttttcagccgcggattctgatggcaatggctagggatggtctcttgccttcatatttctcatatgtgaatcaacgcacgcaggttccaattaatggcaccataaccactggtgtttgtgcagcaatcttagctttctttatggatgtttcgcaactggcgggaatggtaattaagatgtattatgattcattaatgttacctggtccagtacttgaagcaccacttagcctgtaactagaatttgacaagctttagttggtgtaggtgagtgtcgggacacttgttgcatttacaatggttgcaatatcattgttgatagtcagatatgttgttcctccagatgaggtactgataagattggaactggtaaactctatctttattcgatttcaccttagactacaatatagaagattcttgattaaggagagaagtctctaactctcttccaatggccaaaccagaatccccaactcctttataatgctacgcactagtgactagactaacaaggcttttatcaggtacctcttccctcatcacttcaagaaaactcatccagtcacgtcggaacttccatccgtagtaaacaacctttacttggcaaagtggatgattcagttgtcgataaggaaaatgctccaggaagttgtaagttacaattcatttttgcaaacaaggttataggcttatagctatttattcgcattggtgcatgaactttatatgttagctgatctctggtcttggtataagcaaaatttcatatctgttgttgattctgtaggggttctcaacaaaaaaaacagacggaaatttgctggttggagcattatgttcacttgtattggaaacttccttttaagctatgcagcgtcaagcttcctcttgccagggttagttcatcaacagtttatttacttgaggctctatctttcactgggtttcaaaacttgggcctttttctataatactcagctccattttatgcaaactatgataacagactcctccgatattctctatgtggtgttggtggattgttccttcttgtcggtttgattgttctgatttgcatagatcaggatgatgctagacacagttttgggcattctggaggtacttatgtcctttctttttcccaatgttttgtagtaagcatttcatttggcaacaaaccaaaaagttcagagttgtaacttagaactctttttgttctacaggcttcatttgcccgtttgttccgcttttgcctatagtttgcattcttatcaacatgtatctcttggtaaaccttgggtgagttatggatcatgacaccagatttgtgaatactactaaccgatgacttcactgttgatatacatttgttttgctaatgttttagagctgcgacgtgggttcgtgtatcggtttggctgttcctcggagtggttgtttacattttctatgggagaagaaacagctctcttgtgaatgctgtttatgtctccactgctcatctccaggagattcgtcgcacttctggacattctttggcttaagtctacatgaaaccatcaatggaagctcaaggaagtgggagtttcctttgtaaaatatgttcaacaaaatctgtataataatatatttttgagattggattatcctgtgtaaatacaaagttcaatgccactgctcataggcattgtatattttttttaaaacctaaatggtctaaatgttatctggtggactattgtatattttttgaactgctgaatttggtggactatgttgaatctggcgactaaaatagcaaatggaaggctatctgtgaaaacttgctgattggtggaccggatcctaaatcgactcgaatccgacatggaatagttataaaattcaaacggataataaactatcctacccgaattccgaaccaaaatccgaatatctagcttagataacggtatgtctttctaggatggtcaacgcattcttatatttagctcatatatgaaatgaccacatgtaaagttgatatatatatatatatatatatataaagggccacaatttaaagttgttatcagtcggttaacgtcatataacgtcgtgtaaattttggcatggtcaatgattaaatttgtatgaaatagtccatcaacgatttttacatgtattaaatagtcacatgcgaagttcacatattaaatgatattttttgaaaattcgcgtattaaaagaaaagtttccccaattaattgcatttaaactttattgtgtacagaattgcatcaaaacttaacccaaaataaaccggccggtacaaatcggttaacaaactctgttaaaaaagaataacctagccccttaaaacctcatttggaactcaaaaaagcagtaccggaaaata

SEQ ID NO: 1617 - DNA, 3000 bp, Unknown
  misc_feature (1)..( 3000): cDNA_ID_3063381_gDNA_ID_1620425_Annot_ID_156702 3000 nt of promoter + ATG
atgtgagagggattatttttgtggcttttcataatgtgaacaagttcatcaagacaccaagccgatgatgcgtagtcctttgttaaaacaacaatgagaattttcgaggtttcaatggcattcagtagctccggggaaatatattctcctctttgcaattccacatcatccatgaatgtgcttataccacatcttctgagagaatcgtaaagatggctcagaaagttcttccgcacatctgctccacggaaacttacaaacacatcataggtccatcgctcaggaattcgctccctgccttgagccatacctaacatgtgattacaaagagaaactaaggagtgtcatttgaacaagaatctcagagaaagaactgaacagcttaaaaatgtatgcttgggggaaaccatgttttgacaatgaaagtatgaaggggacgtgtggaatatgaacacgacgataaaacacggcacgagcaagaaacatcataggtcactttcctaaatacatgttatcttagcaaggttacgtagtgaaacctttctccaaacaagcatgctaagttaatatattgtaacgaatcacagtaaacaaaactctgtactaaaagggaattttcaaccagataatgaagctttaattgggaagcatgatcagcctaaagttatcttgtaatactactttggtctttgaaaacaattacaaatgattatttgtactaaaaaatggattcagcaaaacaatctatcagcccacaaagttcacaaaacaagcaacaaaagaatggagtaagagctttacttaccatataagagacacaggagaatttgagctagtcctttttggcacactgaagtaaaaaaaaaaaacagagaagatgattttaaagagaagatgaaagaagaaataagaggaacatatataaaacaaatgaaagctcaccagaggactatagctatacagttacagagctgaaatcatgaaactgtagaatgttcaaatcaacttctttgtttaaagaaagcttctttagatctttcacataatgaaattgaaccaaaagaggataacatatcttatctcttgcatttgtgactctgattaaaaaagttgactttccaatctcaaaatcaactctggaggacccataagttagaggaccttgacttaaagctaataacagtgaagaaaaggaattgacaaacaaaacaatccactgatcttctttgagataaacaacaacttgtttaccgaatttctcaatcatctttactctactaaactcactgagacaattcatcgaacaccttcaaggcaatgcagcaactaccttaactctaatcaattaactataaaacaagtcaaccaaaattgttgacctaaagcaagccgtaactaatagtcaaatatataccacaatttaacccttgagatgaaccgtttatttggggaccgaaacgctggctaccttatatctttgattattgagattcgagagagatacgttatgccttttggacctaaccaataaagtttccgtagtaaattaaaatagtcaataaatggttgacacatatcaacatctaactcatgcgaatttttaaacccaacggatgcggttgcgactagtacgatagtttgcaaaaacggatggtcgcaattttaaccattaataaatattttaaaatataaatttaacggtttaaaacatattgtgtttgcgagagttttataactagtaaatttggggttgcaatagggattagtcggcgatgaccaaaataaaatataatctataattacaaatatattcttgtttacttatatatgtaattataaagggaattttataaaatctactactttttctggagttcttttacaatttctacaacacaaagctttcttttacacattgtaccacatttcattatcacatgcacatttgtggacgaaattgtcctagatggtgacagactgatgtgacagccttttgtttttgtctccagatcttgtctccgattagaaattctctattgcgtctacgccttgtcttcgattttatcatcttgctctattattatgaatcccacatcttgtccaccaattgttctcatttaaagattttgaattttatttagattttttgccatctattttggtccacagattagttgaacgttattgtcttcacctgaacatttacaattgcatataattctattttaataatatattatatcggggataagttaatatcgaatgagtgatagaattagataagggacaaattcagatcgaaatgatagacaagataatatgttataactggatctttttgttattttgcaatcgaaggaaaaaaagcaataatctggattggtgaagacaataatgttcaactaatctgcggaccaaaatagatggtgaaaaatctaaataaaattcgaaatccttaaatgaaaaacaattggtggataagatgtgagattcatgataattttgaaagatgatgaaatcggggacaagatctatatacaacagaaaatttccaatcggggacaagatctggagacaaaaacgaaagttatttgtttagtctcacgaaatataatgtttattggttgaagcgcacgtgtgtcgagggaatagagattaatagaaagaaaaaataaatagagaggtaagagaaatagaaaggagcgataaataagaaaataaatatagagggtaaattagtaatttcaataggaaatgtcgtaggagttaaaaggggattggaaatgtggtagattttataagaaattgaaaaaaatggtaattgatgtaattttcccaattataaagaaaaattcattcaaatgctcttttcatgatgccccttttcaactctaccttttcatgatgccccttctcattatgtagattttttttttttttttttatatcaattggctaaatacagcacatctggttcagctaaactaaaaaaaaaaaaag

SEQ ID NO: 1618 - DNA, 3000 bp, Unknown
  misc_feature (1)..( 3000): cDNA_ID_3063374_gDNA_ID_1620425_Annot_ID_156704 3000 nt of promoter + ATG
agcttcaaggctggcgggttggagatgtcgcttcctcagtcttgcgggtcggattacacttactaaatcagtcctctcatccattccggttcataccatgtcaacaatttcgctgccacagtctattttgaataaattagacagtatctcacgctcttttttatgggggagtacaatggaaaaacgaaaacaacatcttattgcttgggatcgtgtgtgcttgccaaaacaggatggagggttaggcatccggtgctctacacagatgaataaggctcttctctcgaaaattgggtggcgtttacttcatgatgatgtgagtctatggtcgaaaatcttgagaagcaagtaccgtgtcggtgatattcataacagagcgtggatggtgtctaaaggtacatggtcttctacatggaggagcgttgtcgtgggtctgaaggaggtggtcttctcgggtttgagctgggttctaggggatggtgttgatatcctcttctggaaagataggtggatgtcgcagaccccgttatgtgaggtggtaacatgcgaattaccggcaaactgggaggcggttaaaagttgtggatgtttggagagatggagtgggctgggatttacagaggcttacgccgtatttcacagaaggtatgaagctcaagttactatctttggtggtggataatgtgacaggggctagggatcgtttgtcttggggagggtgttccaatggtaattctacagtcaagtcagcttactcttttttaagcttggactggagttcgaagcagcagatggcgcgttttttctctagaatttggcgtgttgtagctcatgaaagagttcgagtgttcatatggttggctgcaaatcaggtgttgatgacgaatgttgagagatacagacggcatttatgtgattcgagcttatgttcagtatgcaagagtggggaggagacaattctacacattttacgggactgtccggcgatggcgggaatttggacccgcttgttaccagcacggagactctcttctttctttttgaaatcgctgttagaatggatctacgcaaatttaggagaggagatagagattaatggttgtccatgggcggtcactttttcgcaggccatatggtgggggtggaaatggcgttgcggtaacatctttggcgagaacaggaagtgtcgggatcgggttcgttttattaaggatcgtgcgttggatgtttggaaggcgcatgtgcacaacatgggagtgacgacgcggacagctagggaggagagattgattgcgtggtctccgccaagggtgggttggtttaagctcaatactgatggggcttcgcgtggtaacccgggactagctacaacagggggcgtagttcaagacggggatggaaattggtgttatgggttttcgttgaatattgggatttgttcggctccgcttgcggaactatggggagcatattatggtttaaatatcgcttgggagcgcggtgtcacacagttggagatggagattgattcggagatggtagtgggttttcttcggacagggattgatgattcgcatccgctgtccttcctggtgcggttgtgccatggcttactttcaaaggactggtcagtccggatttcgcatgtgtatagagaagctaatcgtcttgcggatgggttagctaactatgcttttcttttaccgttaggttttcatttgtttaattctactccggataatgttatgtcgattgttcacgacgatgtagcggggtctgcgtacccccggaacgttcaagtgtaatttttttagtttttcagttttaataaaaatgggggttcgccccctcttctaccaaaaaaaaaaactctaccttttctgtcattttcatttctaccatctttaattttttaatgacccatttacccctaatttggaaatcgttttaagttaacaaaataaaatattaatattttcgcctaaaatgttccaaaataaatttcccgccaaaagtttccgaaaaaaattcacgccaaaaaaaatttcaaaaatatatttcccgcaaaaaaaattttttggcggaaaatagatttacaagggattttaaaataattttaaaatatttacaagggattttaaaagggttttaaaagatttagaagggattttaaaagggttttaaaagatttagaagggattttaaaagggttttaaaagatttagaagggattttaaaatggttttaaaagggttttaaaatatttaaaagagattttaaaagggtttaaaagggttttaaaagttgtataagggtttttaaaagatttttaaagaatttacgagaagaccctttaaaaactcttgtaaatattttttaaatcttttaaaacccttttaaaatctttggtaaatattttaaaatcccttgtaaatcttttaaaattccttgtacattttccgccaaaaacatttgttacgaaattttttttttgcgggaaactgtttttttggcgggattttttattttttggcggaaaaaaagtttggcggaattttgtttttggcggaaaaaataatatttggtgccaaaaatttggcgggaaaatttcagtttataattacatgttcctattagatgaatgtaatttggtcattctgttcaagggaagaagtatttttaaaaatggacaacataaaaaagtattgttgcaaaaggatattaaaaaagggtagttttgcaaatctcccaattataaattggcaccttttatctttgattattgaaattcgagagagatacgttatgtgtggtaaaaaaagatacgttatgtgtttcggacctggcaagtaaagtttcggtagcaaattaaaactttctttcacacgtgtcaacatcttaatcatgtgtaaggaggagacgttgcttaaggagtttgatattattttggaacaggaggagacgttgtggtttcaaaaatcgagatagaagtggattcat

SEQ ID NO: 1619 - DNA, 3000 bp, Unknown
  misc_feature (1)..( 3000): cDNA_ID_2141759_gDNA_ID_1620426_Annot_ID_156728 3000 nt of promoter + ATG
acgtttctgatgctttgttcctctcacttgctaagtttgatgtgatcctctctagatccgctaactcaaatatcttgcacagttagattcaagtttttatattagtttagaacatacatgcattatttcttatgtagaaattatattcatatatttattgtatttgtctatacagatattattggtcaggttgtcgatcggtctgaaatccaaaatcttaacgctagcaacaagcccaccaaaaaaatcgattttgcattatttcttatgtagaaattatatttatatatttattgtatttgtctatacagatattattggtcaggttgtcaatcggtctgaaatccaaaatcttaacgctagcaacaagcccaccaaaaaaatcgattttcatttgagagatcagcagtacaaacaatctatattcatattcattcttatttaaagtttgttgttttttttttactttttattaataaatttcttctttccatttttagtgacactcgcttggcatgtacactttgggggaagtatgctgagattgttgaccaagcttgccaggagtctactgatggtattgttgtttgcttaatccgatttgcgaagatcaatctctacaatggtaattatgttgatatgtgttactacatatctatactattttaaaaacacgaccttttatttttaaaacagatactaggagtgtttccaattcttttgatgtttcacaagtcttcgtcgatcacacgttggctgagttgggtctttttaagcaaaggtaattgtatttatttgtcactaaatatatttgtttctacataatattaaccaaagtatattttcttgatatatagcataccaactgatgggttaactttgggaagttctggatcttttcacaagaggctctatgcaccaagaactggggatgacgatggtgattatccaaggcaaacaatcaaggaagtcctcacattttctgatgtactattcattaatttatttatcctactaacatttttattacatttttatatttttagcttagtttgtgaattcctctttaaattcatttgaaggtcggtaagtgcaaaacagtttgcactgtttcggcaattgatacggattggccgtggtactatttttgttgtcgtgctcacaacaagaaggttgtcaaagaagaagctatcaaatttgaagatgtcaaacttcctcaaaagccaagattttggtgtgaaatatgcaatggttttgcaaaatctgttgttcccaagttagtctttatgaaatctttatattgaatgtattatgatttataatttggtatttttaatcttataatcctatttaactttaaggttttggctacatctccatattatggaccaaaccggtgaagctaaatgcatgttattcgatagtcatgcaaaggaaattcttggcattactgcccatgatttgcttgctgggtcatttgatgaggtatattgtcttttttaaaaacaaactctttcattaaaatgacaacgttcatgttataataatctgtattttttgtagatcgaagacccaactgttttgcctgatgtgatcaattgtttgaaagggaagacttttcagtttctattgtgtgttcaaagggaaaacatatttggtggatatgattcattcactgttgcccgagtctacaccgataacattgctgatgaaatcgttcaagaggactatgatgcatacgttgatccatcatccttaatttcgatcgaacaggtttgtcaaataacattaaacaattccaatcattaatatttattgtttagagttgtcttattaaaatgtttttgtattttcatataggattcccttatgctcactaatggtgttgacctttctgatgtggatttgtcgtcaacctttactccatcatcaaaacgaaaagaagatgatgttgatggaaatgatcacgcttctacaagtaggaagaagttttctaagatgaccatgtatgaggaaggctccgacgaatgatgctcaatgactacttaatgtttttgcttaaagttatgcatgttgttttatttttttaagatctaaactatttttattttattttatatttttccttgggaattaataaagttatttcaattatatgtcgttttgttaacaattttattacttaagttatactctctttgttctactaaattttatttgttatatgttcacaaattaagaaaacaaatttaatgaaatatttttatttcgctatttaagtataatattattaatatttctctcttctttttgttatttaacaattaaaatagtaatgattttaatgtagaacatcaatttttggaaatattaaaaaactcaaaacatcaactttccagaaaacaatattgttttcttattacgaatctaaagattttatattatactgttagtcatactaaccacaaacaattttactaattttgtattaattattaaataaaatcataattagcaaagattttgtacactaaataatcagtctaactaaacatacctattcctattttttcatagattcttattataataatgataaattttttttaacatgctaagaaataagtggcataattattgttaaaacctataagatcttggattggttgtagacgatttctttcctttttacacatcaattatttcaacgaggagataattgatcaatcatcctttaatttgtgttccaatttgcacaaaaatatagtagaaaaaataaatttgaatatacattccgtatattgtgccaaaatatatttagattattgatattttggttaacaatatattttcatatatattgtttcctattttttagcatggctatgtttatcatcttattttgtttctcatacatttagctttatactgaaaacaaataaacaatttttgttattttttcatcgattacaatgaagaaaagaaaggataatgatgaaa

SEQ ID NO: 1620 - DNA, 3000 bp, Unknown
  misc_feature (1)..( 3000): cDNA_ID_2141781_gDNA_ID_1620426_Annot_ID_156735 3000 nt of promoter + ATG
tagatcaacaagtcttgtagagttggttacccttggtcgagtaaatgggtcgagtaggaggggcgagtagatcaatctgcagcttcatctgaggttgccttgatcgagtaagagggtcgagtgaactgctgcctcctctgtggctgcctggatcgagtgaatggatcgagtagaatgctcatctgcttccctcctggttggatagagtagagggtcaagtagagttcttttaagctccttatgcacctgaaaacacacaaaaacatgcaatatgtatgcaagatgatcctatatgcataagtatgcaaaataagctaaaatggtgcaaaatgatatgatacaatgagaaaatgcaaagctaaatgatgataaatacacacctaaaatgagtaaaatatagtgttatcagttggccaaatggcggttgacttggatagcaggtttcgatcttttcgcaatgacattattgttattgacaatattgttattgcactcacttggtggaagatcgttaggtatcatactggccccaaacacgtgaagatccaaaattattcgaccatatcagatgtgactgtcgaacccaatatcgaagaaatgcaagagataaaaatggtcctcgattaatgcaagatggaaggaatcgggtcatgatgcttcaagtaaaatattgtttacttttattttcctcctttgtatccttcaaacaaatatttatgggaatttcatattgtctttgccttcaaaatgttcattttcgagatatatcataactcaaccgtataatagaataactcagccgctaagtaacataattcagatataactcaaccgtaaacccacataactcagtcgtaaagtaacataatttagatataacttagtcgttgagccacccacatagctcagtcgtaagtaacattggttagatataactcaaaagtaaaagcacataactcagttagtcgtaaaaccacataactcagccgtaacatgtaaaatgaccgaacctttcaacttccctatttatataactcagccgtaacatgtaaaatgaccgaaccttttgactttcctatttatataactcagccgtaacatgtaaaatgaccgaacattttgacttccatatttaaataactcagccgcaacatgtaaaacgacaagacattattgcaaataactcagctgggacgttaaagaaattgcaaatattacggtgcttagagtctacaatgtcacgaatacatatagcggttaccaaaaaagggaaagaagacacaacacatacaattcgtgcaaacaatactatgcacgacaagttttaacattgtgcccaacttctattcatcgagaacatccgtgttccttcctagggcgtttattctcaacagcgacttctagtgctgatttcatccttagtttcttgggccagtctggctggttcacaacaattggaggcaagcacggttggtcaattacaattacagggacatggacttttgtatctgaaggcatgattgcaccagcgtacgcattgacaaaataattgctcgtatagtaagcactgcactgggatatacgagacacacccatatgctctgcagctgcgattgaatggatgcatggtaatttttctttctcgaaaagatggaatgtgcatttttttgcatccacatttacaacatgcaaagatgttccataagttacttgtacgcggaaagcatcaatcgtttgtacatccataagtcttgacgttgtgacacgttcctattagtgagatgaaaaaaaaaaaaatacgttatggctgagttattctcattatgaccagtttatcattatttgaggactgagttatgcactagttatagctgagttacatgtaacagtttatcaacactacgtgtgagctgagtatgctgcgtgctcgcatcaactctccgttcagcaaaccatcttgtcatcatctgtcttatcgcttctaacagtcaagctatgggaagatttctggcttttgacagtgctcttttcattgattctgctatattcatagtcattaaattgtatatatcactgggaaaatgaacacgcgcccacatttcaacaccagctctttcgaggtatgcatgtagttgaggatcacgctcttcaatctcgttgaacgcgtcatcaaaatcagtccgcctataacaccttgccgcttttttcaccagagagaacaaatgttttcctttgaattttagcaaaatgttcttatacaaatggtaagtacaaatcccacgagcagccaacggatacacttcaccaattgctttccctattgactgatgtctgtccgagattatcgccaggtccgttgcgccatgaataacaactttgagttgcgtaaaaaaccaacgccaagattcatcattttcagtgtcaactacaccgaaagctaacggaaaaatctgaaaattaccatcctgagctatggctatcaggagcgtccctttgtaactaccatggagaaacgtaccgtcgacatcaacaactctgcgcatgtaatgaatcccagcgatactggcaccaaaagcaatgaacatatagttgaatcttccactctcatcaatttgaagacgcgcgactgtacccagatttgtccgtcgtatcatgtataggtaagaaggtagttcttcaaaactactattaggggttcccagagtgagctcccttgcaaacctcagcgtcttgtatgacttccaataacccattagaactatatctgcagcggatatgtggaaaccaatcaaagacacatatgcaagtgcaagcaagggacatgttcaacaaattcgggttcaactgaaacaatcttccaaaggtgacaaatcgattgatgagtatatacagcatctcacaacaacgttcaatcagttagctctcctaggtaaaccgattgaccatgaagaagagatcgagttcctcctagcagacctacatgaagactacaaaaccatg

SEQ ID NO: 1621 - DNA, 3000 bp, Unknown
  misc_feature (1)..( 3000): cDNA_ID_2141767_gDNA_ID_1620426_Annot_ID_156730 3000 nt of promoter + ATG
atgacgatcaataagagccaaggccagtcattaggcaatgttggtatatatttaccgaaacctgttttctcacatggacagttgtatgtcgctatgtctagagtgaaatcaaagggagggcttaaggttcttattacagacagtaaaggaaaacagaagaatgaaacaacaaatgttgttttcaaagaaatattccgaaacctttaatagattattttttcaggtatgatttatttattttgattattataaaataaatatcattgtaaaaaattatataacatactaacttagtcgtttttatatttgcaggttggaataattaataaaagcatttctttggttaattttcttaatgcaagctttttaataccagtggagaattatgtaatctattctttttttattttaatttttttattatgagttttaaatataaataaagacattttctaattattttttgtcaaaatttataaaatagagtttttgtggaaccgaggaactacatatacaaaatatacaattacgtacccaaacatacataccaactatagacatatattttccatgctacaaaccgaggaaactatatatactaaacaaaatatagtttgaccagactaaatatattgttcatgtaccaataatacatgataaacaaatacatgtttaaagataatgaaaataaaatagagtttttgtggaatacacagaactgagatttgattattgaataaatcaaagataccgtgcgtagcacgggtactggcctaatgtataagttattttgtaatctttaactagaagttgttaattatcttcctaatcaatgtgggcttaataattgggcctatatttttattcttgtaatcactatcattgttcttttcccattgatctcagtcagcaaagtagataaaaataatgttattttcatttattatatcagttagatttatataaatttcaatttccagtagtagttaattctagttatgctcatttaaatgtaaatttagaaaataatagtaattttaactaaaataggatttttcctaccatttttaaccatccatttcttatcatacactaaataaaaaattattagggggcgtcaaaatatgacccatgtttggtagcattccaaaatttacatgaagttctgaaactttaatcctttaatcttttgtaaagaaaacatagtgtcaaaatctactattcataaaattttaaatttattctaaatcaaacctaaaataagaaaatattttctaaaatgaaaattgggcaatatcattgaagacattttcttaaaaaaagaggtcaatataaatgtgattgttcatacttactcatagggagaagccccatacaatggcactgccaagtagagaatatgaagcagtagatgatgggagttgttgtggaagttgccactgaatgcaaacacgagaagggccgttgaataaatcattcccatcatattttcaaatattgtttttagtctctactcttaccaaaaaaaataagggttaaaagattttcttaaaaacaagaaaacaaattccgatcatccattcttaatgaattactcgctcttatcttatttttttaagaatacttggatcgtaattgtagcatattgagtttgaatttcttccattttgtaagtattttttttgttgggcttctgttttaaaactatctacaaatataatgatgatatatttttaacaaaaatcttttggatctacataatgcaaaagagcttttggttattttctttagtttttcatacttcaatggtaggctatctctaatgggattctctgaaaaaattaatatattaaaattatttaattttatagaatttaataaatattgcaaatcataaaatattaaatatatataatttttatttttcaaacattttaaaatagatgtaaaaaaaagaaccggaatttaagtgttttggttctgtaaacttgtggttatgttatttggttcttaaacttgtttttttttttcctaaacttgtggttaagtgttttgcttcttaaatttgtagaagcaaatttctggaataaaatttgtggttatgtgttttaagtgttatggttaaaatttggttcccataagtaatcaaagctttcttgatttgttgaaccatgtgagctttgacaactgcaatgttatctttaataaagaatgataaagtcatgaagatatggaataataataaccaaaaagccgaagataaattggaaagggcttagtttgaaccaagttttaggaattacaaatcacattttgaacagagagtattatagaacaagaaggaaatcatgaagataattacttggaaactttattcttccctgcaatggcaaaaattgtgggatctgtgaacaatgcacacattcttcatcacataaataactcgaataggcttaagagtctggacttagaggatattactcttccgtgttcaatttataaggctgcagaataaaacagtgaaagaagtagatgagattcataaaccaaatatcaggaaatcaaattcttatgatcaaatagaaaatctagttgtctgcactcaccaaaagcatagagtgaaaaaaaaaaacaattagcatttaccttaaaatttccaaattgtttcaatcacatattcaataacatatgcaaactaatcacgactcgtttttatgattgaaaacagatacaacaacagattaaattcaagtttgagaaagccaaacgatttagattgatctatctatcaatattgccaaaacgtaatcatacatacctataaaccttaaatgtaatcatacaaagtaaaccatagcctcctaaatgattcagatttgcaacaaacgaagaaccctaatttacaaaacgtaatcctaaaatttgttcaatccaaaaactctaattttggagatttaaccacaaaatactttatctcgaccaaccaagcctaaaataacc

SEQ ID NO: 1622 - DNA, 3000 bp, Unknown
  misc_feature (1)..( 3000): cDNA_ID_2141842_gDNA_ID_1620427_Annot_ID_156750 3000 nt of promoter + ATG
tgagtacgaattagatgctagaaattgatagtttaaggagtaatacagaatgcttcatcatttagttttttttttttcatttgttggtgatgaaagcttcttattaaatacatcttatcataagtaatgcaatagaacaaggatattttaagaaaatagggggggaaatgatgtattgtggactattattgtgtatttgacgaaatcaaattttgtgagttaacacaaaacaacaaagtgctcagtattacttaattttgtttattggtactactagctagaaactaaaataaccgtcactaaaaatgttatttcttccattatttattttagaagtacaagaataaaatagtagttacattttctctgatgtgatttaatgtatgtaattgactagaataaaatatttgtcaaaatttcagttatggttaaactattttcgtctttaagcagtgtgccacgcaagctatgggtcatagggcttttgcatgaaagggaaacaaagtaacggttaaattctgcggcagccaaaaaaaaaagctcactcttcaagggtaatttcgtctttttccaacttcgaatctatctcttactcaagttaagatttatttggatgtattgaaatctatttggtatgacgaaatcttatcttattattttattaactaagagataattaattaagagatgtgataattacgtaatttattagataattaaaattacaaatatgccactatgagagagtcacgcgatacatagtactacagtagggtccagaattgagaaaatgattacgttaaccaatcaggggaccggtttcacttgacggtagcttatagatttatgccacgtggattttctgtggttcccatttgtaccggttacctggagatgagttgtcacttatgttcgtagcggtcgtttgttctgtgtgttactgtttaagacgcagcaggtaaccggttagcttggcccacgtgtggctcatgcagttttacacgcgtgagacttgtgataccatttgttttctaatttcttaaatttggattttttctgtgtgtttttaattattctgctgggtccttgtaattattggaacttttataactcatctgtgtaatatacaaagataaattcagttatataggcatgggtcctatgtatgtattggagaaaattcaaaaacttttccttttattctcaacagattaagtaactgataaatgttcctcacgtttttttcgtaaatgaaatactgagacgtttttttcttccaccaaaatcggaaatgttgttctaccaccaaaatctttcttaatcaataatttagttcaagtattgatgtatataatcttttacgttttgattgactatatatagtagtaaatcttctcttattatgaatggtttcatagaattataagaaaaattaagaaaaaaaattgtctacaaaatttatcattacctaactacttattttaaagggtgtattcaatcaaacatttcaaatgatttttgttaaaaaaacaaatccaatattatttaataataaatttcaaaagttataatgaaaaggttaaattgcatattatttttgattttatatgattattgtatttttttgatgtgatgggtaaaatgagaaaaatggatgatttaaacgatttttttggcataaaaccctaaatataattatgttttgtcgatagtgaattattaattttatttataatatatatatttttttaattaataattgattttaactcaataatgctttaaaaaaaatattcaaatcaaattatatatatcactaacggtttctaatttgaacgtgttccatgcattgaactaattaaattagatcaatttcgttttgggaacaaacacatttgtaccaaattactaatgatgggtaatatctaaatgttggagtagattaatataatgtaaaaaaatcgttagtgaaaatgatcctcaaacgacaactccaatagataagatcatgtgtttttgtatcaataattatgttttgtcgatagtgagttatttacttgattaaatatataatatataatataataattaatcttatctttataacatttttaataatatttattatattctaaattatatatagatcgttaacggtttctaatttcgaacatattccctttattgaagtaaccgttagtgaaaatgatcctcaaacgataattctaatagataagttcatgtgtttttgtatcaataattatgttttgtcgatagtgagttatttaatttattaaatataacaattgatattatctctgttacgctctttgaaaatataattattatttttaaaattatatataaatcgctaatagtttctaattttgaacatattctctgtattgaagtaactaaattaggttagtttttttatggcaacaaaaacattgctaccaaattatcgatcattgataatatctaaatggtgaagtattaatataatgaaataaaaacccgatagttagaatgatcctcaaacaataattctaattgataaatccatatatgtttatgtattagttatcatgtttggtattactgatgtgagttattaactttatttgtaaaatatatgatatttaaaattaattatattaatcactaacagtttataactttgagcattttcccttcattgatctcattaaattagatcaacctttctgtaaacaaacacattactattgatcattgattcatgagtaatatctagatgccggagttgattaatagtataatgaattagagattgttagtgagaatgatcccgaaacaacaattccaattgataaatgcatacacgtgggcctggagcattcttctggcccaattaaagcccactaaagatttagccttctctatctcatcgaaggccaattcattttttttccgatcaccggtcactgcttcgggtgtctcgacttcaactttccgatg

SEQ ID NO: 1623 - DNA, 3000 bp, Unknown
  misc_feature (1)..( 3000): cDNA_ID_2141877_gDNA_ID_1620427_Annot_ID_156760 3000 nt of promoter + ATG
agaaaagacttgtaccttaattttctcaaattctaataccctaatatattactacttactagtgtactaaagaagtcgctaacgcgtttttttgtatctttaatcacattctcacatgttggcttatcttttttttccttcgtaatcaataaatctccaaatatataaatgcaacacatacgaacgactatgtattctatacatggagtggagacatgagaacgtggggttgtaccgtgcacgtggagaggacatgtcttgcttaatgattatgcgaccatggaacaagtaaactttgaacttggggaatatttgctctcaagttatcaaattcatcttttttccctccaaaatcccaaatataatttaagatatcttttcttcttttaatttccctttctattctcatgaaaataacatataattaatctacgcaaagaaacattaaaatctcgataaaataacaatatccgattaatgtatacatataaattatctctctcacacatgttgttacatataaggcggtcaaatacaataacatggaggatcttcacgtgttctcttggttgtcttggcttggcttaagccactctgtataatctaagaagtgaattgtaatgtttttttctttcaattctttaacctctactgcatttgatatttcgtaaattttaatcctaaagagaaatatagttgaaaaaacaactttacacgacgttgttttccgatgaactttactcattaacaaatttaaaaacatgttatttgttttgccttcatcaagtggattgtaaaatgaacaattcaactagttattgcttatagttgttttgttagcataaaaacatagcagctagttcaactcttaaaatataaaaaatagtattattgaagtgtaagcagaattaagtgtcgttttacgtcaatcatttgtgtgccaaattgtttcgttccgtgcgctggtggtgaatatttttgtccaagtatttagaattacttgcggcagtaatcccgggattttatcttcgttttatcttcattttagtgcacacaacgtaagcaatattttactaaattttcgaattagtgttaatcatcgcttaaatcaataaatgtctagaaccatgtcagtagatttaaaacaagttaaacatactcaaagttgatttcacgaaactgttagaatggtgtggataattcggcaataaattcatgtcatctcgaattaatttcattgtcttattttgtctatagcagttactttttgtttgaaaattttatcttatacttattaggttcatttatttggatgaaaattagctccaactaataatcttgatgaatgtgacattaggtaagttaggtgtatatatgtaactgcttactactagttatagacttatagttccacatcttatcttatcaatctcaactaataactaatctccaaactctcaaatgataagatgaatttgatatgtggataacataatctgtatcatcatcaatctgtaaaataattactccattgaattgttttataatactcgagggtataccaaaagtacaaagaccgcgatacaggtaatcaaaccctggaaaattcgtcgcggaaaaccaaaaggtcagactaataagaatgtacgatctaaaaagaataaattcatccaatcatattaagcatagtcatattcgtggggtccattattcacacgacaccaacacaaatttatatttctcctttatataatttttatttatttatatggaaatacacctttctattttacttatctgatatctgaactaccacttttcttttttttttacatttctttcacattaatataatcatatttagtcaatagtcaaaaactcaaaattagtagaaaaatgatttattttattaccatgagcttgttactcttttctatataaagacacaatttattgtaatatagagtatagtacataaaaattaaaattatgtaatcaattgttaacataaaatcatcacacaatctaattatagtaggagtagtaacgtaaatttaattaaacaaccaattaaagaaaagaagaaaaatgaaaaaagaagctttccgtttcattgttttagcttttaattttgaataagaagttgttacatttgtaaaaacaaattttatatttaacttttaacttttttttattctaacacattacaacataaataaaataaaaaagataatttttgcttgaagtagaacctctctctcagtctctttctcactattctttggattcttttctctgtaatcaaagcaaagctctgcaaaaatatttctctccttttctcttcaaaactttccttttttatgattcatctgctaaaatgcaccaattttctataatccttcacatttctccaggtaacacattcgattcacctgttttttttttttttttggtcttcagcgattttttgttgtcgttattgtgtgtagtaggtgtgattttttttcttttcttcctggggatttttgttgttttcgttgagaaagtcttctttgggggtttggttgcgctgaaggaagaagaagaagacgaaataatggaaaattaaacaacgaaaattagggaaaattagagaattaagaaaggttttattcaatcggcgcgtttcaaaagtctacgcgattctcgagattcattttcaaatccttcttcctcgggatctatagtatagagcttcagtaattttgtcctcttgaggtatttgtttgaagaagatacgaattgatttttagctgaatgaatccattttggcagccaagcttttgttgaagagttcgatggtcaacgttacgctaatttcttatttgacaaattagttgttgtcttcctcttcttctgacattgtgccatttaacaaatacttcttctctgatccattattgtttttttgtttgcagagacgtctaaagaagcttgaaaccattattagagtatttgaca

SEQ ID NO: 1624 - DNA, 3000 bp, Unknown
  misc_feature (1)..( 3000): cDNA_ID_2105835_gDNA_ID_1620427_Annot_ID_156762 3000 nt of promoter + ATG
tagtcaagattaatcctgatctcgttcttgttgctgggagaaaaggtattatttgcttcgttcttggtttcttaattagtaggtcaatcagaactttgattgttattatgtttgtcttcgtgtttatatgtttaaatgttttaatgttgtgcttgtgttaatatttgatatatatgtctttttcttatcaaacaatagttaaaaaattactgtttgcttttagacttttcaagtgatttaatctttgataaggaaaactaaaataccatgttttcaaaatgaaatattctagttcatatatatatatatccctttcttaatatacaaatatcttacctcgatatttttccaaactgaaaatatttgtttttatgttgatgcgctatagcaggagaaaagtcgatgcatctatgttgtaggggattctataaaagaacttaaattccatatctttataacatataatataaagtttgatgatgtcaaatttcttttttttaatcacataactatacaggcatgacaccactacatcttgtagtaaaaaagggcgatgccaaccttcttactgagttcttactggcttgtcctgagagcatcaaagacacgaacgtgaatggcgagactgctctacatattgcggtgatgaatgatagatacgaagagctcaaagtgctcacaggatggatacatagattgcacaaaagcgatgctgcatctactgagattcatgtcttgaacaaacgtgatcgtgatggcaacacgatcttgcatcttgcggcttataagaataatcataaggcatgttcttacccgtctttacaattcgatattcatcgtttaatggttcttcaaatttttgaatcttatattaagaagaagataaaaaaaccaaaagtatgcaaagatataggttaataaaaaaagtcataaaaaatataatactctaattaatcttctcaaggccatttatgtgttataggattttctaatgaatggttgtcgtgaagcttctacaggtagtcaaagaactattaaaatgcatatcgctgaaccgggacatccaaaacaaaggtggtatgacagcccttgatattttacgtactaatggatctcacatgaacataaaaacagagaaaataattcgacactcagggggtaagagcggggtttctctatcaaaagttaagaccgcatctgtcttcttgagatcgcccataacttttgtagaatattgctccacgacaatgactcgctataagaaccgcatgtccgacggaacacgaaatgcccttctagtaataacagctctgattatcacagctacatatcaaactgccgtccaaccgcaagataaagatgaaatatattacacgggaaatatcatgataaatgtgttgtttgtgtggggattcaatactatagcattttgcttggctattgccttgacatttatactcttacctgttggtaaagcatataattggtggtacatctttatttcggtgcctctcgtttgttcttacgcactttccatgtttctcaagtatatacaattcccgatattatgtatgcctttatacttgatgatggcatttatactcggatttctaatctatgtatttgtactatacgtgggatggaagagggctaagcaggagaaggtaccagaaccaaaaagtgagctgacttttgaaggcttcacgtctatgacctaagccaatgatcgaccttcacaggatgttgggagcattattcatgtttgattgtaagtttgttaatacgctttgtacaaacatattccaatgtttttgagtactctttcatattgtaaactaatctgtaagttggttttttttagtcttttggggtcaaattcaatctaaattatatgattttttttttattttttttttgaattctagaaacaccataagtgacaaatatgtcactctagaacataacatgtatccgccgctgggcctcactaacagtccaagacaacatttatgtatcctagcgttgatttacttattctgcaatagatgagaaacagcctttaattcgttaccaatttaattggtgctaattaagtcaatagactcattagtcactactcagaattgaatctcacattggctattagtggagaataagactcattggctctggttgaattattgatttatatctgattcgtgaactgattgtttcaaaaagaaaaaaaggaaatcgataaggttgttatagaaactgtattcaaatcttatcattatctacaatttagtattcatccaacaatcgcatgggagaaaaaaacgagacaaattttggcctgcaacataatggattttctggcgcctttagaaaagtcctaacgtgctaacatttcaacagaaaaatgtctcatggaggaaagttataagtcagaaatgatgcaagagaaaggcaggatatcaagaggattacagatgatctaaggacccctaaatttccttatattatatttcttcttccattagagttaggccatgttccgctgttcgtttgctcattcagataattcatttggatgaagctgcaaactgatttacgtgtatatgcaaaattgagcatcattcatgagttttaaagattaggtcaatttttcgaattcatttagatagatgattcagtcaaaataacaaatcatcgatttggatgcaaattctagatgaggaaaagaacataacctaaatgatactattaccacttttttgtatcctagccaagcgttgatttacttattctgcattaggtgagaagctttttagttcttctttccagtttttttggcaaccactcgagtgaccaatttaagtggtgccaattaagtcaatagtcaatagactcactactcagaaatgaaaaatactacaaaataactatgctcccatatgttaaatataacgacactagtttcttggtccttacaattatttttctttctttgtaagtatg

SEQ ID NO: 1625 - DNA, 3000 bp, Unknown
  misc_feature (1)..( 3000): cDNA_ID_1010953_gDNA_ID_1620427_Annot_ID_156765 3000 nt of promoter + ATG
tgaactgttcaccacatttatgacaagaaacagaggaattgttgcctccattaatggtggattctctgttcatctccaatgaaacccttctgtttgtatgaaaccctaacccttctcctcctcctcctcctcctcgatctctctccgacaaagcaaacgaaccctttcttgtttggctcctgtaagaagctgaatggttaagataatgcatcggtgttcctggtctaagcatccctacataagtcgtagaccgaccatttcctccaccgccacctccgccggaatccgctgctccgacaggtgaagccatgtctccgacaccagtgatcttaagctcacaagttgagttactaagaataacttcatgagttataggatttagaaactcattgcttccaatagaacgaggactacttattggtggtttctcgaaatgtcttttgcttccatggattacgtctttgagatttgctattgatcttgaacatcctgataaaccaccaccgcatacggcggctccgccggatgatatgccggagattttcttggtggagattgtggagaggtgttgttgctgtttagtggtggatattgggtcgtggacatcagatggttcggatttacagtggagggatttcttgagtgagaaccaaacagttgggatgttgttcttgcttttgttcttcttcttcttttggctttttttgcttgaatcttccattgttgttgtcgatatctctctctttctttctctctatcttcttcttctgaatatttttggaagtgatgctataataaatataaattaaatattgtcgccggatgataggtaataataagtggattttgtcttatgagatatattaaaaaaccaagtttcttttctttctagaaggcatgtacgagcaaatgaatctgaaggaggtctacgatgtctcaactcaccgatgtaataagtaataacacgagagaatgtttctttcacttactgttttgccattcttaaaagtgtaaaaactgaaaagacttcacaacatgttcataaatcatgaaatagtaatttatagactagtccatatttacgaattatcacattaactgaatattggaatctttttagtggtaaacttgatttaatgcacggtaataagaaaagaaaaaacaagctaaatttcatgaacttgcattcattaacaaaattaacattagccataaatcgtgattaattcaatgattttggtttttaaaagatctttttttcctatagttaccgtgtagagaatcttgaattcatgtcatacttctaaacttttggaatttcctttaactttctcttacagaatttaattacagttaatacgatcataaatcaatgagactgtgcgtgagcaggttcaccggtctaataagtacttttactcgcaagaagaaacaaatattttatttctaaatttacctttgagattatatggtgaaagagttgattattcttctatgatgtctgaaacctagtcaggctaaaactacatatgtattcactcactattcataaatacgttaatccaagcaataatgatgacaaattgttggtcagtgacaactaaatgagaattactaatgaattaatagcatggctataggaaataaaattgaataaaagaacattgatttcatttctttctgcttgcatctgtcaattcactcttaaatgccccataagagcatatgaaacattctgacatttcttggaaagacagtaatcaatatacattttaacaagccattaaaatttatactaaacttcttattattacaccatgcatgtaactttatcactctagtttgataaataacaatagttgacataatatgtttatacgagcggacggtgaaatataagatttatttgtataaacgaaagtaaaaccgcaacgatagtacatcaatatttttgcattatctctgttcctaataaagtaacactgtagtatttacatcatatcgacttcaaaacatgaaggaatggatgacaataacagttcgttaatgatcaaaacacaataactctaatctgaattgtgagtttgtcaaactttgaaagtgcatttattacgaattgtagatatcgcaaagggtagataatggaagtaggtgtgggtgtcgttatagccatattgaattcaaaaggaaagacattaaattagaaattgaattttgaaacatgttgatagatcatgtccttcttctgggttacccagttttgccctaaaacctaaaaccaacaggaccatcatttcgaccacaccacattgactggtctgccccaatctagctatgatatatcttaatttccgtatgacttggatccataaatattgaaatagatttggtgaacacaatttactcttaaaacttcttctctttcatgcatgttctttttctcactttaacatttttatatagtgacatttttagtaatccaacgttatttatatgattagtaattcatcaaatttatatagtgataaaattccacaatggttgttcaataaaaatatgaacaacacaatagaattagtaaaagtgactatgttaaatcattttcttcgctggggtttggtgggcgagttctaaacccataagcggcccatttacttcgtaaactcaattcgatttgttcagcgttccaagcccataatattattttcaagggcataaaataaattgaggtttatatggaaaatttggaaattccctcgtccagaagaaaccaacaaaaactgcaaaagttcaagcggtgggagaaaaaacttcagatcgtagccattcattaaattataatcaacggtttaaacctcttcgatccgcgtactctattcttattggtcaaataacttaatcctccaacatatataaacaacaatcagatttctctctgttaatttcgtcaagaaaaaaattcgatttttttgcgctctttgtgggttgttgttgttgaaa

SEQ ID NO: 1626 - DNA, 3000 bp, Unknown
  misc_feature (1)..( 3000): cDNA_ID_2141895_gDNA_ID_1620427_Annot_ID_156766 3000 nt of promoter + ATG
tgaaaattttgcgaaccatttcatctttctcgttaccatcattataactagtgtccaattcaagttgtggttcgatcattttgatatttaaagtaaaattgacaaaagaaatcctaaatttgaatgagttacgttttgagattggttcacgttcacttttaaagaaacttaggttctgttcatatttgtactatatcaaccattcatcagttcacatattcagttttgatcgttatgatgtataacaaatcatttgaacgaagatttagttttcttttttaaagttcgatctattgtatttttattttttactaaagcagaaataaacgtttccgaatgaaaataaataagagaattgtggtgtaagaaagacgtacgcaccggggatatcggatttaaggacataagcttgatccgtctgagaccaatcgactctacactgtcctaagctcctaaggctcgccagcaaaacctcagcttcaaattcccacaacggaaaggcgtctgacggatcaaagtacttcccgaacaaaaacgggctaaaaagagacccctcaccgaacacagccttctccgagcctcctcccccgctcaagaaccttcggaaaacatcatcgccgagcggtacgctccactttcccggcgtcttgtcatcagtgtggatctctagtttgaggcttccactactactcgtcatgagagaaattgagacgaatgaaaaaaggaaagtggttgattgtgtgtgtgagttttggaatcaaggtttgttcttatagtataattttgagatagctaataaaaaaaatgatacaaatattttgattttaatggggatataaaaagaatgtttattcttttgtttttttgtggaggtatatttgcagcatatgtaaaatatatatacttatagattgacatgataggtgcaaagtagattaaagaagaaaaattaaacgaagattatggaaaaatagtgggtgctgaaaattatttgatgataagagaaaaagttgggagagattcttatttctttgtgactatactttagcatgctttaagtaaagagaggaatatgttcttttgacgtagaaattgctcgaagggtcacaaagaaatgtgtcttatttgctttgagccataccatttcgattcttcatcttgtactattttgataactgataccccctccatatcatcaataaataagtttacagaatagggataaaattggaaaatctgttaaacatctacattaaaaactgacaataacaactaatttaaaacaaaattcaacttgtaaaacgacaactaatacaaaagaatttatataaaaaatatctttatttcgatgtataataaagaagtatttgtttatttttaattggttttgtataaagtatttattactatcaaaagatgtttaaatcactgtgatctatttctcgttgaggcaattatatatgcaacgtgaacactataaataacgagattagtcggattttgtatagaggccaaagattagtttgtgtgtttgtcttggaaaaatttccttaattaccaaaaaagtattatagtttgtagcattttttaggtttaagttactctattgataatttttattaaaacctacactacttttgtgaggtgcagttttattggattccaagacactgtaatacatcattcgattcactggctaaaggtccgatgcctaatggatgtagttataaagaatctccataaagaacactatggtgattaatcaatgatattcattattgagatgttctttaatttaagaagttcataatcaaaagttacttctataataggggtggctcctcataaacaaatttaacccaattaattaataccaaacttaagtttatacgcatttgagttttccggttccaatgataaatggaattaggatagtttgatcttttggtgtgaactttcttaagagaagtaagaaaataggtgtgaaaggatcaatagcgtaacgtgatagatcaagattctgagtcttttattaattttaacacttggctttcccaagcaatttgactattgagagatgggccatgcatcatgcatgcatctttaaacatggaatcaaatgattttatcttcagaggttataatttatttgtttctattgctattttacctatttataatctggttttaaagtggtacaagaaaataaaaaaagataaacatgattagctgttccttaactgtaacaacaaaaatgaagaaatcattataaacaatgttttcatttctatataaaaaaacattacttaaaagttaatacacaaaattagaaaaaatatcaaatgtatatgaaaactgaagttttagtatttaattttaataacatgataaactaaaataaatagacaaataatatatataaaaaagaattaaaacagcgattttagtttaccttctctttttttctttgagaaataaaaccaagaaaaaacaaataatccaatatattaataactctgcgtaaatttcgcgtgattgagtttggtggaaacaaaaaaagaacgagaaagcttcgagaaaatatttgtatgaagcttgagagctaatatctccgtgaatttatctcgtcgacttttctcggaaaaagtaaaaggttgaaacttttttggtctctctctggtcaaaattctgggtttggttgaacgcaccgacgacaaatcgcattgtcaacatttggatctggccaacaatcattagcaccaactcttccccttttgtgctgtctcgaaaacgtgtaattgatctcgtggcattgtagtaagaagctttaatttaattggtcctccaaggaaattgcatcgaagtcagctccaaattttcgatcagggttgttgagcttttgtgttaaagtttcgatctttatcgaatttcagcaaaaagctgtagaatcggcaatttggttctattgagtatctgatgaaatgagaagcaaaagatatg

SEQ ID NO: 1627 - DNA, 3000 bp, Unknown
  misc_feature (1)..( 3000): cDNA_ID_2141889_gDNA_ID_1620427_Annot_ID_156764 3000 nt of promoter + ATG
gcaccagccttcttagggagaaggagattgtggatgttaggcatcactcctccattagcaatcgtcacatctccaagaagcttgcttagctcctcatcgtttctgaccgcaagctgaatgtgacgaggaacaatacgtgtcttcttgttgtctcttgctgcgtttccagctaattcaagaacctgaacaaattcaaaacacacaattcatgatcaaactttccaaatttgagaactttaacaactcaaatcaaattggttaccataattgaaaaaaatttagaatcttgcgagaaaactacaacgattcatatgatctcgattaccatcaaccaatcagaacaaacccaaaattaggtcaattacagaactacaacaattcaattcaaacacgaatctaattcaatttttgcatgtcaaattcggaaaatgtaagaaccctagattcgtaatcgatcacgcaaaaacagagtcagacgaataagatcggaaacggaatgggaaagagagaaaagacgatgtaattttacctcggcggccaaatattcgagaacggcggcgagataaaccggagcaccggcaccaacacgttcggcgtatttaccggcttttaagaaacgagcgatacgacccaccgggaattgaagaccggctttgctactccgagatgtagctttcttcgccccaccggatccaagagtttttccacgaccagccattttcaacaacaacaacccacaaagagcgcaaaaaaatcgaatttttttcttgacgaaattaacagagagaaatctgattgttgtttatatatgttggaggattaagttatttgaccaataagaatagagtacgcggatcgaagaggtttaaaccgttgattataatttaatgaatggctacgatctgaagttttttctcccaccgcttgaacttttgcagtttttgttggtttcttctggacgagggaatttccaaattttccatataaacctcaatttattttatgcccttgaaaataatattatgggcttggaacgctgaacaaatcgaattgagtttacgaagtaaatgggccgcttatgggtttagaactcgcccaccaaaccccagcgaagaaaatgatttaacatagtcacttttactaattctattgtgttgttcatatttttattgaacaaccattgtggaattttatcactatataaatttgatgaattactaatcatataaataacgttggattactaaaaatgtcactatataaaaatgttaaagtgagaaaaagaacatgcatgaaagagaagaagttttaagagtaaattgtgttcaccaaatctatttcaatatttatggatccaagtcatacggaaattaagatatatcatagctagattggggcagaccagtcaatgtggtgtggtcgaaatgatggtcctgttggttttaggttttagggcaaaactgggtaacccagaagaaggacatgatctatcaacatgtttcaaaattcaatttctaatttaatgtctttccttttgaattcaatatggctataacgacacccacacctacttccattatctaccctttgcgatatctacaattcgtaataaatgcactttcaaagtttgacaaactcacaattcagattagagttattgtgttttgatcattaacgaactgttattgtcatccattccttcatgttttgaagtcgatatgatgtaaatactacagtgttactttattaggaacagagataatgcaaaaatattgatgtactatcgttgcggttttactttcgtttatacaaataaatcttatatttcaccgtccgctcgtataaacatattatgtcaactattgttatttatcaaactagagtgataaagttacatgcatggtgtaataataagaagtttagtataaattttaatggcttgttaaaatgtatattgattactgtctttccaagaaatgtcagaatgtttcatatgctcttatggggcatttaagagtgaattgacagatgcaagcagaaagaaatgaaatcaatgttcttttattcaattttatttcctatagccatgctattaattcattagtaattctcatttagttgtcactgaccaacaatttgtcatcattattgcttggattaacgtatttatgaatagtgagtgaatacatatgtagttttagcctgactaggtttcagacatcatagaagaataatcaactctttcaccatataatctcaaaggtaaatttagaaataaaatatttgtttcttcttgcgagtaaaagtacttattagaccggtgaacctgctcacgcacagtctcattgatttatgatcgtattaactgtaattaaattctgtaagagaaagttaaaggaaattccaaaagtttagaagtatgacatgaattcaagattctctacacggtaactataggaaaaaaagatcttttaaaaaccaaaatcattgaattaatcacgatttatggctaatgttaattttgttaatgaatgcaagttcatgaaatttagcttgttttttcttttcttattaccgtgcattaaatcaagtttaccactaaaaagattccaatattcagttaatgtgataattcgtaaatatggactagtctataaattactatttcatgatttatgaacatgttgtgaagtcttttcagtttttacacttttaagaatggcaaaacagtaagtgaaagaaacattctctcgtgttattacttattacatcggtgagttgagacatcgtagacctccttcagattcatttgctcgtacatgccttctagaaagaaaagaaacttggttttttaatatatctcataagacaaaatccacttattattacctatcatccggcgacaatatttaatttatatttattatagcatcacttccaaaaatattcagaagaagaagatagagagaaagaaagagagagatatcgacaacaacaatg

SEQ ID NO: 1628 - DNA, 3000 bp, Unknown
  misc_feature (1)..( 3000): cDNA_ID_3063427_gDNA_ID_1620427_Annot_ID_156761 3000 nt of promoter + ATG
gcgctgaaggaagaagaagaagacgaaataatggaaaattaaacaacgaaaattagggaaaattagagaattaagaaaggttttattcaatcggcgcgtttcaaaagtctacgcgattctcgagattcattttcaaatccttcttcctcgggatctatagtatagagcttcagtaattttgtcctcttgaggtatttgtttgaagaagatacgaattgatttttagctgaatgaatccattttggcagccaagcttttgttgaagagttcgatggtcaacgttacgctaatttcttatttgacaaattagttgttgtcttcctcttcttctgacattgtgccatttaacaaatacttcttctctgatccattattgtttttttgtttgcagagacgtctaaagaagcttgaaaccattattagagtatttgacaatggaaggagaatccaaaggattaatcgttgggatctcactaggtttggtgattggtgttgtcttagctatctcagctttgttctgctttaggtatcatagaaaaaagtctcagattgtgaatagtggatcacgaagaagtgcaaccattcccatcagagagaatggagctgattcgtgtaatataatgtcggattcgaccattggtccggattcacctgtgaaatcttctaagaatgggaggtctgtttggcttgaagggtttagtaagaggagtaatgtcatctctgcttctggcattttggaatattcttacaggtttgtctcttcctctgacaaatcttagtttcctgattaggttattattttattgtcttaactatactcaggactagacttctcttgttatagtagttactttggttattatttcaaagtttgaaagttcattaaaaaggggaatgctgttgtggatatgagaaggtcttgcattcttggggttatattccgtttttgacatatggtctttggtgattgcttcagggatttgcagaaagcgacgtgtaatttcacgactttgataggccaaggagcatttggacctgtctacaaagctcaaatgtctactggtgagatcgtggctgtgaaagttctagccactgattctaaacagggcgaaaaagagtttcagacagaggtaagatatatctatggattcatttccgaagaacaagttagtgtgtaaaacatgtagcattaggcagacttttaagcattacaataggctttctgaaatctctaatactcaatttattagttgtgtcatctataagacaggctacatgaatgaacaatctatatatcttactctcttagtatctgcttagtttcttgaaaaactcatccactcgccttaatcttttcaggttatgttattgggaaggttgcatcaccgtaacctagtgaacttgattggatactgtgcagagaaaggccaacacatgcttatatatgtttacatgagtaaaggaagcttagcttctcatttatacagtaagtaactacctggttatacataccatattaatctgcttgtcactaaatgaactgttaatgcaatgttgagctattcggtatctttgtagaacatttattgagttgatggtttagacttcactaaatgatgagccttggtaaagatttgagatgcactaaaatggtacttttgatacaggcgaaaaacatgaaccgctgagctgggatttgagagtatatattgctttagacgtggcacgtggtctagagtatcttcatgatggggtaagctgcttgctaaaaccattcaccattttaatgcatctcttaaacaacaacttcaaaactcatgttctaatcaattgttccaggctgttcctcctgtaatccacagagatatcaaatcttccaacatcttgctggatcaatctatgagagctcgggtaaacatatcttctttctctttgaaatctcagtctattgaaccacctcaagtttctaatggtgatcttctttaacttcaggttgctgactttggcctctccagagaagaaatggtagacaaacatgcagctaacatcagaggaacatttggctacctcgatcccgaatacatttcaacaagaacattcaccaagaaaagcgatgtctatggcttcggagttttgcttttcgagcttatagcaggaagaaatcctcaacaaggtctaatggaattggttgagctggtaacataaaactaaaaagtcctcgaaatctccaattgttttgtttggagaattgcatgtaaagactaaacgttttgttgttgttgatgaacaggcggctatgaatgcagaggaaaaagtcggatgggaagagatagtagattcaagattagatgggagatatgatttacaagaagtgaatgaagtagcagcttttgcttacaaatgcatctctcgtgcacctagaaaacgtcctaacatgagggacattgttcaggttttgactcgtgttattaaagtgagacattgcagaaagcggcagaagaattctccgtcgccgtctccacggcttcctcctcctcctccgatagtggaggagtcagaaggtgagttaactgcaaacggatcattacgatcagaaattcatcggagggataattccttggacagtagtatagctgaagacgtgattttgtaaacaaaatgaaaaaaaagtctcaatttttttaattattattaacttttaaaatgtgattttgtttttcaattcttttgggtttttagacgctagattgtctatatttgtgaatgaaaatttgttctttgttttttcgtgttaaaacgagttcaaaactggagaaccatattatatatttgggctatgaaaagaattgaattcaaggcccaattaaaacctagcctagcccattaaggtttagtgataatacagtgtcgtttaatcgtttatccaatttttatcgtcatctgtggaacggataggacgaaggaaaaagaagaagagtgaaagttgcagagcgagaaaaa

SEQ ID NO: 1629 - DNA, 3000 bp, Unknown
  misc_feature (1)..( 3000): cDNA_ID_3063432_gDNA_ID_1620427_Annot_ID_156752 3000 nt of promoter + ATG
tttcgctctattattcgtttagattcatttgttttttttttcagatcgaaccgtagaatttaattacaaaattagttcgtttttcaaaaaagaatattgttattgtggcttgtggggaatagaagtggtacagtgaagtcatgggctttgggtttgtgttttttctttctcgtttatgtttcgacgactttgaaaactcttttggattttattgtctgatatctttgccggtttcaatacgagtcttgtctctgtaactgctgacataacatttcctttccttcttttactttcttgttttttacttgaataagtagtacattcgatcagtaacttttaccaaattttatcatttgttttaactttacctaatagtatgaatattatgtacgagtacaattctcttttcctagttcgaataacccacttcaagaaatggtaacaatacaatcattcacagaagttacatttttctaagaacagtttttcattctaacttttttggatggtacatttaaagatttattattggatttatgtatcaggtgttttgaagaaaaagatgagaagagatagaggatttgaagctcagaagtagagagaaagacctaaggccatattgtccatttgaaaattcctaaattgtaaactaatcagaaagattagtatgctaattatatgagtagaatagaattttgtttgagagttcttgtaaagatgagactccccatgttctattctatgttttgtgttttagaattttaaatttgatatccattgtctttgactaaattgatgatgtttatctttttgtgatggttacaaagttgctccaaaacttaaaactaatttatttttgatcgacgaaactcggtcaaaaatactatgatttgtgaaaaattcatgtataagattgtacatatactagggctagggccaccagtttttgaaaagttaggtctcaatgaaactgaagtaaatctttctaaaatactcattttatttttttctgtttgtgagttgcgaacctagtataatgaagattcggggtaatacactacactaacgtagaaccaacatttgcagcaaacaaagataataattgcttaacaaaactaaactaaatatgtctgaaaagattggtcggcttcaattcttctcactcaagtcgtcggtagctttgaatactcttaaccaatccttctctcacgcagaaaagagaacaaacatgtttctcggctacagattatcatctattgtgactgaaccatcaaacagttcgtgttcttgattatgcgacaccacagtcttaattattttcagaacttgaaccaatttctcatgaaacctcaaacttagattgcgacataaaccagaatgaaaaatagtatagcaataagaatacgacatttttcgatatttcaacatttcaaacaaaatgaagtgtgcaggatttcaatcaaattttttgcatcctacaggctacacactctattttttttttttttcgagttagaacaaaaaaatctcatttttcttcgctgtttgtttttctccacaatatacaaccattctcattctctttttcaaaaatgcaacatttgtttttcaaactttttgaaactcccatcaaagccccctcaaatcttgagtagaaaatgtgcctataaatgaagaaaacggatcctgacaaaaggtagaaccataaacattgtgcactagatgtagaaattggtgaaataaaaacaaaacaacaaaaactgaaaccatatcgactcaaaacttgatggacaaaatagtcctcccaactttgaagatgagaaagatttgtccatctttgtccttgtgtagcgatttttacggggcctaaaaatgtaatagaacttacttcagcgagacttgtaggtgtggattgctttaccaacgtcacatgtcaaggtgatcaccaaattacagctttctgcattattgactcatcgaaatctcttcttaggtaagatgtttcatatatagcttgtcattccttcatttaaatatatactttcattattattttttggtatgttttgattttgaatacattctatcatgtttattttgggcacatcccctgaacttgtcccctttgaatattttccaagttcaattatgctctttatggttaattttatgatcaagacttcatcaatgaatcgaaacgtttgcacacaaaaattgatagattaaaacgtatatttttggataaaatgggatgatcctattttaccattcaactaattccctaaaatgaatgtaggtagcatactcaccatgtttttaattttaatggatctaaaatattagaccgctcgctaaatacatataattagaaactttcaggattacattaatccctaatcgacatctacactttttgtttctagagagaaatcgacataaggagcaaaatcaaaatgaagacaatatgtaaacatcatcgaagaatataccacccaaaaaatctctaattatctttataaaaatcagtttctgaattcaaggaaaataacactaaaccgtaaccgaaattttacgtgattgtaaagaaaaccaataagtgacccttgaaatttcatttattatatattgacttatttcaaaatatttctattaaatccttgccaaaaattgataaaccgaatctagtcgaacaaacagattcgttgataagatatagtacttttttttttgtaggggttgataagataagatatactttgacatagtaaaccttgattatatgaagatgatttgcctaattacgataattaattaatattaaacgtcggtcatttactgctgacgtcatcattttaccttagtggataaggtattattctctttcttcaaaactcaaatcaaagaatcgcaactatacatttctccaaaatctccgagttctacaattgtgtgatcaatcaatcttctccgatttcaagcttctcgatcaaaagaatcatc

SEQ ID NO: 1630 - DNA, 3000 bp, Unknown
  misc_feature (1)..( 3000): cDNA_ID_2141872_gDNA_ID_1620427_Annot_ID_156758 3000 nt of promoter + ATG
tttatattcatatttatgcttcattctatcctcttctatgatcgaactgtgttgtgcttcgtctcgtgttattacctttagaagattaaaaacttcaaattatattttgaaggaataatcagaaactgtcatttacaaaaccaaagtattaagtgtaatagttttttaagaggaagaggattttgcttacatggttaactcggaaatacttaaaacgtcatcgttttgttgtttgtgatttaattgattggaccggtatgtaatgagattgatcgggttctgagaaattcagatccggttttagtgttgttgatttttggtcgactttaaaatctttcagtatatatgcttcgagttttgttttgctacgatttcattttgtgaaccaaaattttttaggcaccaccaatctagatgatcattttcaaaaacccaatgggtccgtagccattagccaatcaataactcacaattttcgtttagatgcaactacttaacattaaaagtgatgattataacaaatgggaataagtcattgggccacagcattgagttctcacaatttcacgtggagctgtctagaatctctacgaacatttttgtatactacaacatgtggaccgaacaaaaacaaaaagaaatatcatcccaaatactaatggcttacataaatttatgcactaaatgttataaagacaaaaaaggaaacaaaacatacaaagagataccgttcatacaataacattccttcgctgtccaattacgtttggtgagacaattccctctttctcatgcaaccagatttgtatttcacaactcatcatattactccaaaatcataacggtacccatttttggagtgttcttagcttataatggtaatagtgataggttttgttgttttgattgtgatctataatccttagacgcaatgaaaagttagttgtaattacaaatgtcgaccgcaacgtgtacaaatgtttcttgtttccaagtttgtggagtgggcacaagtcaaacttaactgcataaactaatcaaatggtaatgtttctaatcggataacgtttctgattaagttcttttcgatggacgattcttgttatttctcattcgattcgatcgtgtgggttaggtttatagattcaaatcaatcaatcttccatcaatatattttatgatgacccatgacacctagcaagtagcaacataacaaactgattaatatcattactaatatataaactataaactataaagtcgtggtattaatgagaaaatgagggcatgaatatttttattgttttaaattagtaaaaacaaaatttaacaagatgactcagtggcggacctacgttacaactaggtggagcacgtgccccatattaaatctactaaatattatataagttgttatttttcattatattacagttagctcaaatggtttttcggcaagcaatgccttatactaacccaagttcgaatctccaaaccgtcacttttgtaagaatattttataatctacatacaatttaggtaattaaattataattaatactatttatataaatgatgccccacataaaattaccttctagatccgctcctgagatgactcatcgtcgtttttgttgcgccgcatgagtgattactttcaaatgtgaaagcattttagatgagtcgttctctacggttgaattatggttttaaaatgaagctgtttaattacacgtttcatgaattaagtttggaccgtttcattttttatatcgttaggagatatgagcctgatctgatctatatttaatatagttcttatctacatgagtttctattatagttcttcctacattcatttattataaggttttctcattgccacgtataatataagcacatgcagatataagtaacatcatatcattttacgtacttagaaaataaaaacaatatggaagttagtcccaaaaggaaaaaatgatagtgatattgattttagatagtaatattataactatgtctatatagttcactcaatatccgattcattaagattgataagccaccatgtaacaaaaggataaattgggttatttgtctatacgctaaaccgatccaaaccaaattagagagaatagacagataacccaatttttcttttccaaatccaaatctgaagaaaaataaagatttaatttttttattatacatgtatttgaccatctaatgatgtaaagcagatgaatcaaagtgaaaaacatgaacgaccatcataatttcataggtgacaaaacttattcatttatgagccacacaaaaaaaaagaagaagtagaaatatatgtcgtcgacaaatattaataagtggtccaagaaaatagggttatcaataaaaacattttgtatacgaagaatacaagttccagttacggaaacaaaagtgattcacgtcgacataatgtcatatgattctgcgtcaaaaacgatcgtttaattgtctctttatctgtttatcgcaactttttaatcatttcattatgaatccttttgcatttcgttgcttgctcccgtataaccaatcggattctttatatgatttattaaaaataattgcatttggaaactaatataatcaccaaaacaatcaataaccaatccttgtctggtcctattttaaaccggagttggttattgactgtttctaggtaaactaactccggtttaaaataagaccaaccaaaggaggtttcgtaataatgtaacaaatcatgtccacgtaaacaagtgagtcacaacgtcaagattctcgatgtccttctataaattgcctctgttccataaagagaatcaccactcaaatctcttcaccttggcaccatctataaatatcctcaaacattagcctctttaagaaatcaattccaaccttttaaagattaatcttgaaaagtttctaataaaaggaagagaagtgatcaggtgtggtgacgagtaggat

SEQ ID NO: 1631 - DNA, 3000 bp, Unknown
  misc_feature (1)..( 3000): cDNA_ID_2141951_gDNA_ID_1620428_Annot_ID_156779 3000 nt of promoter + ATG
cgtgtctcactcgcttgagctgatgaagtgcgataatgacgtggcatgttgggatggagaccaaagaccagcattttattttattttatagtaactaattttaaaaaccaaacaacctgagattaaaattttaatttttactgtactgtagtaaatttgggtcctgattaagattaggcatatttatctcatagtttataacaagtagcagctgaaatttgtattactagcttatagtaattaaactaaaaactacgttccaggttttaaattattgtttaaagaagatataataatatattaagaaaatagttaattaaggtaaggaggaaagtagggtttggtctgtaggttagggttcaaagagggaagagattaggagaaaggaagcatgaaggcatgacccatttcttcaattagtgctccttaatctggtgacacgtgtaggtcccacgtgtaatcacttcacattgttatttttcaaaaaatcaattagtaaaaacaaaactttgtccatcatcaaatagtagtagttttttatgtgtggttacaatattgtaagaagctctcccccttttactatgtaattcaaccccactctaatttttaaaatatttatgtaaagctttacccgaaaacaatctatcatgggttggtaatgacacatttcattaacagtgttagagaatgattcctttaatttttctacagtaaaatgttaggtgatctcattgtactacatcggaaaatactcaaaattatgtcgtgtaatttagataatggacgaatatggttttgaaatatttatggatacccaacaagatttcttaactagaaagacaaaaaaatagagcacattttgctcgttttccatcaaccctatttctccaatttgttcacatcatgatcaaaaatacagtagcaattaaaaaataaaataacaaatataaatggctatatagatcaaccctatctagctattagtattactagaaattgacaataaaggaaacattcacgtgtgtgagcatgtactactctacacacatgtccacagttattatatactgagtactagtatacgttgatgttatcaataataaaaactcgaaattaagtattattttcttataataatctatttaaccatatttgctactgtactatttagtctattttcttttgccaacctttgtattaaatatttgtactattagtttcaattataggtctatcactatgtatatgtccgaataatggtctaaaattgttaatataaaatacagattttatttcagctaaagatagttgaaattacacaagaaaatagaagagataaaaatgatcaatcagctatgtaagacgtcgtatggatagttcaataattgtggtaatacttaaagacatatatcaaaattatcaacaagcctcgaacacaaactttacaaaaagcctgtgtctactttatgagtgtttgattattaaattgcaaggtcgtagtataaaaatttcgtaggctttcaggacacaagattaaattcatttatctaaatggtgatggagtacttttatttttatatatcaaaatggtgatgatatacgaagaccatatatttagattattaaagaaaaaacgagaaaagaagaaagaaaatataaaaaaatggtttttctttttaacggacaaagattcctacaatggttgcttttagaccacacacaaatgctacacagtactcttgggtcccacacctcttagcaagtgcgttaccaacacgtgaatttcctctccccattttctcgtccttttcctctcaatattgtatcgtctcgttttccttgtcatatcgcgtgtgacgtgttattggcttattgctgaacagtcttcttttttattttccatcgttatcctgatttttttttttttccaaatttgattttcatggtttgtaattttgcaatagattttgtgtttcacagagagatagtttacgtgttgttaaaaataatttgtgcaaaatagtgtgcgtgtgttaaatattaaacgatatataataattagaagaaaataaaaagttttgtcgcgattagttatttgatatttaccttgttcttttgtttatcgctgcgacaagcaccgacggtataaaatataaagaaaaaaagaaagagagatgaaggtgagatgaatgaaagagtcgcagcgacagatctgaagagataggagaaagggaatttgagacgctgaaaattccagcgtctacggaatggccgaattacagtcgatgcggcagagatgaaaaaaatgagaaatgaaagtgaaaaagagatgagaactttttttgggtcgcaggtagctgacgcagcaatcaacaaaagaacatggccaacgttttagtagatactactataaaagaaaaaggttgatttaattcattcgtaatttggacttaatttttttttaggaacactaattaatcttatttgccagctgtatgagtggactacaataaactcttgtctataaaccagattttcttcctttttaacgcttccacttacaacaatatatgtaaatatgtaattatgacggggcatacggaaatttaatttttgaagcagattcatcccattagccagctgtattaagtggtaatccaagagttaatttagttgttcagcaaatgattttagataaaatcaactactagtttaaaataactatcgaatgactgttaaggcttcgtattttttgttctgccatcaggatatcataaatatggttgaggttcgtataatattcgacgatcttttatatatctgagttgtaattgaattagagaaaataaaaaacagataatgaaacgtctttgtttttccataaaaagaaaaacagggtaaattaaagtacgagagattcacgagacgaaaattcctagaggcgcacgatagccaaaagaccatagaaaatgacatccgaaatatctttaaaatgctaaa

SEQ ID NO: 1632 - DNA, 3000 bp, Unknown
  misc_feature (1)..( 3000): cDNA_ID_2991306_gDNA_ID_1620428_Annot_ID_156789 3000 nt of promoter + ATG
aaaatactccgtcacaaatttcctccagtaaacaatactgctctcctacaaaatcagcaatgacacgactggtatctgtcaagagcttttttctagaatacacataaaacaaaaaatttgacgactacatgcacactcacagaaggcctttgtcgctgatgatataggtactgcatcaatcttcgagcgcaaacgctattttcataaggtcttggcccaccggttagttgcatttgcattccttgttgttgcaactgttgctgttgctgttggtgctgctgctgcaactgttgctgttgctgcacttgttgctgctgctgcagttgaacccgttgcaatggtgggagggactggagatattgttgctgttgcctcagcttttgttgctgaagcaagatttggaactgtggattttggccttgttgttgttgttgctgctgctgctgcaatatatcctgtctctgaagccactgacgtaaaatctgctgctgcaaagcatcatcctgctttgaatctaatctaggttttttccgtgcttgagttaagttgtttggatcctgaaagaacgattcagaagcacgccgagccatagaaagcgggatttgattagtttgtgatgtaggcagtgatgtagcactagagccacctagctgaacactaggatcatgccgttgtaccacagtcgacccatctacaactgatgaaccagatatgctgatattattagaagagaacgacataggagacgccggtaaacgcatatatgactcattattgatactagcactacgctgcaaatgaggaccacctccagagagccctgaattagcatctgtgacaagcgaactagctcctgcgcttggaccgggtgttgaaacactcatcataaccggattatgcatatcaccagaaaccatactgagattgtgatagccaccagtaggtccaccacatccaggagcagagttagatgaattcccataagaggaagtcaagtgagagttaatgaagctttgagattcatcatctccttgaaagaaaatcccagaagttgaagaagccattaaagggtaggtcccaagtgagtctgaaatccaaagtttcttcctcaatgcgacacaaatgtcccacctttactactgatacctacaacattatacatgtatcgattaaaatcagatcaataacattccctaacacatgaatctggtgcgttattaaagatacacagacattgaacttaaccactgaaataaaaaaaaaaccaaatcaaaaccctaattttaaagttcgttacttaacataactaaccgagaaactaaccaatccccaaaaaaaaaaaaaatagatagcaatcccttaaaaatctcggagttagatatttaaaaagcaaccgaaattaaattacaaaataaaaaagcgaagaacacggaaacaacgtacgaagaactgttaagtggagcttcgatcaatatagaacaaaagctgagagatcacaactagaaattaaaactaaacccagctgaattgaaacagaagaagaggaagataattaatgagacaagaagaagaagaagaagaaggaaaaaaatttgcctggaaatttcaagctgtaatataaagttaaaataaacaatcttcttatttattttgtgtttgttgtttttgcataaaaaaaaggaaaatcctggagagagctggaactaggcaatgaacttgacgcgcctttgttaatatacctagaggaaatcgtaagaaccaaatctgaccggacaagccggtgacccatctgcttatggttttgcaagtactttttattacccgctagtcaatactgacacgtgtcttgtttatcgtaacaagtatcgtatgaccgattggtaacctttagctgttttgattgcgtggcatattcttgaccttgcgatcaataaagttaaatcaattgtggatcgttcgattgagagcatggatcgtgtgcgacgcgtgtagtttaaagttgattgaccaaattatgttttttattttatttttttgtaataactgtaccaatgattgcagctgtaaatgagtgggcttacgacaaatatcctcttttttgcatgattacttattgaccccaatattactccctttgacaattcaacccctaaaatatttcgacaagatcatccaactatatggagctacgacccaacaggcctatttcagtatttttaggcccattattagcccataaataattatactctgttctccaaccgttcaaagctctgttctcgaacagtcttgaggtcaaacctaaccggtgtctctgtctctaaagcactagcttgttcaagaaatgatcaaagaaagctcgtgtgtggtccgtacggtccatggatcattcaaaacttggcaagaagacacacaacaccgacgataattctagacaatgtggatctgcaagaaagagagatttttaagttgcagagtttgtcggagttaaaggcgtgacgtgtaacacaagtttctgtttcagttatttcattagcttacctgtacttagaaacgtagaacacgacttataaaatacagaagaacgatgacaaataaatataaatgtaacaacgacattaatatatcgtcattatttatcagaaatagaaataaatatgtgggggatacaacatttatattaaatatatgtatctgtgatggactgataatgagacataacaacaatcacattagctgtcactcttttctttaacttttttttctcattgtataaaattttataaaacaataatctgctttatatgattcttatctttcttcttcttccacgagttctgtccagaaacagaaacattaatttattacaaaacaaagtgtatttacttctctttgctcagacgtttcttttttcttcttcttcttcttgatctttttcagaaatcaacttcatctcatcattcctctgtttttttctctctatctctcttaataaagaaa

SEQ ID NO: 1633 - DNA, 3000 bp, Unknown
  misc_feature (1)..( 3000): cDNA_ID_2142003_gDNA_ID_1620428_Annot_ID_156792 3000 nt of promoter + ATG
cagaacaccaagcactcatgtctgaagaacctgttcttgaacctctcatgcctttaatttataaaaaaaaaacgctttgaattctctctctctctctctctctccctgtctccttttgactttgagaatgaatgtataaattaggtttatttaacatgcgttgctcgagagggatttatatggcaagatagggtaggttagtcttttcagtttatgggttttgtgttgtgttgggttagagacttggtctcttgtgccttgcggtgaaggtcaacggttgtgactcactaaaggagattttagcactttctttaactattcctccaaatcatatccatcctccaaaaatggcaatagacaataattaattttatttttttacgcttaaaatttagtaatttttatgccaacttttttttagcaaaaaggaaaagagatatgtaaatattaaaagaaatatgtaaataaaacaataacaaaaaaatattgaatggtagagtcgtagatgattttattagattaaagttttataagaaattttctgatcttctcttttagtactggttaagatattggaatatttctttattaaatttaagatatgtttttgaaagcactcttgagctaattaatataatagttgaccaattgttttaatacttttacaaatttaaactaaaattccaaaactataacataatgtaatttctgagtgcaaaattcgccggaggctaatattaggcagggggtcttaccttagccgggttccttcatccaaagtggcaaggcaatagcctcgacaaaaaacaacaaaaatcaagatcaaaatcaaaataaaattcagatatcattgattcgtttatattcaaagttatactaaatatgttatatgtgtggttattgggtcacttttttgaaaaagatatcgtataaacgaaggaaaatggagaaaatgaggttcaaattaagaaacgtagccttccaaagtagccgccgtttaaagacacgtaagttattagttccacaaaagccaacgttacaactacctttctataattacttgattaacctcttgactttcaaaattttcagattacaaaattctctgttcattataaagtggttcatcagtgtgattatttgttcgttttttgtcaacgtgttattgatcgattcgattattcatatatttaggattaaactttttttttggaaccaactgtcattgtatcggttgtcctgtcgtgcatataccaaaccagtcataacatttgatgcaagtcgatgagttgagaatttatataattgattgaaattgttcaactagctatttttgttttgtatattaaatttaaaaatttattatgaatcattgataaatgataatgggtgagaaaaccaagtaggctactatacgtttcgacaagtttgaagaaagaagtggatttctcctataaccgtctaattaaatttccacatagtgataaatgcgtagcaaagtcttttattcctaatctcgatcctatttcagtaataacgtaagaagtacgttacaaaaaccttagaaaataaaagtgaaaaagaaacatctagccaaatatatacgtagcaggtggtggatctggttcatctaaccgacgaaatgtacttcacttttagaaaaaacgacttttgaaacgttttgagtttagcatataaaaactttttttttggtcgtcataaggtgataaggtgttaaaaccccaaaatggtgttgcaaacttacaaaaacgtggcgtgaaagaacatcaccacattaaattcaaatttaatccttttcttttagaagatactagactagtacatcgtgctgatttccaattggattggggaatatgatgtaagtgtaagaaagaaaaaaatgatgttagtgaaagaatatggttgagattagacaaatttgacgacgaaaaataatgggaatctttatcgttaatggcgtgcggaaaatgagtaagcgaaaggaggaccaacggttaaaacgaaatttgacaaagtccgatcggtccacattctacaaaagcagtcccaattctatgggtttatattttccacagcggcggaaagtcttacttcttattataagcatccattaagtgtttcatatgcacatatttgagcacgaaacgttacacaagtatcaatagttgtctttaatgtttttttagatggctgttgttcctttttttagagttttagagaagtttatatattaccaaccattctttacattgcctttcattactatacaatttgataatttgtttaagcgatggaaatttgaattatacaatcaatcatacaagtcagtttgacaaaatatatatcatacaagtcaatatttttgtttctgttactgttatccacgatattcgaactatgtctcgtagtccaagaaccggactggataaaataccccctcctaaacaagattcgaatttggttaatgggtaaaaaacttaaccttataattcactaccaaattctaacatatcactctcaaaagtataattttacccggataaatttatgagtttgactttgtggatgaaggttacatgggtaataaatggaggaaataaaaatttattgaggtgggggttcaaaaactttgtaaatgtagtactgtagctagttttagagaagttttattttatgacttttgtccaaccaacccacgagtccacggcccaccagcatgtgagatatttagcccaaaaatgagtaaaatgtagttgacccataatctcttcttcttcttctttttgacgttaattgaccctattgagcccatgtacacaaatacattgatattccaagaaatgtagaatctcaaggtgaatgaacattagaaactagccacataaaaattgtgacgataagatttatgctttcttcaatcaaaatgattcaaaacaaaccaaaaacatcataacaattgttaatagtgagagaaacatg

SEQ ID NO: 1634 - DNA, 3000 bp, Unknown
  misc_feature (1)..( 3000): cDNA_ID_3063456_gDNA_ID_1620428_Annot_ID_156796 3000 nt of promoter + ATG
atttcctttttcttgaaaaaacaaagcattcaagtactcaggcgcatatgaaacatatgaaaagtaaaatgcttcaatagtagagacagacatgccttggaaccttggtgggtaaaaaaaacatacttgaatggcttcataatgaagcaaaataatgagagaacatgagaagcatcatcatcaaaagccaacacttcaaaaagaaaaaaatggatatggatatccatgggaataaccccatcaaagcatcttctcctttttcttcaagcactcaaatgtcaaaaaggtcaccacttttattaaaactcatatatatacactgagccattagtccatgaataaccaaccagccttctctcaaagcaaaccaaaaagaaaaaccaacattgaaagaggaagttacgataagcggagcagtaatagggcatctttctattggcaggcgacttggctatttgtatcttttgtgttcttgactattggctatgtcacttgccaaaggagagttgccctgtcactgcttccgcttaaacacagtctataaccggttctgctaatatcaatccttcttttggacatgtccaaagccgagattgattgatagagaattggtctctctggctacaaaactagtgcggttctctcgatttaagttttaatagcattcactttgcacattgcatctttcacatcaaatttccatttcatcaaccatctaaacctctttgttagctttgatataagcaacgatctaaagtctaaaaaccattaatcctctgaaaaaaaagacaatttcgatggttctattatgtttctccaatgcagaaattgtatcgtctgaattatagtagattttttctagactaaagtgtaaaccaagacgaatctgcactaacaagacacaccaatagactttacagagaaaggttacgagttttgaaaatattaacggaccatagtcatcgcgaagacagttgaaacggctgaatctctccgatttgcagtatttcgcttcgggagtcagaaagcagaggttgaaggcaaacgccgctaacgtaaaccttctctttcaggtggaatctctattaaaaggcttttgggccttatttatagtcttgtatctcaataggcctttggagtttgggcttaattatctaaatcggcctttggacttatccaaaatattttattcaactgcttgaacgtctcccttacatatcgaccatttcattttttaaaaagatccaacatttggtgaggaaatccaaaaatcgaatatccaatcagtattaaactaagacttattgcccaaattgtatactaattcagttggaacggtaatcgaacaagtgaaacgaatcagtgcgagacacgtgacaaagcactgacatagtacgatgatgtcgatgccaattttcaacactgttttctttttggcgtgggccttttcgatactgtttcatctcctctcgttttctcctaagattaaaaataatagaaagaggacaatgtattattattctcttaactcatagacataatgacacgtagtaggttctctagttcctatcttttgatttctgttaacgactatgttcattaggagctactagtcacaatgccttcaattaattttaacaacatattttagctacgagcttgtcgagaaatcagtttgttaatactattaaaaaaatagtattcacgaaaattttgaaattctctactaaatttttattaaatcacaaaacttttaaaattgaccccatttaaattgactcccactaatcctataattaagtgttatgttctctagtaatgacgacatcgttagaaattcaaacactaataaatgattttattaatattgctcaaagcctcaaagtcgtccatcgatcttctctcccccaaaatttcctattttagcggagactttccaaaatcccttgttctttctttcctcgttaagtttgccaaaatagggtaaagaatatgtttatctcgtagaccaaatggatcttcctaatgcttaatagcttttttatatatatattttaagttatatttcgtacggctattattttaatgcaacatttgaacctgccacgattgtcttttttctcaattatataaataaaggttgaaatactataattggtgcacagctacaataattatgatatttacttccgtaacgtgaaggagaaatatctaataaattacatttttatataaaaactgtactaacttacttaaaatgagagtgaaaatactaaatcgtatgaatattacagtagtatttaattaccattttattgaaatttgatatatatatatatatatatataaccatatattggtatatacacacatttttgttgacaaataaatcaattcttataaccaagtttggttgttttccagataaataaaataaaaacaagaattatcctgtttcttgttttggcatctaattatccttttgtatgtggggaggagaagatatggacacaaatttaaaatactctatacataatttttattattatcaagaacagaaatgaaaataagaatggcatcattttattgtgacccataaaacaaaaaagaaaagtgataaaacataaaaaaaaactttctataaaaaaaaaaaacattaagaaacttgccccttccttctctcacagatcattctagggctcctgacagaaaaaccaaataccttttcctctttccatttttgtagaatttcaaatctttctttcctcaatctttcacaatgatcttttcctgtgaagttcttgattttaaatcaccctttcttcactactagcttatctcttcttcaattttctctaccgacattcaattactctccctattcggtgagatctctctctctcttttatgactttggttatgatgactggtcactggcttgtttagggtttcaatctttacagatcttgtggcagaaaaaatcaagtcaaagcaagaaaa

SEQ ID NO: 1635 - DNA, 3000 bp, Unknown
  misc_feature (1)..( 3000): cDNA_ID_2142022_gDNA_ID_1620428_Annot_ID_156798 3000 nt of promoter + ATG
aattgttgtaccaatgttgatctaatcaagtttttctttaatattttttttgccgccaaaaggagagacctaaccatgttcttaaaacaaattgggagctgactcagtagtttggaaaagaaagaacttggaatttttggttcttttcttagaaacttctaacgatccaacctatagcaagcaatttcagtaaaacaaaacattttggaaactcgtcacccgatcatgttgtcaataccttggaaatttattactgcttttgtcgtctcaaatcaactattttgttgagtttgcaacatagtattcaacaaattctcaatatcaaaaatacgtcttcaaaataaagtttgaactaaaacaacgtgaaatggtctctaatgttttaatgaaatacaaagcttcttttagttgttgtacctatgtcgttctaactaagtcttgaaaattaaatttcggtactgatatggaagaaacggcttgtgggcacaatagtttagtcatagactcacaggggacatttaaatgaaatttatttaaactttcagagttatatttcattattagaatatggacctactccttatagaagctactacttgatttagcacattaatgttgccactctgccatacgggaaaataaaatgatacaacaacattatgtttgttacgaaagtttcgattcactcacttggcatttaattatacatacgtatcacaaacaattattgcatgttttcagaatcaaaagtccaaactaattttaaaatataagtcataaccatttaaattttcaacgataaagatttatgatctcgacttatcaagcaatgacgtcttaaatcactaaataacgaatgagattattgcatcgtctaaacaggttaacaatcttaccatgttattatgactattgtttttactaagtaatggaccaaaactgagagtagtagttttaaataaacacaatcctctatacatgttaacaaatattaactcaatgactaagattgagaataccgaaaagattaaataaatatactaatccgttcatgttggacttagaagataagtaaataaccaataaatggtgtagtttgaattgtgattaccacttggaatcttgacataaacatatctaaaatggtccatatgtattagaagttgtggtccctttttaggtgatagcaaacttgcaggatgttgcattaatgttttatagaagaaaaatccagaaatgtaaactgagatctttcttaattagtttgagactggagagacaatatacctctttggctctttcgtctcttcttcgttttgtttgttttaagcacaatttcttaaaaagatcagtccttttctctgttctttgtttttagttttgttttaattacaaggacaactttaatttggattgtactatgaccatacctaaaaaaaattcatgtgatttgtattggctacattcacttaaataataccatgttatggtccagcctcttctcttcatttatgaatttaaattgtacaaactatatcattctttctttcttgtatgcacactatatatatgggctatttttgttttgctttcactgctatctgaaattcttatactgtatatacatagaatctaaggaataataaatatatgtatccgtatgaatagaaccgatatgcaaataaaagacgtaaaactaattaatactcataagagtgatgaccaaacaacggtcatttgggtttcactgtgatcccatctacaaattattactactcattagtcattactatgtagtatatagtactacctaagcggtgaatttcacatcacatttattgatagataagatcatattgtacttgtttaatggtcactgggcattaaattatgagaaagcaagtcaaaatcaatcttaaggataaaatttgaaaggaggaagacgtcatggtttgaaacataagggtcacgattgaagatcccctcgttgtttggtaataccgccatggagtttgtgtacgaatcttattgttgtttgagcttttgaataataataattttaaaataattagtgttgtggattcttttataaacagtgttgtagttgcaagtctgacatagtttgtaactaagcataggcatattattattttaagaaattcgcatgaacagtttgtattattctaataattctcccatggcatatcgttatatcgtgatcagtcttaaactcttaatgatcataaatttaagacgttagaaaactgtcgcagaataaatatatggtgatagcaatcgagagaatctccctattcacgattggttattgctagagtcgccaaatatttatgaaccaatgacacgataatacaaacaaaaatttgtcaatgtcgttgtcaaaaacaaaacgatgagacattttttttgaaaattttacagttcaaactgtgtgttgtttttcatgtattgattatttagatttattatgctaacgagttctgtctgttgagataaaaaaaaaaaaaggaaaaaagagagctagagatgtattttttgattctttcaagtttcaacaaatatatatacatcatgtgataccgacgggattacaaaacattacgtgtatttcaaagaagccaaaacaagcaggcccctacttacctttttctaaccaaaaatgtaattcttattttcattacaaataaccatttttcatttttattcaaaatattaattgattttagatttgacaaacttctcctaattaaaaccctacggaaaaatagttgacgaaaaagaaagcctatgaaaaaatatacgtatttatttattcatacggtctcatggatccactttctctcagctatatattttttaatcttataaaaaccatttcctctcttcatatttcttcttcttcctcctcaagtcacaaaaccaattcaacaactcagacaacaacagagctctcatccttaaaacttgacaaaacaaaaaatg

SEQ ID NO: 1636 - DNA, 3000 bp, Unknown
  misc_feature (1)..( 3000): cDNA_ID_2142011_gDNA_ID_1620428_Annot_ID_156795 3000 nt of promoter + ATG
tatgactggtttggtatatgcacgacaggacaaccgatacaatgacagttggttccaaaaaaaaagtttaatcctaaatatatgaataatcgaatcgatcaataacacgttgacaaaaaacgaacaaataatcacactgatgaaccactttataatgaacagagaattttgtaatctgaaaattttgaaagtcaagaggttaatcaagtaattatagaaaggtagttgtaacgttggcttttgtggaactaataacttacgtgtctttaaacggcggctactttggaaggctacgtttcttaatttgaacctcattttctccattttccttcgtttatacgatatctttttcaaaaaagtgacccaataaccacacatataacatatttagtataactttgaatataaacgaatcaatgatatctgaattttattttgattttgatcttgatttttgttgttttttgtcgaggctattgccttgccactttggatgaaggaacccggctaaggtaagaccccctgcctaatattagcctccggcgaattttgcactcagaaattacattatgttatagttttggaattttagtttaaatttgtaaaagtattaaaacaattggtcaactattatattaattagctcaagagtgctttcaaaaacatatcttaaatttaataaagaaatattccaatatcttaaccagtactaaaagagaagatcagaaaatttcttataaaactttaatctaataaaatcatctacgactctaccattcaatatttttttgttattgttttatttacatatttcttttaatatttacatatctcttttcctttttgctaaaaaaaagttggcataaaaattactaaattttaagcgtaaaaaaataaaattaattattgtctattgccatttttggaggatggatatgatttggaggaatagttaaagaaagtgctaaaatctcctttagtgagtcacaaccgttgaccttcaccgcaaggcacaagagaccaagtctctaacccaacacaacacaaaacccataaactgaaaagactaacctaccctatcttgccatataaatccctctcgagcaacgcatgttaaataaacctaatttatacattcattctcaaagtcaaaaggagacagggagagagagagagagagagagaattcaaagcgttttttttttataaattaaaggcatgagaggttcaagaacaggttcttcagacatgagtgcttggtgttctgctgttgtgttattgtctttaatacttttgttatctgttcgtgaaaacaacgcttctaattcgattagaggttctcaattctcaacgaaaccttgtgaggagatttacatcgtcggagaaggagagacacttcacaccatcggcgataaatgcggcgacccgtttatcgtggagcgaaacccgcatatccatgatcccgatgatgtctttccaggtcttgttctcaagatcgcacctttttacttcaacaggaaattgtaagacatataacaaatacgtttcttttttctttctcttttctcttcttttaaaattttgtttgaagcatactttaccttaagtatgtatgtatatattactaaaggattcaaaaataaatacagagatttgaaagaaacagagcaaaaacagagttgtgtaccgtgagttgattattcatgttttgtgggtttacaagttcatttagatttaggtgtatatggtaattatcgatgatttttggtctttggggtggaaaatttgattaaacaaaattagtagctgatgaatgcaataacgaaacgccaagttagaaaaaggtcaacgactttacagtctttactagtggcaaaatatcaataaaggagttatgttattctacaaataaaaagcttcatcgtttaataattcttccacttatagaattctcgtatccaaagaggacagattatttgatgaataggtgtgctatattcaatgatgtgtgaatttatgcttagaaactcgtggatgaaaatatgaattttattgatatatacgaatttcaaagaacaatagccgcatggtttgtgtctcttgctataatccaaataaggattttgttttggcaaaaaccttaagaaatttttacaaatacatggtcaagttgcccattcccaatccatatcagttcttcaactttcgagccctaagccatcgtttcattgacttgtaatgtgggtcggacctgattatgttggaaacccaaacttgaaatttttgcaagtgggcttaaagttttgaagttttttagcgatatgggtaagtagggattttatggatcgcatagtggatatctttaaagttagaattggtcgcatgatgcccaatgagtgaattatgtcattatgttaccttgatttctccctggtcgaagagaacttattcgtaggtttatcgaatttgacataatatcatatgttccgagaatgctttaaaacttcatattctgttgcttgttaatgtaatatgatgtattattatcacaacaataaagtattatctgaacgttgcctcattcgtcccgttacaaataattatgtttgaaatatatatatgcaagtcaaaaatatctcattctcaattaattacataactattcaaaattatcaccaactctagttctagacttccttttttgtatgcaatattccaaaaactaataaactacacacctagactaattatgtcgtcatctcctaacactatagcttctaatttcaaaaacaaaattcccaaagtaaaagtaaaatgaacattattaccgtgcatgtcgacattactcccaaagaattgcacaaaatctccaaaacctctgtaaacaagaatctcttatatataagaaacgtgagttgttcgctgttacaaacccacaatcaaagccacaaaggaagaagaagaaaaaaaacaaaccctaacttttgtcaaaagtaaacg

SEQ ID NO: 1637 - DNA, 3000 bp, Unknown
  misc_feature (1)..( 3000): cDNA_ID_2141999_gDNA_ID_1620428_Annot_ID_156791 3000 nt of promoter + ATG
ctcctaaacaagattcgaatttggttaatgggtaaaaaacttaaccttataattcactaccaaattctaacatatcactctcaaaagtataattttacccggataaatttatgagtttgactttgtggatgaaggttacatgggtaataaatggaggaaataaaaatttattgaggtgggggttcaaaaactttgtaaatgtagtactgtagctagttttagagaagttttattttatgacttttgtccaaccaacccacgagtccacggcccaccagcatgtgagatatttagcccaaaaatgagtaaaatgtagttgacccataatctcttcttcttcttctttttgacgttaattgaccctattgagcccatgtacacaaatacattgatattccaagaaatgtagaatctcaaggtgaatgaacattagaaactagccacataaaaattgtgacgataagatttatgctttcttcaatcaaaatgattcaaaacaaaccaaaaacatcataacaattgttaatagtgagagaaacatggcttcaacaaaaataaactctttaacaacaacaatctacaattacaaatccccaagaagatacattaaccacaaatcccaaaaccaaatcaaactaatttcaaattccctaaacccaaaacccaacacaacacagcttcccaacactctctacagtgtcagcttcaagactattggaacaggtaagcttggcatctccagatatcccgatttcgaatactctcctctaggtggctctggtgccggaaccgccaagaaaatcgacgacaaaaacagagcatcaaactctgaattgtctgtttgtttcaatgtggccactctttatattccttctctcactagccaaaccacgaagtttctcggctttccattgccaccgtttctaaaaatcgatatctcaccggagattttccaaggaactatcaaccaagaatccgggaaggtgaatatttcctaaatcctctgttttttgttagtcaagaaatcctctgtttccataatcctctgtttttgttcgatttcttttacaggtggaattggagtttatggcgaagttctttttcacggcgggaggagggatatacagagctccggcgttggtggtgagaactgtgttgacgacggaggaatcgataggagagaacaagagagggaaaggagagagactggacgaagaaggaaagtgtagactcgtcggcgtcgcgaaagttgagaccatcgacgatttgtttatgaacacgttcctctctcttccggcggagtgtctcgccgatctacaagctattatttcagtctctgataatcaatcttgaatcttaatgataaaccataaatatttgagttgaagttgattaattatttgtttacttaaaaaaaagtcttacacttaggatttgaataaagaatatgtaatgggtggccatggaaaataaaagatgagataatgggtgatgatgagcatggaacacaacaaattacagcttgaagaagtaaatgcgaattgacacatatcttaacacttgtttgtttgtgcattgtgattacgaaatttatatagtttatttgaccgacgttgtaatttgatgatttttgttgttgttggagaattgattgaatactgtagatgactacttgtgacgaaagagacttttttaatatataaactctaaagtctaaactgtaaaaattacttatctccaaatttcagcttatttgtctatttctcttaatagtagtataagccaaggttccaatgtgtttgccgtgttttatgcacataaaagggttacgttacacttgttcaaataatttaattggttggaaaaatggaaaaagaagttacatgtaaatttgttaagagaagaagaagatacgagtttgggaaaatggaataaaatcttcctcgtacctcacaagtcctacaaaactctggcaaacactaattaccacgtgcaacataatatcatgtttgatcttctttttactaacgtttcaaaacaaatatttcttctcttttagttctatgattgtaactaataacaatgataataatgattttttgtgtgtgtgtcgtatcactcgatgatgcttaaagattattgattgatcgcaactacaaatctactgattcgttttttgactttttattctttgtttattttggcggggactcgtgtgtagtttaaaggagagattaactataacattaatagtaacaaaaataaaaccagtttaaatcaaaactaaggaaaatttcctcccaaaaattcggggacaagttcgttttcttctacacgcgcaggtcttgaacgtgaggctgtggaatcatcgtgttgtcatgtattacaatatttgtcatcgtttttatttgttttcacgttatctaaactattatacatttgttttctttttctcttatttgtcatagattcttaaccaaaaagtcagaatacttcctaagacttttggtggaagataaacttcttttgtcattgagtatgttaaatagattaaataaataaaaaattagcttcaaaattagatagaaataaaaaattaagaaatggatggtctgaagaagaagtcgacgtctgtgaccactacaactcccacgcgtcactctctctttcgtcacgcgcttgtttcttcacttcctccttctctcaccctcacgggatttctctctctctctctctctctcttttgccgcagcgagatctctctcttcttctctctctctctggctctatgcatccacctgtctccgtaatttgatggacaagaagaaactgccacaccctaacccattcaattcctccgatcacccaccgacttactctgctctctagaaatttccctacgagaaagcttcttccttttgtctttttgcttctcctttcttcttctcttctatttcttctctctactctctactttcttctgtttttggtaatcggatg

SEQ ID NO: 1638 - DNA, 3000 bp, Unknown
  misc_feature (1)..( 3000): cDNA_ID_2141987_gDNA_ID_1620428_Annot_ID_156788 3000 nt of promoter + ATG
tcgagagcctcaacatacttgtgtaatctttcctccttccaacaatttgtaaatcgaatcattagattctaactatacataaaaaataataattgtcaaagcgacttcaaaaacttgaataacaagactttatgggtatgattggtaattacttatagaatggttccataattctgcaaatttatgaataaaaattaatagagttgtgtcatctagaattctaagtaaaatgaagaattagattagtaacagtgagtaataaaacatgatttaagtacctgcatcttcttcttcaatttaacgtctccatcacctgagatggcatcgagcttgaccaattgattcatcaacatctccatcaaattctcaagattcttctcttcaactttccctcctttaccaatcactgtatcaaacgccgacagctaaagtccaaaaaccaaaaaaaacaattctgattcaagttacgagacaagagcgttgttatccggaaaatttaaaattatgtttcttaagttacttgtccggcgagtctttcgacttggaaactaatatcagagattgctttagatgatttctctttggtggcgattttcctcaactcaaggagacgtttctcctgagaaatgggatcttctataagaataagtttcgaacgatctttgacaccagaaagatcaagaaacatctttgagtctctttctttgtctttgtatataatctgcatgtcttgatgatgaactcctgtcgcaccagacaatatcttctttaattcccctgttgttaaattcaacaacaacaacaatcaaattccaaaaacagagcatactaatagtataaaggaaatactgtataactcggaatgttttgtgtcgtttaccgaaagtagattgagagttgatactgatctcgtgatggaccgacccgtatttgacccgaacccgaatgccacgtggcacgcttgagctatgatccgtccttttctgtacaaccattcctccaggtcggagctccatttcaccgtcgccggaagttgttgttccgatactcattttcatcattttctttattaagagagatagagagaaaaaaacagaggaatgatgagatgaagttgatttctgaaaaagatcaagaagaagaagaagaaaaaagaaacgtctgagcaaagagaagtaaatacactttgttttgtaataaattaatgtttctgtttctggacagaactcgtggaagaagaagaaagataagaatcatataaagcagattattgttttataaaattttatacaatgagaaaaaaaagttaaagaaaagagtgacagctaatgtgattgttgttatgtctcattatcagtccatcacagatacatatatttaatataaatgttgtatcccccacatatttatttctatttctgataaataatgacgatatattaatgtcgttgttacatttatatttatttgtcatcgttcttctgtattttataagtcgtgttctacgtttctaagtacaggtaagctaatgaaataactgaaacagaaacttgtgttacacgtcacgcctttaactccgacaaactctgcaacttaaaaatctctctttcttgcagatccacattgtctagaattatcgtcggtgttgtgtgtcttcttgccaagttttgaatgatccatggaccgtacggaccacacacgagctttctttgatcatttcttgaacaagctagtgctttagagacagagacaccggttaggtttgacctcaagactgttcgagaacagagctttgaacggttggagaacagagtataattatttatgggctaataatgggcctaaaaatactgaaataggcctgttgggtcgtagctccatatagttggatgatcttgtcgaaatattttaggggttgaattgtcaaagggagtaatattggggtcaataagtaatcatgcaaaaaagaggatatttgtcgtaagcccactcatttacagctgcaatcattggtacagttattacaaaaaaataaaataaaaaacataatttggtcaatcaactttaaactacacgcgtcgcacacgatccatgctctcaatcgaacgatccacaattgatttaactttattgatcgcaaggtcaagaatatgccacgcaatcaaaacagctaaaggttaccaatcggtcatacgatacttgttacgataaacaagacacgtgtcagtattgactagcgggtaataaaaagtacttgcaaaaccataagcagatgggtcaccggcttgtccggtcagatttggttcttacgatttcctctaggtatattaacaaaggcgcgtcaagttcattgcctagttccagctctctccaggattttccttttttttatgcaaaaacaacaaacacaaaataaataagaagattgtttattttaactttatattacagcttgaaatttccaggcaaatttttttccttcttcttcttcttcttcttgtctcattaattatcttcctcttcttctgtttcaattcagctgggtttagttttaatttctagttgtgatctctcagcttttgttctatattgatcgaagctccacttaacagttcttcgtacgttgtttccgtgttcttcgcttttttattttgtaatttaatttcggttgctttttaaatatctaactccgagatttttaagggattgctatctattttttttttttttggggattggttagtttctcggttagttatgttaagtaacgaactttaaaattagggttttgatttggttttttttttatttcagtggttaagttcaatgtctgtgtatctttaataacgcaccagattcatgtgttagggaatgttattgatctgattttaatcgatacatgtataatgttgtaggtatcagtagtaaaggtgggacatttgtgtcgcattgaggaagaaactttggatttcagactcacttgggacctaccctttaatg

SEQ ID NO: 1639 - DNA, 3000 bp, Unknown
  misc_feature (1)..( 3000): cDNA_ID_2141959_gDNA_ID_1620428_Annot_ID_156781 3000 nt of promoter + ATG
ccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggtaaatttttgcaatatgtagcacaaagtgtatgaggttgtgataacccttgaatcacttttcaactaacacatgacacattgatgtaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcagtaagattttgcaaattttccatcttagtttatatcgatgttagtgtttttcttataacactgacacaatgatctctcttgcagggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaaacaaacaaaataaccaacaacccttttgctgcaagccgaggtatgtaaaagcttttgagatattagtagactagagacacagccaaaagtttatgtcattacattcgactgatgtttgttctgttaatgacagcaggatgggggtcgattggtggagactggagagcaaaatgggatgatgggtttaagataagatattaaaaatgcaatttttgaagtattttgttggccacttagataattagcatcttccatcacccttattatctatctaataataattaatagatattataaagtaaaacataaaaaggttacaggtattatatagtagaatatgaaaagctcttttataagtagaatatgatggtgtggagttgtagtcggaggctggtatcggttctttttatggatgtatttttttccttcttccaaagatctcttgaagtctttttattgtttatattaatcccaatgtacataagttttcaagctcttgcccttttttaattatcttgtcgattcacattttctcaacttattctcttgctgacttttggttttggtctggtcttgtcggtattttgcagcttttcgtattagacggtgatatagatatattcacgaaactgtaagacctcttaacaaacggattccatttcgaatccttacattaaataaattcggatgtttctagctacaatctgaaaattaagcttgcaatgagcaaaacagtgagccctctttttaaagtactttgaaaaaaaaactggatgctaaaatttgttgtttcccttgtaacaatgaggaaaacaaggtttgggttttcaagtttatttctctagctatgctcatgtccatataaacgaatccgctgaaaaacagaaagatgacaccatggcaaacacatgatcaaagtttcgtgatctatggtttcattctatcatatggctcttcataaccaaacttgtatttaggtagaactctatctaaatcaagactttaaaccatatgaaacacacaacaccggcaactctggcatactaccgccttaagccgacaatctcaatcgtcacagaaacacaacaaacattttatcaaacttgctgagtttatggaaaaactttcaattgtatcagtttatgccattatcttacaacaatacaaaactgcatagttaaataagtggttctctagctccttgtaattctaccatcgacacatatagtgataggtctgatatggatgacacatcaaagcagacaatctaacaaaattattaatttttccaaaattccaaataaacaataggataaagtaaacaaaatgtgggacctcaccacttggggcacactatatgagggaataaacacgcaactccataggaagtttcttgaagcctaaaacattacgctgcttctcgatcttttaacccccattattacatattactccttcctacattattcttcttctgctttcgtgactttcaggggacacttttgtttttataacttacgcttaaaatcctatgaattcgccgccggttgacgca

SEQ ID NO: 1640 - DNA, 3000 bp, Unknown
  misc_feature (1)..( 3000): cDNA_ID_3063468_gDNA_ID_1620428_Annot_ID_156784 3000 nt of promoter + ATG
cagatttgtttcagataagcattcataattttgtagtacaaattttggaatccaccttatctatatgtgaggccgttttggaatccactgacactgagccttgaattttcattgaatgctacaaaaaggaaaacaaatgaatctaatttgatactaaataaatcataaaggaatatatagagaaagggtgagttacaagttgcagtcggtgttagggtcgatggtgaagcccaaaacgacgccgcagaagccagacaaagtagaaatggcggtggcgttagagttatagacattgatgagatccatgaagcagttacacagccactttctcttctccgacgaatcagagtaagttccgatcacagtcatcgcgtcgcagcaactcgaccctggtatcggatccggatacccgtagttcacaaactctgtgcacgacgatatcagcgttcccaccgccgcacaatccgctgcgttttccacagtggctgaacatatcgtttgcagtagtaataagaagagagacaccaccggagagaatgatctcgtcatatcttttgattattaggccaaactagttaggacgttttcgcttggtgtacaaggtagggtttatagacaacacgaaaaacgagcgttgggagtgtgtttggagttggttttcaacagaggttgtgtgaacgcgatgaggtttatatgaattatttccacctctaaaaacaagccatatcatgcgaaaagtgattagggtgcgcacaatagtgtcattgacgtgcacgttagcacatatgaaagcaatgttggaagtgaattgcaaaggaaaaggtggagttcatatagagaagacaatcactcaatggttaagtacttttatatataacaacctatgtttcgaaaccattatatcgataaaaaaaattgtttgaaaacttctaactaatacaaacacattgtattctccacatgatatggaacacccaatatatgaataagatgattacgctttatttcctccgcactagtaccttcgattccaatgtgtctcatacgatcttttcgcttaggataaaaaaaagactacatataccgtgtcatgacagataaccatcttattgatgaaaacaatctcaccacttccaatggagctatctacaaccttggaccatccttgtttattatgatcctccataacccatattcccacgctcctctcataacttacgaatcctagctttccttggtaatttatcagagtcgaatccttgctatcaatcagctctttcggagcattcacatgatcaaatttctcggacctaacatcaaaactcaccaagaaaaatgtagaaccatgatcttcagtggctcggtaatagatagccccgttgatgcaaactgcgggtagccacggatagtgatgttggataccgcatttgacgttcctccattgcttcttgggatctctcaatgtgaaaacaaaacaagcattctcaaactcctccgatttagtaatcatcaagcacattactttgtatttattcttgacaggatcgtacccaaagacgaaaacgtgattgaataaatcatctatgagcatttagatctttggtaagagaagagactgcctcgtagtagggttgtatatagcgacagaaatagaactatctgaacaacataaaatcaaaccacgaatgtagccataacagtcgaccgttaatccagggattgatactaattcttggttagtgtttagaggatgagtgaagatgaaaaaagaagatttgtctgattggtagtggaagatgagaaggacatcccaccactgctgcggatgagtcatcgaacgggccacgatcgaatcaatgaagtctctacgggatccgataatggttgaccattgtttcgagacgcattggaacctcacgagagacttcgcagggagtttcttgagtatctccaccgttatatcgagagggatatcaatataacgggacttttccctagtggagatttcacggtatcgacgacgttgtgatgagatattgtagttgctctctttgcttcttctcttcatcacgttaaaccctagagatttgattatatggaagatacaacgagggctttacatgttcatatatttatcaatataattgtgagtactaattcgaaacggataatgaaaatatattataatagaatttttacaataaattaaatttctattacaacaaactaaaatctatcttctttagcaaaaaaaaaaaagacatagaaatcttctcacatggtacgataaattttagctgaggtatcgtttggagtttggacattttttcaaaagtcaaaagtgatctggttcggtccgatttataaaccaaaccgaacaaaataaaccagaacggtttaactaaaatccctaatttcccgtacgatctgaccttcctttagtgatctcataacttagccattctaaaacccattcaccgtctctgtttcgttcgccgtgattcatagtcgtctcgtctcaccgtcaccatcaccgtcttcttcttccattgacaggtttcattatttctgaagattctctattcaagtagtttttaaagttttcctctttgttactctgtttggttttttgtttgattttaacatttctttgttcccccgatttatcatcattttcaagcttaaatttttggatatgtttgcaagtgcctgaagctgattgatatctcttatgaaatctctctgctttcttctgattctgtttccttcaactcacagttcaatctttagtatgctcttttagtaatctcttctatgatttgttgtgggttctctattgttttctatacgtatttccaaaaattgaaacttgattatgtgtgattccttttaagcaagatcaatgaataaaaaagtttgctctttgatctgaaaatcagcaatctattggatattgactttgttcttactactgtaggatcttgtttagattctgcaatg

SEQ ID NO: 1641 - DNA, 3000 bp, Unknown
  misc_feature (1)..( 3000): cDNA_ID_2141915_gDNA_ID_1620429_Annot_ID_156809 3000 nt of promoter + ATG
ttagttggaatatgctctatggatgctgatcagtgaccactatctaattgactaaaaaaataatcatcattcatccaaaatatcctaaatagattttaaaacacccaattacatcagcaactatatatgttacgtgagcaacagcgctatacatgtagaaaataatttccagtttttataacattacaagatcaccataaaaagtacggatgttaaaatgggctaaacatttagagtcggcccaggtccgctaaaataaataaaagcccggtcccgattaaatcaaaggagaaacgtttgggcttaaatatggttttgcagaaaaggtttcgggcttttatagggctggccctattatactacggttctgttcgtttctccatttgacagatccatccaattgatccattcaacatgtccatctagatgattcattcgactcttgttcgttttatttttagtcggttcatttgactggaccatccgaatgagatgttgttcgtttacttatctctatctccatccaaatgatttgcaataatacaaatacctaaaatacccatgctttcatctaattcttaatctaaaatatatttaaaagtaaataaatttcaaataatagttttttatatttataaatttattttacggttttggcgggaaaacgtgattttatgatttgacgggaaaactcgattttacagttttggcggaaaacaaaattttacgtttttggcgggaaaacgtgattttacggttttggcgggaaaacgtgattttacggttttggcgggaaaacgtgatttttgcggttttggcggaaaaacacgattttacggttttggtggaaaaacgtaattttttggttttggcaggaaatcacggttttacgggtttgccgggaaaccgtgattttgcggttttggcgggaaaatagaattttacgatttttgcgaggaaaaaatgattttgcggttttggcgggaaaacgtaattgtacgggttttgctgaaaaacgaattttacggttttagcaaaaaaaatgattttgcggttttagcagaaaatttaattttttattttttaaaaaataattgtaaaataagatttaaatctatttatttattttatctaaaaatacatctaaataatcaattgaaataattagggtatttttgtcatttgttattttagattgaatcatctccatccaaatgatccaatttagttcagtcaaatgagtttcaaaatttagcctaaattttcaaactcatccagatgattcatttggatggatcatctgaatgaaccgtttttggcaccaaacgaacatcaaaactcatctccatcgaaatgatccatcttactgatgaaacgaacatgcctacaaacttttttttttcttctttaacactaaacgacgacgtctcttttttttttctttttttttttctttcttcttcttcttcaatcttctttcttcgatctcttattttttaaactctcttctttgattgtgagaagccataaaaaaaggttcgatatctctctcttaatctttcatctttctcatttttctattctcatagattgatatattctctatctttggaatctgattcataggattggggtttaatggttttcgaagaaatctgggttaaagtgtgttcgtgtgttctctaaatttgattcactaaacgtgggtttcgaaaaattgaattctgtgtagctatgatcttgtggcataaggcaaactgattcctgaagttggaacatcgttctctggttcagtagagaaccgacgaacacccttccccatctccgacgatgttgtttttctgcttaggacacaagtttgttttgttttttttctcttaaactttcatactttcacacactcataagtttacacacattacacatatatataggagatttcttctactcaccatacccactctcttagaccttaaacttagtcactatttaaccttacttctagacattagacttagggatacaagcaaccttacacaaccttaccttagccactaacaaccccaactactctacctcaagtacttagctagaataagctacttctacgaatgggccacaacaaaacatacttcaccactttgggcctacacaacttcatcagcccaataagataaaacataaaacccacttctcttgtcttcttcttcttcttcttcttcttcttcttctcacgtctctctcttacgtcgtcttcttcttctagtttccaatcttcttgttcttcatcattgttgtttccttctcactgatgttcttcttcttctttgcaggatcaatcggagagttcaatctcaacagacgaccataccctcgatacagtagctgctccgctcatcaacgtccatttcgccgcctttagccgtcaacgttctctggttctgttgccgtacaaaattcttaaaggtcgcgtttttatgtaagcgtagggtttagttgtcgtcccgctctttttaattagactttgttaatttaattaggttaattagataagacctaaaacggcgacgtgtaagctgtcgtcttcttgacctttttggtgaactcctccttcctctctatcggctatcgctcgctgcgtctctgtgtcttgttgcttggagcaagctctccagcgtgagttaatctaatctctgtaatgattaattaccttcttttacggtttctggaattgcatctgtgtgtgagcacttggtttgaaatatgatttaactagtgaattcgataatgctgttcaataagaatgcttagaaaagccttaactgggttttactcaccactcttcttattgaatctagaaattgaaagtgtgaatttttgcgagttctcttattcaaacttcactgcgaaaggtggagtttttcgtctctgttttctccctaattcttatagtttgagctaatggtgttaatcaggctcaagaatagataaaataaaatt

SEQ ID NO: 1642 - DNA, 63 bp, Unknown
  misc_feature (1)..( 63): cDNA_ID_3063476_gDNA_ID_1620429_Annot_ID_156812 3000 nt of promoter + ATG
ctttctcgctgctaattcagttgctcctttcgataatgagaaaaatgacttatctgctcaatg

SEQ ID NO: 1643 - DNA, 3000 bp, Unknown
  misc_feature (1)..( 3000): cDNA_ID_2105831_gDNA_ID_1620429_Annot_ID_156811 3000 nt of promoter + ATG
cagagcatggagagttggccttaatcacagtagaaggttcccaggctgcaaagcaagaaaggatatctttaaggccccccatgctgcaggtagatttttcttacttttacttgaaaatattgtaagctattgggaagcataatttttaaggtctaagcgtgttgttttgtactgcatatgtgtcgacatctatgtcaattcatgtcaaactagcaagagtcttccttatgtgtataccttttaattgtaggtggtgcgtttagcttctttccaaaatgctccatctgttccaccattcttatcattgccaagacaatctagaggtgatagcgatgacataatggatgaaagaagggtcaatgaggtagctgtgggtggtggaggagtctcagttgctgttactcgtttcccagtggagcaaaaacgaccagtggggcctcttgttgttgccggtgtgcgggatggagttctttggctcattgacaggtactatgagtctcctgttcttaccttacgacaagactgactcttgttaatacattccttgttcgatgctgactgtatgaattggtgaatcgttttatcttcatttgagatatttatatttaattagattatgaattttcctttccatttatattatgcactaggtaggcactgaaatctgacattctgcattccaaagtttcctcgagcactaagcttgaatacaatatcttgccatgatagtcattttagttgcttgaatgaataaagaaatattagacagaagatagaaattattgtctgacacctccttccatttcttggtaggtacatgtgtgcccatgccatatcccttaatcatcctggtatccgctgtcgctgtcttgctgcttacggggatgctgttagtgcagttaaatggtatggatatgtttctcataatctcgtgtttatgtgagtagttaagtagctggaatccttatacaacattttttttgcgcagggcaagtaggcttgggagagaacatcatgacgatctggcacagtttatgctagggatgggatacgcaacagaagctcttcatttgcctggaatatctaagaggtaaataaaacatataatattttggtgccgcttttccttcaatttggttctactatagacagttttttctagtctctgaattgcttatgctggacagtaaacagaattcagtatttcactcatgtattgaatccttcatcctagcgttcaactcaaccaaaatggcatcagagatttttttttcactttgacttaggttccgagtttgacttaactttatgttttctcaggctggagtttgacctagcaatgcagagcaatgatcttaagagggcacttcattgtcttctcacaatgagtaatagcaaggacattggacaggacggtgtaggccttgatttgagtgacattctctctttgacagctactaaaaaagaagatgttgttgaagctgtggaaggaatagtgaaatttgcaaaggagtttcttgaccttatagatgctgcagatgccacagggcacgccgacattgctcgcgaagctctcaaaagactggcaactgcaggttcggtcaaaggcgctttacagggtcatgagttgcgaggcctttcattacgcctagcaaaccatggagaattgacacgcctaagtgtatgtctgcaatttctctttctttcggtttctaacttggtttctcgtattttaggatacctacagaaatctaaagacctttgtcttgttcactagataggatcgacataactatagacgaatttatgctttgattttatactttgtatcttctggttcctaattgaaatactttattaactttgttgcagggacttgtaaacaatctgatctccataggccttggacgagaatcagcattttctgctgcagttctgggagacaatgcgctcatggagaaggcatggcaagacacgggaatgctcgcagaagccgtgcttcatgcccatgtaagattgtttttgtattttggtttttctttttgcagtttataaattaaacttgtattgtttctgactacgcctactgtaattatttccacaggcacatggtcgcccaactctaaagaacttggtccaggcttggaataaaacgctgcagaaggaagttgagaaagctccgtcttctaaaaccgatgctgcaagtgcgtttctggcttctctcgaggatccaaagctcactagtttatctgatgcatctagaaaacctcctatcgagattctacctcctggaatgtcttcaatctttgcttccattacggctcccaaaaaacctctactcacgcagaagactgcacagccagaagtagctaagccattggcgctcgaagaacctacgaaaccattggctattgaagctcctccatcttccgaggcaccacagaccgaatcagcgcctgaaaccgcagccgctgctgagtcaccagcacctgaaaccgcagccgttgctgagtcaccagcacctggaaccgcagccgttgctgaggcaccagcatctgagactgcagcagcacctgtggatggaccagtgacggagactgtgtctgagcctcctcccgtagagaaggaggaaacttctttggaagaaaaaagcgatccgtcttcaactccaaacacagaaacagctacgtccacagaaaatactagccaaacaacaacaacgcctgaaagtgttacaacagcgccacctgaacctattacaacagcgccgcctgaaactgttacgacaacagcagtgaaaccaacagagaatgcagcaaccgagagacgagtaaccaattaccctccaataagaagccagccaatagattttgatttcttgaatggctaaaccaagttttcacagaagatcccaaaacgaagacaacagagtgtatatcttttagatatatttcataatcaaagctttatgttcattataatttaattgagagtttaatg

SEQ ID NO: 1644 - DNA, 2557 bp, Unknown
  misc_feature (1)..( 2557): cDNA_ID_2025081_gDNA_ID_1620430_Annot_ID_156819 3000 nt of promoter + ATG
gatccaaataagaggttcgctagtaaaattctcggctcagactctaatttgagtcaatgccatcaagaagaactcaatgaaccagatacacataatcgcagaaagataactgaataatcttggcaatataaatcttcttgcttattatcgtctttctctaccaatataactaattaagattctttaaggtctttattttagcatgggtggcttatgattaatacttgtttcgaggaactttcttctgccgcaactaatcttacaacaagctaaaccacatatccctgacatggcagtatcttaaggactatacattaactttacgagcaaagatgaatgaacagagagtaagaaaagacaatgaactacaattacaaagacatcaaaatctataagatcattcagagaatttggaaaaaccataaagaaatgacgaatgtaaagtcatctactgaagcatataaagtactttttatgaaacacaagcatatcgaagccaatcttgaggccatattaaagtgaaaaaaaagcaaggcacccgcacagaacatgaaatgaatgtaggccacagagacgactgaatcttcgcaaactcacaaaccaatttattatccaacttagtgtgatccaaaccaaaggtatgaatacacaatccagctacagaactagcatgaaactgcactatgtgataccacattacagatcttcgtaagacttaaccataactctttatctagctagcaacaagtaattcacatattctcatgaatttgatcaatccctagagtttcactaaccaatatcatcagtcaaaaaggaaaactgacctgaacaccaccgtctaaagcagcacaaggctgaagaataggaccaggattcgaccgttcaacagcaacttgaaccggtacaccaaaacctttccttggtccagtttcacgaaatctcgtctgattctcttcccgacgtttatctccatcaccagaaacagttccagtgttgttatctccaccatcaccatcttcatctctcacagctccatgaccaccaccaccatcgttatgaccaaaaccaagtatacccgttaacttcttcaaaaaacccattaaccccagatatcaaattcgatctaaagccctcaaatttaacagcttttctctcaaatgaatgatcttccaaaattagggttttcgaatatccctttcctctcccgatttttgctactttctccgatcgcttcttaatccaacaatattcatttcctactgttaaaacccagaaatctctgtctttaatctctctctctcgtgaacactgtgttaatcttcttatgcactgcaacaaattatagaaagatgaatttttttttggatcaaagacggatcgagcaagatcttctttttatcattaacggcgcggtttctattaatatactaaataaatattccacattttttttttctctcgtgagtgaacaaaaaaaaaaattgcgatcatttacagttttacttttacacatcactgacatcagagagaattgaacaaaaaaaattcgaaaagtttcgtgttaatcatatatatgaaagttggctaactctctccaaatgattgacacatcatcattttagcatttgccatgtgtctattaagtaattaatgtaagctcttcaacttctaatttataagttaatgatatatttattatttaattttacatatttaattatagtattactaaatttattttaatattacatgatttttcaataaaaccatttaatagttttctcatactcgaagatttttttttgtaatccaaactcaaagtatgagtatataatagtcgtggattatttaatgatttgagtaagttattttcttaaattgatattatattctcttaaatttatatttatacaataaatcattgaggttgaagaatacgtaaggagctccatcatcaaattcttaggtttctagaatccaaaactaccctctcttaagttggtttaatacaaacgttatttatgaattatgtgtatgatgcattgttgagaatgttgttagaaaaaatatttttaaaattaaaaggaattgtttattgtataagtgaataattagataaataaaaattatatttaaattaaacaatacgaaaaaaatccgaaaataccgcggcgtagcgcaggtgatcacctagtgttaataattgaaaattaagaacttctatacattgtttgttacctaaccattcttcatatgtaaacaacaattaaaaatgatgaaggatataatgtactacaggcccataattgagacgcacaggcccagaatcgaataagaccggcccattccaaaatgacgactgaattcaattttgtttctattttttgataaaaaagaaattaaaaaaatatcgcatttcagttgttcaacttcttcgtcgtcgtcttcttcctttgctccgtcgtcgagatctcgtcgaacctcaaatctcaaatctcctgtaaccagatcgtctaattatccgatctgcgtttcgaatctcagatcgaagatg

SEQ ID NO: 1645 - DNA, 3000 bp, Unknown
  misc_feature (1)..( 3000): cDNA_ID_3063513_gDNA_ID_1620430_Annot_ID_156830 3000 nt of promoter + ATG
ttcttgtttttaagtatatcatttattttataatttattgttatccataattcatattaaccaaacgttttcataaacttgattttgtttttccttatttctctcttttttaattagtttagcaaaaatgaaaatgaaacagaacataactttagctattttcctaatcaatgttttcaggttggtttgttttggttgcaacctagaaaattagtttctttagcaagaatattaaattgccacctacaaaatttgattgcaacatacaaaattagttattaaaattgtattacatcaatgaaggtattagtttaaacacaacttccctttcaggtgatgcatgataggaatagttagtattgacttcgcaacttagctttcctaattaatgaatttaaatagaaacatcaacaaaaatcaaacactaaacacaaaagggtattgcgtaatcactcatctttaaacctagatttgtgcagtaatctcctcctgatttgattaaattagtgagcaaaacataaatgtattaggttaaattctcccaattaagaagcttatctctctttgtagctctagctcaacgtactatgcatacaaggatacaacatcggtccgttgtttgcatcacattctttccaactcatacttatgagtaagcatataacaaaagtcattaaatacgcatttttgtgtataaaagcataaatgatgtaataggaattaacttatacaaagatagctttgcatcactgtcacatttgtgtgagaggttaggttaccggataattaattttgttatagtcagattggatatcattaagagaaaaatgttacaactaacaatataataacgtgtaataactaaataaaaaatataatattgctgaattaatacgcttcttattttttttttgttaagaaattataataacgttttttttttggtgaggaaatataataacgttttgatcaaaagatataatcaaataataatatcccctatatattaatagagaaatgcacttaagaaattaacttttagctatcttggtatgtacgcagatgtcatattgacgtatcgcaattagagcaattcttaacaaacttgattcattatccattatttcttaatttacttacaaaatttttcattattattagatataaatatctcaacaacataaaaataaaaaacaatttctaattaaaattagtaaataattaaaaactaaactctaactaaaacaacctaataattaagcaactaatatttcagaacttaatatataactaccttcatttttttatataaacataaaaatatatgttaacaaagatattaataataatcaatgtatggtaacaattatttctatgtaaaaaattgttggttcagataaaataaaaaggtatattacattacattatacacaaataaacttcagattttaaataataatccataaatgttctaatttactataatacatttatttaataatcattttatcttgtacatagtgcggaaaaactatctagtaatatagtatacgctcttttacataattagctgttgattttcaaaataaaataactaaataaaaatacggaaaagaaagatcaaatcaaaacgtgaaggttgatgatattaattcagcatatatttttttggttcaaaaatactaattcagctgaagtaagaagcgtatattggtcaatactattttgcgccattgtcagaatgatttgtttctcttcccactaaagaatttttttctccagcaaaagattcattacaaccgatagaacaatacctaaaaatagaaacaaggtagtgcaaagtaagaaacagcaaattgataaatagcaatatcttcttccacactgaaaaactcttggtttttactcttggtctttttcgccatatcatatacatcgtagcatggaaaacataacgagcaatgaaactctccattcgatcttgccactgacccgagactgtagcaattaaaacagaccagtttgtagagtatttggccttgtaaatcttttttgctatgttttctcatatttctgctgcaaaccaaattcatatattttctgtaccgatagtttttgttttttttttaaccaatttcaactattttctatttcggtgacaaatttttaacccgaataaaccaaaaaattgattacaccgatctaaataaactgaaccgactaagtttatgcatgagacatagtgttttgattttacgagaatttattgatatggcgaatgataaaaatatatatttttaataaaatgctaaaatctagtttttgtaaattgaagaccttttgtcaaattttgattttaacactaaatcaaatggtagatatgagatatcaaattgcaataatggagcaataactttctaaacacaataaatatacttttttaaaaatatattaaaatatcagaacttttcagcaatggaaaatggaaatagttataagtctctcacaaccaattaatgtgatgactatataatagtttataatacatactttttgtgaaaagaaaaaccaaaaaaggaataaaatttgacgaaattgattaatatttttggtggaaaaataatagtgaaagagagagagataagaccaaagaaggacagaaagatatttttaaaataccaaaaaaaaggaaataatcaaataaaattagaaaattccaagagggttccttgaacccaacgcttcttcttaggctcggggctggttcgggattaggttcggaaatattatacattgtcgacattggtaggataagtaggactctttctcattgcttttcgcttcgtcttcttctctctaaaactctttctctgcaagaaaaccaatctctctctctttcactttcttaaaccctttatctctctaaaaccctcctttttaggtaaaaaagttttggtgctgactcaaaaaaggttgggtcttttactgcattttgaaatg

SEQ ID NO: 1646 - DNA, 3000 bp, Unknown
  misc_feature (1)..( 3000): cDNA_ID_2046555_gDNA_ID_1620430_Annot_ID_156834 3000 nt of promoter + ATG
taggcttaatttttagcttcatggacttgtagcaatgtttcaccttctggctagggtttaagctgtgattaggaagatgttgacttattttttcctgttgaccactctatttatagcatttcatgttgttgtagatctattataagatcatattgtttttgtgcaggtcaacgaacttagactcgtggagtcctgagcagctaagaacaatgatgtttggagggaacaatcgagctcaggtgttttttaagcaacatggatggaatgatggtggtaagattgaggctaagtatacttcaagagctgctgatatgtatagacagactcttgctaaagaagttgctaaagccatggctgaagaaactgttttaccgtcgttatcctctgttgctacttctcagccagtggaatcatctgaaaatgggtttacttctgaatctccgaaagagagttctttgaagcaagaagcagctgttgtctcttcaccaaaagcttctcagaaagttgttgctagtacgtttaagaaacctcttgtttcgcgaaagtctgggaagactggtggtcttggtgctcgtaagcttactactaaggtaacgtttttcgtttttataaagaattatagcttagcttctcggttcttggttttgattagattagtatttgttgtatatgtagtcaaaggataacctctatgagcagaagcctgaagaacctgtacctgtgattcctgctgcttctccaaccaatgacacatcagcagctggatcatcatttgcctctcgatttgagtactttgatgatgagcaatctggtgggcaaagtggcacacgggtgcttagccatgttgctccaccaaagtcatcaaatttctttaatgaatttggaatggacagtgctttccccaagaagtcaagctcaagctcatccaaagctcaggtaaagaaaagtttcatttttaacagaactgaagaaagagatagaaatcaattctcgattcctctttgtttacctgttttctttttacttaggttgaagaaacagatgaagcaagaaagaagttttcaaacgccaaatcgatttcctctgcccaatttttcggaaatcagaacagagatgccgatcttgactcaaaagctacccttcagaagttctcggtatgtccttaaccgatcaaactctatactagttttctttagtctcgttgttcatacatgcctaatgcgattacaaatctatcagggttcagcagctatttcaagttctgatctttttggccacggaccagatgattccaacatcgatatcactgcaagcgatctcatcaaccgaatttctttccaggtaaagttctgaagtagaatcaaattcttcagcttttcttaactctgcttataaggtttttttatttgactttgtttattattgggcacaggcgcagcaagatatgtcatctattgctaacttagctgaggaaacaaagaataagctgggaacatttgcctctagtatattcagtgatcttcaggatagaatgctgtaagaaacatacaaaggatcttgtcttttgatttacagagaacaaattgttggatataaatgtcatttttatttttggtttgactttgtagttgaaagagtgatttttgaggtaaattgttaaatgtggaatttgataatttgatgtggatatggtagaatatgttacagtattatgtatggtattgaacatcaatttattcccttgatatggttgcaaaaaaaaaaaaaaaaaaaaagaactcagcataagaggaagaacttattaccaatcaaaacttttgttgaaaagaactaatattgaaaaaggagaaaagtgagcagatggattttctttgaccatatcggcatttctattaaaatagttccatttttattataatataattaaattttgattatgaggattttatattaaaagttatatttattactgaataaatttaatttataagactaaaaaggtgattttacaagaaagtaaaatatataatttttttaacttgaaagaaatttggtcaacaatatagtaaaccgttaaacttggaaaactatattgaaaaagatataggaaagctatatttgggcaaacaatataaagaaaacgtaagatcaacttaggctaatgaaaactttaaattggtcaacaatataaagaagataataatatagaaatgttagtatttccattatttgttaaagaaatgatttaatttagcttttagaaacaaactgacaaaaaaattgatgtggcatacagtaactagaaatatttttacaatatttttttttggaaaaagtaaataaatctagattttaggaaaaaaatgataaaagtaactgtatatatttttattttgtaaagtatataacacaaataaaagcaatattaaatttcaataaattgataaacaaattaacaatcaacttgcgtttttccctattgttctccttcctccttcaactatttaacccaaaaaaataaaatctggttttgtcattttttttttttttcgacagttctggttttgtcaattaaacttgtttaaagataaaaaatataattggtcaaagagtctctgagaatccaaacttccaaaaccaagtgcgaaccatggttgagttaaccaaataacctaatcaacgtttaattacgcttattttatctgtggaaaaggtcaaaagaaaccctaaatccccaaataaatggcggcttgattttccctcccaattcaaaccttcttctccactccaattctcatcttccctccaaatcgtttcgattcgctctcagatttcgaaaatttcccaacttttttggagcgaaactcaaatttatcttcttcaattacttacagatcgatttacgagatgcagaattctcccaaaactaaaccctagcttccacttcttcccctttccttcaattcttcacaaaatccgttctcggttttgttgttaatg

SEQ ID NO: 1647 - DNA, 3000 bp, Unknown
  misc_feature (1)..( 3000): cDNA_ID_2046551_gDNA_ID_1620430_Annot_ID_156835 3000 nt of promoter + ATG
ccttgacccgctctttcacaacccgacccggttaaagcaccagacccggataaccaaatcacacgagagtttaagaaagattctccggggagaccaacaccgttaacgaagctttgagtcatcgaaactaagaagaaccattcagtatctgttacttcttcatcgtttgattcatcggaaaccccaattccgccggagattaacgagttaagctcacgtattactcttttccgatgctcttgctccgccgtgttggtgttgttcttcttcttctctttatcttcctctcctttgtagtaaccatctccccagccgaggatcactgtgttatctccggtggatgaatcgaagtcgtgtgagatctgccagaagatagcgtaagtccagttttctccggcggattctattaaagcttggagacgttgttgaagagtatcttcgttgaactgaggctgaggtggttgttgtggtggtggaggaaagagagatgagtggtggtttgttccaatgaaagcttccatagccgccgccgacgcgtcatcgtcggaggtcaagaagttgattgatgatgttgtgccgttcatgtgaacatacgccggttgaaaaggtgatattttccggtgaaaggtgaagacttttttccggtgagaagaagagagaggtgacgtgtagggaggaaaaatcaaaagagggaaaaagctaagcaaatggcgtttagtgattgtttggagaagatgattctctctacaatactatattttatttttattgtttttctaaaacaattgtaaataattttttcttattttcttaagtttttgttgagagttgcgacatattatatgacaaaaaccaaacgataataatttggttaactgttacgaaaacgtaaataaattattcatggagtgataattctcgtttggacactgttttgtctgaaacataacttagatccgtttattatcacatagccacttattgttttatggagaaaaaactaataaataatccatttatggtgatatagtgacttagagtttcgaatatggaccaatgctataattcaaaatttcataagttagaaatctaaaatataaattttatttttcatataaattaatattttaaactgcaaaaaagaattgcatttttaaaaggaaaaaaatagattctactcaatttatatcaattaagttaggaatttaaaataatatttcaactgattttatgttagttataggaaaataaatatatatgaaaaaactaaaagtgttttctttctccaatcatcttttttttttaaatatcatttcattatgttcattttattaaaaatcagtttgaaccgttaatatgaaatttacgttttcaaataattatccggtgtaaatttttttttggtgtaatggttaactaaatatccattaatacttcatcacaccatatatgaagtttgattttcatagattacaaattattgaagattaatggaaacgatttctatctagagattttagtgtggtgcatagaaccgtatgtcgtagtacagtaccatctgtcaaactgtaaaattgtacaagcatcgatgtaaaactatcggttgtggagttgactacgaaaaccataaaaagaaaactcaaaaaatgatttgctagtcctaaaaattatttgtaatatatattcaaataataatgtatccaacaacatagcaacttccgttcaatttttgaaagaggaagaaattaacgtataaaatttgtattttctctataaaattcatattcgaatttattttttcttagacattttaaattgtttttttctttttttaaatattggaattatgttgtgtagcccactttaattgtttgggtcctctgtctaggcatcgtctgtctgctttccatgtttctgtcaccataattgacatatctatttattaacaatcttcatatttttgtcacggtatactgtaagttttctttaaccacatttttttcatcaaattttttatcgtttggctaaaactataatgaccaaccaaagtatataattttttaaaacgttacatatgatttttttgtcaaagttacacatgattattgacaaagaactacacatgataatgccaaccattacttataaacaaaatatccagaaaaaaaaagaaagaagaagaaaagtagtcagtgaaaaggacaacatgtacaataatattcaatggttaatcacgatggctaaaatgatccagctcacgtgattctcgtggatgatgtaattacaaaacgactttagacccactaatcgtacactaacatatgattattgacattacataataaaatatctctacttcttgccagttttcttacaagacattgataaacatgttacatgtcacagaaacattgtatcaagtaaaaagttttactttatcaaaaaagaaagaaagtaaaaggttcgagaggaattagtgaagataacctaatttaataccttaatgtacttccataacaagtcgattttttggatttaacaattattttggttttcaatttttcacaattctgtcttcatctttcaagcgatcctctttgcgctaataacaagatggagaaaatcatgataaaatttagcgatgaggttttatcctttttcattttctgttttatggttaagttttgtgattaaagaattagaagttttttacaggatttagactatggttagagtttacatttgatttagaattgtgtgactttcatataaaaataatgacatctacgaaattacgaaatacaaatatgggcttattcattattgggccatacaagcccatcgagtttagtattgatcctctaatcaaaaaacgtaaacaaataagataacagaaaaacaaaaacaaaaatttctgctttgaagaagaagagtcgatccataatcgccactttcagatttccagattctggggaaacatctctaaactcttcaacgatg

SEQ ID NO: 1648 - DNA, 3000 bp, Unknown
  misc_feature (1)..( 3000): cDNA_ID_2046515_gDNA_ID_1620430_Annot_ID_156846 3000 nt of promoter + ATG
tttaccaacctaaattgacaaataaagagcaattcagcatggctttcatttggctcaatactgagtatgaaggcgaacgcaccagtgcccactttggttgggctgtaagaatttaattttttgttttgtttttttaaatcgtgatatactagatcaaaattaaacccacttaatgcaaccatcatttagcatatgtataattagttcatttgaataaatatcatggttaaaagttttactgataactttttttttttactacgtatgaaatatattaaggtgattcctgcactatatggcgatagccgtacacgacttactgcatactggagtgtgagtaacaatgtcaccaattatcgtctgtccctatcacaagaaagtagattttttttttctcttctttaaccccaaatcgttttttgcagcaagatacattcgaaagcggatgttacaatataaaatgtaagggtttcgttcaaattgataggagactctttcttggagccggttttgcgaacacctctgtggtgggaggccaaaattttaaagctttttttgcaatcaatcaggtatataagtatatataacaactacgtttttgagttaaactaaattcttggtttgatattgatttattcaaaacaaaaatttgaataaaaataaaatttctcaaatattattaaaacagttctttagtttcaattggttagtaatattctttaaccgataaactcgaagaaaattttcactagataaaactagtgaatttcttcacaaactttagtataatttaccaaaaacaaatataaccttacacttctttttttatgggatctacacaaataataggatccaaaaacaaacaatttgctgctgacagtggggaagatttacttagggtattggccagaggaacttctaccttttttcactgaaggagcggagtcagttatatatggtggattgacgaatgctccatctgatggcattcaaccctttaatatagttagcccaccgatgggtaacgggaacaaaccgctggatgaggaagttgatctaaagcatacttgttatatgcactctcttaaatatgtgacacaagattacaagagtgtcgatgttgataccaacaaggtcgccgaagttgcggacgcaggtatatgttacgacgcgatttattttgataaacttggggggtatggacaaacgtttaccttcggtggaccaggtggtcattgtgatgtgtgatcttcctttatgtgatactttgatatttcacttttattcaataaaacaatatttaaatttctaattccctagtcgattttgatagctttatattcttttacaatgtttttgtataaccaaaactcatggacatcaaaacaagagatattcgcgtgtcgcattcttttaatcatcaaaacacacagtactaggttgatgaacaattataattctaaaaatcttttacaagtttttttgtcattccaacttaaatttgagaaaattgttgtatgcatcgattgtttttgtattgtatgtttagacaggcaactactaactatgccaaccgccagatatccaatggaaagggtttgaaattgctcgaatttttctgatattgtgtgaaaacccttttcctatttttttggcgattagtgtagtaagtacttgcgtataatacaaaacactacacttcacctataaaaatttaaaaacgtctccaccttatgtaaaaccgagtaacgggtaaaacatgtcatgtacgtacggaaacaaaattatatgttgattgggttctaaataaaatactaagccatgaaatttaagcctttcataaactgatattgaagcttcaattggaatctgtcaatcaaagattgtaaccattgacaaaaacttatagttttaaaatcagctaccgacaacaataaatttgtcattgttggattcaaaatacaagtctgttttcacaataatgttaacttgagtagtttcttctttcattctcaaatctgctatcaaaagccagagttttggtaactttaaataaatcggtcaggacgttaacaaatttattatcactaaacgtcattctactaattattttttcttagaaaaatctgttactatatggcagatttatgtcaaaaataatgtctgacgccactaataaaataaatttgttacacattataataaatctgttaattcctaacaaagcaataggtattttaggtatgaaaataactcaattaacttttatattttctgaattagtttactaattaaaccctcacaataataaaaatattactatattgggtcaacatagttttttcccaaaacaatactatgaatggggttaagataggaaagataatatggcatcaaaatgaagactttataccaaaatatttaaagattttataccaaaatatttaaagattttataccaaaatatttttaaagattttataccaaaatatttaatagttaatattattaagtaaattaccttataattaagaattttcaaatgactaccttccctatatatacattgcctccgcctctgttattaccaacggctgaacatagaaaatatgcaaactaagcaaatgacttctccttggttgttgatcatcatattctctctttcattaccttgcttccatggaaggtctcaaaatactaaggtctgtcaccattttgtaaatataaacttaactatacaatatatacaacttaagttctaaaattctcatatattgtagcctcaagaacctgagtacgaatgcgttgatatctacaaacaaccttcgctacaacaccctaaactccaaaatcaccaaatccaagtatatttctatatatttacatttgtgtgtcgattttctccacctaatgtttatcatgatcatataattatccctatttaatcgatatattttttgatacatcacatagatgagaccgagcgacgaagttctagcc

SEQ ID NO: 1649 - DNA, 3000 bp, Unknown
  misc_feature (1)..( 3000): cDNA_ID_3063517_gDNA_ID_1620430_Annot_ID_156829 3000 nt of promoter + ATG
aaaattgtaacaatttgaagcttttttcaaattcacattatgctatttttgtaaaatcattttcttattggatgttgaaaggtggaagagagttgccagctaagttcagtagatgacattgcaggagcagttcaccacatgctaagtatcattgaagaggagcctttttgttgctcatcaatgtcagaattaccatttgacttctctttgaatcactcaaatgtcactcattctctctgagaaatctcttttttgttgttgttattccttcttttaattttatcacatagcacatctttagtttttttttttcagaatgaagaaacacataagctttcttttaaaatcctaggttctttttctgactttgtaaaggctaaatgtgaatttataatggcacataacatattagttgttttactcttaattttatgcattttctgatagtaattaagttataaattagtacacttgtgagtgtttgaattgttttatatatataactggattcttatatatacaaatcatcaaaaaatttagctaggctctcgatcttggatattagttagtagagagtatatactaaaaatctttttaagtgtgtttataaaatttcaagggctaaacagatgatattttatggagatagttgtcaatttaagaggctaagttgtaacatgcaaatggaaaaatctaaagaaatcaattacgtgttaatgtgtaatcgtattaaaatctttttgtgataaattaatttggatattctgttacagaagattttaagacatccgccatcattgcgagtgagattgttgtgttcggttgcttatgttgttatattaccatcaacatccacgacactattttatggacctttctccagtggcccatattaatagttttagatatgggctttatttgatatatccgtctagctttaggccaccaaggctggcaacagaggcgagagtacttcactttagtattcggacaaggtttatatttctccaaaattgtttgctatctttcgacttaatttgcactcatactcgataggatgataaatgctcatcattttggtacaatacacaatttttttggtacccgctgcttttttttcgttcaatgcttatcatattcgactttactcgtaaccgacgatctttgtacccataaagaagtggaaatcttgacttttcttcacgaaataaagattctcttcattatctcctttggactccatgcgaatttggtcaacatgttcacattttccacataactggttcgttctaagaagggtattgttgtttattataaagggaatagaaacaaatttattttgtttttagattgttagcatatatacaattaatgtctgtatataaaaagaaattaggatatgtatttgatttttgttttctgttctattaatatgtacctttatgtgaaaaatacttgcatttgttgagagaacacgaaaagatatacatagacccgcgtaatctctcccgtttaactaagattgtttagggctgggcacaaggcaagtacttgccgatttggaggtacttgtgacttgacttgccttgtcaaagtaattggatttttggcttgttatttgccttgttaaaacgagtacttggtctaccaagtatttgtctaaattttaattacttgcaagttacttgacccaccttgttacttgtcaaaattaaatacttttacttgaacctaaaatatttggaataaaaaaccctatttcatacataatatttaaggtcaatgagttttgttataataaattttaaaattttagcttttatagaccaaaccaaaattataaatttgttataataatttaagcattagtatgttagtaacaaatatacaatgttcaacaattaacaaggtaagtaatagaaaaaaaaaaaatccagacctaattattagttatcccacaagtcacatgtacaaataacgagtaacagagcaagtaaaaggacaagcatcaaaatgatgcaagtaacgaggcaagtaacgggataagtatcaaaacgaggtaagtaacgagtcaagtatcaaaaaaaattatgatacttgatacttggcttgctcttgcaagtaataaaataaaccgacttgttacttgacttgcctatgacaagtacttgaattttcaagacgagtacgaaccgagtagcgagtaattgccgagtagcgagtacttgtgcccagggctaagattgtttgtaataatgaggattactaaatatggtccttcgagatgggacaaaatatttgcatcggctcttccacactagagatgcatcacaactgcatatagaatcttctaacacaatggagttcacaaattgttgtggaagttaatgtctcccaagttcaatgaatctgtttgtttgtcttaattcaggagataacttgagcaaagagagacctccatgtggtattatccactgcacataaataaaaaggaatttcaaaataaggtttgtaaggatttttttttagaaaaaaaaacagattatgcggtaaatagacaatttctggtttaccattttaccttatgaatacattctagagaagatgcgccactgataccaataaatggattttatcattgtgaaattggatttgggtatcgcttattggtgccttttctagtctagtatctcgaccggtgaagacttattctctcacgtctcagtgtcctagaagaaaagatgcaagtaataaagagtttgtgtagttataaggtttccgagttcggatgacattttttgaatcaaaatctcgtgtatgtgattgagtattaaaaatagacatgtaagttcacgtagaagttctcgtgtataaccaagttcggaaaagtagacttatgtgagttcatgtagaagttccaatctaacataaacgcaaaggttttcaataacacatgagaacaaaaaaaaaaacaagagacgaatgttttgagcctttaga

SEQ ID NO: 1650 - DNA, 3000 bp, Unknown
  misc_feature (1)..( 3000): cDNA_ID_3063533_gDNA_ID_1620430_Annot_ID_156820 3000 nt of promoter + ATG
aatgaggtgagtgttgagtttctttctgtgtgtatgtagatcggctaggttgtgcggtagtgatgatattttgcattctctcaaacgcaggtgtttctggatattgtggaaagtgtaaaccttctgatgtcctctaaaggtaaataattgccttttatgaagttttttgaagttgtctttcttgttgatttgctgtgtatgactggttttgcattttatggaaacggttaggcaatgttcttcggtgtgatgtgacggggaaggttttaatgaaatgtttcctttcgggaatgcctgatttgaagttggggttgaatgataaaattggtcttgagaaggaatcagaaatgaaatctcgcccagctaagaggtatacgttgttaatacattgaacatcagtagccactgacttttctttgtgctaactgactctcgttttgtgcagtggtaaaaccattgagcttgatgatgtcacatttcaccagtgtgtgaacctgaccagattcaactccgagaagactgttagttttgtaccaccggatggagagtttgaactgatgaagtaagttttcgaatgtccactgttgcaaattgttctggtaccaaatgtgtattaactttatgatgtctcaggtatcgaataacagagggtgtaaatctgcctttccgtgtattaccaacaatcaaagaacttggtcgtacacgtatggaagtaaatgtcaaggtacataacttttctcaaggattacaggatacaaaaaaattggcttgatctttgctctcttacaatcccttcccgtgttttgtctgttcaggtcaaaagtgtgtttggtgctaaaatgtttgcccttggggtcgtggttaaaattccagtgccaaaacaaacagccaagaccaatttccaagtgacaactggtcgcgctaaatacaatccatcaatcgattgcttggtttggaagtgagtttatataatttcccctcatattcatctctataattcttttgttggtgttttatcaatcattcggcatctttctctcttttactctttaggataagaaaattcccagggcaaacagagtccacgctaagtgcagaaattgagttgatctcaacaatgggagagaagaaatcttggacaaggccaccgatccaaatggaatttcaggtcagtctttgtctcttttaggcactgttaaatagaaccagatttgcttaaagcaattattaaccgtctcagctttgttcttttctaggtgccaatgttcacagcatctggtctgcgagttcgttttctcaaggtacgcattgttatctatgcttttgaaagtaccatccttccaaaaaatgcaatgctaagtagcagaatctctaagccattgtgtcattaaatccgttcaaatcttttatgtgatttgcgttttggttaatctgtctctggtctttcaaaaattgattgctatactacttttttggacctgactatccggaacgattggcaggtttgggagaagagcggttacaacacggtcgagtgggttcgatacataacgaaagcgggatcttacgagatcagatgctgaacattaaacacagttcaggttcagtgacatcagacttaaaagtttcatggcttctagttttttgttccttatgcaaaacaaaaacaaaagagttaaatatgttttataccttgttttatgtttgttttgtcgattagagatatctgtgttaatatgatttcttatgtcttaatttggtattgaattctgtttttctttctttctctgtttgtgaaattgtacgagatatagtttagattaattctggtgtaatcgaacgtgatagagtatttgtgaaagcagtcggattctttttagtagtagaatcgggtgtaatatgttaatgaaaacaaattttacttgagaatagttcgaacttcgaaggtttttacacataacatagatcgttaaaatcttttgtaagtctactaattcttcagaaacaaacgggaaattgtaaaagtaatagactatcaaagctacacccaagtacgtctttcactcgtggttggttatgcatgatcgaatttctataacttcgcttatggcaaatgtggtcatggtggttctttggactgtgtcatgtggctctctgcccacaagacaccagatatcatggatactttgctactcacatgcaactcaaatatggtctaagacaacaaacatgattctattgaactgcttctccatcgattgggatcacctcgtcggtattctgaaatccacaagctgggtgtcttgtttttgcatcacgttacttttcaaagttccctataatgtttgacgagaatgcaacaaccgacgacatggataccttccacaaatatcaataacgaattctgaagtttaaggatttttaacttcagaattcgttattaatcattcacaagttattgtgttattttttataatatatccaatgcaaatactcttttttctcatctccaaactgaagtatttttatttttataaactcttaataaaaacggatgaccacaaatatttctgctataatttggatgataatgaaaacaaaccaactacaatctactaaagattcaaaaatattttctcgaatgcttaaacctcacgtaagtaaataccaaatcaattcagataaaattaacaaaacaaactcaaataaaatctcctaaaaatcctataaataaaaagatgatttcattttttttcttcctattaaatttacattttccgccacacttcatctctcccactagtctctcctcgagactctctctgtatgtgtgcgagaagcgagaagcgagagagagagagagagagttgttagctcacacgctttctctattttctcggaattcacaaaacagaaagtttcatcctttacgagaattaagccgaaagaaacaatctttgagtttgatttcttcttccttccttctctctctctgctcta

SEQ ID NO: 1651 - DNA, 3000 bp, Unknown
  misc_feature (1)..( 3000): cDNA_ID_3063547_gDNA_ID_1620431_Annot_ID_156859 3000 nt of promoter + ATG
cacaccatcgttttcgctattgattatataattttaacttcacattaatatacataattgggtatgtaatcaaactttttagtaaaacaatatacgttataatcaattttaatatttcaaactccacataattgggtataccatctagtatgtctaagaaaacatactaaaataatgtttaatatttttgtcaattcacatttagccatatcatattcatatccatagtttgtttgataaattctttaacacttaaatttgaacttcaaaatttagtcagttgcaatccctttattattaaaagggaagtacaaattgaaattttgtctaatttggcctcaattttgatttcaattttggattttgttctttgctattcaaaatcattaagggtaatttggtcttaacaatctcctaaactttatatgatccgattcaatttaaaccgttcaataaaattaattcccttcaatctaaaccgttcaacaaaaataaaaaatctatatcgtttttgaaatcaaaatatgatcacattccatccctaaaaacactatattcaatcatgaaatcaataatcaataatatccaaatcatatattacaattcttcactaatcattagaaatttatatttataagtttaagatatcaaatttattcaaaatatttagtataagaaccaaataaaccgattgcccgcggtaaaccgcaggttaaaaacctaatttttattattataatagttttctcaaagaaattctaatatatatatatatatatatatataaattactccagaaaaagttgtggacatcgataacatacatcttactgcatctgtcccaataattgatttagttatatgtggtgatgaggtttatattgtcgtattcatagaaaacatccaaaaagagtaaagtctcgtgtctatacatctatttatagaaaaataaaaaataagatgcagcacgtaacaatgaatgacataattaattggcctttaaaatgtctttgaagtcgacctttagggagggttatgcagataaaacacttcccacctttagtgatatttgggttatttttctatatttaaatgtgattaaggagtccaatgaacttatcgttgtaggtatgagaaacgttatttacgggttcagacaaaagttatttaaatggagtaattttaaaaaaaactaaacattttgatccactaaggaagatgaaacattcatcaagtttgttaatgacctagtttagatcgactagctagatggctagccatgtggttgtctcgtcatcgaacatcaaatactaattaatttttctttttctcaaagtgtaactttatatatcattcaaaagatctatacactgcaatgccaaactcttgtttagccagacacatatctactcgattacatatatgtgatttgcattgtgaaactttttaataatctcaaaccacaaaaaagagcagttcaagcactacaaacgatactaatagtgcttcagcttgttgatctaattgaagtaagcactataattttaaatttaaatcctttatcaaaaattttttttaacaaaaataacaaaaattcgttcgatccaaatttagtttattacataatttaaatttagaacaaattaactgcatatagaaatataaaatatttcattctgttctagtgaatattttttgttttttgaattttttttcccacataaaaaaaatcatgtgttttttattgttaagcatgcaaaattgcaaactgccgagaaaatagctaaaaattgtagcaaattattttaatggatattatatatcattttgtgacggtgtacaagaggatattcatagcaaagtgattatgtttgagccccacaaaaaaaaacttattgaataacataactaacaaaagaaaagtttattgaatatttggaaaggtaatatatccatccatagaaattaaaattaatttataatctaatttgtggaccagataatccttttgaagcctaacttaactgccacatgttgctgccgtcagcacccgttttgcggaactgaaacaaacgaaatgtatattctatatttagttttacttgcagattttacacttgtaacaaaaaatgtgaattgagaatgtgtttttaagtaagtagttaagttaatttgtcttggtcttcttcactagatgatttgaataagttgtgttactttgtatagtagggatccaattaactatagatcggattttatagatctaaagatgttaagtaaaaaaaaaaaaaaaaaaaaaacttgcaacaaatttctattttctttcaaatttgcctttggtttgctttaacaagtcatttttgacaaacaaatacctatgtctaattaccgttccaaatttaatttgaatctgtccttttctctataattgttgtcacaactattaaaaaataattaataattattattactttcacaacttaatttttttttccacaactataaaaatggaaaattagtgaaataagtagttaaaaaataattaggtagatagtctttaaaaaaaaatgtcttcaatgaaataccgaccaaatacgttactccattgtcaaaatcatggccaagttagctaccgtcttgactagttattcatcatttaagagtgtaaaaaaatgtcaaatatttgagtggtgccttttactcgattgttcaaaatagaaacatattcattaactagggtggacaatattttctgtttgtatctaataaaaataaaatcgtcgtttgtttttttttgtcatcttacacagctcataaatgataacgaaatatgtggacaacagaaaatatcaatttatggctttctaaattattataataatttagcatgtggtgataccacgtccaaactgacatatctttgcactatatatatgttgttattcctctttcgattccctcataaaccatattaagaactagcttatagataaggatatg

SEQ ID NO: 1652 - DNA, 3000 bp, Unknown
  misc_feature (1)..( 3000): cDNA_ID_3063567_gDNA_ID_1620431_Annot_ID_156863 3000 nt of promoter + ATG
aaaattgttgttatccactggaaaaggtgcgtctgcttcttttccatctttataaactgccaaacccgtggctttctgtgcatctatgtcttccaagcaatctatataaattataaacgcatgacatcatggaactaagacgcaatatacatttcttgattggtttacataaatgtaaaatcaaagtaaagcggacacagaccttgaaggccaagtttagaaagcatgagtcgtccgccaggttgcataaactcacccatcattctttctggttctctcatgtccctctcgatcacatgtactcgacgcccatcctatagtcggatattagcataggaaaatgattgtgtataatatttgtattcaaagccgactctgccttaaggtattttttcctatattcattcggtccctttttgactaaaatgttctcgtagacttgtaatctagtgctagaggtattataacgtggacgaaaaaagttctagagttacacatctcctaactcaattctcattagttttccttttaaagattcctaattattgcgctttaatttgttcttatatccttaggcgtttttcaattcttagagccgattttgattgtgtcatgcaaaaacaaaatattgcaatatctatcttgccaaaaaaaaaacatacataatgtgtataggttttatcctattattaatacggagattttagtacaagaaagtagttaataaaagtgtgatgcagatttaatatttggacacaaagctatgacgccactttacataccttagcaagagcatatgcgagagccgaaccacctacaccagccccgacgataatgacgtcagcagcaccgtctttttgatcctcagccaccgtatcagccaaatccgtcgccttcttcttcatgttggtaaggtagaacaccgtccacgtcagcacgaaggcgactaacgtccataaacaaacgtgcgtaaaagccatatataaccaaatctatttgttctcaatatgatttatgagtttttaaaaaaaatggcttatgagatagttgtggaaagaggagtgacatatatatagttcaaagatatgtcagtttgaacgtcgcattattaccacatgctcgttatcataatctcggctgtcaaagtttgacataaaagaaacgataagtttatatcagataacaaacagaagatattgaccaccctaattaatgagtttttgttactatatagaacaagcaaacaaaatgcaccactcaaattattgacattttgactattttaattcatttaagagtttcaaaaatctcaataatttgctaattatataaaatgtcaagaagttaactagatgttttagaagagagatgcagattcggcaggcggttcttgggaggatcttggagagcaaatgtacagggtccaaaataattttacaaatttttcttcacactttagggtctttcgtttaaaatcatctttattgtaggcttaaatatataatagtacagaacccaatattctaatgagccggccctgagagattcgatacttggaccgattacgaacaatgggaagtgcataggcgagaggcgagccgccaacttcggctccaacgatgatgacgtcagtaccatggtcttttctcatctaccgcattatccacaagtctgttattatcttgctccagatggctactagggaaaatgtccaagtcaacacgatagtttagtagcatctatcactacaattaacggcaaatccatatctataagggtttagggtttaggatttagtatttgcctgttactttagtctttatatggcttttaagagaatttacaaaagcacaaacgtgacatcatcacatacatgattatatccaaacttctgataaatcaaaaagaaaatcatagtgaataaacacatttcacaatgaatgatgtcacttcttgtttcgtgttccgtttaatgttgtttctatttttgtcaaaggtcgacgtaaaatatcgtttcgccaaaaattgttggagactaattcattttttggctgctttccatgaacaagtcaatataatcctcaccacataactttatcaatgattgtgattcggtgtccatattttcttcatatatatcttatctacacataaattcactatcgtcttaaagttttcttcttcacatttactctgtcttggaaatatagagttattgggagggaagtcaaaacaggaaagatcaagaaactaaacactgctcctaagaaactaaaataaaataaaataaaaattcctacatgcaagataattttcatagcgttagacgccgtacggtggcagacttctagtcttgttacatcaccgtcaccctctgattttctcgtcgtccagtccaccgtcttcaaagaaattattatgacttcaagacaaaacttctagtttccaaaaaagaaaagaaaagataagagctataaacgagtcagtgtacttaaataaacgagtcagcgaaagaatgtagcgttccaatatattaaataaaacaaaattatattcatatacccttatgaaaaaagcataatacttcattatttgatgctcattgctcatctcatacacaaaatcagattcataagcaaaggcgacgacgatgaagaatgactaaataagttgaaggagtcgtctccatgataaaccgtaaccaaaccctgcgacattctattgtatgtgtatcttttttttctttttttttggtcataattgtatgttttttttgtttcttggcattgtcactgaaaattataccttttcatttttgccttctaaataacccaattgtgttactttacagaaaagcccatccaacgattatttttcttcagcccattagcccattaacttcaggataaagataagagctacgttcaactctatggtcagaaaaatcagagaaagaaagaaaacagagcaattacttgaagaatccataggaagctgaag

SEQ ID NO: 1653 - DNA, 3000 bp, Unknown
  misc_feature (1)..( 3000): cDNA_ID_2142065_gDNA_ID_1620431_Annot_ID_156866 3000 nt of promoter + ATG
attccaacatggtttatcatatagtatagaggaatataaaatgaccacttaaaacaaatgacgagtaattactaaaccacgatgacaaaaaaaaaaaacagataaataaggaaacaactagtatgactttaaatttttcttttaagtgaaatattctcctttgtttattacagctaacaaattatagaaataaatatatatatatatatatatatatattgctattggagaatattccaaattaaactctcaatgtacataagatagacttttcaacgagtgattaaaaaagcaataattcataatatatcttaaaatgtcaaaagaggaaatgcaaaacaaaaccaaatcgagaaaacaagaactaaaattaattatcgacaattaaatgaaaaaaaaagaaattaaacatgggtaagagagacaaaactaaaacatgaaatagaagacaacaaaaaaaaaaagtagaagagatgggaaacaagtcgatagagggttcgtaactaaaaagatcacatgataagatataaaaggcataacgcctaattatatctgactctcctttttattgtttattgtatggtcagttgctccaatttgccttcatggtaaggtctgatgcagcagctttcccaattttccctcagtgtcgagtctcgctcccaccattggtgaagtccgtgagctgtcgttgacttagtcggtttgttcttgtttacagtcatatctgctgatggaagaaggtggagaggttccgatgacaaatccgacggtgatagttttcctcttcttcccaccaatagactcctaactgattttctagcaccgattctctcgatgtggcttgctcctatctcagacatgaaggttttgtgtctgaagtaatcgatgtatcctgcacatattggatctgctggattcacatataaataaggtatccatgatgctgtctttggatcgtcttttggaacctgtagtaatttaagacaaacagtttcttgtaagaaaatcaacttgtatatagtagtactcagtttggagtggccaacaaggaatctcaaatgaatgaaacttgatatttttatgtaatcgcaagtgaatgaaacttgttattttaactcttaagtagatcaaacatttttaatttaagactatttatttacctgtagatcggttaaggccatggctacggtggctttgacgacactcttggtgatttgaaacaaacctttaattatatcgccaccaggtagctgctctagaggaatagacgagatgggtgggttgaatatgtaactctcgaggaggaatccagaaattttcatggtctttccagccagcaacactagggcggctcccaaagagtgtccagcaagccagatagctgaatggttgtgtttgtccaccatacggcggattacatttatggcgtacatagacctgccaccttgatggagggtgttgaagatgcatttgaggtcaagtttcaaatcaaacttccaagtttttccctttaaaactgtgccgcggaaagcaattacatagcgtggaactttcacatgaggggtattttggtagaggtggtatagttcgtattcgaaaatggcaccatagatggagctgtcatcgtcgatcaaggtttcgagtaaagtgaagtggaaaaattcccaccatggcttggctagtgcttcagaaccttcccgttcctcaagcctgtccccttccaatgtatacactccatttaccaaacttgatgccactgaggttcgatggtactgattgttcctattacaaggaaaataaacaagcacatgttagttttagagtccgagtagatatggaacaaaaacttctatctttgtctatcataagaaaaataaaaataaaaatctattttgagtgctataaaacaaattaaagaaaaatatatcttaaaaggaagtatctattttatttatttcaaaacaaataaaataaaatgttaccagtcaatagatgtaagatggaaggggccaaaaatgttgaaagtatctgtatctttggaagccctctcttctcctcccatcagttttccgagagaacctcgtcccatttcttcttcttcttcctataatctaaggtattacattgccaataagtaatcaaactgatataaagtttaaacggtgaagaacaatatgaaaatgtttcacaaattaattatacatatatttcattgaatgcactactggctactctttctggccattgccaaaacttttatataaatgcatgttctgtaaattaattcgaatttcggtataaatcctgattagtgattactaaaaattagaactgcaaaaacaaaaagctaaacttatcgtttttaaacgacagattatacaaaagattgtaggaactctctctctaggctttgttatgactatcattcactcattacataaaataaacagaattctttttaaaaggaagaaaaaaaaatcagaaaatgataacataaaataaaaacataagttaataccttttttcgtgatcttactggtcaatcagactcgaatttaatcgaatatgatttaagtaaacttaagagttcgtgaacttctttctatctctcttctagctcagatgcaccttaggttgacaaaaaaattagatcctatagagttattctgttcttctttttattctttttttcaagaggaaaaagaactaatgagttactacacagataagcatcttgctatttatagatggtaaaaaaatgaagactttttggatccggagactttgagaactatccctttaacactgaaccagaatgtattaactacttctttagttacaaattgacaaattttctacaaattggcaattaaaaacacatttaataagtgtgaattagtctctgactacatgtacagcaactggtccgatttatttatcatatagtataaagacaacgtttattcatccatcatcaaaccaatatagtcccacatg

SEQ ID NO: 1654 - DNA, 3000 bp, Unknown
  misc_feature (1)..( 3000): cDNA_ID_2142068_gDNA_ID_1620431_Annot_ID_156867 3000 nt of promoter + ATG
ttatcaacagcttctttcttcttcaatttactggttattttttcgagattggaagttggttcatgcatctcccaaaaagtgggtgccgttagaactggactttggtcttatagttctcacgtgattttttagaaaatacaaaaattagagttttagagttacttaagtaagtgaaattaaacctaactcaaaacatgaaattttcatgagttaagatgtggtaagtttaagttacatattttaattcactttaaaaacaacttttagtttttttatattaaaataatatatatttttcttaattcaatatcaattattgcgagaaaatagttttattagctgaattttaataacatttcataaatataattatttgaatttcttatttttgttgctataactatttttgttattttcatttttgaattatccataatatttgcaagcatagattttaagaagatgaatgaaaaagagagggacatatatctcagtacctattcagatcattctcactgatttacatactctatggtatatcttaataatattataataatatctttaatataatttaattatgtaattaaattttaagttattaacacaattgaaggaatcaaaaatgcacatgtggtaaacaaatttatcctataataacttgttgatggagcagttcttagtacccagcaaggcaacaagtggaagtggtcactttctctccttgcaacttttttaagatccagaaatattatatttgtttttttttagaatttgttagttgtgataagaaaacaaaagttattaattaaaatgaaaaaaaaaattcccatttttattttaaacgacatattaacagaataaatgaattgagtgttagaaaaaacaaaacagaattgttacttattaagctggtgccaagtcgagatcgattaagaggtttatttgaaatatttcatattaatggtttattgtaaaaagaaaaataaggataaaagttgaataattgtcactttgaagggctctttcggatattggaagtcacatgaagaacttttttacctagccaacatgaagaaatattaaatggtgaggtatacagtatactgtatataaatttatcttcttgccacttggtgcatatgtcttggatttagaaaagctaaaaagaattctgaatgcaattttattattgataattgtaacgatagataaagtcaaacaattataataacactgccacttagatagaacttataagaaaccaaattgataagcaacaataaaaaagtgttgaccattattttcttaggccatatagtaatatcttgatgcttgacatttgatatttttatgtccctcccttattcttaagcatccattggcattacatgaatttgggttaagcgaatagagtagtgtagagtatcgttgaccttaagtataaaattcaatcgcaaaactttttccgacagaaatatataaccttattattaattaacgttgagtgtagtgttaactatgcttgagagtaaatacaatttgaatagaaaacattattatgtaatctttatctatttagaatatgtgcaatttgaataatataccgagcctaaaatctaggataacttttatcaataaattcaaacgcaaaataattttcgtaatttctaaaggagttagtaaaggaataattgtgagttacgttcattttagacttatcgaaggttaatatatttatgatttttatacgaggttagtaaattacagaaaatcactttcgagggaacaatatatgatttcaattttttgtcgattcatcttctgcactgaactgattttggttccaatgttgaaaaaagaataatgtcgaatcaaactgagagataataaataattgctatgatgtgagtctattatgtatatcaccatgcaatatttttctgtatatatatattacaattaatacaatgattgagtttagatatagttatgtattggattatatttcttgtaactaaccttttacttcagtttaaagccaatttgttgttaaaccaactatttttaccttttctttattgagtttgatcatgtgggactatattggtttgatgatggatgaataaacgttgtctttatactatatgataaataaatcggaccagttgctgtacatgtagtcagagactaattcacacttattaaatgtgtttttaattgccaatttgtagaaaatttgtcaatttgtaactaaagaagtagttaatacattctggttcagtgttaaagggatagttctcaaagtctccggatccaaaaagtcttcatttttttaccatctataaatagcaagatgcttatctgtgtagtaactcattagttctttttcctcttgaaaaaaagaataaaaagaagaacagaataactctataggatctaatttttttgtcaacctaaggtgcatctgagctagaagagagatagaaagaagttcacgaactcttaagtttacttaaatcatattcgattaaattcgagtctgattgaccagtaagatcacgaaaaaaggtattaacttatgtttttattttatgttatcattttctgatttttttttcttccttttaaaaagaattctgtttattttatgtaatgagtgaatgatagtcataacaaagcctagagagagagttcctacaatcttttgtataatctgtcgtttaaaaacgataagtttagctttttgtttttgcagttctaatttttagtaatcactaatcaggatttataccgaaattcgaattaatttacagaacatgcatttatataaaagttttggcaatggccagaaagagtagccagtagtgcattcaatgaaatatatgtataattaatttgtgaaacattttcatattgttcttcaccgtttaaactttatatcagtttgattacttattggcaatgtaataccttagattataggaagaagaagaagaa

SEQ ID NO: 1655 - DNA, 3000 bp, Unknown
  misc_feature (1)..( 3000): cDNA_ID_2105929_gDNA_ID_1620431_Annot_ID_156864 3000 nt of promoter + ATG
cgtataaaaatcataaatatattaaccttcgataagtctaaaatgaacgtaactcacaattattcctttactaactcctttagaaattacgaaaattattttgcgtttgaatttattgataaaagttatcctagattttaggctcggtatattattcaaattgcacatattctaaatagataaagattacataataatgttttctattcaaattgtatttactctcaagcatagttaacactacactcaacgttaattaataataaggttatatatttctgtcggaaaaagttttgcgattgaattttatacttaaggtcaacgatactctacactactctattcgcttaacccaaattcatgtaatgccaatggatgcttaagaataagggagggacataaaaatatcaaatgtcaagcatcaagatattactatatggcctaagaaaataatggtcaacacttttttattgttgcttatcaatttggtttcttataagttctatctaagtggcagtgttattataattgtttgactttatctatcgttacaattatcaataataaaattgcattcagaattctttttagcttttctaaatccaagacatatgcaccaagtggcaagaagataaatttatatacagtatactgtatacctcaccatttaatatttcttcatgttggctaggtaaaaaagttcttcatgtgacttccaatatccgaaagagcccttcaaagtgacaattattcaacttttatccttatttttctttttacaataaaccattaatatgaaatatttcaaataaacctcttaatcgatctcgacttggcaccagcttaataagtaacaattctgttttgttttttctaacactcaattcatttattctgttaatatgtcgtttaaaataaaaatgggaattttttttttcattttaattaataacttttgttttcttatcacaactaacaaattctaaaaaaaaacaaatataatatttctggatcttaaaaaagttgcaaggagagaaagtgaccacttccacttgttgccttgctgggtactaagaactgctccatcaacaagttattataggataaatttgtttaccacatgtgcatttttgattccttcaattgtgttaataacttaaaatttaattacataattaaattatattaaagatattattataatattattaagatataccatagagtatgtaaatcagtgagaatgatctgaataggtactgagatatatgtccctctctttttcattcatcttcttaaaatctatgcttgcaaatattatggataattcaaaaatgaaaataacaaaaatagttatagcaacaaaaataagaaattcaaataattatatttatgaaatgttattaaaattcagctaataaaactattttctcgcaataattgatattgaattaagaaaaatatatattattttaatataaaaaaactaaaagttgtttttaaagtgaattaaaatatgtaacttaaacttaccacatcttaactcatgaaaatttcatgttttgagttaggtttaatttcacttacttaagtaactctaaaactctaatttttgtattttctaaaaaatcacgtgagaactataagaccaaagtccagttctaacggcacccactttttgggagatgcatgaaccaacttccaatctcgaaaaaataaccagtaaattgaagaagaaagaagctgttgataatatttctagttttgttgtattttgtaaatttggtcttgtgttcaatttattcgtagtaccgtttcttttgttagtcaggcttttggttcgagagttttcttaaaactcgtcgcctttattttcataagcgtttttgtcgggcatggattgtacccttcactttagcccaacctgaaacaagattaacttcattagcagccaaccaatcccaaaagactcatgatagtcggtcatgattctatcaccaacttagtttttttttataaatagagaggcatctcattaagagagatgggacaaataaaaaagatgggagaagaaacccaaacttcaaacaactgctctattcatccaacttgggttcaactgctcttttctttcatcatgtcgtttgactgcttatttcgtccaactgacactaaactattacgctcgtctatctcgttgattgacagtttagttcgtccaacctggcatccaactactctgttcgtccatctagttgcttgaatgctcagtttgtccaacttggcgttcaattgcttagtccatccatctcatcgcatgactttgtttgactgctagttcgtcactcaaactgcgtagctcgtcgtccagattgactagctcttagttattgtaatatgaactacgaattatttgtccatttctatgaatatgtaggcagccttttacaatgcacatctataaactaaataaactatgtgttcgtcatgagaactacttaacttctgaacttcacagttgtcatgaaattttttttccttgtaaacaaacttacaatattttatcaaaatctatgcataaacattttcgattcttgtcggctttatgtctggaagatttcgttcagttttccggcttagtatagtttttgttttcttttccaatttttcatttttttcattttttagttatatatatattatacacgcatatttgtatctctattttattatgtcataaacttttgacatatagattttagtggccataatatatttttaaggacattttgtcattagtgctgaaatggtgagtcaatttcatagaataatgtaactttctaattgaactatattataataaaaatacaacactaattacatatcagcatgtcgtaccattacttcttgaatttgggcttaacgtggcccagagttgacataattgcatccacataatatttttttctccgatcatcggaaaaagcagtaatcaagatg

SEQ ID NO: 1656 - DNA, 3000 bp, Unknown
  misc_feature (1)..( 3000): cDNA_ID_2142053_gDNA_ID_1620431_Annot_ID_156862 3000 nt of promoter + ATG
tggggtcttgaagctcttgtgtgtatttcgttgcttcaagctcttctgttgcttcagtcttaaaacgttgtttggcattttgtgtgatcaaatacaaagatttctttttctttaaacatcttagagttctcaatatcacaagtaagattgcatcattactgatgcagttgcaactgcaaattacatcatcagtgacacaaccttttgccattatgtttagttggaaagagacatgagaataagaggtcttcatgaatcattttgtatatccattggctctcatctgttacctagtggcttaataaaaaattgtgaagacaataatgcagaaactcgaaagaggccttttatcttaaataataataacgagaaagagtatcattcttataaaatcatattctctacattattagttacttctttacatttaaaaacagcaaaataaacatcaccagccgaacaagacaagaacaccaatgtgttcgatcaaatcttcgtaactccccaaatgtcatatgcaaccacccaactgcaaaaattcacaagtacaaaaaaaaaactcagagttcagttactaattgttattgtttgacaacaaaaggatactaactttatttgttagcaagttatataatctctcaccataatagattcgatttctttgtcggagacaggtgtacgtttcggctggagagatgctttccctccatcagcagtgttcttcggagctgccggaacatcagaactcgccgtcacatttttcttaacgccggaaacagatcccggcgccggtccagaacctgagaaagtcacacacaaaaaaggagacgttaagaacaagaataaagcaagaactaaagaaaataagagtagtgaaagagaataaactaaaccaaaaaaacataaaacaaagaaaaatgttaaccagatgagatagaatgtctctgaggaaatttgatacgaggaattcttctcatcttcagcttcctatggattcttcaagtaattgctctgttttctttctttctctgatttttctgaccatagagttgaacgtagctcttatctttatcctgaagttaatgggctaatgggctgaagaaaaataatcgttggatgggcttttctgtaaagtaacacaattgggttatttagaaggcaaaaatgaaaaggtataattttcagtgacaatgccaagaaacaaaaaaaacatacaattatgaccaaaaaaaaagaaaaaaaagatacacatacaatagaatgtcgcagggtttggttacggtttatcatggagacgactccttcaacttatttagtcattcttcatcgtcgtcgcctttgcttatgaatctgattttgtgtatgagatgagcaatgagcatcaaataatgaagtattatgcttttttcataagggtatatgaatataattttgttttatttaatatattggaacgctacattctttcgctgactcgtttatttaagtacactgactcgtttatagctcttatcttttcttttcttttttggaaactagaagttttgtcttgaagtcataataatttctttgaagacggtggactggacgacgagaaaatcagagggtgacggtgatgtaacaagactagaagtctgccaccgtacggcgtctaacgctatgaaaattatcttgcatgtaggaatttttattttattttattttagtttcttaggagcagtgtttagtttcttgatctttcctgttttgacttccctcccaataactctatatttccaagacagagtaaatgtgaagaagaaaactttaagacgatagtgaatttatgtgtagataagatatatatgaagaaaatatggacaccgaatcacaatcattgataaagttatgtggtgaggattatattgacttgttcatggaaagcagccaaaaaatgaattagtctccaacaatttttggcgaaacgatattttacgtcgacctttgacaaaaatagaaacaacattaaacggaacacgaaacaagaagtgacatcattcattgtgaaatgtgtttattcactatgattttctttttgatttatcagaagtttggatataatcatgtatgtgatgatgtcacgtttgtgcttttgtaaattctcttaaaagccatataaagactaaagtaacaggcaaatactaaatcctaaaccctaaacccttatagatatggatttgccgttaattgtagtgatagatgctactaaactatcgtgttgacttggacattttccctagtagccatctggagcaagataataacagacttgtggataatgcggtagatgagaaaagaccatggtactgacgtcatcatcgttggagccgaagttggcggctcgcctctcgcctatgcacttcccattgttcgtaatcggtccaagtatcgaatctctcagggccggctcattagaatattgggttctgtactattatatatttaagcctacaataaagatgattttaaacgaaagaccctaaagtgtgaagaaaaatttgtaaaattattttggaccctgtacatttgctctccaagatcctcccaagaaccgcctgccgaatctgcatctctcttctaaaacatctagttaacttcttgacattttatataattagcaaattattgagatttttgaaactcttaaatgaattaaaatagtcaaaatgtcaataatttgagtggtgcattttgtttgcttgttctatatagtaacaaaaactcattaattagggtggtcaatatcttctgtttgttatctgatataaacttatcgtttcttttatgtcaaactttgacagccgagattatgataacgagcatgtggtaataatgcgacgttcaaactgacatatctttgaactatatatatgtcactcctctttccacaactatctcataagccattttttttaaaaactcataaatcatattgagaacaaatagatttggttatatatg

SEQ ID NO: 1657 - DNA, 700 bp, Unknown
  misc_feature (1)..( 700): cDNA_ID_2142105_gDNA_ID_1620432_Annot_ID_156880 3000 nt of promoter + ATG
aagaaacccagaagaatcctaaaatctaaagctcaacaataaacatatcctaatcaaaagaaggaagctttgaaattagagtcatgtgggtatagtgaaaaagcttacatttagggatctgatgtttggaacaagaagggcagaaccaagagcctttgggaactgaaacgaggatcggtctgagacagaaaagatgaaaccctttatcgcatttgtcgcaaagaagcagctttgctggttgtttaccggaactgcattcttcgcagactgtatcccaatcggaatcggaatcatgatccgacatgtgttgcggtggttcggatctagggtttgacgcttgtgttctccttcgcctcacagccaccattcttacacttattgatttaccagagaaagagagagagtgagagattataaatgtgagatctagccgaggttgagtagaagagttcgcgctctggattcaccggattttcccggggaattttaatttggcgccactgttacggtttcccgatttgcagactggtttattttggttttatctaaccgattttgagaaattaggattagatcggttcatatattttggttgttcggttcggttcaatttgattatcccaccggacaaaccaaaaccgacataagactctccttcaatgtaactttcaactaaattgattttgctctttgaacgatg

SEQ ID NO: 1658 - DNA, 3000 bp, Unknown
  misc_feature (1)..( 3000): cDNA_ID_2142147_gDNA_ID_1620432_Annot_ID_156892 3000 nt of promoter + ATG
ccccggtttgcttcttgatttctcggtctacaagttggtcaagtcctatatccgtgcctcacctttccgacgatcagcacttaaggtagtttcttgatatcctcatattattattaagtacattgttcttttctctttctacttaaatatagctgatttacttatgataatagtcgaacaatttatgctacaaacagaatgttacttgtctttttggcactcagtgaataatttcctgagaacatcttttcctatggttttctgtttcttatattgaccagtttttcatttgttaatcttttgaacaggctctctcgaaagctatacctgatgaagaacttgtgttccttaaggcacagttcatgctcctggatcctaaagacggaggcctatcccttaactgtttcacaatggtaagtatgtctttcatgatttagctatagcattttgactcggactttgatttgtgaatctagatccagtatatttatcccttcttgatctctagattccattttctgaatagaaatagtttcctgaagcaagagatagaaatattgattcaaaataaacacaaactaatatataccgtttataatcgttgagtgtaactgcaggctttaacaagatatgctactgatgctatgatggaatcaaggcttcctgacattttaaatacggtaacacatctcttattatatattttatcttcgcttttgaagtttatgagtggatcaattatgagtgttagatatggtttcatgtgttgctagttgaaaatgattgtacattttctctagggtgggaaacattgagaaatgattgtgactcgttgagctttagtggtaactgttttcaccgtaattcctcaatttgaattctgagtttcccattttttaccactgtgcttgcaacagcagacaattctcattgattggttttagatttagcttgctacaatcaccaaaatatcgccagagttttctctgatattgagattgaggtttctttgctgtttttttccgtactcctatggacttagcactgtgtgctgaattacgccatttttttccttttataaagatgcaacctctggcgcaaaagaagcttgactttgaagagttctgtgcggctgcggtcagtgtttaccaactggaggctcttgaagaatgggaacagattgcaacttcagcatttgagcactttgaacatgaaggaaaccgaatcatatctgtccaagaactcgccggggtatggtcctaatttaagcatctatgagatcgtgtaatcaccatctctttcttaagattaaaaacaatattcttatatttgggcgtgatttaaagcaggagatgagcgtgggaccgagtgcatatcctctgctcaaggattggatccgaagttcggatggaaagctgagtttcttggggtacgctaagttcttgcatggtgtgaccgtacgaagctcaagctcgagacctaggtgacacaccatgatgtaaaaagtcttctaacatgtgaattgagtttcaagaaacatcctaaacaatgtcgtcgtcagagaccttggattcaaagattaaaaaaaaaaacttgaaatggaagtgaagtcaggtaggtatttcctttgtaaatgattctttgagcattttgttttcgaaacaaactaaaaaaggaaaaacatattatatatgttatagaaggaattggagaggtgttgttcttctggttttattctctgctttcactttcgttagtctgataatatgttgtgtacagaaggcgatagaagttttttagccgatagttgaagcaagtgtcaaatttagtgtataggaatgataaagtgttttttcttactcgtattgtgagtacgagtccttcggtgtgaatgatactgtggagtgccccatgctcgtgagaggagctggctttgtggctttggcaaatcctattggaaaatcaggtgagaacattacatcaatccataggggcattatcaaaagagaggcgtgacacaagtggtctaaacagctttaaagaacagacaaacaaagaagatgtggtttcttgaattggtcttaagattacataccagagaaatgtgattgaattggcaattaaatcgttgcttacatttagtttatcaaatgctaaatcatgtcaaacatgtatgtctctctcacatgttaagtgagtgtaaccaaaaatgcggagaatattggtagagaaatctttaccaggacaaaaaaaatatggtagagaaaaactgaagtgggtggttatagaacaaacttttcatatgaatcagtcaactcgtaaattattatgcaagtctaatttaccattcctagaaaattattgaaatgtaatttgaaattgataaactcgtgttgtaaccacttgtttttttggcaaagttaattcttgcaaagttagttacactcgttttacatgtgtttgaaacattgtttagattttttgttactgtttgatacatctatctggtagagaaatcttttatacattaattgagacacattttggagatctaacatctattaaatatatcagctttttcatataaaagtagaatttaacaaacaaatccaaaaaaaaagagaaaaaaacacattttcgatttggtaaagaaaatacaaagtttaataacattaaaagttcaaatcaaccatattacatttacataattatacactactatactaaacttaagtataaaatctaaattgtactgtataaattatttaaagattaaaaaaatccaagtagatgaacataaaacacgtgcctctcctaagtcctcctaactaattggtattaagtcacaagcctcctttatccactcggtctccttcactataaaaagcaaagaaatcccaaaacacttgtagcaccacaacaacaatatccacattcttcttcttttgagtattacatccaacgaaacgtctctttctttctctctgataggcaacaatg

SEQ ID NO: 1659 - DNA, 3000 bp, Unknown
  misc_feature (1)..( 3000): cDNA_ID_3063577_gDNA_ID_1620432_Annot_ID_156884 3000 nt of promoter + ATG
atatttgttttaaattttaaaaggaatcatggaagcaaattgaagactcattataagattgttcgtcttgtttgagcggttgtagaaatagatttggggaacttgggtttcatttagaaaacaatcctgattttcttttgattatcctcaaaacaaagtcgttttagggatactaatagagtcgttaacaagtgataatgaatgttataagttcttttaatgaatgatgacaacatgtttattttggcttggtcaacgaacttctcatgttttaaatggtagtcaacgcttagttcatgtttaaaatggccacatataaagtcgatgtttaaaatagccacaatttaaaacttgactaataaagtcgttaacggatgataacggacgttagaagttccgttaatgattgataacggcatgtctattttggcctggtcaacgaataatcatgttttaaaagttagtcaacgtttagttcatgttttaaacggccgcatacgaagttgatgtataaaatggccatttttttaaagttggaggattaattgacattttgaaagttggaggatttgtgtgtgtgtttttaatccaagatctgcttgtttatctgaatcactacatttggtattttattcccatattttatagaaatgtattggaataaattcatattttttcctttaactataatctcataatatattagattatttaatttctttatttgtttttttcaaaaaaaattaatgaaggatccgaatcacagatattcatttaattgtaatatttgttaatttactaaattaccctcacaatgttgtagttcacaaaatgcttcccaatttataatatatatatatatatatatatatatatatatatgttttttagttattatagactacatcacaacttaagataaagactaagacttttgcatcaagcgaacaacaaaaccagaaattatgcttaattaagtgtcagtgatcgctatataaacaaaactttaaatctcttacgattcaataaaaataaggaaacttcatgatacatcacaaattcccctaactctaattataaaagaatatgagtaaagaacatattccaaaataaaaaatttaataataacaaaatatataaaagacatattatttatttttttctagttattatagaccacatcataacataagataatgacctctgcatccaaagcaattcacaacaagaaactatatcccattttgggatttacttaattaattatagttacatactttatctcgtatgcttacgagcccaaaagaccttcccgttgatccgcagctttactgaatcattttctgataaagaccacaattttaccgtttcccaatggttgagtacgcgattcatggtagcgaccgagtccaagaccagcttcgcaaatagtgcttgctcttgaccatcgtcatgttgcatgtcaatgccttgaacacaattttctccatattgttcggtgaaacattgcttgatcacctcttcttgcgacataggaaccccacgaggaaacgttatatacaaggtccgttcgttagcatccgcgatggagttatccccaacagagacatcatgcatcatgttgatactcacggaagtcggatatagggaatgatgggaggatggtagagtcttgtgacaggaggatgagagggtggtggagtctgttgatagaggttaatcaaatcacacatatatatgcaggaaaattgtaaaacaatttagtaaattatttgtactatattataactggagtaaattataatatattataactataatttggatactatgatttttttcttaattaaagtggtcaattagaaattgtcacacgtctctatgcatttgtatgcaatgtctttacatatgatatgggcatatttatgatgtgctttaaaaaaagaaaactatttatggtgtttctttttatcacatatcctctttattcatatctaattggattatttcatgtttttatttattctctaattttgtgattttgttataagaattgctaaatttatttttgaataacttgtagaatttttaaccaaatttggatgacacttatggttaaaaaaatatgatatttgatttttcttttgtttcttttgaatatcagttattaccattaatgtcatccaaatttatggaaaaaaaatctcaacaactatatttacaaaaaaaaaaattaactatgaaaaaacaattttcctaataaacaaattttgaatacattatcaataagaaattgtcacatcaatttcgccatttattaaaaataaagaatatgtttgcctaaaccaacatatatatatatatatatatatatcttattttattttcacatcaaaactaataaaagttggttttggcacttggttcgtcgagcttaatagataaataaaattgaataaattaatacttctttttatattctatttttttatagagtaaataatttttctagatatgactgagactacatcttatgatttatttgacacgtatcacgattctgtgagttagcaagttcggtaaccaaaatttatataataaaatgttaccatgaaacatgaaaatcaatataatcgcattaactaattatctaaatcaataaaaacattgtaccgaaccaatgatttaccaaattgaaatcaccgatttaaaccgataatcaaacaaacaaaaacatctttaaccgatccggttattgtttgttatcatcaatattgttcaaaggttaaagacgaagatatctaaagcccgtcgacatttcatttccgacagcaaatttgcgaagtcaaatcgcgtaatcaaacttcagttttgttccgttttcgaattctccatttcgtataggagatctccataaaccctaatcccctcagagtgcatctaacattcgattgtgtttttctctattcaaagaagaaattttcatggttttctaaagcg

SEQ ID NO: 1660 - DNA, 3000 bp, Unknown
  misc_feature (1)..( 3000): cDNA_ID_2142132_gDNA_ID_1620432_Annot_ID_156887 3000 nt of promoter + ATG
caaacagtgaacttcaatgagtgtgaattgattgtcacgtcacagctacactcgccgcacgcaaatatagcgaccataacggaagtgatgacaaaaagagctctgacgtttgctacggagacggtttctcaaatccaagactatcttctcccaaacgctacagatactcaggacaaagccgttttctccgcttgcgagatcgcgtacaaagccgtggtttctcgtcttcagagtgcttatacgtcgatgaagaacagtgattacgtggcgatgaaggcacagcagaatcaagcacttgggtatattgatgtgtgtgttgagaggactaacttctttcgccggactccgatggtagcagccaactattatgtgaggttgacggcgaagattgcttccattgcaggccagatccttgctcctagtacgaccacgtccctgtccccttgaacaaaatattattttgtatttttgttagagaaaaactcgagctttgattcatcaataattatttatttatttattaattttcgttgtcttttctcatagaaacaagacaaaccacaaaatttagcatttcagaaatttgtagaattcagtgaattttggaaattttctcacaagagattcgtagaattcagtccactaagttttctatgaatgatgtggttattaagataagatttgttgtgtgcaagaaagtgagttaccgaacaaacagccgtcacttacaccaaaaaattcaatatatatcatatatggtgtaagaaattacacactcccaaagtccagcttgtgacgagaggtgcctttgaacttataaaccatctgttattcttttttctttccaatggtcttaggcccggtcaaataaacgaaccaaatgtaccgaatcaaaaccaaaacaaaaataatcgaatcgaatcaaatcgaaaattgaaaaataactgaatggttactaaattttataaccaaaagaaccgaaaccgaatgattatgtattgaaatatttcaggtaaccaaaaatatctcaaatataaatatattttcaaaaatattagttatttctagactaaataattaaaaatggttgaaaaaaatatatattatagtaaaaatattcaaaaataaccaaaaatatccaaaatatctgaaaatattcaaaacaaaataaccgaatagatactaaattttaaaatcgaaagaactggaaccgaaccgaatcgaaccgaactttcaaaataaccgaatggatactaaagtaccgaaaaaaccgataaccgaataaatacaaccgaaaccaaatggataaccgaacgtacaagaatatgtgatcttcttttaacatttacacccaaaaaaaatgtgtgatcttatttcctccaaatgaaatattattatttaggcccttatgaatacccgccattttgagctcggacgtccacgtcggtctaatccaattgcctacgttacgcggttctttctgcgtgaattatgtcactctttctcttttttggggtgttcattagagcagcaccaatggtggtctctcttatgagtcctttatcataaaaataaagaaaaataattaaaaagagagggacagaagagagaggagctccaaaaacccttatttaagggacagtctcaaccccaaatatacacgtgtagttcttttagtagtcaaactctattaaaaaactaaaatataataacaacattaaaatattattattattttggtttttagggactcataagagagaccaccattgctgctcttagtacactagacaaacaaatatactctatttcaaagtaatacttatctagaactatgtatacaattattacatattgcaatacgataaaaaagagtatcatatctagaaaagtggaatggtctatacgtttgttgatgcttaaagtaaaattttaatttatgacataatttggtagaattctcatctgaatatataatagtagttgttagaaattaattaacttgaaggtaaagtgtgcaagtcataattttatgttacctcctaacttacacttcccaaaataaattacattcgtaaagtttcgtataatacgtaatccatacgaatcagaccaaaaaaaaaaccaaaactcaactgtgaaaaaaatatttttgataataaatattgttgttgtgtaacagtgtttttttatatatatataacaaatggatggattatggaataattttaacagaatatatgggtcaaacttttaatattatgggaatagaagctgacaacacacacatcaaaaagctgggacacatcaggtagtaactgaagtcaaacatagacaccaaactcaactaaacccactctttttcaaaagtcagtgctctttctctttgtggggtttgttgtttactatcgacactttcaagggactccatttttttcctatttttataattattaccaacaccaacttcacaatatttgttctgtttttgttaatatacaactttaccggatttgtactaccatcttcttattattctttttttcggatcatatattaaaatataaaaaattgcacggttagtgagtttcagaccaacaaccatatatcaacccgctctgtcttttatctgaaaaacgtgtgttttttccacatttggttgaatctgaatcacataatatatgtactctcaattacaatgcaaaccctaatttgtacttctgtgcagtacactttctctctctcttcattcatttctcttcttctataaaaaaaaattcttcaattcaatatcactaatatgcgattctctcttcttcttcttcttcttccatcttacgccaaacctcgagtctgcgaatcattcgattctcagattcgcatattttcttcgaattcgctaggctcaaaacgttgtttccgtgtacaagaagcaacctaacgatttggggccaggtgaaggaagagctgatttaggttattgagattcgttttcttcaa

SEQ ID NO: 1661 - DNA, 3000 bp, Unknown
  misc_feature (1)..( 3000): cDNA_ID_2142142_gDNA_ID_1620432_Annot_ID_156890 3000 nt of promoter + ATG
gtttggtaccttgaccaagcagctgcctccgagctctagagaggtagcctaaacacattaatattggtgttttgtttgtagtctctacgttgctttgtgttgaataaccggttaatacatttgcgtacgtttacttcgtacaaaatgtgttgaatattcgagctagttgtttcttgtagttgtgatgtgagtccctggctatgactatatatcattataaaaatatatagtgggcttcatttaatctgtcatttcatgaatggtgtttaattaaacttttcttttagggtttatcattaattattcatgctttttaactatatattgtacatagtatatacaagtgataatcttatatactatatattattgttttgttttattatataaaatcaacatgtattagatgagaacacctgcccaatgtaagtttttttaattaacctccataacataattatactatatagtaatgctgcaatacgctcgtatacgaataatatagaagatgagaagaatattattcgttttaaaattcacagaatgggatttacttcaaagtggtaattttgttggccaatagtagttgatacgcaagacatgcattaagttagttttaatatgtttccacacagaaaaaacatggacgtagaatgcaagcattaattgtatataccaagtaatttgtgtatatcatgtcaaggacaaaaaaaacaagtcaacagaataaaccacaaccccatatataaacctgttttcggagaatctcccaaataattattgcaccaataaccagtatctaaccttgaaataaacactaaagtaaaatcttaaatcgaaactctcgcttataatagaaaaatgtgccagaagagaaaataggtttcttggcctttactagggatttgtttctgttttcaagtgtgtcagatttgctcaatatttatcaagtatgaacaaaaagagaaaaaagtaggttgagattttaatatggttgttgaaccattaagaaaaaggagcccattttcaagactcaagagaatggtaattttctgtcgatttgttagtctataaacaccgcttgtagatgtaaaaatttcaatggttttgtaaaatgatgcaaattgagttgttcactgtggtgatcttgcgtgttgaggatgaatttgcccgttgagctaataatttctggtgaacatattatgtcatttgtaagatgttcattgattgtgatgatagtcatataatatgaaaactaaagtattcatctactttaaaaaaaatgaaacctgttacattgcaatgaaataaaaaatccattaaagagctaggaacaaaattcagaggaaaatatgattctactgttccaaagaagaatgtatgtgataaattttattcttgcatctatctttttataattcccatttggtggttatatctcatttatcttcattcaattgatttatttatgaatatattgtataaggctctagcaaacaaatatgagaaagttttaaaagccaaatgtaaagactaaattttaaatatcgatttaataaggaaaagttgttacatctgcaaaatatattgtatatacactattgaaactcgtttctgtcgatagtgtcgaatcatgtgcaagcaagctaagcgtagagtggagacaaaaattctagtagtaaactttatttagtttatcgttgttcagaaaagacattttattagtttataatttgaagagagtagtgtactaaattagtagtattgaagagcatcgttctattttattttcttaaagtaattacatatagagtcgacgttccaacgacaactctggacagctcacgcattatgtgattggtagttaggtttttgtttgaatagtttttttgcacaaaaatttggtttggaaatattataagttacacatatctacggcctttaaaatcatgcagccactcaccttcaacccttgtatggaccggagcttcttactagggattaccatttgaatttaaccaacatttgaactgcggacccgatgaactaaacagaaatcaaacgaaaaaaaaattaacgaatttattggctacccgttgacaatttatttaacatttatatgtactgatgttagcaaatgaaatatgtcttaaaattaatggacaagaaaaattggtaaccaagtagaaaagtgctttgagagtgtatgacaatgctcaagatcactagttcaactccatctgaaacttgaaagggggtatttacatttgaaatgtggttcctgatacttaaaaatattatagagcaaagattcagaattcttatggtttatcaaaaaaaaaaaagaaagtaaagtgccgaagcccgagttcatgggatgtgcttttaggttccgaatggttacgtttgtaccttaaacaacagaatgtgccaaaagtgacagcatttttgtgttatattttcttgtatgatctgttttttttttctactttataagatgtaactatagtttaggtacatattaatttaagagatatatcatcaatcaagtgggtgtttaatattttatactagtttatttccaattacttgtgtaatcgtttcataactcgatgagctgctgtgagatataaaattatatatgttttgatgggtttcttatgacttgcagttttgtgcatatataattaaacaaaagcgacccatgttatgagcataattaaataaagaaaaaaataattaaataaagaaatctatgaaacttaacaagctgtttaggaacaaaaagaagagttgaaaactcattaacaatgaagagtggtaaccctaaaacaaatcataattaaaatacgataagcactaaaatacataataatttttttattacaaataacgcatgtttatcctaattgcacgttcatcacctaatcatcaaaacatttaacaccacttcttcttcttttctaactattacatctccttgatcagattctcataatg

SEQ ID NO: 1662 - DNA, 3000 bp, Unknown
  misc_feature (1)..( 3000): cDNA_ID_3063581_gDNA_ID_1620432_Annot_ID_156881 3000 nt of promoter + ATG
gaagtttggagaacggatcctgttgaaggagtctgatcttctaccaaagaaacttaagaagaaaacaagaagacgtgtcgcctcaagcactatgaacacaaataagcagttggtctgttctgcggactggcaaggtccaccgccatgggactcatctttaggcggtgatggctgccctaaatttctattggatgtgatggtatttgaatcaatttctgttttctgttgctcttttgtttcttggttttatttaattagaggacaagaatttgatttcacctatttagtatctttgtttttgaatctaaccattttcagtagaatccatgtggtatcataatcagtttcttgtaaaactactttataggttgaaggtttggcgaaacatctacgttgtgtggggattgatgctgcaatcccacactcaaagaagccggattcaaggtactttatcctaaagctgctattaaagtttttctgtgacatggggttttgatcacaatatctgtataggattgattttctaattgtgatgttgacacaaatgccagggagttgcttgatcaagcattcaaagagaacagagttctattaacaagagatacaaaattgttgagacaccaggatttggcaaagcatcaaatatatcgagtaaagagtcttcttaaaaatgagcagctacttgaggtacaaacaaagttaattttcaacgtataagctgttatgcaagatctgtgatgtggcatgatttggtttactagatttattaatcaaaaaggacacataccctggaaattttgctttaaagaataggatctctcaagacactagttaacaaatttatttttaaccttactttctgggtggaacattttctacactacctgtaattatggcatgcttggattcaccgagccaaaataacctcgtccactcactgtgcaaccacttttcttacattcagtagaatgattacggattttttgtgaattactgaaacaaataagcttcgcaggtgatagagactttccagctaaagatcagcggaaatcagctgatgtccagatgtacgaagtgcaatgggaaatttattcagaaacctctaagcattgaagaagctattgaagcagcaaagggtttccaaagaatacccaactgcttatttaacaaaaatttagagttttggcagtgcatgaactgccatcaactatactgggaggtaagtcacctaccccatcttttgccgttgtgcattatagttcttgaacgagtataccttgtgtcaaaaaatcatctggtccatctatgttagttgttttgctgattgaacagtcaaattttagttgcctaacgatatttatcaaatcagtgatccaattaatatttgtatgaagtcttagttggtgaattgaatcttgatttctttaaaacatcttcatgtgttcatgtcttagagcagaaatcatctccacaagattcataacttcctatatagctctgatctgttctgtctctaatagtcagtgtccgacatatttaatgtttgttatgtggtttcagggaactcagtatcataacgcagtccagaagttcatggaagtatgcaagttgagtgagtgattcactttttttttttttttttgggtttttacaattttggtgaagtgttcaatctctcgttacctcagttcctcaaatgtttttattttatatcaaacgtctctaagcaaacaagatgtgtttgtaacttgtgtcgtttgcacacatgtgttccagaggttattaaccgtgtacaaatgttttagtttgttttacaaagttgaacacattactatcttatgagaagaatagacttgtagtattttctatttaccagttaaattcttgcataattttcaaagtggaatattattttcaatatgctttcttgagatgatggcttttctagccgtagattcatgcattttaaatatgatgatataccaaatttaggtattgtggattggattggtctagttcattagttaggcaaaaaatttaacctcatcaaatcaacattacctctcttcctaattttctccattgaattcttgttcaaccattttttttctttcactagcaaatacggtgatgaactcgaaaatgatatctttgcgacagatgaattaaccggtataattggaaagcgtttcttgagcatcagtgttcctacttgaggaagagttgtcttgtagacctaaacaagagatcaattgccccaacacgaaactatgtagatcaaataagtatttagttcactcttctttgctcacttcaaatatgttttagacttattagaaaatccggtgagtcagatattcgacgggcacattcacatcggaattaatagtttcatagggtgttgtctcttaaatttggaccgaccggttggattgcctatctgccgtataaagaaaataagacaagagaacattaatttcatggttgaaccggacggttcttggctaaattgaaccgaaccgattgatttcagaaggtatgtataactttttttacggagtcgtcatcactttctctgctcgtcggcgaagttcacattcaccggtcgtatagtgtcttcgtctccttcctcgtgaaatttgttcatcacagtctctacagtcaccaccataggaggtcgtaccgccggatcttcgccacaccattaatttctgcgttctctcttctcaattcgccgccgatctctctgagcgtaattaccaaatcgtgcttaggtatgtcatcaaatcttgtctcacaccttccaattcatctccatgcactaattcattaagtaattagtcaagggtttaattcaaactttatggttaaatcgacgagagtgctgatgttttggggttagggtgtgaagaaaattatattgattctctctctctctctctcctgctaattagatctccttctcctagaaactgctgtgaggatcgatctcgattgatc

SEQ ID NO: 1663 - DNA, 3000 bp, Unknown
  misc_feature (1)..( 3000): cDNA_ID_3063620_gDNA_ID_1620433_Annot_ID_156901 3000 nt of promoter + ATG
taaatattcttcaagaggtcaccggagaaaggtgtggttttattaattcattctctaatctatgattggttataattagtttacgttatgaggattataaaagtgatatacacatatgtatactatagttccatagaaggtcgtttggtgagaagttacaagaggagtttcaacggtttctcggccctactcactgagtcagaacgagagggagtagccggttagtgttcttagatcgagacacattttatgttgaaatgtttttaaagatttaaccatttgaaactcttttgtgttgttagaaatggagggagttgtgtctgtgttccggagtaagaactacaaactccaaacgacggcgtcttgggacttcatgggaatgaaggaaggtaagaatacaaagagaaacttcgccgtagagagtgatactattatcggattcatcgacagtgggatttggccagaatccgagagcttttctgataaaggctttggtcctcctcctaagaaatggaaaggtgtttgtaaaggtggcaaaaactttacttgtaacaagtaagtcattaaaatttctctaatagaagattagtattgttttaggcagagattgatgtgttcacaatttcagcaagttgatcggagcaagagactacacaagcgaaggcactagggacctccaaggacatggtactcacacaacgtccacagcggctggaaacgcagttgcggatacaagcttctttggaataggcaatggaacagcgagaggcggtgttccagcctctagagtcgcagcttacaaagtctgcaccataacagggtgtagcgatgataacgtactgtctgcgtttgatgatgcgatcgcagacggtgttgacctcatcagcgtctctctcgggggagattacccttccttatatgcagaggacacaattgcgattggggcttttcacgctatggccaaagggattctcactgtgcactcagccggtaacgctggtccgaatccgaccacagttgtgagcgtagcgccgtggatgttaacggttgcagcaaccaccaccaaccgtaggtttttaaccaaagttgttcttggaaatggcaagacacttgttgtaagtatcaagtaacattctcattttcatcatcatagtatctttgtcccattaaattaccaattgggttttcttaacaggggaaatcagtgaatgcttttgatctgaaaggaaagaagtatcctcttgagtacggagattatttgaacgaatctctggtgaaaggaaagatcttggtttccagatacttaagtgggtcagaagtagctgtttcattcataactacagacaacaaagactatgcatctattagctctcggcccctctctgttttatcacaagatgactttgactctctcgtctcttacattaactccacaaggtacctagcagtcttctttctatttcattactcttaatattctccttctttgtcctctgatacccttgtgtttgctttctcaggtccccgcaagggtctgttcttaaaactgaggcaatctttaatcagttatctcctaaagttgcttctttctcttcccgcggtccaaacactattgcggttgatattcttaaggtatcatattatttatgctcttgattctttctttttttttcctggcctgagagacaatggttggtggatggattgcagccagatatatcagcaccaggagtggagattctcgctgcgtattcacctttgagtttaccatctgaggacaggcgcgataaaagacgtgtaaagtactctgtactgtccggaacttctatggcttgtccacacgttacaggcgtggctgcgtacatcaagacatttcatcctgattggtctccttccgtaatccaatctgccatcatgacaaccggtaaacaaaagtccaacttttactttcttgcatcgcaagtaacgtgtgttgacaactctgttcttatactgtctcttaatgaatctttgcagcttggcagatgaatgctactggaactggggctgaatcgaccgagtttgcttatggagctggccatgtcgacccaatagccgctataaatcctggacttgtctatgagttgaacaaaacagaccacatctcctttctctgcggcatgaactacacttcgaaaacccttaaactaatttcaggtgatgccgtcatttgcagtggaaaaacattacaaagaaacctcaactatccttcgatgtcagctaaactttcggaatctaatagctccttcaccgtgactttcaaaagaaccgtcaccaaccttggtaccgccaactctacatacaaatcaaagattgtcttaaatcatggatctaagctcaatgtcaaggtttcgcctagtgtcctttctatgaaatcgttgaaggaaaagcaatctttcacagtgactgtttcgggcagcaatatcgacccaaaactgccttcgtctgcaaatctaatatggtctgatggaacacataacgtgagaagccccattgttgtgtatattgatggttactgatgaggcattatcagttcaccatagttatcaatcatcataacattttgctatacatatatttcttcaaaaacatgtctactccatatacgttttctgattatgtcatcataatgcaaaatgaaaataaagtactaaacgatcgagaaaaaaacagttgtaaaaaaaaaaaagattttgattaaggagttgaagaaacaaaaacaaaattgagttctaaatagatgtgaccaaataaaaagtagatatctatttcctaaaaatgtatttggtcaacatacgatacttctagttaccaaaagagttttgctcaacatacaatcacagcatttgacagaaatatcattaaaattactaattttatactagtgtataaattatatcatgttgatctcgataaaaactgagaaattagacaacctttaattcattttataagaaaaag

SEQ ID NO: 1664 - DNA, 3000 bp, Unknown
  misc_feature (1)..( 3000): cDNA_ID_3063602_gDNA_ID_1620433_Annot_ID_156912 3000 nt of promoter + ATG
tcagttgttgatttctcgattccagatctattaactccttcatcgtcttctgctctccatcttcgatttcttcttcaacgagcttcttaccctcatcatcttcttcttcttcatcctctatcaaatccggtacaatggggaatcgaatcgagctctttagcagctcatcatcatcatcgtcgtcgtgattagacctaacatcacacgatctgcgtcgtggctggtccaaaacagaagcggatgcgtcacgaacagagtaggagcgaacacggcggagctcagtggaagctgagacagaggaagatagagcttcgatggtagagagacgttcacggagacaggtggcacagaaaccagtggtgggtttggaagaaggatgacggtgacagacggcggagtgacgacggcgacgacgctgatgggtttggtgggtcatagctcacagggggtggtttgagttcagtgaatggaagaagaagagagtgaagttgaagaatctgtcagtcacattttcaggatctcgagaagaagaagagaaagagagtcaagagtggcgttgtcaacactacactaaccctttccctttccttaaaccttttctctcgttttattatttcttcattttaatgcgtattatatttatttctgtactttcttatagttaatgaaaaatacagaaatgagttaatgaaaatagagagaaaataatgttatgttttttgtacaaaatatcaaagaaaaaatggtataattgtgtcacatgagagtggcagagagaatcaaaaggaagaagtgtacaacacatcccataatgggtctgacctctggtatttgtaggacgaacataaaagactcttaattagtgaaaatattaaaattaaatggatagacctaaaagattgaaaatggtgaaaacacgtgtgccccatttgttttcttttaccttgggtggtaatatttggctgcttccgtcatttctttggattcccttcgaatcgagaaatagcttcaatgtcaacttttatttattcttctttatttggtttggatatattagagttctgattagtggagtgatttttaccaagaggttgtttagtgcaacaagatgtaacatttgaacaacacgctttactttttgatgcaacgacataaactagtttttgaattaagtgggtttgttcaaatgttacatcatttgttacctgaagtgtgttatcattcaaaacaatatttcattgttatcgtgaaaacagagaaaccactctttacaatggttttaatagattttaactatgacatttacctaaaataaaggagatttattttctctaaacgtttgtggacagcaatggctgacgagtgacattgagattcggagttacgacaagttcccaaagagtatgtgttcttttattaaattgaaaagaaaaaaaaaaccatagcaggtcccaaaaatacacagtagtaattgtttttgtctcaatgtgattgtaccggttttgttttctttctggtaaacaagattggaattttccgacgactttgtccaccacagacagaagcaaagtttagttttacagtgctcaatcgaaacgttaaagaaagcaactgctggcaaataaaaattttaatatggtaaaaagtaattaattattttgggctcaagattgtaatttggagcccaataatgttagttgggcccaaaaggaaacaaataagccttttaggattttggccttttcttgtgcaactgtaataacgaatttgccactcggaactttgccgtcgtcatcgtcttcttcgttcatcttctaccggcgcaaagaatacaaattaaatatcgctgagaaatgtgtccgtgagccttgaattccatgggaattgagtatttcaggttattgaagctagcttccttgtcgaaataaagggcatgttccaagttttgtatatcgtatacatcctttctgctctctttatattgggagatcgatgagatcgaccctaaccgagtcgatttggtttgggtcgatctcagatatctcccaatactttacaacatacatacaactggagaaagaaatcaactttttgtttgtcatagcaggtcagtctcattgcttatgtagtttacttttcggtgtcttactattatgcaccgtttagatgattctgtggcaaagtagtttgtacaaaagactcatctttcatcttaaaaccgtttagacggacctcattttacttgttggtggagatcatgcatacaacttgcagctttaaatacaaccatcactgttccttgtcaagagaaaatcttgcgtttgtctcctctttctgattctctactggatagaataaaagaatcaattaaacatttccttgttcatgtatagaaggtgcaacctaaaggcttcttctacattagatcctctagcgcagaggtatggattccgctgctcatatcactccttgagttgtaactgctttctcgatgagtataggatttgcatatagttcgattaagttttagttttggattaattttgactctgttacttagagaagagaggagatttcaaagacatgttattagttctcttttcttattctccgtcatccttagactataaaggttttaacatcaatgagtcgttttctactctcgagtcttcttgtgtggaaaagtcaaaagtatacaaaatactcagaataccatcatttgttcattttcattgactatgaaaatagaataacagcaaaacttgcaagaccaatcaagctctttgaatcggtctacaacacattaaagaacatataatttatatttctattgtatgtacagataataatggatcattatgcttatattatatgcacaaatgtatctggcgtttaacaaaaggaataagaaacatacatgacttcaacaaactttatttcttggaatttggacatctgacataatattcacttctttcctataaccatgtctatagacac

SEQ ID NO: 1665 - DNA, 3000 bp, Unknown
  misc_feature (1)..( 3000): cDNA_ID_2142209_gDNA_ID_1620433_Annot_ID_156915 3000 nt of promoter + ATG
aaactcgaagtatctcccgtagtctgtgagttactcgaaaccaacttaggatccgatgatgatgccgacgacgaagaagatgatctctgaggtatagcttttaatccagaaaacttatcttggtttatcataaaaggaagagaagctaactttgaagaattcaaacgataagaaaccgtttgagaaaacttagccctcctaatccacgaagtagcctcttcatccatctctaagctcgaaaacaaactaaacaacctttttatcaaagactaaacaaccaaaactctcaatatctccaaagtacctaagcaaacccgtgaatacgaatgagatgacttgctgcaatctccaacgatctcatttccacgaagatacaaaatcttttcaaatccatcgaagccccatttctcaccttcaaccattaatccacaaaaactacaaatcataaaagaagaaaactttcctacgaatactactaagctcgaaatttctccaaacgttcccaccaaaatcaccggaaaatcctgaattacatacctcttcctacaaaatcaagcaacaatactcagaaaatcgaatccatagaagctattgaaaacgataatgagggttaaaagatcgatctgaatcaacaaatttaggaaactagttttcgatatttgtttacctgaatcacaacaaaaaactatgaagcgtcgtcgtgtgttaaaaggaagagaagaggaaagccaagtgaatcggaaatcaagaagatccggcgacttgaagccggaggaagatggaatcgaaggagaaatttgagagctaaaccataagacgtttttggattctcaaagacctttttgacgaatccagacctcttacgcctttttagatggattttttttttctttttttttcacagataaaatgtggaaaataaataaattcttttggaatatttagaaaaatacgttaaaacgacagcgtattaatctgtctgtcagcatctctgatatgctctaattattctgtctgaaagagaaatttaatttaggttcccttttttagtcaaataaattctaaaggccatagacttcggcccattaataataaaactggcccaaattactttatgatataggccatgatgattgcttgatagtaaccagaaacgaaagaggcctcaacgttgacaagcttcactaatcctatgagaaaaactcttctgttttttttttaaagaacataattcacacaaattaaccattctaaacaagaactttaaactacataaaaccattcctatctcttattctcaacattggggaagtgcttaaacaattgttacaaaacaacttttgaataaatacatgctagttttttttttctttgtcaacaactttattagattgactcaaaacaagcccatgctaggtttttatatcaattaaattcttgtttttttttcaaaaagaaattaaacattgtttttttttttttttgttaattaaaacatgctagttgcatgaagttataagttctgtgatgacactgttttaaattatgtattagatcatatgcatctatatttttttctattttatttgtaaaagagaaaattataaatgctactggccaaaaatacgtgtgtgtgtggagaaaacaaaatggccaaaaaataaatgataggagaggaatagaagagaaagaaagaaagatttaagaggtgagtccaaaagattggtaaaacacaaatgcttaacaacagagttaatttttggggacaccacacacatgacacatcactttgtctccagacctatgtctgtcctacgcctttggacatacccttttctcttttatccgatcatcgtatcctacacacattatctcatgattactaatcttgtcttcctttttttttcggtttaaagcaataagcgatatgtacacatcgcatacattaatattttacaccactagctattttaagtttctttattgaacatgtgtacctagctagctagttcatatgatcatatcagtggaagactggaagatatactaaattatacacaaatatactttctgttcagcaaatgttttttgagtcaactattacatttaattaatggtttaaaatagcgagctaagagtggagttaaaatggatgcgacaaaaggaaaatatttgaaaatttgacaacatttttaagatatatttacaagaagtaccaacctctggtcatcattgtattcttctaaatcgcagaatacaaaggttagtacaaaagaatctatcaaataatgggggtactggatttgtcaactatatcacttggaaagcttatgcatggggtataaccaagtacgaaagtataactttattcttaggtcaaacttgcacaaaatattagggttaagaaagtcacctgaatgatttcacgggaactatatatggttaatgaatacccaccctataaaaaaaaacaagagtgacacagaaaggatacaccatttatagacaaactagaactggcttaattttttcgtagcttgcacaatttcatatatatttttaagaaagtcttatggaagatatgtacattaagaggtcatgcgtttctgatttatttgtgacaacctcagttgaaatcattttgccttgttgagcgtttgtgattctggcttcagttttgattctggatatacttccagtgaagttaatatgatttgtaataacaaactagacaacaaatggctagatgtcgaaacttgaaacaagaaatatcccactcctcaattataatttcataattaaataatcaagtttgatacttgtcacatcaaaactctttttcctcattggcctgtttctctcaaatcttcaataaattctctatatatatatgagaaactttgaacctcatttttcatatatatcactgttcttcttctatattggagttcatctcttttgtttctaaagaaagagagagagagagagagagaagagaag

SEQ ID NO: 1666 - DNA, 3000 bp, Unknown
  misc_feature (1)..( 3000): cDNA_ID_2994869_gDNA_ID_1620433_Annot_ID_156918 3000 nt of promoter + ATG
ggtttaagagcaggaaatcaagaaagatcctacaagctcttccttcttatctaagcctctgacctcatatctctgaacttggtattcctcaaatgtggcaatatactgcgaatacgaattggttagcccggctattaccacgctgaattctcttccattgctgccttctttaagcactgttttcacggcatcacgtagtcgcctccctgccattgttgtgaattcttgcaagcagaacaatagagaaaggaaattactaatgttctacatcagtttagaaatgattttttttgttctgggggagaccggaatacctccggggacgcagagaatcactagctggccaatgcggaggatctgaactggtaatatcgacggctgaaaatggattaagaaacagtttttccatcacaaatagctaagtgggattcaatttttatccatcacagtacaagattatgctctcaccgcccagtcgtatggttgtttcatttcaccggtatcaagcaatatgggtttaggtcgttggcatcgtacttgttcctcagttggattcttgagaaggttccttacaagcctccagaaaggatttcccttacacaaagtcacaacataaagtatagtactaaacatctttcattaccaagttagaaggagaatttgggttttacctgatcatctccttgtttaaagtcaaatgctccaggtccatcagttgttcctgcagcgaaaccaaaacccattgcagctggacatgttttcaccacttcggaacctccattttgtccattaatcgtcacttcaagctgagagaaatcaacatatgcatgacgatagtcaacttttccttgtatctcctcagaggctttagtgaaaagatccgcagccttcttgaactgcctctctccaataatgcgggtactctcaaattcatcagggtagctgaaacatttagtcatgccaagttatacatctaacaagcttgactctctaaataccatattgtactaagagagaacataattttctgtgattggtttccgcattgctgaaagtaaaagtgtgcagttaggaataagacgtaccctggtccacggccgtagcattgctcattctttccaccacaagtactttggttgaattcacaaggaaggcctgtgtctatacagaaggctcccaacacattcggactaacatcaccgcagttagtttgacagaaggcagagacaaatctaggtttgtcagcgtgtctaaatctacttctgacccgtctagcaacgcttgacatccttgtaacggttttaccgccggtagacagtaacgaggatgccatttccatcaaatcttgatctgcaataaaagcaacaaaaagttagttttacaataacaagccattactaaaactcttggagctatggttatttacgctcaccataaggatcactgattatgcttgagactcttctaggagattcaacatcaactgatctacaaccgttttctcgttcaaaccagtcttccatgatacgtgctgcagtgcctttattgtccccgctgattcaaggcatttgtacggctcatcgaagtgccatgagttgcaaaccaattgaaactacccactggaccccattgatcatcaacgaatttgacaagtgtcatctctttatctacatcatattcatatttactacgttcatgtgccggattgttaaggtaagcactgggactacggttcacaccagcatccaagagctcccctgcaagctcagctccaaaagaaatgtctttagagaaagcaacatataaaatgaatcataaaaaaagtgtcccacaagctaaatcactcacctttgttgattaaaatggacccgggacgaagattttcatgagcttgtataatactttgctctataccgtccacaagagcattgaaagattgatgaacaaacccgagagatgtaactaagtacaaaatgtattggagataaccccctggaccagcatgagtatgagttccactaattgcaacattttcctccgtataaagctcaccgtacctctgtttcaatctttcaatcactttgatggtcacaagctgtgaggccataccagcatcaagattaacaaaagcaatccttttcttgtatggctcagccacgatgaacgcacgagctctgagcctgaagtgaacaccagatgctacttgttccatgttagcataacccatcatgttaacatcagctgcaggtcctgtgatgtcatagcttccaagacccatcaaataatcggaatctgagaatatacaagtgagcctcaacagaaatagcaagaacaatgtgcagtgcatagacatagaccacctcgtcatcttcacactcaatatggagtaatcaactctttctcatttctagtccttcctagagaataatacaaacgtaagcaacataaacaaacacacatatttcatgaatctaaaattattaaacccaaaatattatccaacctgaagaagaagtaacgcaatccttaatgattttagctgatgaacacactaaccatttgctggagctgatagaaactaattgatgtgaacgatgtgaagcaaaacaaaagaagatgagagaaactcaaatagacaaatactcaataaagtttcgtttttttttctggtaacaacgataatagtatgtaagtaagagtaaagtgtgaggaaagttcttatttttaaggttgcggagaaagaaagctacccaatttcagctgttttagcgtatctgtccttctcaattcggttttcacttcttattcgatttctaattttcaaagtttggatttttggggtaaagttagttaaaatgcatacataacgggggtagaatgtaatttataaaattgtattgggtctgtttgtgaataaaccaaaacttgtggttcttctctgtctcaacctcagtcgccgatcttcaacagtggctgaaacaatagagagagagcgataca

SEQ ID NO: 1667 - DNA, 3000 bp, Unknown
  misc_feature (1)..( 3000): cDNA_ID_2142215_gDNA_ID_1620433_Annot_ID_156917 3000 nt of promoter + ATG
tttgtttgacaaaataaaataaaatactgtagtctgtttatgacaaaaaaaaaactgtagtctgtttatttcaccaacaagctctttgaaattctcctttcatatttgagtttactagattatactacttactgtatttgtataaaagtagtaataatataaaaatgtatatacaccttctaaaatagggtccaatatagttaccatatagttacagctacattaacaatacatttattttattttcggtcctatgtataaacattaacatgattgttgacaaaacatataaaaagtttttgctaatttcataattttcttaaatcattttttgtttggttatcaaggaacagtgtagcttttgtttttctttttttgggtcaaaagtgtgtagcttataatgtcattttggtctataaaacagcaaccttctttaactgagacctgttgttttttgaatgtattcgatgtatcatatttccacactttcaagacaattcatatattattcgatcaaattgtttctcgctaccaaaaaattgatagccgtatattgattgacaaattgacagaagggaaacagaaaattccttggataagcataaacagggccaaaatataaagttaaagagggatgggcttcatggatttgaaagaatagggcccttctaaaccaaagaataatggagattgattggtcaaattcaagagagtctgttttctttcttttttttacaaatcaaaacagtctactgaactgagtcctgaaagaaagaaaaagattctaaaattggttctctgttaacctcaaagttattgaataaaacccatctcatgtacttggtaatttgaagatctttgcttacatgaagatatccattaaagcacggacttgtatatatatatcatattagattggttcatatgcggattcctgttacttgactaagattggttcaaccaaaaactgctttcattaaaggtgaatctaaacgatggttttggagtctgtggaaaaagggatacaaacaagatttttacgctacggttggaagaaatgtaaaactggtccaacaagactatcttccattgcataacattgatgattcgataaacaggcactatacaatatcaggagaagtattcaagttgatttttactgcaaaagatgtattatttgaacaaagaaataaagatgctgtgctgaagaggagacttttcaatattgaaaatttgggattttgatagaaactaaaacctgccaatcgtagttgaggtcatttattacatgtttaaaaccagcagatctcctacaaaacaagttcaaactttatagtagctaaacactaggcttagggatgctggctcatcaaaatcataactcaagaagtgtaaagtcttaacaagaaaaacgaatactcggtcatcatccgtagattatggatcatttcctacaaagctatcgacgaattcaaagaaactatcaagtcacaacaactgtatcttcttcccaataaaaagaaaccgcaaacagatagatcaagaagtacccacaacaatggaagtaaacagatcaggcagcttgaacatcagcagtggttgttgcaggagtagtctttgacaggtttgggatatacttccaacaacgtttgtgaactccgcttatcttctttggagcttccgcagctcgcaatcctgcatttgagaccatgtatgtacgttactctcatgaaagctgcataaaccttaacaccaatgcaatggtgattatctagtttcagatatggctactcctaataatttcaccctatactccatagacatgacaaaaagctccaactttgacatcaatgggcgtaaaaacttagcaatacgaagcaaatgatgacaaaaaaagtcaccatctttgtgaacaattccccaagcttttccatgtctaccatcctgcatttgaatccaaaatcaaacaaatacccaagtcagataatcaaaccccaaatgattaggtaataaaaacattatctcagcttacgaaaaatggaaacttttcaatccagacatgaaagagaagaagacgaagaaccttatagagattgatcttagtgatttcataagagattccattccagtgagctttagccatatggtatccgattccccaattaggtaagaactgagcgacttcgattaagtttttcttctttcttcgtttaggtttattcgaatcggagctagggttttcactcgccggagtagatgccgccgacggcgccgcagagaaatttcttaagagactaagcgagagactgaaagcaccaacagtttcggttctagagattgctctgttcataagtgtcatcgccattgtatcgctctctctctattgtttcagccactgttgaagatcggcgactgaggttgagacagagaagaaccacaagttttggtttattcacaaacagacccaatacaattttataaattacattctacccccgttatgtatgcattttaactaactttaccccaaaaatccaaactttgaaaattagaaatcgaataagaagtgaaaaccgaattgagaaggacagatacgctaaaacagctgaaattgggtagctttctttctccgcaaccttaaaaataagaactttcctcacactttactcttacttacatactattatcgttgttaccagaaaaaaaaacgaaactttattgagtatttgtctatttgagtttctctcatcttcttttgttttgcttcacatcgttcacatcaattagtttctatcagctccagcaaatggttagtgtgttcatcagctaaaatcattaaggattgcgttacttcttcttcaggttggataatattttgggtttaataattttagattcatgaaatatgtgtgtttgtttatgttgcttacgtttgtattattctctaggaaggactagaaatgagaaagagttgattactccatattgagtgtgaagatg

SEQ ID NO: 1668 - DNA, 3000 bp, Unknown
  misc_feature (1)..( 3000): cDNA_ID_3063599_gDNA_ID_1620433_Annot_ID_156913 3000 nt of promoter + ATG
tcttgcctaatccaaaccaaatcatatagaaaattcttgtcccctttttataaatccaaaatttatcattaaaccccatgttaagaaaacactttaaacacatcaatactttaaacaaaagaacaaattatattagtcacaagtgatattccaactggggtgaaaaggaatatttacctgtgattcctgggattaagtgagcataatagtatgcctggcaacatcttctcttctctctctctctctctctctttctttagaaacaaaagagatgaactccaatatagaagaagaacagtgatatatatgaaaaatgaggttcaaagtttctcatatatatatagagaatttattgaagatttgagagaaacaggccaatgaggaaaaagagttttgatgtgacaagtatcaaacttgattatttaattatgaaattataattgaggagtgggatatttcttgtttcaagtttcgacatctagccatttgttgtctagtttgttattacaaatcatattaacttcactggaagtatatccagaatcaaaactgaagccagaatcacaaacgctcaacaaggcaaaatgatttcaactgaggttgtcacaaataaatcagaaacgcatgacctcttaatgtacatatcttccataagactttcttaaaaatatatatgaaattgtgcaagctacgaaaaaattaagccagttctagtttgtctataaatggtgtatcctttctgtgtcactcttgtttttttttatagggtgggtattcattaaccatatatagttcccgtgaaatcattcaggtgactttcttaaccctaatattttgtgcaagtttgacctaagaataaagttatactttcgtacttggttataccccatgcataagctttccaagtgatatagttgacaaatccagtacccccattatttgatagattcttttgtactaacctttgtattctgcgatttagaagaatacaatgatgaccagaggttggtacttcttgtaaatatatcttaaaaatgttgtcaaattttcaaatattttccttttgtcgcatccattttaactccactcttagctcgctattttaaaccattaattaaatgtaatagttgactcaaaaaacatttgctgaacagaaagtatatttgtgtataatttagtatatcttccagtcttccactgatatgatcatatgaactagctagctaggtacacatgttcaataaagaaacttaaaatagctagtggtgtaaaatattaatgtatgcgatgtgtacatatcgcttattgctttaaaccgaaaaaaaaaggaagacaagattagtaatcatgagataatgtgtgtaggatacgatgatcggataaaagagaaaagggtatgtccaaaggcgtaggacagacataggtctggagacaaagtgatgtgtcatgtgtgtggtgtccccaaaaattaactctgttgttaagcatttgtgttttaccaatcttttggactcacctcttaaatctttctttctttctcttctattcctctcctatcatttattttttggccattttgttttctccacacacacacgtatttttggccagtagcatttataattttctcttttacaaataaaatagaaaaaaatatagatgcatatgatctaatacataatttaaaacagtgtcatcacagaacttataacttcatgcaactagcatgttttaattaacaaaaaaaaaaaaaaacaatgtttaatttctttttgaaaaaaaaacaagaatttaattgatataaaaacctagcatgggcttgttttgagtcaatctaataaagttgttgacaaagaaaaaaaaaactagcatgtatttattcaaaagttgttttgtaacaattgtttaagcacttccccaatgttgagaataagagataggaatggttttatgtagtttaaagttcttgtttagaatggttaatttgtgtgaattatgttctttaaaaaaaaaacagaagagtttttctcataggattagtgaagcttgtcaacgttgaggcctctttcgtttctggttactatcaagcaatcatcatggcctatatcataaagtaatttgggccagttttattattaatgggccgaagtctatggcctttagaatttatttgactaaaaaagggaacctaaattaaatttctctttcagacagaataattagagcatatcagagatgctgacagacagattaatacgctgtcgttttaacgtatttttctaaatattccaaaagaatttatttattttccacattttatctgtgaaaaaaaaagaaaaaaaaaatccatctaaaaaggcgtaagaggtctggattcgtcaaaaaggtctttgagaatccaaaaacgtcttatggtttagctctcaaatttctccttcgattccatcttcctccggcttcaagtcgccggatcttcttgatttccgattcacttggctttcctcttctcttccttttaacacacgacgacgcttcatagttttttgttgtgattcaggtaaacaaatatcgaaaactagtttcctaaatttgttgattcagatcgatcttttaaccctcattatcgttttcaatagcttctatggattcgattttctgagtattgttgcttgattttgtaggaagaggtatgtaattcaggattttccggtgattttggtgggaacgtttggagaaatttcgagcttagtagtattcgtaggaaagttttcttcttttatgatttgtagtttttgtggattaatggttgaaggtgagaaatggggcttcgatggatttgaaaagattttgtatcttcgtggaaatgagatcgttggagattgcagcaagtcatctcattcgtattcacgggtttgcttaggtactttggagatattgagagttttggttgtttagtctttgataaaaaggttgtttagtttgttttcgagcttagagatg

SEQ ID NO: 1669 - DNA, 3000 bp, Unknown
  misc_feature (1)..( 3000): cDNA_ID_3063608_gDNA_ID_1620433_Annot_ID_156907 3000 nt of promoter + ATG
aaatgtagatatgacatattactctatatatatattagccgtaactatcactggagatgtacactgtaacatataaatgattgggggacaaaggtttttctctaatagtatatgatcaaggttaattaaacattctgaactggattaaggtgatataatatactactctctaagtacggtatggtaccattaccggccatgtaacacaagcttaccggtttaaaagacataatctatttgactaaaatgtaattaattaattagggctccctaaacactgttattaggaaatgcgatccgtgaaatggggaatgttatgttgtacgaaactcggtaatggatttctttgacatgttccaagattcttcataaaataaaataaaatcattatggtgttttgaataaaagacaactcatgcgatggtcaactactgtgatagaaactcaccaataaaatcaatttgacattctttttgaatgaaattttgttgctaagggaataaattaagagatgcatggtatattttagtgatgtaccatttaaccatcttgtaaaatatactcatttcttttctcatttattataaagtttatataatgcattatttgatactaattatgtatacttattatttttttttattttttttaatgtatacttatttcttatgtttaaatgtttatttccttaaatttaatcaaaaaaatatgtttcaaacatcgatctgattaattacaaataacctccatagaatctgtgctttaaaaagacaagcaactatgatgatcattaaccaaaccgaaccaaattgggagcaatcggagatctcacgtgtccacttttcattaaatcataatgaatagatctaacgtacagtattaagccacgttaacaaatcataatggagaagacagattcctcgagatcttaaaaaaaacagaaaaggaaaataaaagaaaacagtaaagagagagagagagagaaagaaccgaccaatgataatgcaaaacgcggatctcacgtggacccctttgtacaacttggccatgaaagttaccgctgatctcgaccgttcatttggcggctccttttccctcatctgacacataaaatcccaatttgccaatattatacaaaatgtacgtaatcagtgaaaataaagattataaaagtatacagaagcacgtatatgtttgttgtatattagtttaatatgaatgttgaaaacttggtattgttttttcagaggcatcgtacactcccacaaaatgtcaacttcgcgtatttaaattaattaaataattatcatacattgtttttgagttttttttctcccttttttgtgcctcaatgtcaattattttgtatttcacaatttatcagagtgttcaccagcattattattttgtaattatatcgttcacggaatttttcttcgattcattttattttctttctcaaagttccaaaattatatttttcatgtctttccgtgtgaccaaatcaaacacaagaatttacgatttcatcattaatcgatttacatttagttcgaactctaacatatttgttacgccatttatactagtgaatatgtaagacagttataactgtaaagttctaactatactaattacttttccattgaaaaagcttaaaagtttttagggtccaattaagtagctaaagtttaatcaaaatgatttcaaaagtagtagaaaaatatgcagttttgtttaaccggtggtgaaatgatgattatgaaattaagaaaaaaaaatgtttatgattaagaaagagtttgtaactatgtataaggagtaaaagtaatcttgattaggaaaataattttaaaattacagcaaacaatttagttttcattttcaataatagtgaatataattaaacaatttataaaataaaataaaaataggagaaattgaaaaatggaccacatttggtgtatagatagacacggacggtagtgagcaattttttaagcggttcataaccactttattttaaattttaatacatgttttaatcatcttttctcatttcaaatatctatttgaagcgtccgtttaaaactttcaaccattttacccaaaactgttaagtcatgagtatttttaactattaagcaggaatattactatgcaaggtgacaaaaaaatagaaagaagtaaaaaagagaatcaaatcttaaattttaagaagaaaagaaaaaacagcatcaaccaaaaataataatttatcaaggacagaactataagagcccaaatcatcacctcctttctctgcctacttctctcttttttttttaactcgagaagtttataatctggtttctgattttagttttctttccatttatgggttcatttgcttcttcttgcacgttatagttttcctaattgggtaagctccaaggtagcttcttcaatattaatttcatttttttcattttctgtagccatatgtttattttcccgagaaatattatccacacccagatctttaaatctcttttaactctgagtctctgatacttaaataccactcatgctgcttattagctccaccaaatctggaaaaccaatagattctttttatttcttctgcaaaaatctcagagctaccctaaaaattctctctttttgactcacttaccagatctccactagattttactcaattctttttcaaaaggtttaaacttttatagattccttgaagtgggtctaagcaatgcttcagagaaattccgatgatttcttctctaaccaaaataaaaatgaagtatcatttgatagtgatttttgtgttcttcttttgattctcttatctcttccttcccatcaataaacccaaaaaaattaatatcatttttgggatcttattgatcccaaaattcgtaaatccgttgacctttgtcggcatgatttgttcttacttaccgtaaaaaaaacagagctaggttttagttttcggacatg

SEQ ID NO: 1670 - DNA, 3000 bp, Unknown
  misc_feature (1)..( 3000): cDNA_ID_2991813_gDNA_ID_1620433_Annot_ID_156904 3000 nt of promoter + ATG
ttggaatactatttcttgcttgattcacaagataaccgggattgttgtccatggattggcatatagcttccctgagctccgctttgtttaaacggcatagttctgactcactttcttctgaacaacttgaatcatcacattcttctttgtttgaatctgtctcatcattcatttctacctctttttcttcgctttttcgactcacaacgcttttatcatcgtcttctattgtagcttcttttccatttaatgggagattttgttcagtatgatcaatatattcattctccaaatctgtagacaaaacaagtacattaatattcacagagaaaatacaaacaccaaaatttaattaccagaaaatgttagagatataacctaaacgtttcctagtagttgaaatgtctgaagcagaaactgggctgttcatacactgaacatgttctggtgagaacagagaaaaacgacagaagctctcatgacgacaaaagaacaaatctttttgattaaacaatgaaaactcttgatcaaagctatctccagtaagattaggtctttcttcttgaggatcataaggaatgtcaaaagggtttcttccttgtaacatcacagaaggagctgagcctggaatctgtaatcctttaacagtagtaccatctgatgaattatttcgacgtttttcaagtgagttcctcgaaaccgtaacgtgaaggttgttggtgttgttctgtctagggctagttgtttcttcagcttgaagcttattcttttgatctaaagctagtctaaagcgtctcctcgctcttcttctagcgattaaagactctagtctcttatttctctcaatctctgaaatcccatgctcattagcattactcatctcctgtttcatctctactttaccatctgattctccatatttgatctcacagttgcaaaccattggttcttcaacgttgagatgacccaaatcacgagaaactccctctccaagaaactccttctctttgtcttcttcttcctctactacattggtttctaaagcttttggagactcttcgaattgaggagtacgaccaaggagatcattgtaaagagaagtcaagataactttgtctttctcttcttcgcttgtctgtgaatcccattcttcaactttcattcgagcatttcgtctaacacttcgttgttgttttaaatggcatctcttttctcctccacaactcttctttggctctgaatacgaacttgagaatcttaaccctagcttttctcgggcatacactagagcacatgcaagaaccggtgatgtatagatcaagaagaagaacagagaagggaggaaaatgtatagcacgagtaaaaacattgaaacccctgacaaaaccgggtggtttatcatgaatttgatgctcatgttcatcgaatatccaagaattttccataatataacgatgatctctttcgtgtcaatgcccattttccatataatctcaaaagatgaaaaattgatatgaaaatcaattgaaacaagatccttttttttcagagatctagcaaagaatctggcatcaaagaaaaaaactgataaatggagtatctaaatttagagaagttatatcgtctggagatcctctgtttcaggatgttaatttttctttctttctttctattgtttacttaagagggaatttaaacgacaaaacagaaaaaaaaagttttgttagttaacgattttttttttgggaatgtgacacgtttaggcacttttagagaattttatttcttttgaggcacttgtcagggatgaggcacttttccaactttttcattaaacttttgaccaatttgcccctgaaaattaaaaaattataattaaaaaaaaagtttcatctctccacgttccttttttttccttcttcttcgtcgcttctctctctctctctctctctctctctctctctctcttctctctctctctctcttctcattattacttttttttctttccttgcaaaatcaaacatttaagagtttatcaaaatcaaacatttgagagtttatggaaaacccaagttggcaaattccagtattaaatttcatatccatttgatcgccttgtttggtacaatttgattatttcttgataaattgatgtttcattgaacgtctaaccttaaaagcatattcttttacttatgagaatcacttatttccacatggttacgtttacatggacaagttatcatggagacaaactagcatcattttttatcttctctgtcttccatgttttttttttttcatcatttttattttctttttcaaaatcattaatcatggtggttctctataattcttacaaatcatagaaattctgagattatctcaaaattctctatcataacttaaaaacgaagaatatattaagaatcaacaacagaacattgctgctacaattgatcttcttacacgctttatatacttaaacttgagtacttggacactcatcaatggacaactatgcttcagatgtgagttactagatgaccacttggactagagtgcttggacacttatcaatggacaactatgtttcaaatgtgagttattagatgaccatttggacttgaatgcttggacactcatcaatggacaactatgcctcagatgaagttacatcgacaatggcctttttgctgctactcgcgttctcaacatcacgaaccgtttcaagcccagattgcttagaaggtaactgatcatggttaacatcctcacttttcattgtaatcgatgacagagattccttaatcaaggagagaaataaatggaaccaaatcaaataattgttgagagacagggaagatgatgataaatcatatgaaattgggtttttagttttgatttggaatattgagattcccgtaaaaaattggttttgattttggaaagagaaagaaataaagacgatggagaaaagagttgagagagaaaatg

SEQ ID NO: 1671 - DNA, 3000 bp, Unknown
  misc_feature (1)..( 3000): cDNA_ID_3063612_gDNA_ID_1620433_Annot_ID_156906 3000 nt of promoter + ATG
gtgttttgatatccctcggcctagtagtggaatacacaactcttttagtcggagccacacttctaagcatagtctcagacgactcagagagcttaatactactactactagtttcactctcttgcaaattcccatcatctttcaacttaaacaaaacatgaaaaccatccacctccactttctgaacctcatcattattaactttactcaagaaatcactatacggtacactcataaacgtcgtctgtgtccgaggctccgaacccggtaacgggattccgggtcggagcaatcgcacaacaaacataacaatacccaattgtagtaacattacaccaatctcctgcgcttgaattatcggtttccattgccatttcttccctttagaccaccataactcattcttaccttgcttccgtcctttatccttattggtctttccttctccttcacttgagctagctttctgatcaccttcttgacaattcacaatcgttctactactactagtactcttcttcctcgaaaacccttgccaaagattaaacctttcctggtttatcgaccctggaactgattgaggaagttgaatcgatgaattggagacgaatcgattcggattctgacgaaaaccaaaagatcgatctcggaaaaagctcgaagcatgcaaatacaataaactactagtactacaacaagttgagaatcgaaacttatcgtgaatcaatggacttagcaattcgattgaagtcattattttttctttcgaaaccctagaaattgaggaaatcaaaggaagacattgcaacacatttttgggtttatctaatcttctttttgggtcatgaacgcgaggtttactgggaacaacgacttcgaatatgaaccgttggatttgaataaagagagttatctccaccgttgataacgccggagttctgttttgtaagaagattatctgaaggccagaatccaatgtggcgagatgtatagaaagcaatggtgttttgtgtgacgtggatgaaaggtaatggttgatgagattttaggttttttcttgaccacaggttttaaacggtggatatgggccacgaatctggttttttggcttctagggctcacagaatggcccaaaagataatcattttcagtttcatggctataaattttctgaatatttttcatagaaatttaattttgttaacatcgtcaaaaaatcaaaaaatttaatttttggttctaatttgggtttctcgtagtctagaccattaagattcaaatagtttcataattgtgtatactttttttattagtttctagaaaaatagattcggcgtttaacacacaaaaaaaaaaagagaatattacacgtagaggcactattttgaaactttagccacaaataggcactttaaaaggagaaggcactttaccaaatcaaaatttccaaattgccctctgaaccacaacgctttctcctcattttctctctcaactcttttctccatcgtctttatttctttctctttccaaaatcaaaaccaattttttacgggaatctcaatattccaaatcaaaactaaaaacccaatttcatatgatttatcatcatcttccctgtctctcaacaattatttgatttggttccatttatttctctccttgattaaggaatctctgtcatcgattacaatgaaaagtgaggatgttaaccatgatcagttaccttctaagcaatctgggcttgaaacggttcgtgatgttgagaacgcgagtagcagcaaaaaggccattgtcgatgtaacttcatctgaggcatagttgtccattgatgagtgtccaagcattcaagtccaaatggtcatctaataactcacatttgaaacatagttgtccattgataagtgtccaagcactctagtccaagtggtcatctagtaactcacatctgaagcatagttgtccattgatgagtgtccaagtactcaagtttaagtatataaagcgtgtaagaagatcaattgtagcagcaatgttctgttgttgattcttaatatattcttcgtttttaagttatgatagagaattttgagataatctcagaatttctatgatttgtaagaattatagagaaccaccatgattaatgattttgaaaaagaaaataaaaatgatgaaaaaaaaaaaacatggaagacagagaagataaaaaatgatgctagtttgtctccatgataacttgtccatgtaaacgtaaccatgtggaaataagtgattctcataagtaaaagaatatgcttttaaggttagacgttcaatgaaacatcaatttatcaagaaataatcaaattgtaccaaacaaggcgatcaaatggatatgaaatttaatactggaatttgccaacttgggttttccataaactctcaaatgtttgattttgataaactcttaaatgtttgattttgcaaggaaagaaaaaaaagtaataatgagaagagagagagagagagaagagagagagagagagagagagagagagagagagagaagcgacgaagaagaaggaaaaaaaaggaacgtggagagatgaaactttttttttaattataattttttaattttcaggggcaaattggtcaaaagtttaatgaaaaagttggaaaagtgcctcatccctgacaagtgcctcaaaagaaataaaattctctaaaagtgcctaaacgtgtcacattcccaaaaaaaaaatcgttaactaacaaaactttttttttctgttttgtcgtttaaattccctcttaagtaaacaatagaaagaaagaaagaaaaattaacatcctgaaacagaggatctccagacgatataacttctctaaatttagatactccatttatcagtttttttctttgatgccagattctttgctagatctctgaaaaaaaaggatcttgtttcaattgattttcatatcaatttttcatcttttgagattatatggaaa

SEQ ID NO: 1672 - DNA, 3000 bp, Unknown
  misc_feature (1)..( 3000): cDNA_ID_2106017_gDNA_ID_1620434_Annot_ID_156928 3000 nt of promoter + ATG
atgcagagatgatgagaatcaaaagaaatatcacaagtttgagttcttggctaagaaaacgcatcacctttggtttggtggcagatgaggacgatcaagcttgtgttaagattacgaggaaacgagaaagagagagatcataattgagccaaaaagaaaaaggtggatatagagataacaacaaagtgtgtgtgtgacgtaagataccaatatcagtgtcggttccaccaccaccttggtatgcgtgatagctttgttgccagataatttcttccaggtgttttattattaagaaggtagagagttatgagaatctgccattgatggtagtttacctggagtttccatcaaaatgtacacacaagaagaaaaataaggaagagctaagtgatgagagcagaacaatgtatctcaaagattcctaataaattggtgagtagtcacaaaggcacacttggaaacaagacaagaccatactgatgttgcaattatactagtcacaaacgggtctcgtgttacaaactaacataaaataccctattgctacttgtttgttccaggaggatcaatcaactttatcttcaactcaatctcacccgattcaacagcacacagcctcagccacacactctgcaccacctctccgtctatgcaactgattgtgctctctcgagatacgcagttctctggatccggtaatactttcctaagcgttgtctcaccagaggacacgcggactacgtgtcttagtctggcaactgagataagcggttgaaggctgagagaggcatggcccatcttgtcatctgccttgaacctatctttatcaaacacttcctgcaccaccccattaacaatctcagcatcatgatcatgatggtcacaaaaggaaagattcatgaagatgtagacataccaatgcgagaactgctgcaggatctttcagagtaaagttcagttcctcattccacactggattcaggcaattgttgatcactttggtcttcgctgactggttttcaaaacagtaaaacatcacatcaacagacaaataaacacaacgagatacttgtttccttggtagaaacacaaacactggttctagttgccaagaacaatgaaaaacactgaccaaacatacctcatttcctaatttgacaatcacataaggatcacttgacttgaaatctcggatcaccagtttctttccttgaataacagtcacctggagcagtcctagtggctcgcccatctcagattctacaaacacatgctaccaactttagaaacttcttgagacaatcctcgtgaataacagagctaaagcaactgtctttattagacaatcagttgaatatgacaaccaagacacagagaaagagaaggaagtactagtcattcaacattcaacattcaatctctaggaagctaggatatatctaaacaactacgccaagcccaaaattttctgagagcttcttgatatagaaaacgaaattctgggaaagattcacacttatatcagtaaataataaaaccacacagagagaccaaatgctgccaatctacagaaacatctatctagcgagtaaggtagagaaagaaacaaaaatcgcaagcagaccttgatcaagagacaaaccaagaaacacagaggactctgcaaatcaaaaaaggctcaaactttgtgggttgaacccagaagctactcgagtctacaacaagaccaatagaaaaccttgaaaccctaaagaatgagtaaagtagcgaagaacggtacgaactgaaaaggaagtttcagtgtttcactgagaaatttgcaaactttagaagaaaaaaactaataaataagaaacagaaaattactgaacaactttaccagtttggaaacaagaataaaaaatcgtcttcttgtggttgtgatgaattgagcaaaacagaaagacttgtattcgtcttctttgagattaacgcagcagctacttacttacacctttgtagaggaggcgaggactatcattctcatcagaattttttgtttttagttgaaaaacatttttatacaaatgttgtcttaaagacaaattccatggtctcgactcgactctcgaggttgctataaagaattttatttgaccaaacaaagtcttaacatgcgttttgaccgtaatagtaatttagtggtatctaactaatgaaaacagtaaaattatccaaatcatattctacaagttatcgaatactcctttgattcttgaacaacgtagcagtaacggtaatgaattaattactacaaaagttaggtaaacctaatcctggttataataaattagtgaatcaaatacttttgtgtgaccctttaccacacgaaaaagaaaaaaaaaaactttaaaaattgtttatatgcttgaaatcagaggtggcctctgacacgctttgactcggtctaaccattaaagctccaatataggaccatgcgaatttgtgtaataaacatctcacactttttatgcagcataatgttaaacggtaaaaatgttattttaatcccttaactttcaaaatgtgttcattttatttaaaacataaacattaacatttgaaatacaagaattcgttgaccacaccaaatagacatgcccaatacatactcaaagcccaataaatctgaaaatgtccagaagatctttaaatgggcctaatgaatatatatattttgaaagccctaatgaagctttgatacaaagctttctttataaacgctgcgtcacatcactgaatcaaaaaccctagcgatacttcatctctcgagccggagccgcgttgcgaaagcatttcaatcgtagtctaaggtactctatcgatgattcttcatttctttctttcgaattttacaagcagatatattccttccgattattctcccattaaattttcagtgttgttttgatctgtgaataatgttggtttgttatgttactttgatggtttcagagaatg

SEQ ID NO: 1673 - DNA, 3000 bp, Unknown
  misc_feature (1)..( 3000): cDNA_ID_3063694_gDNA_ID_1620434_Annot_ID_156938 3000 nt of promoter + ATG
cttcttcttcttcttctgggaattgatcactctggtaaagcacaattggcacgtccaaaacgacaccgttccatcgaaagaggccacattgtgattggtgagcccaattaggaaggcctattttactaatgttgaagcacatgttgtactataaaaaaacagagtttattatctgtttctttggcttgacatgacaaatgtacaactgggagagaaagtcagtccgattgtgttggggatgacgatggcaaaagtagtaaataaggaagaaacaggaggggcgttttcgggagaagaaggaggaatatgagtgtgagttgttgttgtaggaatctgggcaagacaataaaaaaggcaataccttcacatcatttgcatctgagaagtcttggtgggagtctctatcgtcgtcgtatccaaagctcttcaatggagaccgatctcaagtcaacctttctcaacgtttattctgttctcaagtctgaccttcttcatgacccttccttcgaattcaccaatgaatctcgtctctgggttgatcgggtatctctctctcatcagtcagatcccacatatatatccttcgaatgctggctgattctctctttctttgcagatgctggactacaatgtacgtggaggtcagacttgtctacaacagcctctttctctctctctctctcgcttttcatcgatctcctttttttttctcacacttacttcttcttctccagggaaactcaatcggggtctctctgttgttgacagtttcaaacttttgaagcaaggcaatgatttgactgagcaagaggttttcctctcttgtgctctcggttggtgcattgaatgggtataccaatgataaagacttatcctttcaatctctattagtaatagatactctcctctctctctctttatgtcgctatcactcatcatattcattatctttgcagctccaagcttatttccttgtgcttgatgatattatggataactctgtcactcgccgtggtcaaccttgctggttcagagttcctcaggtaaagttttcatattttttgtcacgctgcagtccactagactattctaacacaatgttacaggttggtatggttgccatcaatgatgggattctacttcgcaatcacatccacaggattctcaaaaagcatttccgtgataagccttactatgttgaccttgttgatttgtttaatgaggtaatctgttttggcagatctactattctcttttccacttttgatattttatcctcagtctattattccatttgctgtctaggttgagttgcaaacagcttgtggccagatgatagatttgatcaccacctttgaaggagaaaaggatttggccaagtactcattgtcaatgtgagtcaactgtgggcattgtctaaattttagatacggtttcttctgatggttgattagatgaaaggcagtattctgacctgatgcaatggttttcaacttgcagccaccgtcgtattgtccagtacaaaacggcttattactcattttatctccctgtgagtatggattctcttcttccctagtcatatttggggtcaaaaacaatcatgttattccttttgtctccatcattgcaattgtagatcccgtgacaagctgtgtttttctattcaggttgcttgtgcgttgcttatggccggcgaaaatttggaaaaccatattgatgtgaagaatgttcttgttgacatgggaatctacttccaagtgcaggtagattgctgttaagtattcatgagagctatatgataggtagtgttgggatgttgataaccattcttttgtgtaggatgattatctggattgttttgctgatcccgagacgcttggcaaggtttcactcgtgctaacacttggtttctcaggctgatgtgaatgtattcacttggttcagcatattggttttttataatgcagataggaacagatatagaagatttcaaatgctcgtggttggtggttaaggcattagagcgctgcagcgaagaacaaactaagatattatatgtaagaaccatatcatcttgatcaaaaaggtttgtatcctgtttggaacctgaaacatgttttgttctgatttactaggagaactatggtaaacccgacccatcgaacgttgctaaagtgaaggatctctacaaagagctggatcttgaggtttgtagcgaacctcagagatatgatgttgtaatacacaactaacatttttgctaattggacatggtttgatctgaacatgatagggagttttcatggagtatgagagcaaaagctacgagaagctgactggagcgattgagggacaccaaagtaaagcaatccaagcagtgctaaaatccttcttggctaagatctacaagaggcagaagtagtagagacagacaaacataagtctcagccctcaaaaatttcctgttatgtctttgattcttggttggtgatttgtgtaattctgttaagtgctctgattttcagggggaataataaacctgcctcacttttattcttgtgttacaattgtatttgtttcatgactatgatcttcttctttcatcagttatatgaatttgagattcttgttggttgatgcctgtgactacatacataatattgaccaacagaagaagataactcgatacatacattgattttataacactgagatttaagcaactcttcttcttctctaatgcctacattccattccaaaggcaagaaaataaagcttcaagcgcaggcctcgacacgtcaccttgtcgcttaatttaatacaacaactagagtttatttataaataatggctgtgaagggtaaaagcgtcttatcctcaacgaccaccatcatcatccagctagcagcaattggtttttcactcacacactagaaacaagaaaaagaaagatgggagatttaatggctcggtctctctcttgatctgacgacgacg

SEQ ID NO: 1674 - DNA, 3000 bp, Unknown
  misc_feature (1)..( 3000): cDNA_ID_3063680_gDNA_ID_1620434_Annot_ID_156943 3000 nt of promoter + ATG
aaaacgtcgcgagatctagatctcagggagagacaattccgcttaaaaaaaaaaaaaagctaatcagttgaaatatatttcacctaaaaaagattattcttctacaagttcagattaatcagacagaacaaaagaagagagctttaacatttaacgaaactggaagaagaagaagaaaaaacaactgtacctgtggtttaccggtaacgacagtgacacaatcttgacaaccttgaatcctttcgtcgccgatgagtggtctgatgtgaacagcaaccttaacggaacaatcatccggtggcggcgtagattccattggaagaagaagaagaagtaatctagaatcgaagaagagagaaagagagagagagagacagtgaagttgcaggcagacagacaaatgtggtttgatgatgtgtttggacagagagagagacttggaaaaaaggaaagggtagaaatggaattttgtaaaagaaaaaaaaaactttatcgaggagagagcttaaccgcaacgacaataacactctgttttaacttcccttaggctacactctttagtccttactatctctttcttttcttataaaacggaccgacgtgactttcctttcactcttcccggttctaacctctcctctctctttctatctttcaagtgtgacttctgacaaaaagtggtggaggagaatatttaagcaaagagagaaaattaggtcaaattctttactttattgcatgtgccgttgtaatgtacacatataccaaatgattgtaaaatttattacataaaagagttttaggagatcgtattcaatcttatattttaaatgatttgagttattttgaatttttatacaattttcaagaatttggataaattttaagaagttgttatgatttattgtaaaattttctaaaattctatctaaactcatgaaatttcaaattctgtatttttaactaaggaaatccactaaaattcacttaagtctcttatagtcattaaaaatttaattcttaaaatgtttttaatgatttttaaatagattttagaatctaatctaatgagattttcaaaaatccataattgaataacataaaatttgttatttaaatacaaatcacctaaaatgtttgattgaatacattccttttagagtttatttagcaattatgtgttcacctaaattacaactgtaagttttaagtttaattcgttttccttatatttgcaactaacaatacctttgtggagttatgtctcacaagctatgaccaacggattggtttaaaggtttacatctaaactacaattgtttatagtgtcagtttggtatttaaatatgattaggtaagaaaacagacaccgccaaaaaaatgggttgttgacgtaattatgaagcaaagacggctatgatatatattattttcttatttttatatatgtatatttatatttatattcagatgaaaaaactaaataattactgcagtgaaaaactaaaagagaaattaaagaaatgttagatatgaaagtgaacaaacagtgaatgcaaattgtggctacgatcgttgacaaaaagtgtcattctttttttctgaaagcttaatgcacagttgcacagaattagaaaagaaaaaaaaaagagaaaaaaaacacggacgacttttggagaaaggtccacaaggagagacaatgcgagctggcggaggaatcgtggtcacgtggctttagcgatgggtcccaatttatcggcttttatgggaaggaactccctactcttaggctaatgttcggatccaagaaaataacagaaactaatcaaaaaagcaaaaccaaatccgaatccaaaccagtaatatacacggacggattctaagtccaactctaacaatatcttatatctctcatggttctctaaaggtatgaggtccttaaagaaaatctcaaaaataaagaaaaaatgagattttttgttaatagtgggatttaaaggataaatcttattaaaaaaaaaaaaaaaatcttcgcgaatagtgaacatgttaagtttttgattatccgaagaatttggttgtgaaaatttgttccaatttggagatgtgatcactgatctacgagagattgatttctatgatttgatatactagggagtagtggttataattctaggtttgtggcagggattggtttttcagctggtatggatttagagaaatgataatcagaggagaaggaggagagtcgataaacacgacgaatcgttactccgaggaactggattcattaacagaagccatcgacggtttcttggccttgcaagatgctcttgaaaaaggtagatattctgattattatttttgttgcggattgtatccaaagttgcattattttttcagatgttacatacttatttcttgttataagcctgcattatcatgttggaatcaactaataacatcatatgaacaatgattatgatgtttaatgtgactctttataaaattccatttgcagaggttcagtaattccaagaggtcgggaatgaaccaatgccacaacatcatgaacaagtcagcgacgcaagttcacctcaccacgagattgtaaccctgttaaccaatgttgaacaactggagaacatgctagaagaaacaaggtctatgcttgaggtgaaagacaaatttaagaaacccatacaattttatatggaatcatttcgtagaatatctaaatgttaagaaaatgttggggtttttttttttgctaaacttgtaaatatcattaaaaatgaagtggaagtattacaaaagcaatacctaatctagagtaaccttggcaaaaagaaataaaaacaaggttacaatatttgaaaaatatgatagaaattatctgatccaaagaagcatgagtggtctccaacgcttccgagagcgtcttcccgtgatggtgttgcggatttctcgatcaatcatcttaaagagagcagaaggatg

SEQ ID NO: 1675 - DNA, 3000 bp, Unknown
  misc_feature (1)..( 3000): cDNA_ID_3063676_gDNA_ID_1620434_Annot_ID_156947 3000 nt of promoter + ATG
ttcgttattaggcgtgtctaccgcatcaaggagaaccaccaggacgagcggcgggtgctgctgattgcttgttgtagctaacagatagctgatggctttttaggagtcagattgttcttttcatgttgatagaattgacatcttatacacatcactaaatgagctcatgaggaaataaacctcatcctcaagttgcagatatttgtatgaacaatacaggttttatttgttctttggtttgttgtaaatgataaaatatttgtttagtgtccacttttgttcaagtaccttaagactgagacaagaaaccagagcagaggcaaagcgcaaaaagatgcaaagtcttttctttaagcgttaattgataagcataagacacattacaagtaaaggttaagacaaatttgaagtgttgtatatctcccattccattcaaagatcaacaacatttagcaacaaaatattacagtgaaggcaatttgccgcagattctcatgtaatggccaacaaaatagcatccttgtattacatattgctacaccagtacgcatagtgttcatctctcctatggatgctcaccagaccaccgcattgcagacagataaaactgcttccgtcagcaaaggcatcgagcatgatctgtgacctcccacttttttccagaatagatatgccatgagcatctgctgtaactgtttgtttggtaccaaataagtcttttgacgttgtaggctcatcaagcgcaagaggctgtgcttctgtaatggcacactctgcaaatatagaagccagctgatccatactagctgtttcttgaattctacgcttgtatagttcacgggtacggttcagtatctgaagaaccgcctcatctcctccttggtttctcatcgccatcacgacctgttcagaacaagatagactgactcagagaagggttttataaagaaaaaagttcaatgcagtctatatacataaagtgaacgatcttgccatcatacatttccacaaatgcgacgaacactcaaaaactaatcccaattcaacaaggaagatacttttatcattctaaaagtctaaaagaagataaagaataaaattgcaatcttatgataaagaaagagatcattcttctaagatgttatatctgcttaatatgatataggcaatggatgaaggcgatgtgataggattcaaaccagtaaactacttctttattcacatccccaatgaagagacagatttgaccaagggatgtagttgatgctgctgtatctgttggcaactagacgaaggaaatgaatgtaacagatcaagcttatgatacagctataaaatctgtcgttataatggtaactaatgatcatagggatagaatcacgaaacaaaatctatctttgtgattcatcaagcaatacacaagcctccaaaaactagttgttcatccttatgcgagaaaataaatttaacttctaagtagtatttaatttcgattctgtgacttaagccacaaattccaacgaaccctaattctaaagtccaaagatagcaaaaagagcaccaaagcaaaaccgtatagatatagaacaattggaagaagaatgtttgaaatgcaaaaatagggaaaatttcggagatggaaaagaaacctagaagaaatcgaaaataccgcttggagagcttgagatggttctccttgatcgacgagcctacgagcggcggagaggaaatctctggcggtgctgggtttgtcgagcatgaacgtttcggtggagtcggcatccatcatctgcgtctcgggatcactgttcatggcgtaatgcatctgcgaatggagagaatccaaggaaaaaaaaagacaaggagagactagtagtgatgaaaacgccagaggattctagcaacttcttgtctcattccctaatttctccgacaaattatacctcttatgtaattcggaacactttcaatcaaaaaataaataattaaaaactaatctgaacattttcaagcaaaaaaaaagaagaaattcggaacattttcaagcaaaaaaaaaactaattacaaatatatttaacaaatcatggaacatagataatccttagaatacatattcaaaaaaattcacagcaatagggtaaagtgtaaatatatggtcttaattttgtagaacatatcaaattagaatttctgaaacttttagaacatgtcaattttaaaatgagtagaacatctacaatgtataaaaatacatgatctaaaatatttagaatttagacaaaaattagagaacatattctaaactttttagaacgaatttcaactattttttaaaaaaccagttttcgacaaaatcataaattttcttctctaacacttcttcatcattattggtcaacatatgttttctgatctgaacttggcataaatgttaccttctttttcggtgatatattgtgataacctggtattcactaaaaaatgatgaagcgtatagctctagacattgaagtctcaaaaatgggaaaggatcaacattgctttatcatcacaacgacaagatttttccactacttagcaggatttgcaggacaaaaccaatctctgttttcaagattctactttgattaatataaaaacatagctgttggttatttgttacttaacataaggcgttttactcatttttatatatatgagaatgtcaatgatctatccaaataatcaaacaaacaaaactctatttacatcatctagatgaattagcaaatgatcaaataaacaacattcacatgctggatgcaaataccaaatgcaaacgaataggcccttaaaacaattcaagtataccaaatgatcaaacaaatagacccttaaaataattaaagtgagtccatttaggtttgggccctccactaaattatcggaacagtgaagtcctctggtccctctgtattcaccaccacaggctcattgacagaaagagagtgggagagagac

SEQ ID NO: 1676 - DNA, 3000 bp, Unknown
  misc_feature (1)..( 3000): cDNA_ID_3063669_gDNA_ID_1620434_Annot_ID_156953 3000 nt of promoter + ATG
tttttcaatgttccatatccgttttgtgatttatagggtttttgtttcgttgtttcagaacgtttgttgagaagaattacaaagatttgaagtctctaaaccctaaattaccaatcttgatccgtgaatgtagtggagtccagcctcagatgtgggcaagatatggtaaatttgctttatctcttatctctgtgaaggaaaattttgactcaaattgtttaatttttagagatatgaaaattaattgtgctcttttaaagatttgatatgaatgtagttacatatgtgacttcttctattgcttctgcattcatattttgtatggaggtgtctttataacatcttgtgttcacccattatacactcactatcgagccttgtacatcttgtgatgaaaatgtttcttgttgtgtttgatgtgaatgctgaaatttatggtttatgggattttctaatgtgggttgttctttttctttctcgcgattctgtttgttttgaattttctacagtgttaaattttggtttgtttgtttttaaaaaacttgacatgaatgtggtcattggtaataacagatgtggcttctttcttttgtttctgcattaagttttttagggaagagtcttttaacactatgagttaaccaattacacttaaagtagtacactcacactcacccttagagtcttggtcattgatgataaggaattgtgtataaccgctatgtatattggcttgtgctttataagatgaggattgttttcccttgtcccttgttgtgttttatgtgaatgccaaaatcttatggtttatgtgattgcctactgctgttgttcattttctctctctcgtttttgttttgttttgaactttatggttgtcgcatatcagccttaaattttgagtgagttttaacatcttgagttactcttaaagtacacactcacccttagactattggtcattaatgaaaatgcatattggcttgttcttttgaaatgagactggtttccctagttccttgttgtgtatttatgtgaatgccaaaatcttatggtttatgttatctcattagctgatccattttatatggtttccctgaccaaacatatcagtgtcttcagcaacttaaagtatttaagcatctgtgttgagtgaactttgaacatctttaaactatgttcccacactccgataatgtagtaaagtataatactgtaaatatgagagaacaagatgattctttttctttttggtgataaacttgttttacgcaacagtcatatgcgttaaaattgtcatcctcgattctacttcggaactagtatttataaatgtgtctgtttttgtattgcgttaattcgtgcttggcttgtgcagatatgggtgtggagaggtgtgtaaacttggatggtctgacagagccacagattctaaaggcccttgaaaaccttgtgaaatccggagctacaaaggcctaagtttgtttgtttgtttgtttttctctatatgatcccgaataagattaaaccgcaaaacaatcatttgacatttcctgtcattctactactttgtaactccgtggtgtcatatcgccttgcatttgagttggtttttttgtgtaatccttgaacttggaattaaaccattccgtataattgaaatcacagaaaggagaaaaataaaccatctctgtttaaactttttgttttaggggatgtgggcatgtcggtttttgaccgtgttttccgcaacaattcccggtccgatcagccggttcagtccggtttcaaaaacattgctaagagcgaatcaagttcgcaacctcaatagggtccaatcccaacacattcacgtgcgaagctcaagtgatctctctcaaccgttctcgttaacacgcatctgtttcttttccatattcacaattttacttacataatgtttttttaagtttttccgaatttatattccaaaataaatcagatttgatcttctctatgagattttataattacactacattttataacaaatttgaaaagttctttatttatatttatagtacagtaaaacctctataaattagtaatgttgggactgcgaaattttattaatttagagaggtattaatttatctataaattaatatttatcaatttataaaaagattttcctaatttggtaattttttgaaaatttctacaaaatttctttattatagaaaatatctttctagaaccagttacaagtaaaacataataataatgtctaaaaacagcaccaaaagtattgatacaataaaatatgaaaactatagtcaaacaaataacaaatatgaatttaagcaaaaaaattattataaatatattataaagaaatcttttacatataatatatatatatagttgatacatttatacaattattaatttatgatattgatggaccatatatttacataaaatttttttaaaaaattattatcttattaatttatcgatttgtgtcactttttacactggtcccaattcgggaccagaagaatttattaatttataaaagttattaatttatagactattaatttatagaggttatactgtaatttgaaaacatttttttatatattgaaaatgcaccataatactctttctatttatttaagcattttaaattttaaatatattatttttaattaaattcgtaaattatttattaataataaaaagttaagaaaattatttaatatgtttagattaatcattatctcaaattttgaatatatagaaatataaaatattactattgaaatattatttagatattaattcattaaaaagtaaggaattcaaaaaaaaaatgattatataataagatatgtctccaattctacaaaattataatacaaatttcaaatttctgattttaggtatatacaatctaattattcctcttccatgattcttttacaatcttaccttctcttccgattttagttcgaa

SEQ ID NO: 1677 - DNA, 3000 bp, Unknown
  misc_feature (1)..( 3000): cDNA_ID_2781298_gDNA_ID_1620434_Annot_ID_156949 3000 nt of promoter + ATG
acattaagctacaaaaagaaattgaattgtgcaagggttttcgtcgaagaaaatattaaaattctgtaccaattaattaaattcctaatccctagaaaaataaatacaattacagttgaccacaagatttaattaagctaaacgtggctaataagtgtttgatcgagatacggtctccgtctttggagccgtcaaacaagcggccaaagcactctctagtttactgactacctccaccattgacggccttttccgactacacggcatcaaacactccgctgccaagtatccgacatgagccaccgcctcgatttcgtaaggggtcggcggtggaatcctctggtcaagtattctatgagcctcatccagcaaaatgtatggtacaacatattccactaagtttctagggttttcgtcttcgttattgtgtatcgctttgtgaccagacagcaactccagcaacaccacgccaaagctgtaaacatcgctcttggttgtgagctgttgaaacttgtagtactccgggtcgatatatcccaatgtaccggcagcgtgtaaagagagatgtgagacgtcatcttcttccgttggacccatttgagataggccgaaatctgaaactttggctgtccatgtggcgtccaaaagtatgtttgatgactttatgtcacggtggatcaccggaggcacgataaactcatgaaggtattggatcccacgagcagcgtcaagcgcgatcatcaagcgtgtttgccacgaaagagggtcaaattgaggattgtgaaggtgatcggctagagatccatttttcatgtactcgtacaccaaaatcctctcttctgtgtcctcatagaaacccagaagtcgaacaagatttttgtggttaagccgcgacatagactctagctcgttcacgaacgctgaatccttatctgctcgtcggtgtctcatcgttgtcccagacaatgtaggatttgttagctcagctcgtttgattgcgacatgacgtccatccgacaaaacaccttgataaacagagccgaagctgcctataccaagatgaaaccggacagagaaaccatccgtggctagagctagctcgtcaattgagaactccattagctgcccaggattacctaaacttgctagagtgcacagcctcttctcgagcttgggtatgtctattgtcctagtatcatcaagacgtccagagtcatggacacggcatcgacagtggcttttaaagatcaagaaactgatgacaaggagcaaggaaaacgttccaacgcatccgaccactagaaacgcaatgtttcttctgctccaagttttgttcttagagttttgagccctagtatcaggaaactctccatcatttcttttcaaatcgcaaatcatcaactcattgccgcataaggactgtgatcctgacaatggacggtaagggcattctcttctacacggtcctggcattaccacttgagaaattaggccttggaatggagtgaaaacaccggatttaaaattctcattcccccaacaaattagagtgtaatttcttgtggcaacaccgcaaaacattggccctttagcatatattgatgtaaaatgaatgtccttaagcgtttgaggcaaactaaagttgttgttgttgccccaacacaccacagttccattagaccatctaacaccgcaaccacggtcttccccaaccgctagtgctaagaacttttcacgtggcagcgactgtgtttgtccccaacactcgacatcattgtcaacagtgatcgcacacgcttgtcgtgatccagccgctatcgcgatgtagtggtctccactcggcactttggctataccttcacaactgatcataccaggtggctgagatagcccacagaaaaaattatctcccaaggcaatggaacggtaattatccggccgtggcagatagtacggttgccagcaacggaggcgccttgagactctttcaactccacaaatgcggaaattcccggcttctagctcttcgagctcaggaccgtggtagattcttttgtgcaacatattagttccatcaacagagaatctccaacaaagaagtgtggaagtgttggaatccagccgcgatatcaatccgcacacaaacccattccctgaaacaacccccgaaaaccttcgatttcgaaggttaccggttaaagaaaatggaatcgaatttaaagggaaactggaacattgaagataagagtggttgttgagagcacatacaagagtctgattagagatgtgggagatggagacggtggagagggagaagcaaacaaaggagaaggaagatagaacaagaagaaggagagacacaaagtaagaggagaaacaagagattgagatggtaagtgccattgaagaagagttctcatggcgtgtgaatgttttatgtttgaggagttgtgtttttaagacggcaaatcaacgcggttagagagacatgagacagagacagagacacctccttaccaagagaccaaaactaagtcttatttacttcattcatagtgatttttctctattctaaattatttttatggtcaactctttgaaaatttcaacacttactttcagtggcatcgtcgtatctaaaaactatacttaatcctttggttgaaacaaaataaagaatgactttcgtttatatattccaagatcttttaacattcataatagggcttgtacaaatccttcatgagaggatgacactcttcgtcatttaatgaaagcaaatgtggcccattaagtataattgaagcccaattacctttcacacagttaacaattaagtttttggtctgatcacaatgtttgcgttagctgcgaaacaagatgctgttacagtcatagaagtcttatgcgtacacgactccgatttcaaaatctgaacggaatataaactctcgacgacgaaaatctcaaaaaccccaaaatctcctccaactccgagtt

SEQ ID NO: 1678 - DNA, 3000 bp, Unknown
  misc_feature (1)..( 3000): cDNA_ID_3063665_gDNA_ID_1620434_Annot_ID_156954 3000 nt of promoter + ATG
ggggcctcgggatttttgttatccgcgatatacctaatggtttggtttgctattatcttgagactcctaatgaaagcatcactcatggttaaaatgtaaatctatctctcactatcttcacaggtcgacgtttatggatacaaacgagcaagccttgtgttagagtggatgggaatacatgccttaccgatttacgttctcattgcttgcaatcttgtctttctaatcattcatggattctactggaagaaccccattaacaatctcgtaagttttactttcgtttttttttttaccgttattaacgttttgtgttggagttcaaaaatgttattgttgtttgcagcttcatttaatcggaatcggaaagtaaagaagagaagagaagggaggtgaagaaataagtttcatcaaccaaaaccttaattgtttttgttagaaataaacaaatgccatcttcatcttcacatcccatatggaatccaatttatgctatacttttgtaaacatacggtatatcgtagaaaaattaaaacttcatggctatataagcaaagccttttgtcgaaaatacacatgttggcaagttgtgggagccaccaacataagcatattatattcaaacaaatgttcaatcgcacatgtgatggtttagcgatttagctaccgcacaactgaatcaaaagacttgttaaattgctctcttagtcttatcataccttcatctcatatccattataatcatctttagcaatactattttatttttaactacgaaaaataaaccttgttacgccgttattaacagtgatcatttttttcgttaaagaaatttaacattcaaaaaagataaagaatgatcaccaataagcgtcatgatcttccgtatggtgatgataaacatcgtttgcagttttgttgtatagtacaacgtatatgtagccgtaacgtgtgaatagtgtatggttagggtcattttatttgtgaactaccacaattttgatagcagtggagataagtcaaaggttcgtcttctaattaattaacagcgattattagactatctaacttttcttcttttcttattttgataataactatatatcttctttagccaccttactttctcatcgggttctatttaaatagggacaaagaaaacaaaccatcgatttgtactatgtgctcaattatatcatatgttttgtctccatctatgtatctatttctcttttccatttggtaaattatttaagacccttaaactgacttttctcgtgggcggcgtcgaagttttggttaacagacaaaacatctgttcatgatgcctgcataactctatgtttttatactactcatttgccctctatttcatgctactcttaaaaatagctaaataaaaatacttcaatattagaaaaaaaatcttcttgatgtcaaaaatacactttagatatcccctctagttcttgtgatgctaatatattacaaaattgtttatatatatagaaatattacctctagcaatacaaaaatcttgttatatcaattaaatataacactatccgactagtgtttactaaaataacacataatttttaattatgatctttgaattttagtttatgtattacgctttataattttgttatcaaaaactataaaagctcaaaagtgagcatctataccctaattccgtttttatgcatacacttaggtttatttttattacgagaatctgtgtttagtatatataaaatagagtttatgaatgactaagttaaatacttcaatactaattaaagtaagtcgtattgatgcagacaatataaactttagatatctccgctagtttgtataatgctaatagattcaaattgtctttatgtagaggaattacctcaaataacataaaattttcattttattaattaaatctcattttgtcatttcaaaagtcattttaattactgtgttatttgtctaaagtatactccaaacaagaaaccaaagtagaaggtcagtgcccaagagacaaataaacttaagcatgtccactctttttagcgatcggatcgcttatctgttcttatccattatggaacatgaacgatgttcctttaagactaccacattcaaacgaaaaataagtcatcgatgatagactggatagttatagtttgatgatctagctaattgactttcatatttacataaaacagaaatgtgtttttatcaaaaaagaaaaaagaaaaaacagaaaatgaacaatacatctcacatggagtttgtacaagaatccataataattttttgttcggtacagtaggttagatatacatttgaatacagtttacaagccaaatgttagaagcaacatatttatatagtatcatcaatatacgatccaaaatgaattatagattgacttatggaaaagttagatactatatgcatgattgccaaatacattgaaaaataacaatttaagttcttcaaacaaaagtttataaatgactcggtgtttgacataactcggggttgtttttctttgttaattcacacacggggttggtgtataaatgacttcggtgtttgaaatgtatgacacggtataaataaaaaaggtaaggaagaaatgaagaatagaagaagaacaaaaaaaaaaggaaattaaaaaaaagtcaaaataaatggtcagtaaaggattttgaccagaccggagcggtccatccatagtttcccactaccttccctgatttagcacagaagaatggcaatttgcatgccatttatttcatctattcctccttcactctataaatatattttaaacaaaatcaatttcttccatacacaaaaatcaaacaccttttgagagcggttattttttctctatcaactaatacagtaaccttacgggtgtttatttgtatagatctctgtggttttcttggccaaatctagtgagatctttttggtttctcgaattcgatgaaa

SEQ ID NO: 1679 - DNA, 3000 bp, Unknown
  misc_feature (1)..( 3000): cDNA_ID_2142421_gDNA_ID_1620434_Annot_ID_156945 3000 nt of promoter + ATG
aaacagactcccaacccgacaaagattggcttcttggggagtcatttcttctgccgattgttgtctctgttcctcattgcctgaaacccgtgaccaccttctgctggtgtgcgactactcatctcaaatttggtctctgatattcgcgaggttaactccctctcatcgcctcatatgtacttgggatgagcttctctcttggactagactttccaccaaccaagctccgtctttgctccgtaaagttgctgctcaagctgttgtgtaccacatttggcgtcaaagaaacaatgtgttacataatgatcacaggatccatccttctgctctctttaagatgattgatcgagaaatccgcaacaccatcacgggaagacgctctcggaagcgttggagaccactcatgcttctttggatcagataatttctatcatatttttcaaatattgtaaccttgtttttatttctttttgccaaggttactctagattaggtattgcttttgtaatacttccacttcatttttaatgatatttacaagtttagcaaaaaaaaaaaccccaacattttcttaacatttagatattctacgaaatgattccatataaaattgtatgggtttcttaaatttgtctttcacctcaagcatagaccttgtttcttctagcatgttctccagttgttcaacattggttaacagggttacaatctcgtggtgaggtgaacttgcgtcgctgacttgttcatgatgttgtggcattggttcattcccgacctcttggaattactgaacctctgcaaatggaattttataaagagtcacattaaacatcataatcattgttcatatgatgttattagttgattccaacatgataatgcaggcttataacaagaaataagtatgtaacatctgaaaaaataatgcaactttggatacaatccgcaacaaaaataataatcagaatatctacctttttcaagagcatcttgcaaggccaagaaaccgtcgatggcttctgttaatgaatccagttcctcggagtaacgattcgtcgtgtttatcgactctcctccttctcctctgattatcatttctctaaatccataccagctgaaaaaccaatccctgccacaaacctagaattataaccactactccctagtatatcaaatcatagaaatcaatctctcgtagatcagtgatcacatctccaaattggaacaaattttcacaaccaaattcttcggataatcaaaaacttaacatgttcactattcgcgaagattttttttttttttttaataagatttatcctttaaatcccactattaacaaaaaatctcattttttctttatttttgagattttctttaaggacctcatacctttagagaaccatgagagatataagatattgttagagttggacttagaatccgtccgtgtatattactggtttggattcggatttggttttgcttttttgattagtttctgttattttcttggatccgaacattagcctaagagtagggagttccttcccataaaagccgataaattgggacccatcgctaaagccacgtgaccacgattcctccgccagctcgcattgtctctccttgtggacctttctccaaaagtcgtccgtgttttttttctcttttttttttcttttctaattctgtgcaactgtgcattaagctttcagaaaaaaagaatgacactttttgtcaacgatcgtagccacaatttgcattcactgtttgttcactttcatatctaacatttctttaatttctcttttagtttttcactgcagtaattatttagttttttcatctgaatataaatataaatatacatatataaaaataagaaaataatatatatcatagccgtctttgcttcataattacgtcaacaacccatttttttggcggtgtctgttttcttacctaatcatatttaaataccaaactgacactataaacaattgtagtttagatgtaaacctttaaaccaatccgttggtcatagcttgtgagacataactccacaaaggtattgttagttgcaaatataaggaaaacgaattaaacttaaaacttacagttgtaatttaggtgaacacataattgctaaataaactctaaaaggaatgtattcaatcaaacattttaggtgatttgtatttaaataacaaattttatgttattcaattatggatttttgaaaatctcattagattagattctaaaatctatttaaaaatcattaaaaacattttaagaattaaatttttaatgactataagagacttaagtgaattttagtggatttccttagttaaaaatacagaatttgaaatttcatgagtttagatagaattttagaaaattttacaataaatcataacaacttcttaaaatttatccaaattcttgaaaattgtataaaaattcaaaataactcaaatcatttaaaatataagattgaatacgatctcctaaaactcttttatgtaataaattttacaatcatttggtatatgtgtacattacaacggcacatgcaataaagtaaagaatttgacctaattttctctctttgcttaaatattctcctccaccactttttgtcagaagtcacacttgaaagatagaaagagagaggagaggttagaaccgggaagagtgaaaggaaagtcacgtcggtccgttttataagaaaagaaagagatagtaaggactaaagagtgtagcctaagggaagttaaaacagagtgttattgtcgttgcggttaagctctctcctcgataaagttttttttttcttttacaaaattccatttctaccctttccttttttccaagtctctctctctgtccaaacacatcatcaaaccacatttgtctgtctgcctgcaacttcactgtctctctctctctctttctctcttcttcgattctagattacttcttcttcttcttcca

SEQ ID NO: 1680 - DNA, 3000 bp, Unknown
  misc_feature (1)..( 3000): cDNA_ID_2142393_gDNA_ID_1620434_Annot_ID_156940 3000 nt of promoter + ATG
aaaggagttccaataggcacgaccgatgttattattgcaacatatatatcaacaagaggaatgacaacgaaacaatgaaacaactacttttcgtattcctttttgtcgctgtttatgtaaagcaagtgacaattgacataggtctataggagactttagactttaatcaaatttgccaaagagcaatacaacataaatagtcaagccgattatcgaaccagagtagcatgaatattagcccagtgaagacgaaaagagattcgaatcggaattacgtgaatgtgatttcgaatgactctgacaatacgttttgacttgtgtagtttattgtatattcagtttaactctgtcacccgccgtgttcaaccttgctggttcagagttccacaggtaagtttttcataattttctcacgctgcagtccacttgagtagtactctaacacaatgttacaggttggtatggttgccatcaacgatgggattctacttcgtaatcacatccacaggattctcaaagcatttccgtgaaaagccttactatcttgacctagttgatttgttaggatatgaaattcactgatccataaaaaaaaacataggggtacgtttagaagaatacataaagtatagggactgaagctgcaaatttatgttctcagtagatgttcgatctttggacagaattgaagaaaggagaaaccctagactgagtctggttacttgaaggggatcatgtgaatacgtcgactggtaaagaaagaaagattgctgctttttagatttagattcgagaatgtatggaagatctggtcttgacaggtttaagaagtcccaaacttcggaacccttctctgtatcagcaaatcctcctccggtggtacaacaacatctgtctccggaggcattgtcggggcaaaaaactcagattggagctggtcaatcaaactggcatccccctgattgggcgattgagcctcgtgccggtgtctactctctggaagttgtgaaagacggccagatccttgatcggattcatctagatagacgaaggcatatcttcgggagacaacatcagacttgtgattttgtccttgatcatcagtctgtttcccgccagcatgccgcagttgttcctcacaagaatggcaggtttgtcatcgctactcaattctctcatcacagctttggccactgttgacatgagtcttttttattttttgtagcatctttgtgattgacttgggatcagctcatggtacgtttgttgcaaatgagaggttgactaaagatactcctgtagagcttgaagtgggtcaatccttacgatttgctgcctccacaagaatctaccttctgagaaagaacagtgaggctctcttttctcgccctccacctccagctgagattaagcttcctccacctcctgatgcttctgatgaggaagctgttgttgcttacaataccttgctgaatcgatatggtttaagcaatggagaatctggtggtatgttagggaaaaggaaagagaagaccggatcagaagcgggagtggctaagaggatgaagaaagtgagagtgagcttcagggatcaactaggaggagagctggctgagattgttggcatgtctgatggagcagacgtggaaacagagcctggtcctataaatgtcaaagaaggaagcctcgttgggaaatatgaatcactggtgcgagtgacactcatacccaaaggcaaagtgaaggaagagaaagcctttacaggaggaacaagaggaggtgtaacagatcgactccaggaagctatgaatatgttgaaacggggtccaaaaacagggatttacgatgacctttacggtggtgactcacttgccaaggctgttggtacgtcatgggcttctgtgagtcaaccagcagctgaaactgaatgtggaggggttggtgaagaagatgataacgacgatctgtttggtgactaactgattttgaacactgagattcctttaagtaactcttcttcttctctaatgcctacattccattccaaaggcattggtatgttgtttcctctttgtctatccaatggctgcagcaagaaaagagagcagctctaagcccaggcccattgtcttgtgttataagtaagaaccctgaaatttgatatgagcttgagcctggtcagtggtcattctagttgtgggtcttaacaggagatgcattacatagatagtcattacaaatagtgtggagagtagagagtagggccaatgcaaatggagtgcatttgattagaccactactgacttacagattctctcctcaaggcagaccaattccatcagaagaggacatttgtactcaaatacctctcctctcattctttttcacttttgcctttttgcattattaaaacagcacactaatgatgtgggttgacttccctctcccccacaaaaacagagattccatggggggaaatggacaacaagtaaaacacttgtaaaaatggtaatctgcctctgatgctttaagatatgatttggggatcaatgcatctttgctttgggatttgctttgtgacagttagtataaagaagagagaagctgaatgtgctgcaaccaaattaaaactctcttttgagttaagcctatatccaactcctactcttcctagtgtggtccattgtatttatcataagagtaaactcgcttgtaataaattatagtagggaaaggtggaagacccacttttgtttctcactttctttctgtttggtgagaagttgttttccttatgcaaaagatggaatgcatgaaggacacttgtgtctggctttttatttattttggttgtggatactttcatgatatactttacgacctcaaccctttaataccacacaatctacctccattcatcttttctcttctcttaattttcaccttatctcccaacgagaccatagaggagttactgactccaacttatagctactagct

SEQ ID NO: 1681 - DNA, 3000 bp, Unknown
  misc_feature (1)..( 3000): cDNA_ID_3063698_gDNA_ID_1620434_Annot_ID_156937 3000 nt of promoter + ATG
aaaaagtgagaaagaatagttaattcctgaatttcttagaaaagacaaatgttatgcaaatgatgatagattatgttttaatttcacggtgcagacaaactagacatctgtgttagtaaagcatcaatggctttgagaagaaagagagaacaaggcatgctaaaagcaaatattaggacaagtatttgatttgtactctcttccctcattatgttcctttgcaaagacacagcagaaacatccaaagtgaagatgagtttcatcatcacttgcaggggagcggaatattcgctgacaatcacatcacatgccgtttggattggaacctttttttattaacttaagtcgagagctctgtgttcctcgatttacatttttggtttctattatcaatacgcatcacatgtttctggactaagcagggctataaaggctaatactagtaataaacaatggaaccagcctgtgcttttggactttccccatgataatcttactatttgcttattaccattctttcaactcttcatcgacttctcaaatcctttattcagcaacataacaaaatgaaatcatgttttctgatgcttcatcagattactaaccaagacaaagaatcagaaaaatttcatcttgcaacaggacgtaaatcactgttccaaagtgtaaagcaagatgatgaatgatgatgcccttacttactagggggactccatcagttttatgatatcagagactgtgcttgtgtaatagtctggttctatcttgttgcccttatctagtagattagattcacttgtcacccctgttttgacatacccaatcactgtcagttcaccccaacactgtccagatatcgacttgtattggcttgcaaaaactcaaaagagtatcaaacagttaatgataatgacctgttaggacgaggagagttttgcagccagcattctgcccaaacaagatatcagtatctagcctatcacctaccatgcacattcttgacgtttccgtcccaaatctgcaacacaagaaatacacctctttatcactctatcctgtataatgcacactatgaactgagacaggctttcatgtgcacatacttttgtagcagaaagtccatcatgaaagtagatggtttcccaacaactattggttctctttcagtcgatccacacatggcagcaaccatacacccagcacctagaattacgagtaagaatttgatgctgtgacaaccaagctgctattctgggcaatgaggcctaagagtctagtgaccataccaggccactcttgcagatccgtcatatgtcctactgcatcacggttggtcgcaatgaagagacatcccggattctcgcgtacacagagagtcccgtacctgccatttccgttattgtgttagccaaaactctcagaaactcaattaaggcaaccgacttgcatgcaatagtaatccatcttactgaagcttatagtagttaatgttggggtctagtccaactacaactgctcccacctgtcacaggaagtcatgaagaaatatacaacattagaacctagagcaaaagagaataagaaaaacgcaagattggagaaggaatcaaagtcttatggcccattacacttttatcatgttcaaagagagagtttgatttccattgtgccttcttttcaccatcttcctgcatggaagcaaatactgcttcagatagacagaggaattcaaattatacaattttggttggtttaaaaacacaggagcagtaagtatcaaacatcttgtacaatgatatgagtcctcagagtgaccaaaacatgacctgatcaaaacatataacaaaaggaagactacttacaggaccaccaagacctgtaaaaccggcaatctgcagctcctcaagaacaccctctccaccaatcacataaacctacaaaagcaaacacgaaaggaaaaaaaagtgagaaaaagatgacgatagagagacataagccaatgtgtcagtcgaagtagaaccttcttgtccttaggaaagttattgactttgagatacatagctgccgcaaatgacgaagagaagatctcatccttccaaagtaatcacatttttttgttttagttttaatggtaatcacaagtaatacgaagaaggagaactcaaagtttacctgagtaatagaagtgacacccaaagatcggaacttttcagcgtattgcctcctcgattttacggaattgttggtcacaaagacaacatttttaccctgaaaatcgcaaaagatcagagagagagagactgaaaaggaatagagagtggggaaaagggaaagcaccttagaacggataaggtcgagagtttgggagacgccatcgatgagcgtttcacccttccatataacacctgaatcgaatcatcatccatcatcagagtagtaactaaagaggataacaatcgaatggaagaaagtagaatctaccatcgcagtcgaagaggaacgtatcgacagagtcaaagagagatttgaagttactggaggagagaagctgaggcgccattggaggagtgtcttcttcttcttcttctgggaattgatcactctggtaaagcacaattggcacgtccaaaacgacaccgttccatcgaaagaggccacattgtgattggtgagcccaattaggaaggcctattttactaatgttgaagcacatgttgtactataaaaaaacagagtttattatctgtttctttggcttgacatgacaaatgtacaactgggagagaaagtcagtccgattgtgttggggatgacgatggcaaaagtagtaaataaggaagaaacaggaggggcgttttcgggagaagaaggaggaatatgagtgtgagttgttgttgtaggaatctgggcaagacaataaaaaaggcaataccttcacatcatttgcatctgagaagtcttggtgggagtctctatcgtcgtcgtatccaaagctcttca

SEQ ID NO: 1682 - DNA, 3000 bp, Unknown
  misc_feature (1)..( 3000): cDNA_ID_2142367_gDNA_ID_1620434_Annot_ID_156932 3000 nt of promoter + ATG
tttgccgctgcactattggggacttagctgggctgctctccatcatcgtctgctccatatttatctctttcccttggcatatgactttaacctcacacacgtctgctgcggagctcctcattatcagttcagggacactgtttcctttcattgtggatgctttcctacaaaaagccataaagagagaacggtgtcttgtcatctgacaactgaaaaagttgtgtggttcatctttgtgtatatatatatacctagcattagacttgtcgatcccaagaacaagcttcctaatgttaagaatggtaatgaggtcttgtacagccttagcgaccgagtcactctcaaccagtattgtctccaccttcacctgttcctcactttctcatatgttagctaactatcttgatccactcttaaccatccaaacaacaccaaaagagagaaagagagagagatgggaccttagaagcagagcaggcatgaaggaacttgagcaacagagttcttctcttttccctttcctgagacataaagctttctacttgttcttgacttgctctctccctcgttatcctccccactacacgaatcatacatacacttgagtgcggacgcacatttaatcaaagttaacaaatggacgagaggatatatacagacaggggtaaggaatgaagcgagtctcagggaagacatggatgaggaaaagaagagtagaagaagaagtcattaggttgtcaatagcccaacgcaatgcctccatacttgagtctcctttcccaaccccaacatagacgttgtcctctccgttcatggacactgttccgctgcttctcccttccaactggctctctctcacgctctccagtcttctccttccatcttcttgttcctcctcctcctctatctcattgctcctccgttgcatttcaagttttcttctcgttgactttttttgctcttcttttgccctctctgcctcatcaaaccgtactcctttcttttaatatttatatgcaatgaacatgtgcttgtggaatgtatgacctgattttggtgttttttgcgtgtgaggtttatgaaagcctgaacttttcaagacattgaaccttttacatatcatgacgatttccataaacaaggtttatccacccacgtatgtgtcaacttataataaaataaattgcgtaaagtaaacaaaatttgattataaatgtgcatcatccaactttgcaaaaatatacatatagtttttgtggtcaagaatttgaaactattgatgggtcaacgtcctttgctctttgtgtattggcaactgtttaagcataaacaatcaaagatgcatatgtcatatgtgtacaaggtcgaatatccgaatctcaagcaggaatctttatatttaataatcaaaagtcaaacacacaaaaattgcaacaacaaagcctttgtacatcagcagctattgtgctttgtctcttacatttaagaatccttccatgtttagtttttgacatggtgggaaccggaaagattcaagcctttaatagatcgttttgacccaaagatgaaagctagcatctttaggttatgggcaaagtgttcggctagttttgtgtttgctcttagttttaggcccaaatgagaagtggcccacccagtctgtttctctgtccatgatttatactcacattcaatggccacaactagaacaaagatcgatcaaagaagcaaagcaaatagctaaaaaccaaagttgttgtgtctattgaatggcaaatcaaagagacttttttgtgtgatagcctgataggcctgttttgccatacaaagatgttgacttttgaataaccataaagcaactcatccatgtcatctccggcccctagattatctcttcggatgttgtgttatttgttaaaaaaaaagattagatgactttaatcaaatcattgaaagtaaacaaatgaaggatattgctagagagttttttacaatcttgttaattaattttttataatattgtaaagtttctaaacaaaatctctattttgataatacttttcatgattttattttgtaaagaaaagtgtagaatgtcatgaaccaataacataataatttaattcattaacaatcacaattttattgttttaattgaataacacaaaacttttactaactttataaaagtacaaaaccaataaccctaaatttatgaagattttaaattattttttataaattttaaataaataacaaaagactttaacaaatttttaaaaaatcttgattgaataacataacagattctagataacactttaaatcactaaatttattttgaaatcccaaactaataacaccctctaataaaccacttaaaaagtaattaaaacgtttctaaaaaaaaagacaactttgaatatttgacccaaaaagcagtaaagaaaaaacaaaaagagaccaactttgaataccattatttatcttttgacaaggctcaccaaatcagctaccaagttcatacatggtacaaagctttagcaagttgtcgaatttcatcctacaattgaattttctctttactatttcaaagtttgaatgctcctctgttttcttcgttggttcattgagaaaaaaggaacagactttttacttgtgccattgaccaagaaccacaaagaggaggaaatcaaatggtttttgggagtttgatggattgattgattattcagcaaatcccacagaagaaatcagaagctgcttcttattttttggtcacgaccagtcttaatcaaagtagttcgtctcctacttgttattaaaagtgtatatttctgttgggagtttctgttctcctaccacctcattgacctttaatgatggactcatagtttggtgccaagtgacccaaaaaaaaaaaaaaaaaagtcgatcttgaagatttcatactttttctggcaattctgtttggtttcagaggaaggagtcaaaacaatg

SEQ ID NO: 1683 - DNA, 3000 bp, Unknown
  misc_feature (1)..( 3000): cDNA_ID_3063702_gDNA_ID_1620434_Annot_ID_156936 3000 nt of promoter + ATG
caagagagagaccgagccattaaatctcccatctttctttttcttgtttctagtgtgtgagtgaaaaaccaattgctgctagctggatgatgatggtggtcgttgaggataagacgcttttacccttcacagccattatttataaataaactctagttgttgtattaaattaagcgacaaggtgacgtgtcgaggcctgcgcttgaagctttattttcttgcctttggaatggaatgtaggcattagagaagaagaagagttgcttaaatctcagtgttataaaatcaatgtatgtatcgagttatcttcttctgttggtcaatattatgtatgtagtcacaggcatcaaccaacaagaatctcaaattcatataactgatgaaagaagaagatcatagtcatgaaacaaatacaattgtaacacaagaataaaagtgaggcaggtttattattccccctgaaaatcagagcacttaacagaattacacaaatcaccaaccaagaatcaaagacataacaggaaatttttgagggctgagacttatgtttgtctgtctctactacttctgcctcttgtagatcttagccaagaaggattttagcactgcttggattgctttactttggtgtccctcaatcgctccagtcagcttctcgtagcttttgctctcatactccatgaaaactccctatcatgttcagatcaaaccatgtccaattagcaaaaatgttagttgtgtattacaacatcatatctctgaggttcgctacaaacctcaagatccagctctttgtagagatccttcactttagcaacgttcgatgggtcgggtttaccatagttctcctagtaaatcagaacaaaacatgtttcaggttccaaacaggatacaaacctttttgatcaagatgatatggttcttacatataatatcttagtttgttcttcgctgcagcgctctaatgccttaaccaccaaccacgagcatttgaaatcttctatatctgttcctatctgcattataaaaaaccaatatgctgaaccaagtgaatacattcacatcagcctgagaaaccaagtgttagcacgagtgaaaccttgccaagcgtctcgggatcagcaaaacaatccagataatcatcctacacaaaagaatggttatcaacatcccaacactacctatcatatagctctcatgaatacttaacagcaatctacctgcacttggaagtagattcccatgtcaacaagaacattcttcacatcaatatggttttccaaattttcgccggccataagcaacgcacaagcaacctgaatagaaaaacacagcttgtcacgggatctacaattgcaatgatggagacaaaaggaataacatgattgtttttgaccccaaatatgactagggaagaagagaatccatactcacagggagataaaatgagtaataagccgttttgtactggacaatacgacggtggctgcaagttgaaaaccattgcatcaggtcagaatactgcctttcatctaatcaaccatcagaagaaaccgtatctaaaatttagacaatgcccacagttgactcacattgacaatgagtacttggccaaatccttttctccttcaaaggtggtgatcaaatctatcatctggccacaagctgtttgcaactcaacctagacagcaaatggaataatagactgaggataaaatatcaaaagtggaaaagagaatagtagatctgccaaaacagattacctcattaaacaaatcaacaaggtcaacatagtaaggcttatcacggaaatgctttttgagaatcctgtggatgtgattgcgaagtagaatcccatcattgatggcaaccataccaacctgtaacattgtgttagaatagtctagtggactgcagcgtgacaaaaaatatgaaaactttacctgaggaactctgaaccagcaaggttgaccacggcgagtgacagagttatccataatatcatcaagcacaaggaaataagcttggagctgcaaagataatgaatatgatgagtgatagcgacataaagagagagagaggagagtatctattactaatagagattgaaaggataagtctttatcattggtatacccattcaatgcaccaaccgagagcacaagagaggaaaacctcttgctcagtcaaatcattgccttgcttcaaaagtttgaaactgtcaacaacagagagaccccgattgagtttccctggagaagaagaagtaagtgtgagaaaaaaaaaggagatcgatgaaaagcgagagagagagagagaaagaggctgttgtagacaagtctgacctccacgtacattgtagtccagcatctgcaaagaaagagagaatcagccagcattcgaaggatatatatgtgggatctgactgatgagagagagatacccgatcaacccagagacgagattcattggtgaattcgaaggaagggtcatgaagaaggtcagacttgagaacagaataaacgttgagaaaggttgacttgagatcggtctccattgaagagctttggatacgacgacgatagagactcccaccaagacttctcagatgcaaatgatgtgaaggtattgccttttttattgtcttgcccagattcctacaacaacaactcacactcatattcctccttcttctcccgaaaacgcccctcctgtttcttccttatttactacttttgccatcgtcatccccaacacaatcggactgactttctctcccagttgtacatttgtcatgtcaagccaaagaaacagataataaactctgtttttttatagtacaacatgtgcttcaacattagtaaaataggccttcctaattgggctcaccaatcacaatgtggcctctttcgatggaacggtgtcgttttggacgtgccaattgtgctttaccagagtgatcaattcccagaagaagaagaagaagacactcctccaatg

SEQ ID NO: 1684 - DNA, 3000 bp, Unknown
  misc_feature (1)..( 3000): cDNA_ID_2142375_gDNA_ID_1620434_Annot_ID_156935 3000 nt of promoter + ATG
agttactactctgatgatggatgatgattcgattcaggtgttatatggaagggtgaaacgctcatcgatggcgtctcccaaactctcgaccttatccgttctaaggtgctttcccttttccccactctctattccttttcagtctctctctctctgatcttttgcgattttcagggtaaaaatgttgtctttgtgaccaacaattccgtaaaatcgaggaggcaatacgctgaaaagttccgatctttgggtgtcacttctattactcaggtaaactttgagttctccttcttcgtattacttgtgattaccattaaaactaaaacaaaaaaatgtgattactttggaaggatgagatcttctcttcgtcatttgcggcagctatgtatctcaaagtcaataactttcctaaggacaagaaggttctacttcgactgacacattggcttatgtctctctatcgtcatctttttctcacttttttttcctttcgtgtttgcttttgtaggtttatgtgattggtggagagggtgttcttgaggagctgcagattgccggttttacaggtcttggtggtcctgtaagtagtcttccttttgttatatgttttgatcaggtcatgttttggtcactctgaggactcatatcattgtacaagatgtttgatacttactgctcctgtgtttttaaaccaaccaaaattgtataatttgaattcctctgtctatctgaagcagtatttgcttccatgcaggaagatggtgaaaagaaggcacaatggaaatcaaactctctctttgaacatgataaaagtgtaatgggccataagactttgattccttctccaatcttgcgtttttcttattctcttttgctctaggttctaatgttgtatatttcttcatgacttcctgtgacaggtgggagcagttgtagttggactagaccccaacattaactactataagcttcagtaagatggattactattgcatgcaagtcggttgccttaattgagtttctgagagttttggctaacacaataacggaaatggcaggtacgggactctctgtgtacgcgagaatccgggatgtctcttcattgcgaccaaccgtgatgcagtaggacatatgacggatctgcaagagtggcctggtatggtcactagactcttaggcctcattgcccagaatagcagcttggttgtcacagcatcaaattcttactcgtaattctaggtgctgggtgtatggttgctgccatgtgtggatcgactgaaagagaaccaatagttgttgggaaaccatctactttcatgatggactttctgctacaaaagtatgtgcacatgaaagcctgtctcagttcatagtgtgcattatacaggatagagtgataaagaggtgtatttcttgtgttgcagatttgggacggaaacgtcaagaatgtgcatggtaggtgataggctagatactgatatcttgtttgggcagaatgctggctgcaaaactctcctcgtcctaacaggtcattatcattaactgtttgatactcttttgagtttttgcaagccaatacaagtcgatatctggacagtgttggggtgaactgacagtgattgggtatgtcaaaacaggggtgacaagtgaatctaatctactagataagggcaacaagatagaaccagactattacacaagcacagtctctgatatcataaaactgatggagtccccctagtaagtaagggcatcatcattcatcatcttgctttacactttggaacagtgatttacgtcctgttgcaagatgaaatttttctgattctttgtcttggttagtaatctgatgaagcatcagaaaacatgatttcattttgttatgttgctgaataaaggatttgagaagtcgatgaagagttgaaagaatggtaataagcaaatagtaagattatcatggggaaagtccaaaagcacaggctggttccattgtttattactagtattagcctttatagccctgcttagtccagaaacatgtgatgcgtattgataatagaaaccaaaaatgtaaatcgaggaacacagagctctcgacttaagttaataaaaaaaggttccaatccaaacggcatgtgatgtgattgtcagcgaatattccgctcccctgcaagtgatgatgaaactcatcttcactttggatgtttctgctgtgtctttgcaaaggaacataatgagggaagagagtacaaatcaaatacttgtcctaatatttgcttttagcatgccttgttctctctttcttctcaaagccattgatgctttactaacacagatgtctagtttgtctgcaccgtgaaattaaaacataatctatcatcatttgcataacatttgtcttttctaagaaattcaggaattaactattctttctcacttttttttttttttttttgtttgaaatcgagatggcattaaagtccattattttttactattataaacaaaaacaaagcgaaaggtgttgttggctgtgactggatcctccccctttcttccgggttcttgtcgtgcgtatccggcgaaatgagaagtgtgtagagcaaacagaggtgaagctgagaagttgatcactcactcaatctaagagtgcatgtaattgaagcagcaaccatttctacttttcgaatcttctctgcttcaatccacacccaaggtatctatctccttcctcctctctcttcttttctagggtttctccctaaagttactgcctttaccttgtttccagatctctctctcctcttattcttctcattttagatcttcttccatctgaaatcacgtttctcccatttgggatctgcttttttacttcaacatcaaagacattagttttctgctgtttgatctctgtgccctgtgtgtatgatcttactagggtttcaaggaatatgggtctttcccgttagctaaagataattaattttgtgtccgatg

SEQ ID NO: 1685 - DNA, 3000 bp, Unknown
  misc_feature (1)..( 3000): cDNA_ID_2142244_gDNA_ID_1620435_Annot_ID_156981 3000 nt of promoter + ATG
cctgatagcttatcattctcagaataagcatagaagattccattgcatataatcccacaacttacaaccccaaaacccatcgggagtctctgcatttctgaccatgtgtttgttgctgagtcgtatatttcacctgaatccagtggctcatcgaataagccagtgcctcctatggcaatgagcacaaatctcttggagctgtttcggttaagccgatcaagcttttgtcttattaatctgtgggatttggttccattttgatcagccgagtttctgttctgtcgtcttaccgatagcctgtgagggtcttcataaacgtctgactctccgccaactcttgacaggtgaaagcgtctatcttggcgattctgtttggtctgcatggtcgaaaactctgaagtaacttcagtggcaccaacaatgggaagtgatctagcatgtctcatagacgcaattttacgccatgctttgatcgaagggctgaataccaagatccctctgtgggacttgaaagagtttctgtccatagaacgacctccaactatataaatctcctcatggatgctcgtcacagagtacataaaccggcctttaagtagatcagtttcaatcctatgccatttgtcctgagaaacatcatacccgtgaatatcaccagaggagcatccatctttaagagcagcaaacagaaacaaccacggtgtttgaaaggagccttctcgtctcatctggagaaaccgctgagtgttggccatggattgccatttcttgcaaacaaggtgtgcattcaataagctggtcaaaggaagcctcatcaaacacatttccagaatatcatcgggaagataaacgtgcttgcggtaatcctggcccgagtctgctagatattttctattattcttcttccagaacctctctctaaccccataagaaaaacaatctaacctagtttcttcagttccacaaattgtcatcaatcccttaccctcctcactagcactagaccatctcttattacttgaatcctcaaaatcctcacccgtatcagcaactctgcaaccaacactgatacttaaacaattcaccgctccccttgcaatctcttcatcttccaccacctcagttttatgaatctttttcttcaacttctggctaacacttttcacaagcctccttgacacggttaaaacctccagatcctgccgtatagactcctccactcccaatggtttctcagaaatcatcatccgtcatctaacaaacttcacgccaagagaagcaacctgcaaatgcagatcacaattacgattcacagaaatcaaatttgatagcaccaagaaaagagcaagtggacacaacaaaaacaataaatttgtccaaaatgtaaataactgaagctgatgatcaaaaagcatttgtgtgagatcatccacattatagcgagatccacttattctataaaccagttaatgagagattaaacatgtaaaagcaaactctaactccaatattccgacaaagtaacctgttcattaccagctccagaaactacaaatctgaatcgtagcaccaaactacaagtagtttttgaaatttcgcttctgaaagtaaccaaatcgaagaactcacttacattgagcaaactccggagattcgaaacgagattcatacatagacagagttgtttctccaaatccaaagcagattttagaaatcaccgaagaaaattgagaattcgaagacctaaaaggctaaaaaggaaggaacaatttcgctttcccttttcgttttattttaatttttaagtcatgtaggagacaggagagactgaattgttgtctttctcgcaaataaaagaagaagaaaaataaagaggtgctaagatgtaattttgctaagtaatttgtaattagcatatcacaaaaatagtataagataaaaaataatttgggcttgaaatttagtaatacagcaaatatttagaaattaatacttaataaattgatatattaataaacacaataaaataaatattgtaaatcagctattgacatatagttgaaatatgaaaattttacaatatatttagttatgaaaatcttggactgagataaatcctactaattgtgaaatttttgacagagaaatcctactagtaatcttggacagaacaatcctactattttgaaaatcttggactgagaaatttcatctttcaaatggatgttctcatttaggctactaagaatttcggagaagaattgggcagaagcagttttgatatttgtactagtttttattcactaaattaaaacaataatttatatgtctatatctaaaaagattaattttactattcttaacaaaaattgacaaaaaataataattaaaatgtcttattggtcaattaaatatagcatgtattaactttaagaaaaccatttagtatgattacaactaattaaaaagccattgaacgagtggttggattgaaattgaaccaaccaatacctcaatcttttgtctgtctccttattgctttattatttattaagcttccgcactatttcaatatctattatttctcaaaattctacactaactattagtaaatccatgttatataacagaacaaaaaacattctgaccaaaatttggttagtttatacaaaaacaaaaaaaatagtaaaatcataagagggtggtcgaatttgaggaagatgatgaaaatgaatttttatttattgattttttttttttgatatccataggagaagcactcttttaggatatatgtcctgtcccgcaaaaatctgatttgtgagaatcacatttcaaaaaaagttgggtgagaagaaaaacaaatcttttttttcttttgtctctaaaaatgaaacaagagaaaattaatcttacaatttccttaacgtttgctttttccttcaacatctttggaatcaattcaaacgcgatagagagtctctaatggtcgatgtgatg

SEQ ID NO: 1686 - DNA, 3000 bp, Unknown
  misc_feature (1)..( 3000): cDNA_ID_3063758_gDNA_ID_1620435_Annot_ID_156988 3000 nt of promoter + ATG
attctctttcaaattttaaactcgattttttacatttaccgaaaacctaatatttctttgttaaaaagataaatattggtcagttttttttaaaaaattgttttttgaaatctaaaaacccaacgatataatgctgaaattatcatttggatagatttgggactctaaacatttgtaaatatttttgatagcattaatataaaatctgtatcaaaatttaagagttaaaaaaaaaaaagacacgaagttggattcaaagtcgaagattcgtccccatttcttaacgaaaaataatgggagcttaagtgtttgaagatgtttgatagtgatacggaaatcaacgtggaattgcgtcctacgaggacaattcttttgtgaagctgaagaatattttaattactaggaaaataattgggatgtttcggtgatgttttcctcaccagatttgatgtttgtcggcggtgaaagttgatatcggtatattttgatgactcttcatcttgtgttgcagttgtaatatcatgtagacagttgtattggataaagtcaaaatgtcaaaacatctctatgcctaacttttatttctccacaaatcggtgtagattttaaagtcttgtttctcttttagtgggttagccaagcaaaatttttttttatttttggtgggttacttcataatacacttatcaactctagctaggtcgatgaggctttctgtgtggtagctcggcatcggcgatcagataattagagttgatagagacattatcggaggctgtggcacaagagcaaacaagggcaactggctgcaataccatttaaagagagtgacgggatccaggatggagaaggctagatggatcagggttaaccctttcgctgccatcttcgtcaccggttcgagccatgctgaaatctggtgaggttgttggtcgactaggatcacgaaacaactagattcatagatctggacgcatgtgtgagattaagctcaagttcacgcatttttacaaatttgactttgaggaatcttggcatggtggatcaagtttcatcgaaaacaactatcagtctagaggacccgcgcgaatataagattctggaaagtttgataaaaggatatccaaccactataaaccaaagcaaaggaagaacgtcgtggtggtcgggaaggtgacaaaaaagaacaaaaagtttgcgaaaagtggaatagagacaagagactaaaagatggatagatacatctttacgccggcgagcaaagactccaccagtattgaaaaactggttcatgcggctgtcctcgattattgaacctgcgtgagagagttttttttagctcaatacaaaagtagatggttaatattttattcgaccactaaattattaagctgaaaaataactcgagtgaaaaatatgacacatatcaattacttttataatgtattgataagaaagattaaaatatgaaaatcaaatatactcaattgctataaatcttttaccaactaacaaaggttgaagaatgaaaactaaaatctaatttgacatagttaaaagatataaaaacgataatatgaatattagattatttaaataccttataaaaataaaattttataaatgattggatcgagtctccccgtagtgattactatccaaaagtatctataaactttataaacttttcatattcaattagggacatttttgaaaatagacaactcaatggagcatttttgaataatgggacatcaaaagaggcatttcaataatttcaaaaaatattacttctaatttaaaatattaaaaatgatctcacatgttccttgttaaaaagaaattcaaatacacaatattaaatttattttagttttcatatattttattagaaaaataaaattaaaatgaataataggaaattttagattaaatcatgacacatgcatgttgcaatgtaaaattagaaacactatgatatatgaatcttatatagaatctaaaaaaatatgaaaataaaaataaaaattattagaattaattaaaataaaatagaaaattataaacacgattatatatgaatctacgataatgcaaaaataaaaaatggaaaaatgaaaaaagtaagaaatttaaaatatacaataatatattaagttaaatatttacaaaaggaagaagtatatattgatgccatataattctaattgtaaaaaaatcaaataaacaacatgcaaacttaattgaaatcttcacatattcttaactgaccaaaaattatagaagtatatcatataaaattttaaattcaatcatgatatatgacaaaattaaatcatgatacgtaccactatactattaattagtaactttttgaataataaaaaaataagtaagtaattgctaaaaacattgtagatcatcccacagcttttttcaacgaaccctaattgttattcttttcttatttcctttttcaatttgttgataagagaaacttcttcgtcttctatgtcttcttcttctatgtcttcttatcaatttcagttcaatttgatcacagtgtcatcgcttccttgagcttgcttcacttccctgaaaattttggtaggtgtgttcttttttcctaccgtactgtttctcccgaggtctgatgtttttcctttgtgtgtgttcacgtatctggttctctgttcgattcaatgttacagcttctgggtatcatgcatattgtcttctttaagaaattaggtttaagaaagactcgatttttttgctctgtagacaaacttggcgatcgtctttgctcccagatttcataaatgtgtagtctttcttagtgtttctctctgtaatgatttgggtactgtctcaaatttaatgacattgctttaaacccagtctaaaaattgaatatttgagaaagcttgtatttttattgaagtttaatgatcatgttttttcgtgtagagaagatatctcgagtttatctgtgtcatg

SEQ ID NO: 1687 - DNA, 3000 bp, Unknown
  misc_feature (1)..( 3000): cDNA_ID_2142320_gDNA_ID_1620435_Annot_ID_156998 3000 nt of promoter + ATG
aaaaccaaaattactaaaacagaaaaagtatatgaactattatttaaagttcaaatatcatcaataatatagagtgtataatttaacttcggcttactataaaaacatagatagttaaagtgtataagaaaataaaattataaattttgaaattcgattcaaaacatatttactaaattaaatattaaaaaataaaaattacaatttactattaaaaattcaaatatcatcaataaaaacttataatcagcatgcctcagtctcagataagaaccacaaaaatgaaatcgtttcttgctaaaaaagaaacatcgaaagcccacgaatggcccagtgggtttctatgtgtttcaatagcccacgaaagcacctctactacaattatattcaccagcctaatattcaacaatgacgataatgtcagatcttccacgggatttgttagcggagattctcagtagggttccgttgacatctctaagagcagtgcgattgacttgcaaaaagtggaacgatttatccaaagatcggagctttctcaagaagcaaatcgtcgaaacaaagaagaagcaattggaatcgaaggagattgaggtgatcatgatgaggaattttagggtttatctaacaagcatcgatatccacaacaatgttgatccatcatttacgcctaaaggtacacttattagcttaagcgatgatgcaaaccatcatcaagtcgataatgtatctagagtctttcactgcgatggtttactattatgcatcaccaaagacctccactataggcttgtggtttggaacccttattttggtcaaacaagatggatccaacccagaaattcttaccacagaaaggacaattacgctcttgggtacgatgagaagaagaaccacaaaatcctgagattgaaggataattattacgctccacgggaacggatttgtgagtttgaactctacagttttgagtctaattcatggaaggttgtacttgatgtcagtcctgactggtatataccttcttataaccgtggcttgtctctaaaggggaatacttactggtatgcaacagagaagcatgtcaatgttgatttcttgatttgtttcgatttcacaacagagaaatttggaccgcgtttgcctctgccttttaacgctaccgagtctcctacttatgaagatgttgttactctctctagtgttggagaagagcagcttgcggtgttgtttcagagtgagtatacattgatgatggagatttgggttacgagcaaggttgagtccacagaggttttgtggaacaaattgttcttagaggttgatttgatagcaatcagctctcactttcagtttctggcagaggctgggagtttcttcattgaccagaagaagaatgttgttgtggtttttgataaagatatggatgaggctaccgatcgcgacatggcttacgttgttgggaagaacggatacttcaaaaaagtggatattggggaagaagcatacacgagttgtttcccacttgtatgttcttatgttccaagctcagagcaaatcaggcagctaacctgattattacgaactactgttttctttttctgtcatcttcgattgtataaatctgaccattgttatcagttatctggaatctcagagacatggcctctctactatatgtaaactctcgtgtggctcttctagacatttctttgaaacagtcaaatgcatcttcaactttacgtttgagagctttttttaccattgctagtatatatatgtgaaaaataaaggttgtaagaaaataaaataataaaagattaattgtcaggtctcatatttcttcatcacgcacatactttttttatttcttttattgtaaagggtaaaatcacatgttcactattaacttaccactaaaatgcggtagttttggatagatattgtagaatgtagtagatttagaaagggttttccaaaatgtggtagattcaacaaaatttctttttttttaaaaaaaaaaatctaccacattcgagagttgatactttgttagctttgctttgtattgataattttttttttttttttaattgataaaaagaaaactagatattgacattcggatttcggatcggatttgaatcgaagtttttcggattcagataatttggatgggaaagtttattatccattcggattttatgactattcggtttggatgatgttggattcagatcggttttaggaaaaaaaattggttaaattttacaaaaatttggttaaattttacaaaaaattgtataattgtaacaaatatgactaaattgttttggatatctaggttatttcggatattttttggtataaaattataactaaatataactaatattttttaaaattataactaaatatcataatatttttagaggtataattttattttgggttatcgaatatccgtttggtttttggttcgaatcagattcggttcgaataattcggatagaagaagtcattacccatttggagttttgtgattattcgatttggtttcaaaaccggatttttggatctgtttcatattgatttttggatttcggattttatgtctactcctaaaaaaacccatgtagttttcgttttaagtgtagaatttatcttttggttgtaagttatatctagtctatcttttgggacgtttggtttcccatgtttggattgtttgttgtaagtcctatgtacaactccatcttctatcgagaatcttttagaaggaaaaaaaaaactcgtatttacgaaatttgacagtagaaaacaaaaacctaagtacaattcaaattgacaaaaaaaaaaaaaaagtaaaaattcttaaaaggggactacagtaaaaattcatgttaaatctaactgctcgaacgttccagtttccaccacccggcgcgtgagtagtaccaccgtcgtcactttcacaatctcccaacagagatccttccc

SEQ ID NO: 1688 - DNA, 3000 bp, Unknown
  misc_feature (1)..( 3000): cDNA_ID_2142328_gDNA_ID_1620435_Annot_ID_157000 3000 nt of promoter + ATG
taataaaaacttgaccaactaaaccaaacaattagttaatctttttaaaaaatggtgtgttttacgcatgggtggaatcatttgtaattgaataattggcgtggttccaaacagaagccgtctcaaaaagttgtagtgtctttgtaaagtggatggatcattcatggtgtaccaaaaggaaatataattaattagagaacagtagtattattgactttgtcttacattaatgtagacaagaatgtcttacatctttctttcaactactacatacctttattttatatatttatttacatcattatgtagcgcacaatgcagaattttatttttattcttatttgtgttaattatcaactacgtacttttatttatacctattttaaattactatcaaatacagtacttttctttttttttgttaaacgggagaatcccataccgaaacctagactaatcccatatcgcagtagagcattagaattcttctaaccattggacctttattaaaaaaactccgatataacgttaccatgattcatacaggtggaaatatctagttgtttatacctgtatgaatcatggtaatgtcatatctgaaaacgacatattcaaatgtaatataaaccaacaatagagtactgattttgctttgtgtatatataaatcatattttcatttccaacagtatcatatcactaacatggctaaacgttttctccttcttcttcctcttttgtcaactattctacttctttccgtatccgttacagaatccgaagcttactccacaacaaagccgtgtcaaggctacaagccggataaattcacccacctccacttttacttccatgacgtcatctccggtgacaaacctaccgccgtcaaagttgcggaagcccgccgaacaaactcctccaacgtcaattttggcgtgattatgatcgctgatgatccgttgaccgaaggaccagacccgagctcaaaggaagtgggaagagctcaagggatgtacgcattgacagccatgaagaacataagcttcacaatggtctttaacttggcttttacggcgggagagtttaatggaagcaccgtcgcgatgtatggacggaatgagatattttcgaaggtgagagagatgccaattattggaggaaccggtgctttcaggtttgctagaggctatgcacaggccaagacttataaggttgttggtctagatgccgtggtcgagtataatgtcttcatttggcattaatcatttgcatattgtctaatgtctttccgaaacaaattgtttcactttggttttcttatattgtgttctgtttttgttgtgtcgtttaaagtttaaaaggtgtagttgtttgaactttgaacctagggaattggatcaaaaataaagttgggttttaatattgattaaaccaatattgggttcacggttttagtatatgaaaccattaaaaacaacgccatagctaatcaatttttaatacatttaaataaaaaactgtaccaataattattaagaccagctttgattcccattattaattcatattaaaaaaaatgtgaatgtaaatgctaaatttgatggaccttcatgaaaaaaaaaattctctctttccactaattaattcttctactatatattaacaagttagaccattttcaatgattgtctctattttttcttgtaaatacagagaaaaaatagaaatctctatttttactccaatggttcctaaaaatagaaatctttatgttagagataaaaatagagatgagttaaagatgcccttaagattcttctgatctattaaaacttttgtagaagcatgagacagcacacgaaagtggaaccttatagcaaaacgatcccaaaatagaccaatttcgtctctttttctcaaacctctgctatttatcttgactaagaattaaaatatttattaaaatgaaattgtttaggttttacaaaatttgttaaaacatggaagcaaaaaccatactcagaatttcaaccatcgacagaagtaacttcaccttttaccaaaaacaaaaaagaccatcgagagaagcaattcagctcacgagtcagatgaagtgataatcccaaggaagaggataaaagagaagtaacttgaccagaagaggataatcctggatttggagatagagatacataaatcgacgagtacagagagttctaaaagagaaaactcatatatccacatacataatattgtgagatctatatgtttcttgtgtgagaagtaaacactcaaagccctaaatctcaataacatgttaatacaacttaggatatgcttgtgaaacaatttcaaacataaaagaaaaacaacgatatagagtaatagagaggtaaaataatgatgtgaatgatttcctttacttgtatttttcgactttatgaagtgtttgtgttaattttcatattcacttacgttcaccggttcatataatatgtcgctcatataatatgtaatattgttccatattaacaatgaatttatacgatcttttttatttgtaagatagaacataagggtagattcttggtaaatgccaccaatgctttcagttgtgtgtttgacaaggcaacgcattcatggttttcaaatttcaatatttgattggatacaattttctctaatatctgtattttgatcgttttgggccttttggccaatagtgtaaaaagcttagccaggtcataggttagctgaggatatatctgtctacattcttattttagggtttagagaatatatagatgtttgtttgaggaagaagaaaccccaataaagccttaattatcacccattattagaatttgccttctaattctatctttttcttaaatccattattcttctcaacctaaaccttttttctctctcccttcatcttcaagcaaggggttccaattccggtaggaatgtattgaagaaagagagggtatagaaaatg

SEQ ID NO: 1689 - DNA, 1671 bp, Unknown
  misc_feature (1)..( 1671): cDNA_ID_3063736_gDNA_ID_1620435_Annot_ID_157005 3000 nt of promoter + ATG
cttttagtatttctataagtatttttggagtcactttttatgggtgggttaaaaacttaaaatgcatttgggtacatttgttaccgacccgttaatctattttgtttattaaatcttatttgggttgttcatataaaactcgactatttaaaaatataaatatttagaagatttggttaagatttaaaactatgaattttttatcatctttattaagaaaaattgtgcatatattatgattcaaaattgtaaaaacggacatatattatctagttgatgaaaatgtgtaagtttaacgtcttacattggttaaaaaatttagacaataaagagttttttagcatgacgggtttggcaaaatgttagttaataacaattataaactatccaatataaatattttataaataaatacagtttgaaattttttatatatattaagtttaaaaaataaatcatattgcaattaaaatctagttaagagtaaaaaaaatatagttaagagtaaaataaatcaaatattgcaattcaatctttcttttggaagaagcgatttgcgcattaaacgtaactttatcagcaactgacaccgaacgacataatatattatggacgaccaatagaccaaaattcagaggtctagttttttcttataagaattaattaaataatcacacacgatcttcgtaaattagggagtgtatccaaacacacatttggaatgatatgttctaaagtatcatgtgttattcaatcatgtgtttaaaaactcttttaaattcaaaatcaaattattgaaaacaattattttaagaacaggtttgattgttaatgattttaatgtgttttagaagatttctcgaacttatatatataaataagtacagtatatatttatataaatcatatgatgcggtatggtaggaacatatcggattaatgaataaaaattatttgattgcattctacattttaagaaatttgaaaggattttaaagtcttttgtgatttaaattaattttgcatatatagttactataagaaaattcaggatattatacttagtgttggtcatagatcggataatcgaaatttaaagatatctgatctgtttttaaataatccgaatctagatctgaaatcaaggatatccggatgtaatccaaggtttaattatatatgtgatcggttattgtcgtctaaccttttaaaaaaaagcctatgaaatatgtaaataattgtttgggaaaattttgctcctttagttctaatctaaaaaatgctcccctaaactaattacagaatatgacgtagtaaatataggatactagaaatttataaaaagataaataatatgaagagaatccaatgcaatgcacttgtcccacaaaccaaaccatgcatggcgaattggtgattgaagacttttcactgaataatactaccaaaacttcgagactcataagtgatacacacaactaagtcgtcgatggctataagctttaagtctatcgctagactgtccacaggtttcctaatcttctttgtcttttagcctttctatattatccaacatatctttaaatttctttaattgacatctccctagcctatataaaggcataagcatgagtggcactgataagcaaaataagagggaatattaagatg

SEQ ID NO: 1690 - DNA, 3000 bp, Unknown
  misc_feature (1)..( 3000): cDNA_ID_3063740_gDNA_ID_1620435_Annot_ID_157004 3000 nt of promoter + ATG
caattatttttaatttatacgtttaatattcaattattttttgttgaaagattaatacataaagtaataaaactgtgtaatttaatatccaaaccattaactgttgttattttcattctcacgatcttacaacaaaaataaaatttcaattttacctttaccatctcaattttttctagaggtggatctatcagtccaaccgtctatgtctctccagggaattcacgaatcgatcgatccagaggtggatcgatcgatcccaccgtatatgtctgaaacgttgaagtacggaccgatcggtccaaccgtctatggccgatttgttgtagcctggaccaatcggtttaccccgtcttctctccgcttcagcttttctcgttctttctcgacccgaataaactcaaaactatctaatccattcacaagtacctaaaacctgcaaaagactcaagacttgatcaaaaagacgtaaaaacggactacgacatgataaatgactcaaaacgaaggttagacaagagatctaagacaccaaaaacgcaacatatcaatagtcttatcacttatgttaccatgaaataaacatataatgtagttacaaacttacaatgttttttagatgattactaatgtactggaatttgtatatcacaattcttttaagttattcaaggcactagtggagaaagattcaaggcactattggagaatgcttttctctcaaatttggctcattttatattgacaatggaggcaagtatctagcactggcaaacttccttgcatatcacggcatcaaccattacaaaacaccaccacacactccgaagcataatggtttttctgaaagaaagcatcgtcatatcctagagacatgcttgtctttacttattcacgcttccatgcccgtcaaagacgatgcttaaacaagttctgcaagcatgtatcgacgagctggggcagtttcttctcagtgttgggtttagtcttatctccgcaaggttcagatttaaagatgttcttaccaaggctttaccacggacgcagtttcatcttctctttgacaagattagactcacaaatggtggttcatcttgagggggcatataatgatatattatatatcttcatcttactattcctgtgtacattttcctttcctctagatataccctatgcacacctcaccaaaaaaattataaccacttatattatacgaatgccaaatctcgatataacaatttaattaaagtaataaatgttaatgaatttaggacatttcaaccatatatttactctatcaccaatatctacatcttacttgccccatactcacccttaattagtacgaacagaaatttcaagtaactacgagactctcacacatctgacatcttaattctcaaaatattcagacaaacaacaccttttgaactttaaacgatccacaacaaaaacagaacaattgttatatatatatatatatatatatatataaaagaaccaaaaacaatataagaaaaccaaagtgaaacaatttgtttcggaaagacattagacaatatgcaaatgattaatgccaaatgaagacattatactcgaccacggcatctagaccaacaatcttataagtcttgggcagtgcatagcctctagcaaacctgaaagcaccagttcctccaataatcggcaactctctcaccttcgaaaatatatcattccgtccatacaccgcgatggtgcttccattaaactctcctgccgtgaaaacatagttaaagaccattgtgaagactatgtccttcatggctgttgatgcgtacatcccctgagctcttcccacttcctttgagctcgggtctggtccttcggtcaacggatcatcagcgatcataatcacgccaaacttgacgttgagggtggttgttgggcgggcttcggcaactttgacggcggtaggtttgtcaccggagatgacgtcatggaagtagaagtggaggtgggtgaatttctccggcttgtagccttgatacggcgttgttgtggagtaagctgtgacggacacggcaagaagaagaatagatgacaaaagaggaagaagaagcagaaaacgtttagccatgttcgttgtttgtagctatggaaatgtgaaaatgtgatttatatatatacacaaaacatgatcgttacgcaattgttggctcataaaacatttgaatatgtcgtttctcgattggtgacaacaacatgtccgttgacgtggaagtaaactaggtggttcgatttataaacaactagatatttccacttgtacgaatcatgatataaactggcaaatatataaggatgcacgacgaaagaaaaacaaaacaaataagaataaaacaagattctgcattgtgatacactacatataaatatataaagaaagatatatagtagatgcatataattgaaattaagatcaaagatgtacatagacattgatgtttaaatttaggattgtcaatctgtatatatgtacctaagatatatattaatatatacatatggttccaaactcaataccagtgttctctaattaatgatcttatattttgtacactgaattaatcatccactgagtcccaaaagaggagggcataggtgcgacgggctagagttaaatcataaaatagattaaaaacaatacatgatatttgaaacaatgatcaatgacaagactttagttttcttgcaaaaagtatataacttattttagaaactccttgaattttgttataaaacaaaattggtagttgcataatttttttttttcaaaaaataaaacaacgatcaagaattttggtagttgcataattttgaagtacagttgtgctagttactcaattaaacttaaaatatattatatcaattgtttggaataacattcatctttcgtcttctcagtttacttggaatgcacgagagctttctcgttgtgagaataactcttgggtc

SEQ ID NO: 1691 - DNA, 3000 bp, Unknown
  misc_feature (1)..( 3000): cDNA_ID_2142267_gDNA_ID_1620435_Annot_ID_156987 3000 nt of promoter + ATG
aataatgtgaatcaatatcattgttctagcataataaaactgtagatttacaaacgtcaaacgatatgaaatgttttaccgacctctaccaaaaaatgagtgatgtgagaatatacgcgcgttatcggttgtttctcactcacctagtgacattggtcgagcggcaaatggtggtgatgactggcctcttttacgactcgcagttttagattttagtccccttaattgggtattctcagttatggggagacatataaacacattttgtatgttttgacaaattcagaatatcaaaacaagacacgtttattatgaagtgtgttaaataatacaaatagattagatgagacacaaatatacaaaggaataagaatctctcacaaaaataataattgaatgaataaaattttgaggagggaaggaagatgtcccaatcccatatatatcatctcaacgcatcatcaaaacaaactcgtcaaagctgagaactccatcgtcattctgatcaaacccacgaatcataaccttacaagcatcaaccgtacacgactcgccgagtcgactcaacgtcctccgtaaactcgccgccgtaataaactcttccccctccataacatacatcccaaacgcttctttcaactccttcctcctttcttcatcactaccatcttccccttccataagcttcaaaaactcctcaaaatctataaacccgtctccgtcaacgtctgatgtcttcaccacttcctccacctcacgtgacgataacgcgccgcctaagagactaacgcagctttgtagctcttcaccggagattttcccgtctgagtttgcatccatatagtcaaaaacggttcttagctcgttaacgtttaacgagctgcttccgctactattactgctcgttcttgattcgtcttcaaggtttcttgacgattctgatctcttcgaggaaactttcttgtatagtcgtgacaatgatgatttttggttcttagcgagagtcatttcttgatttgaatatgaatctagaagatttgggaaatggatttctgatgcaaattcttttcaagaagtggtagattatatatagatgagtatgtgaatgcgtgtaatggtggagagattcttgattgttcgacggttaaaacacgggtttgaatattttggtgttattatttaaagctagaggcggttgcgcggcggtggccgggaagtttcctccgcaatgagtgtttgtggggaaaggtcaagttgaccacgactaggggtgttttcgtaataatgtgatggtaagtttttctcacgtattgtgtgaaatgtgatgtcatatcgacgactagattaagaaaagtagcaaaccttctctttgactttgattgagtatacgatgtgcggacacgtggttttggtcttttaaattgttaaactgtcatgaagtttcatataaccgtccagatatgctccacgaaagtggtatgacttcctctgttcctagaaacttgaattaaaaataaaatatttcatgtgatgaagtttcatctaactgttacattcccggtcctgaattccctttccataagaaaatatatttctatatggaccaaaagagagttttatttttatctttttgcatctcaaatgccaacttcatgtaaaagcttttactgatgtatagttcggctttctaagctcgacggtttaactcggcccagcatatattgttcaaacaattcagttattctttgaaacttctccccgtaattatcgagctcaaagattatttaacaaaaacatctctgtttccccccataaaatctccttataaatacttaatttgatcctaatatcaacaaaatgttagactttaatctatatcttcaattcttgatgaaatgaatttccatgatgcggtgctggcatatcgtgaccttacttaattcacattaattaaactttctgagcaaatagtttaaattgttggtatcaaatctcacaaataaacttactatgaaaaactcatgatcgccaaagtgaaaatagtatagaaagcctagtttagagtgacaaacacttgaaatcctaaacaatcgatcttgtaaccactattgcacatcaccacaaaacacacattatctgacgaaagctaatcacattcaaatgattaaaccaaaataacagaatctaaacattaattaacttaatattcgagatacaacgagacctatacgagtttgaatgaaagacaattttcttgtctactatatgtacaagaaaaaatagagatcatacaaatagcttttcttctaactatcgaaatcaatattcttataattaggcatgaatcctttaaaaatttaggggtcatgtaacacttaacataagcaaatatatgaatgcataaaattattaacttttcgatcatttttttaaaaaattataattttcgcaacgtatttaaaccaaatttcacaaaattacatcaattttttttttagattgctatctaagcccttaaccgaaatacctaaacctaattgaaccgatcagttcaaagttgccagcagataaacaatgttttcatgtccgactcatactccatagtcgaacgattaacccaagaaacatatttccagtgaaggtttagtcttaaatctaccaatataaccagaaaaatccagaaaaaacttgccattaactaccgcatgatcaaccggttaaaacttctgggtgaaaatctttccaaaatattgagattttgacttcaaaccctttgctacaaatagaaggtttgattttggaattaaaatatatagtttgtattaaaaaagaaagaaacattaatatactcatataaaaagagtttaacaaaataaaaatcaggaaggagaagacaataaacgtagctaacctcatctccctcttcttttttttttgttctttaatagtttccgtctctctttttctcctccacctctcctttgtcctcaatagccgacg

SEQ ID NO: 1692 - DNA, 3000 bp, Unknown
  misc_feature (1)..( 3000): cDNA_ID_2142259_gDNA_ID_1620435_Annot_ID_156985 3000 nt of promoter + ATG
tgattagctttcgtcagataatgtgtgttttgtggtgatgtgcaatagtggttacaagatcgattgtttaggatttcaagtgtttgtcactctaaactaggctttctatactattttcactttggcgatcatgagtttttcatagtaagtttatttgtgagatttgataccaacaatttaaactatttgctcagaaagtttaattaatgtgaattaagtaaggtcacgatatgccagcaccgcatcatggaaattcatttcatcaagaattgaagatatagattaaagtctaacattttgttgatattaggatcaaattaagtatttataaggagattttatggggggaaacagagatgtttttgttaaataatctttgagctcgataattacggggagaagtttcaaagaataactgaattgtttgaacaatatatgctgggccgagttaaaccgtcgagcttagaaagccgaactatacatcagtaaaagcttttacatgaagttggcatttgagatgcaaaaagataaaaataaaactctcttttggtccatatagaaatatattttcttatggaaagggaattcaggaccgggaatgtaacagttagatgaaacttcatcacatgaaatattttatttttaattcaagtttctaggaacagaggaagtcataccactttcgtggagcatatctggacggttatatgaaacttcatgacagtttaacaatttaaaagaccaaaaccacgtgtccgcacatcgtatactcaatcaaagtcaaagagaaggtttgctacttttcttaatctagtcgtcgatatgacatcacatttcacacaatacgtgagaaaaacttaccatcacattattacgaaaacacccctagtcgtggtcaacttgacctttccccacaaacactcattgcggaggaaacttcccggccaccgccgcgcaaccgcctctagctttaaataataacaccaaaatattcaaacccgtgttttaaccgtcgaacaatcaagaatctctccaccattacacgcattcacatactcatctatatataatctaccacttcttgaaaagaatttgcatcagaaatccatttcccaaatcttctagattcatattcaaatcaagaaatgactctcgctaagaaccaaaaatcatcattgtcacgactatacaagaaagtttcctcgaagagatcagaatcgtcaagaaaccttgaagacgaatcaagaacgagcagtaatagtagcggaagcagctcgttaaacgttaacgagctaagaaccgtttttgactatatggatgcaaactcagacgggaaaatctccggtgaagagctacaaagctgcgttagtctcttaggcggcgcgttatcgtcacgtgaggtggaggaagtggtgaagacatcagacgttgacggagacgggtttatagattttgaggagtttttgaagcttatggaaggggaagatggtagtgatgaagaaaggaggaaggagttgaaagaagcgtttgggatgtatgttatggagggggaagagtttattacggcggcgagtttacggaggacgttgagtcgactcggcgagtcgtgtacggttgatgcttgtaaggttatgattcgtgggtttgatcagaatgacgatggagttctcagctttgacgagtttgttttgatgatgcgttgagatgatatatatgggattgggacatcttccttccctcctcaaaattttattcattcaattattatttttgtgagagattcttattcctttgtatatttgtgtctcatctaatctatttgtattatttaacacacttcataataaacgtgtcttgttttgatattctgaatttgtcaaaacatacaaaatgtgtttatatgtctccccataactgagaatacccaattaaggggactaaaatctaaaactgcgagtcgtaaaagaggccagtcatcaccaccatttgccgctcgaccaatgtcactaggtgagtgagaaacaaccgataacgcgcgtatattctcacatcactcattttttggtagaggtcggtaaaacatttcatatcgtttgacgtttgtaaatctacagttttattatgctagaacaatgatattgattcacattattggatgtttctataattacagttacaaacagatacataattattgcaccaattcactttttctattcaataagagataatattgtttgtaaaccttttaactaaaacgatccgcttcgaaacttgtttcttaatgtctaaaacaatattacacttcacaattttgccatccgtagaagtctctagtgtaaaaaattctgaatttgcatggttccggggaaattttatacaatctagaaaattggaataaaattttcataaaattatttttttggtcggataaagttttcatagaagaacacatattaaatggatttatcatcacatagtagtagataaacaatttaaattatgtaatacaaatcaaaatgaattaatctatttgccacatatagtgaatttgatttctattcaaaggggaaaatacaaattcatttttaatatgtagtagatatttgtttctcaagtaattaatattcatatttaaaaaatcattgcatatgttaaacaaatctacaaaaaaattcaatggtcattccataattataaataatacggatatttcacaaattcactttttgtttggaacccagaaaaaagattcataaaaccaggcaatagaaatttcatctgaagaaaagaaaaagtaaagctattaaaaatcaaagccacgagaagaaagtagaaaaagttacagtctctgtctatcaaaatcccaacggtaactgaaaatcgccggaaccgaatctgcggcgagccaaaacttgtggatcttttaatgaaaacttgaagattcctctttccacggttgcttctagggttttctcttcgattcaccacatcgtcatg

SEQ ID NO: 1693 - DNA, 3000 bp, Unknown
  misc_feature (1)..( 3000): cDNA_ID_3063794_gDNA_ID_1620436_Annot_ID_157021 3000 nt of promoter + ATG
agaagtaaagcctgtaaaacggtgtgttattgtctttattgtctctagaaatgtagacaaaactctctatttttataacatgattaaacctactcaacaaaagttagtggccactaacatgaattctttttcttactataatccttttctatctttcggttttaggtcaaccacttttcagtggattttagctttttgagaatctctgtcttatccaagattctcttcttcttcttcatttttcaattctttctttttaaaattcttatccgctggatgactacattggttgaatgaattaatggagactcagtatcgttttttgcgtttaaattagtctaaagctttgttgtattatattaaagcactagaatgaaaagactatgtgtactaactaactaatcaagtatatatataatgcaaaagtataactacatttttctttttagaagaatgtggaattttaacattgcattacacacgtatcttatgtacattcgatatttcgatccttaccaaaattcagtaaaacgaaacaacaacaaaaatctaactttaagtttaaacgacatattaaaaaggtttatatatttcaattcgtttaaatataagtaacctgctgttttaaaaaaaaaagtaacctaaaatgtgttttgatgtaaaattaaagtttttaaacaaaacacaaaaaatctgaatgacataaaaaaataatccaccaaaacagttatgagtaagttaaatgatataacaccattctttctgtcatttctattttatttgagttaccatgcaaagccttacattgagaaagagatatagaatgatcaagtacatttctcattgtcatttgattgaaaatataaaattcaaaaaaccttacatcaaaacaatagaaagtggaatgtatagctatctatgtggaaagtggaatgaaactttgaagattaaagaatgtaaaagaatcatagaaagaaataaaaaatagtttatcaaatgggatctcgatagatataatctaaacttcttctcccaactttttctctcgttgtttcccatgataaaaagctttaagacatttgcaccaaaaagatctcaaattcacgttcacatagaaaaattaacaagaggcagaaggaaaaaaaatgtggaggtcattcgcaaggtaaacacactcgcaagacatacgtctaatctcttctttattatctaattatagaattagtctccatctcaatttcttctccgtggcttttctctgcagaagcttcaaactcattaatgtaccaaatggtttgatatccaagccaattcgctctactctcctctattcaacttcttcaaggtcgatcctacatatataaatactataacgagattcgatcttttaatcttaattaaaactcacaaaaaccctcttaacattttttgcttcgactatatgtatagaaagttagaaggaaaagtagcggtcataaccggcggggcaagcggaatagggaaggccacagcggaggaatttgtgagccaaggtgcgcaagtgattatcgtagatatagatgaagaggctggtcatatggtcgcgaccgaacttggctcagccgcacatttcttaagatgtgatgtcactgaggaggaacaaatcgctaaggccgtggagaccgccgtgactcgtcatgggaagctcgacgtaatgctcaatagtgcgggaatatcatgtaagaacatattaaacaattataatgaatttattttaaactaaatatatgtatactaatacatcatatataagatttaaaaaataaaacattacttctataattctacatatacatatctttatataaataaattgcttatgtatacaatgcaggctccatatcaccaccaagcatagcggacctagacatggacacttacgacaaagtgatgcgtctcaacgtgcgaggtactgtcttagggataaagcacgcggctcgagccatgatccccgctggctcgggctccatcctctgcctctctagcatcagcggcttgatgggtggtctaggcccacacgcatactcaatctctaaattcacaatcccgggtgtggtcaagacggttgcgagcgagctgtgtaagcacggactaagaatcaattgtatatcgcccgcaggcatcccgacgcctctaactttgaggatgtttcgagaggcgtttgcgggtcatagcattcgggaggaacaacttttggcgattgtgaacgcgacgggagaactaaagggagagaagtgtgaggagatagatgtggctaaagcggctttgtatttggcatcggatgatgctaagtttgtgacggggcataaccttgttgttgatggtggatttacttgtttcaagtctcttaatctcccttctgcttaattaatttatcaagttagttaaagttttttttttttttttagttttctgatgtggttattacgagtgttttggccttttgggtcattgctgatgtgatcgtttgtaatctatgggacattatatggttggaatttggaattataaatttagcctctctgtggagtttcgacatttcactagtatagttgattatatcagtcaacttagtattagataatcattatgtgtattgtgtaattctaagtgattcattgtttctgatgatttacgtaaagcttatcagaggtttcaaaacatattgcaagcagagttatctatcgtggcctcaggtgttgtaagaatagcttgtccatcagataacatgtatgtagaaccgttagttgtggtctatttaaaactttttaaatactttctttgagatagatgtatttctcctaaatcacatatgtttcttagttatggtcaaatatagaatattaaaatattgtacctaatagtgacactagtcactagagttaggtgccactacaccaagctcttctgactttgtatccatcaatactagaaactcttttgatctcaacaagcagtctt

SEQ ID NO: 1694 - DNA, 2652 bp, Unknown
  misc_feature (1)..( 2652): cDNA_ID_2142601_gDNA_ID_1620436_Annot_ID_157039 3000 nt of promoter + ATG
catttgtgaaatagtaaaaaaaactcaagactcggcaccatcttccaaagaaacctccatcgtttagccaaaacactcactgcgaccacttcttttgttggaagtaaagataatatctgcagaagcaaagcttcaggtaactgactgatcctatcctcattgctcaaactctgaccacaacttttgctgtgaaacaaaaagccccaaaactcaataaacgaaataacactaacttagtttggagcttacagtgtaaaaaaccataaggacaattcatagacctaatcactcattgctcaaactttcaccacagcgtttactaacttagtttggaacttcagtgtaaaaaatcctaagaacagttcataagaaataagcacacatagaggaaacataccatcgtttcattgtcatcgaaagcaatcgaattgcaataagatctcctattgaattattattccttcccgagtactatcgcatttacaaacgctatttcaatccccttcaaaacgcagatgcatcgcaacactccaaacgctagctcttcgatagagaataaatcaattcctagtgatcttcaaatccagctgagttaagggaggacgaagtagttcgagggctgtgaaaatcgacggcggtggagacaaaaaaacacggctgaggttagggtttcagaaaataatgaagcggaggcggaatgtgaaaaatgaagacgatatcggccaaaattaatccacttgcgtctttaaaccggatttatatttccggttcgaaatcatactgtttacttgtgccgatttttggtctcattttggtaatttgtatttaattgcagtaacttactaagtagaaactaatgagcttgagtagttgtaaattaggagaattatcaagcatgagcgtaactgcgtaagtagattccaccaaacagacttggtcttaagtatatggattatcaaagctccatttttcaatgatcatattggggtatcgggcaaagtaaagaaatattcaatcaccattatccacatcacattatcctgaaactctcataagtttcatacatgtctacactctataacaacacggttaaaaacttgatttgcatacaaaaaggtcaggtaacactattgtggttataactaacacttgacaccattgttgttgtaaagctctttttcaatcatttagtcccattctgtaggcaaaaaattgtattagcaaagaactctcatattgattatgtacaagaacatctataaatgtaggtcttcttttacatttaaattatcaatatcactatcaacatctaaaaaaaactgtatcagttttgtttactatattttgcaccattaaatacgcatctaatcagagtttgttattgtgcctttagaagtttttctcaaataacaaatatggatccggtatcattaggctttgatggaaaactctcgtacatcatatagtgaaaaaacagtatttaatcatttaattatcatgatactgacaattttagagtaaaatatacttggttatttttaaatatttagtattttaatttttatgtaacttttattaattattagaatttttatgtatataaatttacatctcatacaattttagatatttaaaacataataagaatttattaaattaatcaagtattgtagtaaaaccattatttgtgtttaaatttcgtcaaatttgtatattcttatctccttagtttagttaatgagctcccaaaactccacgacatatgttttataaattttaattacctgtatcttttaaaaacgaaattcatggttaaccgtactaatatgttggcaaatgttttagagaaaaatgaaattttgtcttgatagtaatcagactatggtaaaaaaaagaaagaagaatgtactatagatgtaaacaaagttgttataggaacatgttcattgcatattacaaaccaaatattaaagagtgtagatttgaagcttaaactagcaataaacatactagtttgatattaatatctaaaatagatttgaagcttaaattttcttgaccaacgaacagattatttggactttaattaactcaggggatattaaatatctaatgcaattaaatacaacttttgttttgattcaaaagaaacaattaataacttgtcaaaaaaaaaagggaagagatgtttgaccctcccactggcggtcaaacccaaataatgataatcactttctttccctgtcatcaatctttgacttttgactcttccttatcatccgttacgatttcgccacgtgtattttcatctctcttcatataaatacttaacgccgttggatcatccttcgttgcttgctgttatctgggttccgtctccgtctctctctgtttcttcgatctgtttttttttgaccaaagaaactttttttttttggtcttccttattctttcttcaatgtcgttgaacatatctgacgatacttgaatctcactctttcttctcttctattctctgtttttagtcacaatttcatctatatctcctctcacttttgtttttgagaattttcgatcccaagcttttctcagagaattttgactggaaatttcgtaattagggtttttgatttgaggcattattctacgatg

SEQ ID NO: 1695 - DNA, 3000 bp, Unknown
  misc_feature (1)..( 3000): cDNA_ID_2142598_gDNA_ID_1620436_Annot_ID_157038 3000 nt of promoter + ATG
ggatatgaagcaacaatgcgacgggaagaggtttattacttttctaacactggagtttttattttatagtttagataaagtttccttcaacaacttctttacctgtaaactctcaggaatgtgtatgagatgtcgctagtgaaagagaaaggaaggcctaaaagcagtaaaggagagagacatattcctcctgagtctcgacctgcttacagtgagtttcatgatgaagccacaatgtgcatttttcgattgaaatcgcttaaagaaggacaagctcgtagtctcctaatacaagcagtccgtcaccacactgctcaggtaaagcttatgttcaaatttcgtctgtttgtttcatttctcatgaactttggtgatcgtctgttgtgtttctgacggttctttcttatgattctttatagatgcgtttgtttcacactggactgaaatcgctcgaggcagttgagcgtcatgtaaaagttgctgtagagaaacaacacattgactgtgatctatctgttcatgggaacgagatggaagctagcgaggatgatgatgatgatggccgatacatgaatagagaaggagaactcagttttgattacagaacaaatgagcagaaggtagaagcttcttctctctctacaccatgggccacaaaggtaagttgatttgacggtaaagcgataaatacacacattacctataaaacttgttcttatgctcttctctttttatctagatggatgatacagacctctcgtttcctcgcccttctacaacaagaccagcagcggtatgtttttttccaatatttgtgtaccaaatgctctcaactgcgattaatcgggttgatgagagtctagtgtgataagtattttacttctctcttgcacaggtaaatgctgatcatagagaagaatatccagtttcaacccgcgataagtatttgagcagccattcagctccgttgttcccagaaaagaaacctgatgtatcagagaggttgagacaggcgaatccatcttttaatgcctacgtattaccaacaccaaatgattcaaggtactcaaaaccggtttcccaagcattaaatccgaggccaacaaaccacagtgccggaaacatatggcattcatctccgttagagccgataaaaagcgggaaagatgggaaagacgccgaaagcaacagcttctacggccgcctccctcggccttctacaacagacacgcatcatcatcagcagcaagcagcaggaagacatgcattttctggacctctcagaccgtcctcaacaaaacccatcaccatggctgacagttattcaggcgctttttgtcctctgccgactcctccagtactccaatctcaccctcattcatcatcttctccaagagtctcccctaccgcttcacctcctcctgcttcttccccaaggctcaacgagcttcacgagcttccaagacccccaggccactttgcaccacctccaagacgagccaagtcccctggtctggttggtcactcagcgcctctaaccgcatggaaccaagaaagaagcactgtcactgttgctgttccgtccgccaccaacattgtggcctcgccgcttccggttcctccgttggttgtccctagaagctactctataccttcaagaaaccagagagttgtttctcaacggctggtcgaaaggagagatgatatagtagcatccccaccgttaacaccaatgagcctgtctaggccacttcctcaagccacaggagttgctcagaccagtcaaatcagaggtataatcgattctttcaaactcattttatgcgtttacgtgaaataatcttacagaaaaagaatgatatttttgaaacataaaagcatgttcagttttccataaaacacaaatgaaatgttcttgtttaacttttgtttgcgtttggcgtttagaatgacactttcaatctacacgcaaacgcaaacgactcgaaaatgtaactgcatgaagtatttttaaaatgtaattgcatgattcataaatggaatttgtttgctgtggatttattgaaacctccataggttattaatcatgcaggagtaggaaagctgatcgaacgatgaggcttccgcgtctgcgtcacgtttgaccaaaacgctgattgtacaaattcagagatcttcacaagtgaatatagaagtcagtatatgtattattctttagttggttaatctccttttttttttcccattgtaaatctgaagcctctgctctttattcccttttcattttcaatcccctcaatttttcttctttcatccccttctatatccgaaacctcaaaataaaattttcaaaaatgcaaaagtatataacgtatgaaactaagtctatgtctgtccatttccgttgtcgggatgggaaggcccccaaagtgcgtttaagatagcgtaaaaccgtctaatacaaaatgcatagttccaacgcgtaaaaaggtaacttctatagtttaaacgtcatctcgacatctaggatttgcggattagaccgcttttatttatcgttcacaaatttcagtctgtagcacgatcgagaaaaataaaagaaatctgccgcgatggattgatgttcaccttaagaataagatggcctaattcgttagctgtttagactacttttactataacattcattcaaatcccagtggttttaggcgatcacctacacctatttgaaaagaaacggatgtaaaacgagaaaatcaggatggataagcaatggagaggttttccctccctcttaaatttatttatgcagaataacaaaaattaagtctataaatttattttaattttttatttgatatatatatatatttttaaaatttatttcttaataaaatttccacaaacatatgataaaagaaattaatacgtggcggatatcttgggactagaggaaggagggagagaaggagcttaagagagcattcgtcgtcgtcaatg

SEQ ID NO: 1696 - DNA, 3000 bp, Unknown
  misc_feature (1)..( 3000): cDNA_ID_2142560_gDNA_ID_1620436_Annot_ID_157030 3000 nt of promoter + ATG
tctctcaatgatttttcttgtcatgtccatcttattttgaatgaaggtaaacgtctgagatgagagagaagaacatataaggatagccaaggagactgcctgatgtcttttgatgagtaaaatggtcattgcttgatataacttatagtcacttgtcaaacatgacactaacccattttactcaaagaaacaggcaagtcatccttggctaccaaatatgattcttctattcatctttgacttctccttctaaataatgtatacactcactttcatatactataacaaaaacttttgaaaccaactgcgaaaatttgacatttttgaaatttaacactttaacaaagaatgaaagtttctgaagtgtaaattttatagtgattttgaagacagaaagaaaagtaggtataacatggatggaaaaagcatgtcaagatagccaaagagactgcctgaaacctaacccgcaagattcaacatgatatttgacctattatactttaaaaggtataataatccaaaatgcatgaatttgaaattgaatcgtggaggcgaaaaagatcaggcaagtcatccttggctactaaacatgacgctttccgccatgttagacctctcttcttcatcatacacttcattactctctatatgtttttgccttattccatacatgcatgtgctctctttttataaccctcgagactcgagagttgagaaggaatatatgcctatcatatcgatttctaaaattatctcttttctttttgcatgggataaatgtagtcaactttatattctccatcacgggaatatgctccttcatatatcggacaatttttcgggtcactaacataatcttcttgtcggttcattcactaaattgtatcgtttttcattggtgggtttaagagttaatatatatatataacgttctcgatcatcttagatgttgtatattatatatacacacatatataaacaattaaatgcaactttagacgtgtttagttcattctgtctgaaagaattgtttaaattttatgaatccgaacatattttgaaatataataacgttaagttttgatataattatgaaatatctatatagatgcataggtagtttaaaagctcaatgatatactatagacttaatattaaaaacgacatttcaactaatatatacacacgtgactcattgtggttgataaaatgttccaatttatttagtggttattaacttattattctcactactttgcatacgttttctttgtactttttgtactacaattcaaattacacgtagctaatcgaatacatattcggtcccttttaccctagtgccatgtgtaaaattatgttccttaaattgatgcttccgccttatggtatgctcaagtgactcaagtggttctcgactatttctctaatttaaaatgaaagtttatttttccttaaaaatccaaattaggaaatttgtgtgatatgttacatttttatcatataaccactattgggtataaaaaggtttgaccattacattaaagaagagtcataatactttttggcatattttttttaggacattgtggaatctcatttgaaagtcttcgattctcttttctgtcatccgatccatatctttttcatttccaattgttgagatttgatttggttcgaatgtcatcatcttgtcgttgcaataaaagtttacacaaatattattcactggtacgactgaggatatattgtgggctaatttttgaattgggctaaagcctcacatgtgattaattttgagttgggctaaaacctatcacataattgttagttatttatgttaaaatagaggttgctctctctcactattcatacatttctcagcattttggctaagatcaagtatagtatctgattttatcaatttaatatctgatatatggactattggttcacatgatacgctatttttaagttagaaactcacattaaaatagcttatctgagttttcacaagtggtctaagcgttgcttatattattgcacggatatggctcattcccaccaccaaatatagtccaaatttttatgtaaatgcaaagacatgggatttggtggtcttagacaacttgtctccaatctccctccatctgagttttgtttttgaattttctctaactatgttagaaagatttgtagtgatgaaactctatcatatatccaacacttcccctaaaattcctttgtttccgtttctgcataattccagttacacacaaagtgcatgcttccatcaagtaattctaagaaaaaaaacatttgttcacaaactatgtcctttcatttttggatggtatagtatatatgggacaacaagtaactagcttttttggagtgtcttgttcaaatttttgacatatagatttgtttgtatactactatatttcatttaactgcatgttttaataaagaaacggatctttgatacatataggtagttttctaaaatcatttggatcttgtgtcatatcgatttatttgtacgtgagatttggctcaccttgccgattaaagttcaactaacgttttgtaaattttattttgtttatagaaattcagaagaggaaacttgcacgtctaaatttgtatataaattataaaaagagccaaaatgtcactgttgttggtgtttataacctctcttacatacaagtcgcaagacaagaggtggtaaatgtggacttttattctaactaattaaatacagaaagatggaaagacaactttctcaattactctctcaaacacaaatttgattctaactaaattaaagttcaactaaagttagtttgtaaattgtattttaggttatacttaattgtactactttttcaaaaaataaaaaacaactatgtttttattttccgcgcatctttgcttggacgagtttgtcgtgttcttattataaacaaatagaaaaacggcaaaagtctcacacaa

SEQ ID NO: 1697 - DNA, 3000 bp, Unknown
  misc_feature (1)..( 3000): cDNA_ID_2142564_gDNA_ID_1620436_Annot_ID_157031 3000 nt of promoter + ATG
tacagacaattgttgccaaggatgatgtatcaagcctcacatggttggtcttgtgaaatcccaacgtttgatctctaacttatactgtggctatatatgttatagacatctaatcatatgatgtttagaggttctaagattctttagagatctaaagatcttttatttgttcatcgaaaataagacaagattatttaactgaatgtacatgacatgaatctatctattactttcgtaagattacaagtttttatttatgttttgaatgtaatgttaaactagactcaaataaatattaccacaaatctgacattcttttgaaaaatctggcatgctttggaaaatatggcattcttatatcaagtgtgagatattcttttgaaaaatctgacatcttttgaaaaatatgacatgattacatcaagtgtgactgtgacattctttagaaatatatgtgacataactcttttgaaaaatctgacattcttttgaaaaatatgtatcataagtttttttagtacaccaagtgtgacatatattcttttgaaaagtctgaaaatattctaagaatttgagactttagtttccagagtcaaaccaaacttggaggcctttacatgcatctcttatcaccagtcgctcggatttatgaaagttataatgaatgcagtcgtatgtaatctttctttaggatcaaacaacaatttcaattactctgtctaaaattcttgatttacatgcgatcaaggtatactgtatataggtaatttgttaaaaatgcaaaactcacaaccgaagaagatttatgttattttggttcttaaagtacgtagatagttttctaaaatcaaattaaaaatctaagaaaatatacaacgttaagaaagaaaaaacaaagacacacacacacatacatgtgaacaccctcccgattggagttaaaactaatttaagtttcgaaattaaaacaagatccaaaaggtcactgttgttgcggtctttacatccaaaaaatgtatttatttgtgctctactcttttaaatacaacaggaggtgtgcaatatggactttctcaattatgttgtatcctacctatataatgaaataaaatccaacggaagaaggccattaattctcctccacgtgcgttatgtcttttatttgttttctatggggctctattatgtttggtcagcgcaacctaattattatttttttgtatcatcaaacagttgtgtttttattcttccacgatagttcaatcttgttttgtgtttttattcatcaaagattcaattatcttttaaacacctaattttcatacaaaatataacttttttttttataagatgataagacttttggtattccttctattataattgtgattccactcttgtgtattgtaatttaaaaacttaaaattttatattttagactaatatatcgtcaatattaaccacttcaaatatttattataaaatctacttcggcattttcaaacgtacccacttccgattctatgcagtttaacttattacactaatttttattttgatgtgtttttatttattatgaaattattacaataatctagtaaagttaaattataattcaccaaaagtttgcggttgccaaatattcttcattattattatttttcatatctcaaacaaagtagttatgcaaccttgcttaaaatatatgatcccataaattttcaaaaccggttttatatgcaaagtacatgtcaaaacgttatcttatttacatccatttactaatcaaatatctattttaccacaaaaggtgtgttttataccctatcatgttttactcttgagatatgttctttgacaccacccacaaaatatctctacgaaatacgaagccactatatgtctctttaatttcactttttatagtttttttcaccgctaaaattgttgactaaaaaatatattgcataaaaataattgataatatatttataagaaaaactatgataagaaaaaatataatcggttgaaatgagtcatgactaacaataattaaaggttaggaaattaaaagaaaataaattctgaaataactaaaaaaaaaaaaatagaagatgatgatatatggatccctatactaatattttggaagtacattgaaaaactaactttcaaagacccaattaattaagctcattaaggataaacatgttaaatactaacttatggacattaattaaattaaaaattataaaacgaaaataaattgatgacaaaaaaaaaactatgaattttcttattaggatttgtaatctactttcttgaaaaaaattgaagtttactgacggcttcctttttttggaaactccaaaataacaaaacatatgaagaagttttggaatagcctttgactcaacaactttaacaatagaaagaaaacatgtttaattaatgttcatgcacttcgtctcggctgccccttgtggcctgtggggttgccgggttggcttagcttgagacgacccaatactgaatttgttagctcggtcagtgaagtctacatgcatgatacaaaaagattgactagtgtttaagttttttttttttttttttttttttttcataaatggtagtgtctcatattagaaatggtagtttgaaaagtattcagtttgtttgttcactttggattatttgattttggttttgttaattgaatcagttttgtttgaaaagtattcacttttgaaaagtgttcactttaaaaagttttgtttgaaaagtgttcactttgaaaagtattctttgagaagtgctcagttttggtttgtccacttacgattattattcacaagctacagcggatagtagtgactagtgacttatgactttgaataaagaatttccctctaaaggaatgaatacattataaatagattattaacctaagcttgatagagaagacagaacaaaaaaaaacacaagaacagggcaaggaaa

SEQ ID NO: 1698 - DNA, 3000 bp, Unknown
  misc_feature (1)..( 3000): cDNA_ID_2142568_gDNA_ID_1620436_Annot_ID_157032 3000 nt of promoter + ATG
tatagtagagagaattatttgtaaagttgtttagatatggatataagaaatggcattaattgtaattcttttgaaaatgaagatttatttcaaattttcacttcaaaaatactaatatagattaaaattgtgctacaaaaatggtcattatatcacataatacacactatgatatgtgaatatataataccatatttaaacaatgttatcatggtcaccctattatagctccaacaaatacatcctatactattatttggaaagtacataataaaaaataaccttattttttgtaagtaattacataggtatgccattagaaataaaattttaaagagttaattaatttaatttaattagaaaaacgaaaaacattattaatttccaaaaaagtaaccaatcaatatcaacatataagatttgatatctaaattttaattaatttaatttagttagaaaaataaaatacattattaatttccaaaaaagtaaccaactaaaatcaacaaattagatttgatatctaaattaacatgttaattttttattaattattatacttcacctctcatctttatatgattctatttttgcgaaagaaataatatcatcatatcatcagtataaaaaaataattagagttttttcgcatattccatgatttgaatttttaaaaacgaatagaaactgttcaatacatgaaaatatattataacgggtcaaaaatagatttaagaaaacttttgactgagtaacgggtcataatttgaatatttatatttaatttcatacatattattttgaaaatttataatcttatatactataataattaataacatattagatttttttttatgtgtatgatgtaatttaatttttagtacaagctggaaaatcctacaattgacgggtttagatcgatatgaatacaagatggtatactacaggtgaaacgctaaaattaacaatcaaaatacaagtgtataatcttaaaacactaaacaatataaataatatcaacaaaacatatacaactcgcagtgtactatacatttaaaatcaaataaaataatatcatatatttataaatcatctttacaaaaaatgtttttagtttagctaaaatataagtctacctgcggtataccgcgggttaatatctagttgtttatgaaaacggtatcacaacaattttttataaggcatcatatttagatgttctaagattctttagagatttaagatctttatttgtccatggaaaataagacgagattatttagttgaatgttcatgagcctatctattattccggaaggtgtcaagtttaactaacttgagtataaaggttttatgattctagtcatatgtgatgtggctctagcagcacaagtatttcaactatactgtttgaaataatggattcttcaggtacatgttgaaggtagagaggtaaaattttcattgtaaaactcacaaccgaagaagagcaaattacaccttcaaaatacacaacgttaaaaaaaaaatgacatgtacgtaagtttgtaaattttgttttgttttgtagaaatttcagaagacgaatcttgcacgtctaaatttgtatctaaaattataacaagatccaaaaggtcactattgttggtgtttataaatgctttcttttcatttttgctctaaactctctaaaatacatgaggtggtaaatatggacttttagtctaaactagatacacacagatgcgaacaaaactatctcaattatgctggagttttgcctttcctaaactttgttatagattttctagatgttagacacaaataagataatatcctctaatagtatatgtcttctgtttccattagcattattattaccaaaccttcatttattccctgttgagttttgatccaatttttcctgtttctttttaatctataatagtcctttttatttatctatctaaagagaattctcatagtggcagcaagtaaggattatttagtttattgttatacttaaaagtgtaaagtataataatttaagtcgatcgaaccagggcttagattgatgtcggctggtagattatagtgtcccacgtcagttgtcatttgtaaggttgcaattcatttaaaatttgaaaaattgatattaccatacacacattctatgcataatgtgcattatcattttttggacaacgatgttattactttgctagtatattgttctaattaatcaatcagtttacaactttgactagccatacaagaatattgacttatcattaacttgacgatttcttacttcataaaaattaattagtcaaacgaatatctatttcttaatttgtaaattgtttggtaaattctctaatatttatactgttttctaagattacaaacaactctcttattttcatgcatgatttacacgtgaataagtaacaacaacataggtccgcaatgatacccaaagcatttcctgaccattcacaccattcaggtctagtacttgtgctcttattcaatcatatatgttatcactagatttgtttctttatttatcccttttaatcaaattgttcaccagtttctacggctcaaaaaccaaaaaaaatcataacacatgacacatgtgacatgtcaaatatatatatttttatccaaaaaacgacatgctaaagttttattttccaacagaaaattcctttttttgtctttttattttttatataactaagaaattttccaacataagttttttttctttcaataataactactattactatatttatttcatatattgtctatttttaaccaataattaccacatgtgacatgtccaatatcgtaattgtatttttttcaaaaaggaaatactaaagttttaatttccgcgcactttcttggctctttctcggaatagtttgtcgtattccgactataaacaaaaaaacaaaaactcttttcttttagagcttctcacaa

SEQ ID NO: 1699 - DNA, 3000 bp, Unknown
  misc_feature (1)..( 3000): cDNA_ID_3063762_gDNA_ID_1620436_Annot_ID_157037 3000 nt of promoter + ATG
taagctttaagctctaagctctctcttttggacctttacctccataacatagggttgtccgttgccaccataatgtttctcctcgtcttgaaataaattcacattgaatgtttgtaagtactttcacattactctaactttagtttactttgattgggtagtgataatttgatcacagaggcggctggtggaaatgtgtctgctcaagctttgaaggaagctgatgagaaggcttttcaagaatcagaggtaaactatatatcgtttgatctgcatttttatcgtacaaatgcatctctggtccagttcctgaaagagtattgatcgcacttacaaaaatggtttttgacgatgactttctaacatgtttctgcagactgaagtgctgaagcagctatcatctatgggtcggcttgtagtttgcgctggagatggtgcggtccaaagcttgagaaatctgtatgttctatataagtttcactagtttctctctagcagttcattcttttagaagacatacacacgctgcttatatctgtttaatatctctcccgtctgttctcatttgatcgtaaatatttgaacagtgcacttcttagacacgggatctccatatggatcgatgttcctctggatatcactgctaaaggggatgatgattcattccactcagaaccttcccctgaggtttttcttccttctttcctctgagctgcataaatttcctatttggccttattacagagaaactgactttcatgatggatgaatccagttgtttgacacactaaaagcgagttacgagaaatcaagaaagggttacgaaacagcagatgtatccatttcccttgaaagtaaggatctatcacaagtcaaataatattcatgacaatttttattatgtgactgattctgctttgttacacggaaacagaaatagctacaaagctagaatttgaagacttggaagcagtaacttctgaagacattgctttggaggtaaagtcttgagctctttttggttatcattttaacttatggttacaaatgttaaaattttatgaacaatgttcttcagattctgaaagaaatagagaagttgacaagagtgaagaaaatgatggaagaagcttctcgacctttctaggtcgattttacactctcattcatagtatgatttatgttgtatatcatctcgacattaatatagctttttttgcataaaatcactcatatgatttttaatttcatagtcgacatgtgttatacaaagaggctcagctttgggtggtggaggagaaggatcatcaatctgtcgccttctctcacgtgagatcgataacgtgctgggcttaatatattgatccactagtatgtgggccttgattatggcccactaatggataagagtgagaaatagtgaaagggcacaaaatagctcatcccaattcccaacagctttcttgtctctcccgtcttttaaaaacaaaacataattaattctccattttttctctgttcgtttgagttgtttttttcttacggtaaaaagacaataaaaacggtaaggtttatttttgtttatagattaattaaagatctaatgtaataaaaagtatgagaaattcttgtttctatgctttgaaatttgaaatttgagctttcattgtataaaaaaaagaatcaaagaatgtttttaatctgggaaaaacaaactttaacgtattttgataaaggttaaaaaatggtaattagaagaaaaaagaaaaagagagcgatgttaatggcgatgagcttattgggatttgttatataaaaaaaacagattgaaagataagagaagaagagagagaggtacctcttgcttcttctttctctcacgcacctctttgaagattcttcttctcttaccttttggattcgtctcttcttcttgattttgagtttgattctaattttggatccagagggtttatttatgtgaatgattccgattttggggaacttgttcgtctgaaatgttttgttgaaccggttgcgtcatcggtgcgtcttttcatggtcgttaagagtttcatgattgcatcggtgttgtgagttttacgatgctgttgttgttgatgagctgattttttttttttttttttctggtgattatttgtctcctatgtgaaacattcttaagtatttttgatcagattgatttgatcacaagtttatcccgttgcaatctctctgtttcattttgtgaacgctcatgtggatcattgatttgtttgatcacttgtggaagatttttttcccagtgttcgattatttgtattttgcttaacttttttattatagtgatgtttgcttgaaacttataacacttgagaatttgtgatgatcatttttgttggaatggctgttattgtatgaactcttcttcttgcttagtagtgttattaataatttgggttttatggcgtatgtttccggatcatgatttgtttgatcgtttcttattcttgtagctggaattagtcataacttcttttgaccattcctgattaacttctgcactttgtgttctattgatgattaaggttaacagtctagcagaacaaatttggttgtatttacttactgtgtcattgattcgctttctccgttttatttgtttcaggaaagggtaactgcaatgaactctgtatctgtcacccttgcatttcatgtaacttcagactgttctgccgtaaaccaatgtcggataaatgttaagtgtttggtttcttgtatgcgggtcagtaagcaagcaatgcacgagttgtggatgcctgtgactgatacataattctagatttttatttattgttctgttagagatagagttagtcagtattgtttattttcaaggatttggtagtttctagggagtttttagataattagggatttggaaactcacatctcagaagtgaccataaacccttttacttgataagagcattagttatg

SEQ ID NO: 1700 - DNA, 3000 bp, Unknown
  misc_feature (1)..( 3000): cDNA_ID_2142584_gDNA_ID_1620436_Annot_ID_157036 3000 nt of promoter + ATG
aataatggtatattcaattggaaaaatagaaatgtcttagattttaaaataagtgatattgctactttagattttgtgttaacgtttagaagaaaaaggatttgtgagtagacccataaattgactttataactcgtaaattaaatcggtcgttataattttttttctaaagcattgtaacgttatatcttacaaaactaatatgattttatttaggttcttctgtaatattagtatagatatgttattcatagtacccaaaaaaaaactactactttatttattagagaaaaaaagggcaagctctagaattaaaatttcataatttttagtagatgttacaataagtataaaggtgggctctgaaatcttgttttgctcaaaagtactcgtaaaagaaattttttactgtattaagatatagtttcaaaagtgtttcatattgctcaagttatttataaaacaagctgagacgaaaaatgggtaattctagtgtatttaaagccatgatacatgaaaatgaagcataagagtgactgacgtggaggttttcttaagaactgattggtgggaatatgagtagtgacttggcaaacgatgattgggtgaatctgaaattgagagaagaaagttgatcaagttgtgaagctataaacagagctgaagatcatttgtggattcataaccaagaaaagtttgttagtttcttcttcaaatttgtttctgttgttagggtctctcatctcgagagctggatgatgattgaagctgcgttacaaaaacatattactcaaaatactacaaactatactaaagacttatttgtcaactataagtataagtataaacaataacatgtttataagcgaaaagacttatatctataattaattacacaaaagtccaatacgcagatcatttgtcaactatcaatcattagtttgtattgagttgctacctcaactattaatagaaaatttaaaataataaagagaaatgtaattgctaaaataccagcatgtgtatatataacacttcaaagagaaaactaactagtttacctaaacaaaagtattctatataacaatgaaaaatctctcaatctttctatttctttttgggctttgcatattggtgatgtatacatgaaaaaatctatgtttacggtcatgaccgaattcagtcgcaaaagcaagaaaatcgtcaaggtgcattgtatatatataaaaacaatataggtataaaatatatcaaaaatggaaaagttatgtcattcagctttaaaccaacgtttggggaacgacgggattttggtgcgacatatataaaggacctgattataagaattttataggttttactacatatcatgcgaaaggtttgtttgttaagggtagatcatcatataattagttagctagagatgataaaatctattttcttgaggatttgttgcctagttactagctataagttttattggaaacaataaaagaaaaaaaaaactactacttatttattagagaaaaaagggcaagctttagaattaaaatttcataatttttagtagatgtcataagtagtgaggcgttgtatacaaaaagtgaactctataatctataggattgccctgaagtacttgtaaaaaaatagtttattaagatatagttgatcgattaattcggcatttgcactttttgtttatgccaaaataaaagacattataagtacatagattatgaaggttaatattaacaacttatctgagattccattttggtggacatatcatttgctgcaaatgatgtaatgcaagtggcgatacaatatccgggtgagataacctctgctaggctggtacttagaagttcatacatttatttttgtccaacatatattgaaagtctccgatttgttatattaactattaatagaaaactttttctgttggacaaaatttaatagaaaatttatgttaacagaaaacaagaaactgtaaattcaaaaatagcaacatagatgttgttataaatacacacaaaaaaacaagtcaacacgacaaaaaaaatcaaaatttctctacagaaaaaatgaaatatttcacaattttctttattttttttagtctttgcatgtttggccatgtatctggcgccggaatcagaatcgtcaacgaactcaaaaataagaagaccctttggatgaggtgttattccaaaaatgatgtacttggtccaacaataataccaaatggaggacaatttacagattatttctttcataatttatttggtacaacgcgttttatgtgtaccttaaaacaagggcctggatttagtcacagtcagagctttagagcatttaaaaattctggcttatgggattggagagctagagaagatgggatctatttaagaagaatctataagaccaaatttgatgatgacacagacaatctgcataaagagcaaagttggatatagtaaatatttacaagctacctaatttatatataagattcaatactcttcattaagacaaattatgtatacaaaaatagtcttattttaattttaatttgtctactaagcaattttttttttttaaataagctgtaaaactattaacactaatttatgtgtgatgtgccaccaaaaaactatgagtaatggcttctaagaaaataatataatttcattcatgtgtataataatttatctataattaacttgcctttaaactcatatgtaacaaccacaaaattcgtgtgtaactactaatgtaaaatcaaaactagtatctttagctaaagaatgatatctattgtaacccacaatcaataatcatgattcatgcatgcatagacccttcttcgaattttcatcttggatttgttttctactcccagttaatctttgtcaaattccgttgcgttaggatatatagttaacagattgattcgccatgtgcgcttttttgtttatatatgcaaaaacgatg

SEQ ID NO: 1701 - DNA, 3000 bp, Unknown
  misc_feature (1)..( 3000): cDNA_ID_2142556_gDNA_ID_1620436_Annot_ID_157029 3000 nt of promoter + ATG
tatgcttaatttggggtaataatgaaaaatttgacataggattatataaagggaatagagagagaaattaagtggtggtcttcacatggcagccatttttagaatatgatgagatgcaagagatgagtggacctatccacaaaaacaacaatgccaatccaccactcttcccatttatatccatacattcttagtttcttacattagcatatctttaaagagttggaaaaacatgtcttgacaaaattagacatgaattatttgcccaaatagatcttcatcattcatcaaacgatttatgttttgatgtaaacaaattttaccaattaatactatttttctgatctccaagtgctatttttttattttattttgcacaaatagtaacccaaggtctctaaatacttagatttctatatttatgaatgtaaggaatgaatgattgcaaggatccatctaacaaacgatataagtcatttggaggataatataatattatgcatagaagaacattcaataatatgtattttttataaatacttatgaatgtttctatgccattgatgttctctaaaaacaatacactgcaattgctaatccattctaatttaattattgctagctaattaattagtcttataccaaatattttctctaaaaacaaatgaacaaaagtttggtggtaagaggcaatgaagtgagtcttctctttcatccaataataatacttttgttttgtgtgttcccttttgcaattatatgcaagtgggtctataattgagtttgattatgaaggctacacacccatctttgtttttttcattattttttacatatatacattttcttttgtattttcactttaaagttctatcggccaaggatggttgatgtgtttagtgtgttattcatctttttttgtcaccattgagaaaatatggttaacagctccaaagttttttaagaattgtttttgtaattattggtgcgaacaatgaataatttgtatatgtaaatatgattgtcttgaataattgtttcatccatatttctcaatagtaaataatgtatcgtttgctttcttaatcggacaaaattaacaacaattgtcgtagattccttcacatttttatcatgaatcatttaatatttcagccgaccgtttcaagtttcaaccatgtgtacactgttttttcacatttacctagcatattcatttcaattgttgccaccattttgaatgaaacctaaattaattattttgtattttatagaaaaataattatttgagtagcgtttggatttatatgatatggaaaaaaaggaatttaataataaatttgctaatgtcatcacctactgactacgtatctccacggatggtgtatgtcctcataaccagacaaattcagccagccttgcttttctttttttcctcctttaacaacccacaaaattaataaaattaaaaactcaaactttgatttgtgtaattaaactacattctctctgaaattcaaaacttgaaaacaaattattgtcgtcaaaaaaactgtattaacaataagaagtgccaaaaaaatataatagtgtatggaagagcttaatcctatcttattgtgagccaaaaaaatatatattctatttcatttcggatatatttaaagataattaaccaaatagtgttttaaaatgtcaaatgtcaaaatatgaaatttatccttgcttcactcggaaataaaactttgttatgaatataacaaacatcttcgtttaaataatcaattaacaataattttagatggactgcgtagaatttgttcctgctttggccaatttttagatgaatttagtttgctctatgatatgttttacaacattaatttagcatatctaagatcaatgtatgctaatgttatttttataaacttttttttggattggacaatgaattttttttttgtaaataaaatttttaattttgtggtttaagaaaacattaccaatagccaatacgtaggtaagtgaatggttaacattctttaaataataactaatcaatctttaatcacataaattagttgaataattgataattattaacgaactactacttaatgactttatttctgcgagtacataaatctctcttactcgcccacaagacaacaatggcataattccgtaattaaaccataaaaccaaggtcaattacaaaatctctctcaagtctgacactactacatcaccttctcttttttctctctttggcgagaatggcctcgtaaccagtgattaggacacatgcatgccatttcccatcaacggtcaagatccatctcctcttcttctccttcaaaccattccccaccgttagatcatctccaaacctaaccacggttcattctttaaccacggtttgtttcggtcagccaggtaggggcctctctgatgtccttcaagactttttatttttctccattaccaaagtcaccaagaagccagaagaaagagaatagagagagagagagagttttgttcttcttctttctggttcctttgctttgctttggttgcgtgatctcctctctcatcaatcttcttcatcatcattctcatcatcattagcttcttgatttttttttccttctttttttcgtttcaagaaactaaacaaagtttctatttatggttttctgattcttcttctacagatctattatttgattctccttcgatcattgtcaacgttttcttcttttgtaatcatcacagttttttttgagaatttgttcatttttttttctcatatattgattcgagttctttcttcttgaatcttgttcttcatagatctagtttttgttttttactctctagatctatagatctgttgaattcacttctttaatccatctctgtgttcttgagttcctatggtctaagtcaaactcaagttcaagatctgttgaatttggaatcttgctggtgaagttagag

SEQ ID NO: 1702 - DNA, 3000 bp, Unknown
  misc_feature (1)..( 3000): cDNA_ID_3063788_gDNA_ID_1620436_Annot_ID_157023 3000 nt of promoter + ATG
cttagtatcacatttaaatgaaaaagaacctattgctaatttttttttttaactcgatgagtcttgatctaatttttatgtattgatcgtaacacgttagtcaacttaactagatagattatatgtgttttttcactctggacttgaatgagttatggcatggtcaggacactaatacaaatcactagataatttccttatacatgtatgcactaatacaaatcactaaattctacagtaaaaagctagaaggcaaagtagctctcataactggtggtgctagcgggctcggtaaggccacggccagcgagtttctccgccatggtgcccgagtcgtgatcgccgacttagacgcggaaaccgggacaaaaaccgctaaagaactaggctcggaggcagagtttgtgcggtgtgatgtcacggtggaggctgatatcgctggagccgtggaaatgacggtggagcggtatgggaagctagacgtgatgtacaataacgctgggattgttggacctatgactccagcgagcatatcgcagcttgatatgacagaattcgagagagtaatgaggattaatgtttttggtgttgtctccggcatcaaacacgccgctaagtttatgattccggctaggtctggatgcattttgtgcacatcaagcgttgcaggtattaacataaaatcaaagtcttagattagatagaaaccttactatatcaaaccaaaagatggttacttagtagttagtacttagtacttagtacttagttaagaatgtataatatcatatcgtattaatcaaagcttggttagtacttagtacttagttaataatgtataatatcatatcgtattaatcaaagcttggttaaacaaaaacttaaatgaagcttaatagttttcaatttgtggtcaacactcaaatttgacttttggtatggacaaaacaatgtaggcgtgactggagggttggctccacattcatacacaatctcaaagttcacaactcccggaatagtcaagtcggcagcaagcgagctctgcgaacacggcgtgcgtataaactgtatctcaccgggtacggtggctacaccgctcactctcagttaccttcagaaagtgtttccgaaggtatcggaggagaagctacgcgaaacagtgaaaggaatgggtgagttaaaaggagctgagtgtgaagaagctgacgtggctaaggctgctttgtatttggcttccaacgacggtaaatacgttactggccataacttggtcgtggatggtggcatgactgctttcaaaatagctggttttccttttccttcggattcatgatcaatcattttgtatcgtctataaataactttgtactgtattcaagattttatatcaaagttggatcttaaaacatttaataaattttcaaagcaaccaactaaatataaaagtttctatagtaagagttaactttgataacatatgactttcatttgaatacaagctggcatgaacttgaagctttgatcacagtttccaactcctcgaccatctcaactctctctttcgaggtaaggcgttttgtgaggaaagttgctttatccaaacgacttgcgttactaaggatatatttcgtcacctctttttcatcttctcgccattcgtagtcttcccatacaaatgtctccagatggagtaacatacatttaggaatattctttggctgaatccatttccacaagggtacgccatctaaacttttctgccatggctgtggttatgagatcaatggcgagttaacacaaagtaaattacatgtatattagatcatcaaaccctaagttgaggtggaaatttgctaaaagatgaattttcaatgcttacaccgatgagcttgaggacttgtaaattaggagaatgatcgagcatgagcattagtagattccaacaatcagctctatatatacacagctccaaatataccaactgataaaatataggaaatggaatctatacatgaaggcaatattattagtagagtaacaatgcaataataaggaaactaactaattacaagaaaaccttaccttcaaggctgatatctccaaggagagacgtttgactgaagtcagtgatctcaagatgaaacttttattattgttgacaatatttgcctccaacagcataggtgcattctcaataagacaagatccacgaccaccaatccatatacttcaagtattttaaagaaggagcatttatcacaaagcccacatgttctttatcatttctattacaaatcgatagtctttgtaaggaaggaactgcaatagttaaaggcttcacattggagtatagagttccatgcacatccaagttttcaagattaggacaaccagataaaaggttaagaactgatgtattgtttatgaagttcacatagtgaaggtgcagagttctaagagatttcagacaaactgaagaagggacaaccatacgaaccaaaaacttgacttccaaggtatctagtgtttcacaattgcacaagctttcaggaaatatgaaccgtcctctaggtgcaatctgatccagtatgaaaattaatggaagatatctaaagttatttaatccaaatctatttttctaaataattttgataatatatatatatatatatgtatctatttttattaatagtttttattttacaatttaatttaataagtttatgcaattatttttgtatttttgtttagctacattggtggatatagcggcgttggtgaataaaattccagcgtatacaaggccagacgttttatcctataacgggccgggcccaatatttaaaccttctagctcacacagaggtcaaagtttttgctctcgtctctagatctgtagaagtagaatggtggagccatcgagccatgtgatgtgatcgaaacaaaaagctctttgcttcttcttcgtccatttctcgtagcacacttttcacaaagaag

SEQ ID NO: 1703 - DNA, 3000 bp, Unknown
  misc_feature (1)..( 3000): cDNA_ID_2046681_gDNA_ID_1620437_Annot_ID_157045 3000 nt of promoter + ATG
ctcttcagatctgttgaaaggatgaaacttttctctccaaggaacactctttgaattatgaaattttttcagggaattgaggaaatgtcagaggttattgaatgttcttatttcttacttataaatacgtttatacgtatgaagatgatggtcgtattgtataactggcttttcaagttgatacggaaaataaaacgacgccgcattaaagaaaatgacaaaagggggctgaggtggcaggtaaatggtaggcagctgacaaaaagtaagtggctgtttcaagggtattatgggaaataatgacttaagttattatcggatacggtaatgactctcatgttaacattgtaaccagccaattataaagagccaagtcatcaaataattatgtgttggtgatgatctgttttctgttggttgattgatcattatacatttatactagtagactaaagatttcaacgtcacttttttggtgataagtttgaaaaagagtaactcaaaccttattaagtttttggtttatgtgtaactgattgggattagagaaaaatagtaaaatacatatctctcgttttacttgtgatcaaaaagattttgtatgattcctaggtgaatcacatctttcgccaacccgtaaagctctggttatgattttgataaatgttccaaggtttctttcgtctttaagtttgttttctataactttgaaaatgtcagaatttggttcttttgaattatcaaaaatttcataatttatactgaaccgcattatttacaaattagtcatttctcaaaatagttcttttgaatttcaattaaaaacggataaaaaaaaggattggaataaatttcagctaaaaaggaccgaatagggtgattttagtgggctaataacaagattatgtagacatcataattcataatgggcctcgtttgaaattgagcccataatagtttgggatcaaccaataacttagtcggtctttgcgagttaagaaaccacgccgcggtagagagaaagagaggaaagcttaagccgacgacgacgacgaagatgagagagacggtgaagttgataagcatggaaggtttcgagttcgtcatcgacagagaagccgctatggtttctcagactatccgaagcatgctcacttctccaggtttcttctcctcttttgttgtagagttggtgatcgtaatcaagattctgatctagtcatcttacttggatttgatggattctgtgatacttaatctgatttagttgtgaattggcctcaatttgagagaaatttagcgagagattatgctcaatcggaaattcaattacgtaatttgaataaagaagcaagtccaaattcataagatcattctcaatttcattatgtagatgctaaatttagtaattctgttgttatttggtatggtaggtggtttctcggaatcgaaagatggcgtagtgactttccctgatataagcaccacaatactagagaagatttgccagtacttctactggtctcttcaatactccaggttccattatctaactcgcttttcacctcttgctctacattgatctctagaacatggcattgtagtagtctctgttagttttcttcagaatcgcatcgctgtttgtaactatccaagtttcactttagtggatcagtcgataagaatgaacgcatacgcatcctttggggatatagttacattgcaactctttacctcattgcactgtcctgcgtttagtctcattagtttatctctatgaaccaatgtattgaaagtgttactgttttctagaattggattcttcttttaccgctcctccactcctatctttctctctttttatagttgtatagtctttaactactgttatgcatatgttccatcttttgacagaggcaaagagacagagtttcatattgagcctgaactgactctagagctgatgatggctgctaactatcttcacacttgaagaatgaaaaggataacgctgttgaatcttattcgacttgtgtgaatcaaaaggataaatctgcattgggttcaagaagaactattgaatagctctaaggaaaagtcatgtacttctttactagctgttagtttttaactgcaacatcaaagttcttgtggcgtccgcgttactagttacttatatgcaaagaacttatcaaagctttgtaacattctattctaataatgatttggtttggtgccgaatcccttgaaaatttctctactttattagacagaatacaaaagtgtgtgactattcatctcaataattggtggaagcaaatcggaaatacacttatctaaaacggcataatacacaaaagaaagtgctattttcgcaatgaaatcagcacacatgtgctggttcgttgtctttgtcttttcctatgatatctcgtgtaaaggctctgcagagatgggccaggcttgcttcatcattaactgcccgaaacagaacacttgcatcactctcaaatatcaatcacattctctaaaccaagatcgtctaggcacattatccaagacgaagctgttggttgcttctgcctccaaattgttccaaaagtcgtaagcacgtttaggccccaaactattggaccactcctctctcaatcctgacgacccttcccatgccacaaataccaatcctaagtcacacattagtgtcggtttgttgtactctttgagatattttttattggaactgacaacatgttactatcgttatagattccaaaaatatggtgacttaccacatcgaaaaaaaataaaattctcccgttgtatatgattatgagtacataaaaacaacttttttgaaaaccgtttgggcaaaagaaacaacattaagcggagaaacagaaaattagattattttctttacttggtccatgtactatctaatatataaacagcctttccatcttgatccccacagaaattataaaccaatcaattgagatg

SEQ ID NO: 1704 - DNA, 3000 bp, Unknown
  misc_feature (1)..( 3000): cDNA_ID_2025310_gDNA_ID_1620437_Annot_ID_157050 3000 nt of promoter + ATG
gatgaatgtaaacgtcgattcagtgtgagactctggaaagtgtttacagattcttttaactgtctccctgttgctgctgttatagacgataagatattatgtatgcacggtggcctttctcccgatttgaccaacgtggaacagattaagaacattaagcgacctactgatgttcctgactctggtttgctctgtgatctgctttggtctgatccaagcaaagatgtcaaaggttgggggatgaatgaccgtggagtctcttacacgtttggccctgacaaagtcgcggagtttctaataaagaatgatatggatctcatctgccgtgcccaccaggttcgtcgtctacacactgttcgtttctattttactaaagatgtcacggaacttctataaaaatataactgttgtgtttttctttttctaaaaggttgtagaggatggatatgagtttttcgccgatagacagcttgttacgatattttctgctcccaactactgtggtgaatttgacaatgctggtgctatgatgagtgttgatgaaagtttaatgtgctctttccaaattcttaagcctgctgatcgaaagccccggttcttatgaagtaaagaggtagttcaagtcttttatactaacttgtgatgagtgtttcaattcctgtttcagtctttcagatttccagattgctataaaaagttcatcatgcatttcttctcaaattacttagattatgacatttgttcatcttttgcttacacaacttgtttaagatttgattgagtaaaacagaaggggtttcgttttgaactttgtgaatatgagctcagagcttggatctcagattcaatcacttacaggaaaacttgtttcatttttgcatgttgcagttgaaacctcgcgggaaagaagaggaaaaaggcgatacgaaagcgggagagacatttgaagctccctgagactttgtccggaggccttgcaaaggcaaaaaaacataatttacatgttatattatcttatttgaactcttgccatttcttttctcaaaacactttatgttcttatgatcttctcctctgactctatatagacagtaaaaaaagtctgcaaattttcattctttttcaacaaccaatttcctcagtgtacatactaaattgttctgtatccatacacacatatacttgggaaatcttcggtttcatggattcttcacaactcgaagcctctttaaaaacagattctttgcttagttgttgtcgtcgctgcaaattatttgacaagtggagagtttttgcagagctaaaaagcgaatacaagttgaccaaaaaaggtcaaatccctggttccatatgaaactgtcaaactttggacgtgcatggatacaaaagcttctgtcagtttactttcctggatttagggttttaaaaccagctgtgaggtttgctgcaatgtggcaatgtcactgcaatgtgttgtatagagtcttaagtcctctgtttactttaaaacccgtattttaacttgctgctattcacaacaagaaaaatgaagtcttgtctagctacttttgctctcgcagtgttagtaacacaaggaagcatttttagtttgtgtttggcctcctctgcttctacaaactctgttcctaattggtttcatcattggccgccgtttaaatggggaccaaaatttccatattctccacctaaaccgccgccaatcgagaaatatcctccaccggtgcagtatccaccaccgatcaagaagtatccaccgccaccatacgagcatccaccggtgaagtatccaccaccgatcaagacttaccctcatccgccggtgaagtatcctccaccagaacagtatccaccgccgattaagaagtatcctccaccagaacagtatccaccgccgattaagaagtatcctccaccagaacagtattcaccgcctttcaagaagtatcctccgccagaacagtatccaccaccgatcaagaagtatcctccgccagaacattatccaccgccgataaaaaagtatcctccgcaagaacagtatccaccaccgattaaaaagtatcctccgccagaaaagtatccacccccgatcaagaagtatcctccgccagaacagtatccaccgccgatcaagaagtatcctccgccaattaagaagtatcctccgccagaagagtatccaccaccgatcaagacttatcctcatccccctgtgaagtatccaccgcctccgtacaagacttaccctcatccgccgatcaaaacttatcctcctccgaaagaatgtcctcctccgcctgaacattacccttggcctccgaaaaagaaatatcctccaccggttgagtatccgtcgccgccatataagaaatatcctccggctgatccatagtaactcaaaaccaaacaaggacgtgtttgtctataagtatatgtctagttaaaaaactgttctgttctttctgttatgttctttctttttcttatgactttctgttatgatgcatcaaataaagaataaactgttctgttttgaatttgttaaataggagagtgcaagctcaagaacaagctgtttcataaataaataaaatatattttctaaaatcaagtaaagtaaaaaaaaaatagatattgtactaaatgaataaacttgattcaacaaagttttgtacgttgttataatttcacttaaataatttagtgcgtcaaaaaaacaaaattaaaacgtaattggtcaaggaaaaaaaaacaagtctcaagggaaaaggaaaacaaaaaaaaaggaaaatttaataagcaatctggaccgttcatactttttagatctgacggctgacagagaactaccattgggcatcttttataaacagagagatttgtttgattccggtcgaactcaaaacataatttgctctcaataagacattaacaaagtcccagaggcagagagagagaatcagagagagagaagtcgag

SEQ ID NO: 1705 - DNA, 3000 bp, Unknown
  misc_feature (1)..( 3000): cDNA_ID_3063842_gDNA_ID_1620437_Annot_ID_157058 3000 nt of promoter + ATG
acgacgtagttagagattcctcatttgagcccaaaacaataatacaatttcgtacactcaaatattggcccaaattccaagttttgttacataacatttgactgggccagtcattattaatctcagcccaaaacataaaaaatatttgtaccctatataataagatcgaaacggacggctgagattgcatcctatgttttgcagttttttgagtcggtcatcgaatccgaaaagcggaaaaggctttctcacgtaataaattaagcttgtagagggtagattcgtaactaagcagcgtgttttccttttttcgggttgagaatcggacccagaacagccaattttaattccgggtcgggttataaacctctatatatatggtaaagcccgcttctttgtcacccgcttcacgatttcttcttcttcgtcgtcttctctcccaatcgtccaattaagctctgctttcaatttctcctgcgaacggtaattatataactctcaatcaattagggtttcaaggaaaacccccaaactcacatcacctttgagtgaattgtatttatactctcaattaggttttctttgaatcgtatcaagatggtgttatcaacgagcgatacgagtagctcttacaactatgttatcgatgacgttatcaacaagtctcgatgcgatcttgtctacaatggagaacttgatgagagtgttcttagccaaattcaatcggttagtttgttaactcctttgtaagttagggttttaggatgattcagaggattttctgaaactgattgaaaaaactttatgtctatagatgtggaaaacgaagatgatacaagcaggagccatgagcggaacaatcgaaacatcttctgcttcgattcccaccacacctgtgatagtgcagacgactcttcagactccggatgcaattcctttacctgagaagaagatgtctccaaagaaagagagtgatggattttattatattcctcagcaagatggagcgagagatgaagctattgtcgatgtagatgagaatgaagagcctttgaacgaggatgatgatgatgaggaagatgatatcgatgatgatgatatgaacattcaacatttggtcatgtgtcaatttgataaggtaatgatgatggctatatagttttctagtggtacatatttactaacaatgatggacttgaaagttgaaacttatacttcaacctacggtgttgcaggtgaagcgttccaagaacaagtgggagtgcaaattcaatgcgggtgttatgcaaataaacggcaaaaatgttcttttctcacaggttagagactaacttctacacaataacaaaaattgtgaagatttcactttggctaattgtatcctctaaatttatgcaggcaacaggagatttcaacttctagaagatgcactgaagatttaacctcttcagaaattgcagaacgtattttggatttgttccaacaataatacttcttttgtaagggatttattgaatggaaattgagaaattttgactataaatgatcaaaatccataaacatgaagatctctcaatgcaaactctaactcaacaaaagaatgaataaagcttttcaaattttcaagatcaaaaacgtaagtaaaatcccaatcgaaagttttgtatcttatgcagcaccagcattcttgcccttcttcttttgaagtttcttcatgtagaattcgagctctttaccttctaatatgtacctgtttcaaattacacaatacaccaagatcagccttcttaactcagagaaaacactgattaaagatgtgatgatttcaatccaaaagatttttttgtttacccatcagcacgaccacattgtccgggtcttgatgcgatacatgcaagtaaccttccactgctaaactgctcttcaaggtgcgagtcaagtgctctgccttcttgtcgcatctccagcttcctttgaacatgattgctcttcttcacttcctcagtggtaacggcctctcctttcttcttgcgaccaatatcaactccatagtgttggagatacccttgcttgaatggagcagcatcaacttgaacaatagcactcttcacaagagtttgtgtacgaacaagctcattgtttgatgcattgtacgccacatccaagatcctagtcttgcgggtcacagcttcacttccccacgagaagtttccagtatcgagcctcaaagctcgccactttacattcccaccacgcacacggatcctcctcaccgtcttgttacttgacagcttagtgttagctggttgtcttccaagctcatacctttataagagataaccaaagttagtttatgtgatcatcaattttgcttcaaccagaagttatacaaagttatcaagcatgtagaaacaaccaaaattaaagaacaagacaagctcatgattcattttgattccaatctactctatgattcaatatttaagcaggggaagattaaaaagcttactttcgcttcttcctccacattttttgcttaccaccagtggcacgtctcttgtgaattgaatcacgagagatacctgcaaaacagagaatcaacaagtcatcaatacaccactattgaagaagaatttctcgacattgatgctagaaaggttatatctttgccagaaatcgaacgagaaagaaacggaattgaaaatgtacccatgatttcaaaagcgtttgattcaagcttttggttctcacgagctttagaggtttaacaaatggcggaagagtaagtggtgtctcgctataaatagtttactctgccaaacacaaacaaaaaaccctaaaacgtcaatttacaatcgtgtccttgctttaaacacaaccacacattaatggaaagaatcgattttttaaaaataatatcaggagtcaaaatctcgaagatgagagataagcgaccaaaattagcgggagaatcctcacttgtctcactccgatccgatc

SEQ ID NO: 1706 - DNA, 3000 bp, Unknown
  misc_feature (1)..( 3000): cDNA_ID_3063827_gDNA_ID_1620437_Annot_ID_157064 3000 nt of promoter + ATG
atctctgttgcggaaaaagcgctatgatagtattcgtcaaatgtttaccaaagttatttcacttcatctctagttttactttcagtgcctcatgtttggagattagcattctgaagttgtgcgtttattaggttttttttttttcgtttcttaggtcgcaagacacaatctgtatgagaaattaacagaaaatttgtgaaattgaaaatggaaaaagcgactgcaatataaactgattaataagaaacttatcctgaataagaataaacaagtcaactagttatttttcagatgttttgctctgttttgataacaactcttacattgtaattatttcatcgaatgacatagtttatcagagtacatatgttaaacaaacattggatctgtaacttttaagtactctccatctcatagactgcttcactccttattattacatcatttaaaagatatatcatgcattgtcttgtaagattcttttggttgcagcagttacgctgttatcgactcagtgtttgaccggtgggtgacgatttcctgttgggttaggtcccgaggggtgcttatgccactttttttcttcgccctaattccagaaaaaatatcttatagctagtaatgctctctttgttattatgtttatgcaaaattggatctccttacccatgttggcatcactcttgcgttgttcggttttgcgatgatctttgcaggtccaatcttgaaatggactattacaagcaaaagacagggaaacgtatgtaagagggcaaagaaccatgccctcaattttttcaacacattttttgtattatctctaagttgtaattcaagcaagctaaacacatacacacatgagtaacgagattaccttcttgacattcccgagtcacgaatctgctgagaagaagacacatgagaaggagaagcttgatgatgatatcatgtcttctcatatttcttatgtagagaattagctaattaattgttttcatataggatgctgcatcatatatatattggatgtgtaacacgcacaatacaacaattttgtcacatctagttggtactcccttggagaatcgtaatgattacctagcttgaagaaaccaggtaagattctctggttaaaatgtcatttcttggaatcctatgccatgacatttccacttcgaaattagactgtctgtagaaatagagtaaagcattacaacttcattcatatttcttatattttccattctgtgcagatttttctgtttttcggcctacatgacaatccgatattcggttccggtatgtttccaaaccgaaataccaaaatttagtgatcatatacagtagctgatctttgttaattaccttattggtactttcttggtatctagaacctattatcttttgaattgtttgcctattaccaccgattgagttcatatgtggaccaataaaaaccggaccaaaccgagcaattaaacctgatttaagtttaatgtcatttatagcaacttcgtgtagctactactataacttgagaacatactatacgtcggcaaaattttgctgccttcatttcaatttcagttaagctttttctttgtcataatcatttaggtgtcattataaccaccacgaaatcttttttaaaaatccaccacgatttatcatatttttatttgtatgtctcttgtgatattgttttttcaccagcaaagtttgtcggtctcgttttcctggtcagggaattaccgttatgtatgtttgtaattatactgctcgcattaccaaaccatttctttaaaatgtatcctctcggaactttcgatatcgatctataaaaataaagttattagttttataccacttggtttataatgatgatacataatacttttgggattatatgtaaagactatgatcaatcgtgttgtggatcttgtgagttgtgattggtttgcagtttgcactatgtcgacaagactatccttataacttggattaaatttttttttttaatatattaaaatgaaagtttttggttcattatatatttgtattttgtaatttacgggtcacgacaatataatgaacatgattaacgtgctttagttatggccctttatacagaaactctggatcactcatgatggcaacttgatttgatctcaatatttatcaaaagaatccaaacttatgtatagatatagacatatagtttctaaatgacttctattaataaaaatgtaattctttgatgaaaatgatcccgatctatgtaaaaagtagatgtaccggtttgatataattttcaactccggtttagtagatcttattcaatttttttattattttaaatattgtgtttatgtagtatagttaaaacaattttcttatatgtatgttactaacaaggtaaagtagttgaaccggttccacgaaatgaatgttttgaaaagtaaaaataaaaaaccatcaggtatccttttatcgacataacattggcaacacctagacaaataggtccaaactatttggcaacacctacacaaatagaaaaaaataggtgctcaacataattggttatcatttcaaaaaaaaaatataagtatgcgcattttgattttgtcttgcatgtgatatatgaaccttctagtcacataacagtgaattttgatatctttgatttggtacctgttttttcttgcaatctgactaaaccgaaactgaaccgaaaatctgtaaaaaccaaatcaaaaccggttaaactacaatcgttgttagaattttcggaagttaacggaaagtggaaaagtcacaaaaccctattggttagaatagtaaagtagaaaataggtatgcccgtagcagatcccagctctttccatgtgttctcataatgaaaacatcgattcccgaaaattcacaaaatcagaaccttgtcatattaaaaaaatctcaatttcaattctctcgatttctctatcatcatcatccatg

SEQ ID NO: 1707 - DNA, 3000 bp, Unknown
  misc_feature (1)..( 3000): cDNA_ID_3434798_gDNA_ID_1620437_Annot_ID_157068 3000 nt of promoter + ATG
agtcatatgtaattatgtaaacaatagtatcagttttcagaatgtacaaagaccaatacgtcaatatatatacagctatactgttaaaaaatatatattcatttatctgcagttaattaaacttgtttttttaattagcatgtttagagcgatgttatactgtagtagacaagagaaaatcgtttaaaaatttgtatcttcgttgtagatgaaatgtcagctattatgtgtactatatatgtaataccgtccaattaaatgcgatgtgcagctgatagacacgtgtatccaacactaaacatcacaattctcccatcacgtttactaattatggccattataattagcaaagttcacattttatgacttactacataattgaatgatagaggtgctatatggagtttttctcgatatttcgtataatcattaacataaatgcgtttgtcaacaacaaaaaagatttaataaataatctgaataataacaaaatttattataatcgtacgccaaaaatacgttttatagccctgcaggaagatttttacgtgaatgccacatcaattcaatgcataattttgtatacgaaccataataggacgaaaaaaacagtctttttctaactatacttgaaaccaattctagactcaagcgggaataaatacacgaaaccgaattcgtcttatgcagtacatagcatgaatgcaatataatctccataacactatcgctctataagccatatataactcatagtcacatgcagtctcatatatgtctcatagttacacatattacaaaatgtctttaacttttgtgtttcctttctacgtacgcatgtgatgatgcttctccgatgtcttagagagcttgggacgtgaaaggttgatgtatggtgttggatactatcagccaaaaaccgtcaagcaacatcgtacaagattgataaatgtctcacatgtgtagtacttaatagtcacaatttgactacacaaacctctaccgacactaatgtagcaattatatcatgttatatgctcttaaggtatagtatgtataacaacatttcattctgtaaaatatcatcatttatatcaaatttatgatatataaaatatcattatcattttaaaataacactaaaataatcagtgcaattccgtataatcttcatatgaaactgcaagaatccttggtgttccaaagattatgatgattattgtgagctttgatttatggtttccatcttgtcaaaaaatggcttttataaatggtagagctttcttagttttccttaagatatacacaacaggttacaaatataatttatttttgctaaaagaaatagttatagtaaacttgtaaaaactactacaactattttatggaaaatgtcttaaagctgtttcaacttttatacacattactgcatttactattctgaaatcaatttttaattaaggtccttgtactataaggaatcctttaaataaatataaatattaacaataaaaaaatccaaaatttcagaatgcaatggtcttacaattacaataataatgtatttgattgtactaaaaatataccttaaatactcaccaattatcttttataatataatccacaaatttctggaagaggaaaaacaagtaaatgcaagtcacatttcacatttcaaattaccaactaccaactacaaactacttccgcgtctcaaattgaaccactaattaatcactactttatatgctcatcattctttttctttcattacaattctagaataatgacttaaccaaaattcatacaaataaaacaatattttggcttccttcaccaggctaagaattttggtattgaaaatctaagtacttcataagaaactgttggaatcatttaaaatttgtgatcatatataaaaaaatttattcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatccaacaacaaaaacataagctaagaaaacgaaactcaactaattttgttatcacccaaaaagaagttcaaacaca

SEQ ID NO: 1708 - DNA, 3000 bp, Unknown
  misc_feature (1)..( 3000): cDNA_ID_3063824_gDNA_ID_1620437_Annot_ID_157066 3000 nt of promoter + ATG
ttttttttatcaaacctctctctaattctaaaaaatgatttctagatttttttgttccacaaagattaattttccaactttttaatacaaattttgttgattataatactaaaatgaattgtaaacttgaaggactattttgaaaataaaaaaaaattattaagttactattgttttatgattattgaaaattgtttagctagtaatttttttttttttttaatatgtgtgaaatttttgaaaattaatccttttagacacagaaagagtagtattagatattacaaagatatcaaaattgttttaatttaaaaatttcactaggtgtttttaataacaatttggttatcttaagctataatgctttgagcgatgcttcaagatttaataatatcgcttggaatcgacaagactaactggagaagaccacttagcaaattagtagaaagcattgcgatgaattttgtaaaatatagcatctccttaacattttcaatttttttttttttttgaattcataattcatatgctgtataatcattaatttatcagctattagtcgtactatgtgaactagatttgaataatgacatgccgtctgatttaatgctatgtgtaactgacggacacgtgtacccaacactagacatcagaactctcccaactagcccaatcacattctccttttccattggaccacctttcatctgcttttaattaactgtggccataagacttagtgaaagaaaaacaaaagttgcagtttttaaactcttaaatataaagatgaataaatttttttatatatgatcacaaattttaaatgattccaacagtttcttatgaagtacttagattttcaataccaaaattcttagcctggtgaaggaagccaaaatattgttttatttgtatgaattttggttaagtcattattctagaattgtaatgaaagaaaaagaatgatgagcatataaagtagtgattaattagtggttcaatttgagacgcggaagtagtttgtagttggtagttggtaatttgaaatgtgaaatgtgacttgcatttacttgtttttcctcttccagaaatttgtggattatattataaaagataattggtgagtatttaaggtatatttttagtacaatcaaatacattattattgtaattgtaagaccattgcattctgaaattttggatttttttattgttaatatttatatttatttaaaggattccttatagtacaaggaccttaattaaaaattgatttcagaatagtaaatgcagtaatgtgtataaaagttgaaacagctttaagacattttccataaaatagttgtagtagtttttacaagtttactataactatttcttttagcaaaaataaattatatttgtaacctgttgtgtatatcttaaggaaaactaagaaagctctaccatttataaaagccattttttgacaagatggaaaccataaatcaaagctcacaataatcatcataatctttggaacaccaaggattcttgcagtttcatatgaagattatacggaattgcactgattattttagtgttattttaaaatgataatgatattttatatatcataaatttgatataaatgatgatattttacagaatgaaatgttgttatacatactataccttaagagcatataacatgatataattgctacattagtgtcggtagaggtttgtgtagtcaaattgtgactattaagtactacacatgtgagacatttatcaatcttgtacgatgttgcttgacggtttttggctgatagtatccaacaccatacatcaacctttcacgtcccaagctctctaagacatcggagaagcatcatcacatgcgtacgtagaaaggaaacacaaaagttaaagacattttgtaatatgtgtaactatgagacatatatgagactgcatgtgactatgagttatatatggcttatagagcgatagtgttatggagattatattgcattcatgctatgtactgcataagacgaattcggtttcgtgtatttattcccgcttgagtctagaattggtttcaagtatagttagaaaaagactgtttttttcgtcctattatggttcgtatacaaaattatgcattgaattgatgtggcattcacgtaaaaatcttcctgcagggctataaaacgtatttttggcgtacgattataataaattttgttattattcagattatttattaaatcttttttgttgttgacaaacgcatttatgttaatgattatacgaaatatcgagaaaaactccatatagcacctctatcattcaattatgtagtaagtcataaaatgtgaactttgctaattataatggccataattagtaaacgtgatgggagaattgtgatgtttagtgttggatacacgtgtctatcagctgcacatcgcatttaattggacggtattacatatatagtacacataatagctgacatttcatctacaacgaagatacaaatttttaaacgattttctcttgtctactacagtataacatcgctctaaacatgctaattaaaaaaacaagtttaattaactgcagataaatgaatatatattttttaacagtatagctgtatatatattgacgtattggtctttgtacattctgaaaactgatactattgtttacataattacatatgactggagaaactaattattttggttagtagaagaaacataactacatatgactggagaaactaattattttcgttagtagaagaaactagaaagaatgcatgaagtaaatgcaaaaccaactactaacaaaccctacttagtcatcatttttcccccatacgaaatccctatataaacccatcatcatctcccacttttctcacatccaacaacaaaacacaagcgtagaaaacaaaactcaactaattgtgttatcacccaaaagagaagagcaaacacaatg

SEQ ID NO: 1709 - DNA, 3000 bp, Unknown
  misc_feature (1)..( 3000): cDNA_ID_1008901_gDNA_ID_1620437_Annot_ID_157062 3000 nt of promoter + ATG
cgttaccattatcggacctcctgatactctctagtaaacaactctcttccttttttgctttctttagatttttagctacttttttttttctgattcttgattcttgtggaacagttttttttttttttttcttcattgatttcggattcgttgattcatatgtaattgttgttacttgagattgaacattgtagatcacataattgtgtggttttcgtattctctctttgtttgtatcggaatttttttttattcttgatttaggtttgttcttatatatagttcagatagtgagatatcgaattgatgtcaatgggattgtattgggaaagatgaaattacccttatctgcaatgctctttatatgatagttaccaaagattttgcttgttgtgcatatggtttaaaacttggtgtaaaaatgcagtgaaggaggattctttaacgcgattatgacatttccgcaaaactatccgaatagtccgccaaccgtgaggtttacttcggatatgtggcatcctaacggttagttttctctctatcggttttgatcggggaaggattcaaaggaatatgaatagaagacagacgtttgaatggtttacttatatttgtcctgcagtttattctgatggtcgtgtttgcatatctattcttcatcctcccggtgatgatcctagcggttatgagcttgcaagcgagcgttggactcctgttcatacagtatgttcaaattgatttgagtttgttcatttttgttcgcttcatagtagtagattctatgattagagttactatagttcagacactataaagggatctctaggtgatttatttcatgtctcagatgttcatgccgtagtgaaacaaattatggtgctttcaggttgagagtattatgttgagtatcatatcaatgctttctggtcctaacgatgagtctccagcaaatgttgaagctgccgtgagtatttcaatcgatttatcgcacatagcttgcaattaagagcagaacatgcttatggattttgtgtgttttctcttgcgcagaaagaatggcgagataagagagatgagttcaagaagaaagtgagccgttgtgtcagaaagtctcaagaaatgttttgatcaacgtcaaacttcacacctttgagatctctggagtttcaatcaaaagttcttcatattcctatctgaaaccctttgaaacgcaacttgttataactcggtttacatctctttttgtcgcgttcgagaaccagagcgttttgaaaggtgtttggttgagaaaagtgctgttcttgagaaactggtattaaaattataaatttcatttgttaagaatcttctttgcttataaagttataaacctataatatcagcaatagtttgctctctgattttgcgctgcttacacttcacagtttgtttgttttgaactggaacttctgccattgcgcttggaatgacattgtttccctctctatagcttcataagtacttgcacagtcattgtcatcacaacccatgccggtttatccaataaaaaccggcatgcagtttatattgaaagtatggaaactgcgtgatgtctacttcaatgtgagtgggtttaagccaaattcattggaaaggaaaatgggagattcttatttagcgaaagggtgatgtccacttcaatgtcatttgaatgtgtttgagccaaatttcctttccaatgtttgattcgcaaacttgagagaacctttgggttatattagcttgatgacttatccggaggtcttcattttcttggtagaagaagtaactaagaacttacacaatcttactatctaaagatgtgaattcaattattcattttacaaaagaagtgtagcttctgctttttattctgtcaatagagccaatatatagttaacaatgatccgacgactaaagatgtcaaattgaaatcatgtgcttagtgttgataaaacgtaagtcatacttctagtttggttggtgttaaccaaaagtaagtcttactcaattgaacaaatgagtttgttgatagatatctcttaaaaaaaattatgtcttcacaaatcttgtagatctttaatacgttttttccccggatgtttattattgtccattttgttaatttaatattccaaaaaataatttaattaatttattataactactcacatttcaaagtattttctctaggatatgtatatgaaaactaaatatggtggatggatggtagatgatgagtttggagacaatggtggatgatacatggtaggagggttgatggtgaatgattgattgttaaacaaagtgattgagaagttgttgacttgtttactattatgtaaatcgtagtatcgatcgttatatagcaattattaatagatactaaaataatagatgtaaaatacaaggaagagtatactataattttcaaaaaatttttaaaaaaacaaacaaaattcgattacagatttacagataaaaaaagtataaagataaatatgtctagcttaatccacgtcatttagctgtaaatggaaaataaaaagctgtatgtgaaaaaaaaaaaaaaaaaaaatctgcaaaaagtaaacaaattgccacgtaagatatctgttaggtcaaacgttgacgtgatttagtagctaacgtcaattagttaatttccgcatttcgtgtatttgaagtctcttctttaacttaaaattatttctgtaattcctttctttaaacaaaacagaacgaaataaataaaaaattcttcgattttgttatttgttagattgaagttcagacacctaggactataagtagacgatctcttattgtcttgtcttctcatcagacagacatcagatcagaagattttggtttcaagctcttcttctacgattccccgaagcttctggtaaaaatctaaacgaaattcccaatcttgtccttagcaaagtttcggtttttacctcttgacaattttcaatg

SEQ ID NO: 1710 - DNA, 3000 bp, Unknown
  misc_feature (1)..( 3000): cDNA_ID_3063847_gDNA_ID_1620437_Annot_ID_157053 3000 nt of promoter + ATG
tggtgacacctcattggttcctcgtaattgccgaactttctttcaaacaacttacgtttagattggaacattaagcttttacagactagtggttaggaataggaaaaatatttgtgttttgagtttaaagtttgtgtttttcaaactagatgttgagtttggcgcatggttttgaaataaatttaaacaggagaatccattaaacacataactcaacatcgagtttgaaaaatgtatgagatcgggcattgttcattatcaagaaaagcattttgtattaatgtatataactaatcatgtgtgatgtggaaattccaacgacaaattggtaagatttcaattcaaagttacaaaacaaagacgagataattaatcaaactagctaggacaatatattgtctccttaccgaaagctctccaaccacctactaaagtaactaaccatgtttcagttataattttattttttcgtattcctatcaagtatcaaatgatatagttaaccaacatttatatatatatattgaaatcactaaacaaacaacaaaagtaacatagattttaatggaactaattttcaccttatatttttacataagatttgaaagtgatggttagtgacttgttggtcgatgacgaatttgttttcaggttaaattttaataataataatatttgaaagaaagatgaagctttcacgtggcacaatgtatttgcctactgtcaacttcaaaaacctggcaactgctatgcagcttcagaggacacgtgtcatgtgttacacacgcgcttcgttttttttcaaccttttgattttgttttgttctgtgatgtgggactcacataattcaaatcatcatcctattgcttgccgccacgtcccagagaattttccgcgaaaagctgagcttctctctttctttccttaattttagttaggttatgaattatttttgtattaatactaactaactaaaatatcatcatcacattacataaacataagattcatcggcgtaacgtaagtaacagttaaagcccaaattacaactctcgatcctacttaatgcatagtaaacgaatgttgacacagaaaaaatcttggtcaagacataaaagtagagaatgtaaacacgtgtcgaacatcgaggaagaaaacaggtcagagaggggtcaacgttgttaaatgttagtaatagagaagtggtccccagtttccaccaaaacccatctacgtacttgtatctcattggatgtcattcctgattgatttagaattgaaaacgttatattttgtttatttctaattgttgattgaatatcttataatttttgcccacaaaagaaaattataagtgtataatatatagttcactcgaatttaacatgtccattgtccaatgtagaacgtatgatcatttctgtttttcagttgcttttattttaaattcccaaaaacccaatattgtgtcaaacattggagaatgatgttcacttttattgtattcacaaaatgctacttatcaactaagaaaattgtaatgtcaaacataagatggtgatattttaaaaatagatgtaaaattagtttagaactgtctgataagtcataagattgcacgattataaatcattgaatattccggacacttgtcaagattaaaaccatgaataagttttcaaattcattttcatcatctcaattgtaaaactaggtaagatatcctttaaaatctttgaatattagttccccggcccatataaaatctcttaaatatatttatttgaaaactctgactgtttgcacttgcagcataaaaaaagggatgaaacaaatggaacaaatgcagaacaaaactaatagaccagacaagtaaaacaaacgaaacaaaacaagtgttgaaatgataactcacaaatttgaacttacttttctagcaaataagaaattgttctaattaaaaaaaaaagcatatgcagtctcaaattgtttctaagaagtattcacgcaccaaggttatatttgtagtgacatattctacaattatcacatttttctcttatgtttcgtagtcgcagatggtcaattttttctataataatttgtccttgaacacaccaaactttagaaacgatgatatataccgtattgtcacgctcacaatgaaacaaacgcgatgaatcgtcatcaccagctaaaagcctaaaacaccatcttagttttcactcagataaaaagattatttgtttccaacctttctattgaattgattagcagtgatgacgtaattagtgatagtttatagtaaaacaaatggaagtggtaataaatttacacaacaaaatatggtaagaatctataaaataagaggttaagagatctcatgttatattaaatgattgaaagaaaaacaaactattggttgatttccatatgtaatagtaagttgtgatgaaagtgatgacgtaattagttgtatttatagtaaaacaaattaaaatggtaaggtaaatttccacaacaaaacttggtaaaaatcttaaaaaaaaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagttttgatctgcccgttcaaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaatagttttgacgatcacatg

SEQ ID NO: 1711 - DNA, 3000 bp, Unknown
  misc_feature (1)..( 3000): cDNA_ID_1976766_gDNA_ID_1620437_Annot_ID_157046 3000 nt of promoter + ATG
caacaacgtaatcaattactagagattttggggcaaaaatagaaagagttattccccttcataaaactgtgagtattcgttaagacttaagaggcacatcaacttaaatcggagttgaaaaagagaaagaacagttgtaaacgagaactaaacggaacataccaattcaagagagatacaccaataagagaagtttaataacaaactttttcttcatttttctttctttctgaacacaaacccatcaaagatggtacgacaagagtaaatgaagagatatatattctacatggtcttgcatcgttgttacatttcatcacccaaaacttgaagagaaaaaaagacagtgaataagcaatagaaaacgaaagtttaaactttcaattaagtagagcagcaacctcttttgccagctccagatgtgtcttcaacgttaatcgttgttccttgccccggaatggcagaattagcagccgctgcttcttgagcagccaaagcttttttgctgatgatgtggtaaatctctgctaacacggtttgaaatgctttctccacattggtggcttcaagagctgatgtctccaagaaagagagaccttctgtctcagctagagtctgtccatcttcctccgcaactgatctcaagtggtttagatcagctttgttcccagccatcatgatcacaatgttggaatccgcatggtctcttagttcacgtagccacctcagaacattgtcaaaggtttgtcttttagtgatgtcatagacaagaagtgcacctaccgctcctctgtaataagcacttgtgatagctctgtaccgctcttgacctgcagtgtcccatatctgggccttaacagtctttccttcaacctgtataaacataaaacacacaaaaagtaatagttaagccatcaacatttttcaatacatcagctgattatgttaatgttttgatgcgttgacttctccagggatggagagttgactttaatgataaggaaaaaaaatcataattagggacaagttgtgggaagctttttgtccattgggtttctccaccatctatacaaaagcaattcctcatgactcatggccagcacattctaagattctctcttgatattaaaatctctaagcaataaaaaaccaaattcaaaaagatgagagaacaatgcacggaatagtttaaaaagttaaaactattcaatgcgcaagacaccacaggatcatttcacttacatggtacctaacataagcatgttccttagactgaccaaaaaggatatgtaaaggatgcaactttacaagtaagaagagtaaaaataagaacacaactgcatcaaatgaactatcgttgacctaaatatgagatcatgaagcagctagccaaccaaaaggcacaaatcttagatcctaagatagagatcacgttaaaaatgaagaaatagcttgaaattgacatatgtcaagatcacagacgcattcagaaaacaagatacttgttcaaatttctctgaatattaccacttgtgaatttaagactatcttttctgctcattctcccaaagtaaaggaaaaaaaaagctacaaaattagaaatcacctgaagagttctggtggcgaattcaacaccaatagtggacttagattccaaacaaaactcattccttgtgaatctagacaagatgtttgttttcccgacaccagaatcaccaatcaacacgatcttgaacaaataatcataatcctgttctaccctatgcgccatttttcctctttgatctcacctataaacacacatatcccccagaaatcaacaagcgatcttcataaagtagacagatccaaagaaattagccccagtcccaaagtacataccttttgttttttccccggaaaaatggcggatgaatcgtgaaaacgaatttcaattgaccctcttcagatctgttgaaaggatgaaacttttctctccaaggaacactctttgaattatgaaattttttcagggaattgaggaaatgtcagaggttattgaatgttcttatttcttacttataaatacgtttatacgtatgaagatgatggtcgtattgtataactggcttttcaagttgatacggaaaataaaacgacgccgcattaaagaaaatgacaaaagggggctgaggtggcaggtaaatggtaggcagctgacaaaaagtaagtggctgtttcaagggtattatgggaaataatgacttaagttattatcggatacggtaatgactctcatgttaacattgtaaccagccaattataaagagccaagtcatcaaataattatgtgttggtgatgatctgttttctgttggttgattgatcattatacatttatactagtagactaaagatttcaacgtcacttttttggtgataagtttgaaaaagagtaactcaaaccttattaagtttttggtttatgtgtaactgattgggattagagaaaaatagtaaaatacatatctctcgttttacttgtgatcaaaaagattttgtatgattcctaggtgaatcacatctttcgccaacccgtaaagctctggttatgattttgataaatgttccaaggtttctttcgtctttaagtttgttttctataactttgaaaatgtcagaatttggttcttttgaattatcaaaaatttcataatttatactgaaccgcattatttacaaattagtcatttctcaaaatagttcttttgaatttcaattaaaaacggataaaaaaaaggattggaataaatttcagctaaaaaggaccgaatagggtgattttagtgggctaataacaagattatgtagacatcataattcataatgggcctcgtttgaaattgagcccataatagtttgggatcaaccaataacttagtcggtctttgcgagttaagaaaccacgccgcggtagagagaaagagaggaaagcttaagccgacgacgacgacgaagatg

SEQ ID NO: 1712 - DNA, 3000 bp, Unknown
  misc_feature (1)..( 3000): cDNA_ID_3063859_gDNA_ID_1620437_Annot_ID_157047 3000 nt of promoter + ATG
ataatcatatacaacgggagaattttattttttttcgatgtggtaagtcaccatatttttggaatctataacgatagtaacatgttgtcagttccaataaaaaatatctcaaagagtacaacaaaccgacactaatgtgtgacttaggattggtatttgtggcatgggaagggtcgtcaggattgagagaggagtggtccaatagtttggggcctaaacgtgcttacgacttttggaacaatttggaggcagaagcaaccaacagcttcgtcttggataatgtgcctagacgatcttggtttagagaatgtgattgatatttgagagtgatgcaagtgttctgtttcgggcagttaatgatgaagcaagcctggcccatctctgcagagcctttacacgagatatcataggaaaagacaaagacaacgaaccagcacatgtgtgctgatttcattgcgaaaatagcactttcttttgtgtattatgccgttttagataagtgtatttccgatttgcttccaccaattattgagatgaatagtcacacacttttgtattctgtctaataaagtagagaaattttcaagggattcggcaccaaaccaaatcattattagaatagaatgttacaaagctttgataagttctttgcatataagtaactagtaacgcggacgccacaagaactttgatgttgcagttaaaaactaacagctagtaaagaagtacatgacttttccttagagctattcaatagttcttcttgaacccaatgcagatttatccttttgattcacacaagtcgaataagattcaacagcgttatccttttcattcttcaagtgtgaagatagttagcagccatcatcagctctagagtcagttcaggctcaatatgaaactctgtctctttgcctctgtcaaaagatggaacatatgcataacagtagttaaagactatacaactataaaaagagagaaagataggagtggaggagcggtaaaagaagaatccaattctagaaaacagtaacactttcaatacattggttcatagagataaactaatgagactaaacgcaggacagtgcaatgaggtaaagagttgcaatgtaactatatccccaaaggatgcgtatgcgttcattcttatcgactgatccactaaagtgaaacttggatagttacaaacagcgatgcgattctgaagaaaactaacagagactactacaatgccatgttctagagatcaatgtagagcaagaggtgaaaagcgagttagataatggaacctggagtattgaagagaccagtagaagtactggcaaatcttctctagtattgtggtgcttatatcagggaaagtcactacgccatctttcgattccgagaaaccacctaccataccaaataacaacagaattactaaatttagcatctacataatgaaattgagaatgatcttatgaatttggacttgcttctttattcaaattacgtaattgaatttccgattgagcataatctctcgctaaatttctctcaaattgaggccaattcacaactaaatcagattaagtatcacagaatccatcaaatccaagtaagatgactagatcagaatcttgattacgatcaccaactctacaacaaaagaggagaagaaacctggagaagtgagcatgcttcggatagtctgagaaaccatagcggcttctctgtcgatgacgaactcgaaaccttccatgcttatcaacttcaccgtctctctcatcttcgtcgtcgtcgtcggcttaagctttcctctctttctctctaccgcggcgtggtttcttaactcgcaaagaccgactaagttattggttgatcccaaactattatgggctcaatttcaaacgaggcccattatgaattatgatgtctacataatcttgttattagcccactaaaatcaccctattcggtcctttttagctgaaatttattccaatccttttttttatccgtttttaattgaaattcaaaagaactattttgagaaatgactaatttgtaaataatgcggttcagtataaattatgaaatttttgataattcaaaagaaccaaattctgacattttcaaagttatagaaaacaaacttaaagacgaaagaaaccttggaacatttatcaaaatcataaccagagctttacgggttggcgaaagatgtgattcacctaggaatcatacaaaatctttttgatcacaagtaaaacgagagatatgtattttactatttttctctaatcccaatcagttacacataaaccaaaaacttaataaggtttgagttactctttttcaaacttatcaccaaaaaagtgacgttgaaatctttagtctactagtataaatgtataatgatcaatcaaccaacagaaaacagatcatcaccaacacataattatttgatgacttggctctttataattggctggttacaatgttaacatgagagtcattaccgtatccgataataacttaagtcattatttcccataatacccttgaaacagccacttactttttgtcagctgcctaccatttacctgccacctcagcccccttttgtcattttctttaatgcggcgtcgttttattttccgtatcaacttgaaaagccagttatacaatacgaccatcatcttcatacgtataaacgtatttataagtaagaaataagaacattcaataacctctgacatttcctcaattccctgaaaaaatttcataattcaaagagtgttccttggagagaaaagtttcatcctttcaacagatctgaagagggtcaattgaaattcgttttcacgattcatccgccatttttccggggaaaaaacaaaaggtatgtactttgggactggggctaatttctttggatctgtctactttatgaagatcgcttgttgatttctgggggatatgtgtgtttataggtgagatcaaagaggaaaa

SEQ ID NO: 1713 - DNA, 3000 bp, Unknown
  misc_feature (1)..( 3000): cDNA_ID_3063882_gDNA_ID_1620438_Annot_ID_157088 3000 nt of promoter + ATG
gtaaacacactcaaaagtgttgaaattataatattacatattttgctcaaaaagagctaaggctttttaaatgtacaaacaaattctcttttgttatatatttctagatttgtctactttaaacgtatgatgtgtttaacacttctttcaacaatatacgtgtatgaataaacatgttttcgacattccacttatgtcaatatcaacacataattttatggctaagcagtaaccaccagctgctgtgtaaaatcacactttaaaaaagtttctttagcctacatctctacgatcatgatgcattggcaataacaagatgacaacaaattttacaaaacaattctcataccatgtggcttaagagaaaaggccagcgaatttattcgaacccaacatatatagtgaagatgtctttttcaatctctttttttaacaagtatactttttttttttggtaaatttcttttagtgaatttactttcatcttgaatcattctttttattttcaattcagttttgttgataatagattttcatgaacgaacaaggttctaagagataataataataaagggggaaacaaaacacatgataataagaatctaataaacaagagaaaaaagagaggtgatgaataaatgtagaagtcgaatcatacaagaggtgcttgttggaaggtcgttggaccaacgcttattgtgatattcatgttcgtattctctatgtaggtttttctttatatcttcccagcatatacgtagttatttaagtttcttagaaaattactatacattgaatatctgaaacaattaatcatgatattatggaattttttttctttcaaaatttgtataaagaaaaaggaattttatagtgggggcattttagcatctcgtcgaagatatgaatgaatagagaattttgcaaagtgtaaagaaaacaaccgaccaaacccacttgttctctcacgtcctttttatgtgttaaattgtcatacacaaaaaaaatatttacaattataatttttctaaagtctttaatgtcaaaattatatgatctatttatatcagtaatacaaatgtaaatcgctatattttatatttttgttaaaaactaaataccataatttaaaagaaatattttctttttctttttatttgcgaagatattgtttagtcgtatggcattgtattagttacttacttagtagttttacagaacgaggtgaagaatgtcggaaaaaagaaagaggtgacgaagaattttgaccaatttgctactttgtaagggaaatataatacaaaaaaattgtatttagcatcattacaaacaatttctccattttgttttaacttttactatcaattttattatttttatacgaaacttataattaataacacgaggtaagcctgttttgttaaattgagtatgtcaattcatttcatgagataataaccttcaaataaagttcataagatagttgccccatatcggtaacttaggcttataaaacagtcttattattggtgatataaaacagtacttaactacttatatataagtacttacaacttattcttattattgttgatataaaacactaaagttgggttaaatcttaattccaattcagctgtttgatgttggtttaaaagtctgtttgcacctatgattctatgatataccgaaccgattcgattaaccagtagttacgagaagttatttgtttcaactaactatctattgatttgatgtaactagtttggtcctctgcgtataaaaggaacattacagaagagattaaatgataggcaattgataattgagacggttcaagaaaagatttagcaaccaacaaccttaacaaattttcatttacgtaactataattatagatcttgctatttttccattttatggcgtcttcttattacgaaactcatactattcagtcacataatctcatttactggactataatgggctttattgtaatgggctttattgtaagacatgagcccacaaatttggaaagtaataagcttcagctcagctaaagagagtctaaaaaccaaagggaaaaatgtcattaaaatccccaacttattgaaaaagttgatttaaatcctcaacttccaacgaaacgaaataaatatcaaacttttgttgattttccaaataaataccaaattttggttgactttccaaataaatatcaaacttttgttcgagtagccatattaagtatgacattaacagaccctgttattagagtccattttttgttaacagactcgttaattgaaaacgacaatattccctataacaataaaacaacgtcgttatgtcataaatgctcaattaaatcccaatttcaaatcatatgaagatttagggttagaattttgcttgatttggagatttaagattggatttgggaatttaattcggtcgttataataaaacgaggtcgctttcttgttataggaaacaataacgttttaaattaacggatctgttaacagaaaattaactccgtgaacgcaatatgttaatctacttaatattatacctaatatgaccatatatacgaaagtttggtatttatttggaaagtcaacaaaaatttgatatttatttcgtttagttggaagttgataatttaaatcaactttttcaataagttggagattttaatgacatttttcccaaaaatcaaggggagttttatggttttatctacttgacccgacagagaaatccggacccggataaaatccgacccgttcgaatgaactcatacggccgagatttttccaccaaactcgacggttaccactcgtttctttgtccaccatcttctctctctctctctctcaacccccgaaaatctccttttcccaaaattttccgattatctcacgccggattgtttttcaatcgccgtcttcataatctccggcgactgaaatcagtctggtaactatttgaattttc

SEQ ID NO: 1714 - DNA, 1418 bp, Unknown
  misc_feature (1)..( 1418): cDNA_ID_3063866_gDNA_ID_1620438_Annot_ID_157099 3000 nt of promoter + ATG
atttatccatgtaacatcacatacacacacatgaatacgtttaacgtttgatctcatacttctcggatttaactcggtttgacgaaagtaaaacaaagtattagaccttggtccaaaatgtagacatcacccctctaataataatgaaaactcatgttatttgggaggagttgtttagagtgattagatccaagaaaatatgtgaacttaattagaaatttcttagatcaaaaaagagggaaaaaaagaagaattgcactctaaactcatacaatataatccaaagtcttttcggttatagattttggtgtacggaacttatctgaaaataaataaataacaagtttgttcgagctacctaaaattagttgattccaattcaagtcattttaaaacattatacacgattttaaaatcgcaaataattaagttgagtgaccaaatgtataggtaaatcatgtatgagtcaaataactgtgcctaaaattgtaattttatgctaaaatgttgattttcatatggactattaaatgaaaaattaacggtggatccaacaagcaataggtgaataagctaaagcaaacccaagaagacataaaacgaagcacaagaagcatattttcttaagtttgaagcaaacaataatttactctatacatttaaatttcaactcgggattcgaattagaagactcgaagatccgacatggaggcatggaaatatttaaaacttacctcggtttcatagatctcaatttaggactatagtttaacacattactacgtctacatgttatatttaatcatctaattaatttgtctcgatttttgttttttttcgattctacagacatacgttaatgtttgcttattccactccccgataataatcaaaatttaaataacaatcaaacacttacccgctgttttggtctgtttctaaccaaacaatgataatcattttgtcatgctcatccaacattagcacaagtctaaacaggccttacacatcagctcaataaagccttaataggcccaattaaaacagtatgggcccacattcttccttctcttaaagcctaaacagttggcgcgtcaaaatcacgtggaggagcactgaagccagtaggtgtctcttcacaggatcatttccttaaagctcattatcacaaaaacaaatccttttgattattattactgaaataaaaagcaaagtgaaaaaggttttaaaaacttttattttcgctcttctccagaaacattccgtttcagatatttttgatttttgaatttgttttcgctctctctctctctctgcttagattagatctgttcctgtgaattgattctctgtttcatcgtttgctcacgccgccgttttcgccggaggtggaagctctcatcgccgtttcgaaaatg

SEQ ID NO: 1715 - DNA, 3000 bp, Unknown
  misc_feature (1)..( 3000): cDNA_ID_2142757_gDNA_ID_1620439_Annot_ID_157106 3000 nt of promoter + ATG
ttatactgtgattgcgggttcgggaagtggtcggagacatgatctaaggcttgatttgcatcctttggtgagcattaatccgaaatattatgatgctattctgaatggtgtggagattctcaagatgaatgatcccgatggtaatcttgcaggacctaatccagatcctctagtatcaccagacttaataccaaaccgtgcaacgccgcggattcgaaaaaataagtcacatattttgccgatcacacttgcagtggttggttctttagttgtgctagcaatgtttgttgttggtgttcttgttatcatgaagaagaagaagaagagcaagccatctacaaactcgtcatggtgtcctcttccgcacgggacagattctacgaatacaaaaccagcgaaatctctgcccgcggatctctgtcgtcgattctccattttcgaaatcaaatccgccacaaatgatttcgaggacaagctaatcatcggagtaggcgggtttggttctgtctacaaaggacaaatagacggtggagccacacttgttgcggttaaacggctggaaattacatcgaaccaaggtgctaaagagttcgaaacagagctcgagatgctctcaaagcttcgacatgtacatctcgtctctctaatcggctactgcgacgaggacaacgagatggtactagtctatgagtatatgccacatggtacacttaaagatcatcttttcaggagggacaaaacctctgatcctccattgtcatggaaacgaaggctagagatttgcattggagcagctcgtggattacagtatcttcatactggagccaagtacacgatcatacatagagacatcaaaaccacaaacatacttctcgatgagaacttcgtcactaaagtatctgactttggtttatcaagagttggtcctactagtgcttctcaaacgcatgtctccaccgtcgttaaaggaacgtttggttacttggaccccgagtactatcgccgtcaagtcttgaccgaaaaatctgacgtgtactcctttggagttgttctgttggaggttttgtgttgtagaccgattagaatgcaaagtgttccaccggaacaagcagatttgatccgatgggtgaagtcaaattacagaagaggaaccgttgatcagatcattgactcagatttatcggctgatatcacttcgacatcgttggaaaagttttgtgagatagccgttagatgcgttcaggaccgtggtatggaacggccaccgatgaacgacgttgtttgggcgcttgagtttgctcttcagcttcacgagactgctaagaagaagaatgacaacgtggagtctctggatctaatgccaagtggtgaggttggtacgaccacggacggagaagatgacttgtttagtaggactacaggacacgtggggaaatcgaccacgaccgatgactctgttctagttgttggtgatgagaggagtggttcgagttggggagtattttcggagatcaatgaacctaaagcacggtagatgatggcttggtaaacaagtattacattcttgctagggttaatatatttgtgtatgtataattgtggaattaaaaaattaatgtatatatatatattattatgagttacatgcgtagcaggttaagttaatcaaaaaacaaaaatctttgtaattattatgtctctctcttccttgactcatgtgataagatattatcttatcaagtttccagttatcatgagtcatgatccttgtagatgattaggctaagcaaaatgacattaagaactaagacgtttgtctaatctagagtggtgttaacatttttcgcctaatgtatgtgacaatataggattcgccaaatcctttatgacaatttttaatctgtacaaatctgatcatcatcgatcccgatacacaaaaactaaactaaataaccaaggactcggcacaaagaacacaagtcctgaagtccaatatcgattagctcaacattgaccttgatggggataaggaaaaattaattcaaatcttggagaataaccgagaaaaaggagaaaattttcatatccccattcgaggaataaggaagttaaacatatctcgaagtgaagactccctcgtataaaagtgaagttcgacagccagccaatagatccacaacttcacgcttaggaaccctacatttagttattgctaagaaccttaacttgctcttcaagataggggaaaatccttttgtaacaatctaatttaaacttgatttttgtactcttttctattttcagtttacttgtgtgttttactcgaacagtcacaactacaaatgtttttaacagattataacatttgcttatgtataaatattctttctttgggtagtcggtacacataatcttttgtttaactactacggttctcgagtaaataaagattgtttatgataataagattttatcaaagacgataattttttattttttaatgagaaatttaattttcctttttctctattttaaaaatatttagtgttaaggctaagttgtagtagatagatgtttatttagagaatagcataaacctaaatttaattatgacgtatatgtatattttacatgaagataattactaacgccaaatcgataaataactgttttaattattatttttcttaaaacatgatattgataacaatctcatcaattaatatctttcaaaaacaaataaaatataatattcgtggaaatttatcaaagaaatctagttacgttctatatatataaagaggcaaaataaataatagtctcgttcgaattaagttatatttattttttaaaggattaaacgccgccttcatataaaaaaaaggaaagtactaattatcaaaaaataaaaagaagtacacactatatatatctaagactttcaaaaccctaacacaccaaatcttaaaggaatcccaatctcatattacttttttctcg

SEQ ID NO: 1716 - DNA, 3000 bp, Unknown
  misc_feature (1)..( 3000): cDNA_ID_2105352_gDNA_ID_1620439_Annot_ID_157109 3000 nt of promoter + ATG
aaaaaaaaaattcacaaatgcaaataagatcttaactaaaattcataaatagataataaaataattaagtcgagaaaaagttgcagtgcgtaaattttattcacggtcatactctcaaattttatttattttctgattataactctttgtttcttcggtcggggtttccgtcgatttggatgatgatgaggatttaaagactcatagttcttcaactgtaatatgttgtattagtggagaaaagaagctttagtctcacaccgacgataagagttctaccggcagtgtagtaatacatagtagaagacggagatctaagatgaaaataacagagacaagaatttgatcaagggaccgaagattcataagatttcatggaatctttgtcgataggggaggtagactccggttcggcgagctgagccaccatcgaaggtctattttttactccttagtatttctctctctcacgatcgaacaagtatctcctcgacaatgacaatatcatatatcttcttccttctcaaaacggctatatagtggtgggatgacagcggatcttggaaaatcatcatcattcagctcacgtcgcccaggttcattggatgtcctgttccgacgagaatctgctcacattggacggcgtcttcaattgtgttctatgatcagatattagaatttcaatatgtaaccggtttagttcagttttgtcatggacatatatctggaaatattctattgcacatttatttataaaaattgaaaatttttaacaaaaaaaaaaactaaaattcataaatgcatgcataatacatactctaacgcatgtttatatgcaattatgtacagtatattattattagtatataccaaactttgatttgtcttttcaaagtccaaaatttaataatactttgataagtcaagtcggcatgtgatgttcttttctttcacaaaacaaaaagttgggtgggttatgcaagtagacaacgatgtggggaagatgatggtttacaatttgtcttagtgctatcaacaaaaacaaaaatcctttttttgtcattatattacccaaaaaatccaatgatccttattattactaagaaaattatattactaactggtcgttttaactatattttctttttatcatctacaacttacataaacaaatcaaaattaattttgagagaagaataatacaaacaagtactattcatatgtcttgatcaaattattttgtcatcactctattatacactccattaagctatttctttcaacaaagtatgattccatctatttctttagatcattaattttgttggtcaaaataagtaaatatagaatttccacttaacatatgcatgggcagtgtaaattaggtcgattaaactgtaaagagagggattaaatttataattacaacttaagaccaaaattatgtggaacataatagataaagtgatagtgagtagacaatttttgacattctgtttgatagaaatcacaaatttgatgtacaataacttaagtatgaaaagaaaattaaaactcaataggatccatagaaaacatatgtatacaaaagactttattaagcatatgttttcatgatattcgacaaacaaagcaagcaaatcaaatgacaaatttcatgtatattaggcagatagctaaaaaaaacaacaaatataacacactaattatcagtatcatactttagccgaatatgagataattcagatgtatatcatcatataaatggtcaaaaaaatatgtggtatatgaattgttcaatgttagattttatgaaaactatgggtaaagtggggtttggcatgttagctttccctaatatgtcactggaatagaaagctagcacgtcattagaagaaaccaaatgttaaatgatccttgacctaaaccaacagaacaatttatctaaaactgttattatttaaatccattaaaacctggtaaataaactatttactattatggttacatttatcctaaaaatcaattggatgatataaacgcgcggatcatcttctaattaaaagaaaccacgtcactagaatatttgcatgaataggttagtgtaattatgcttcttggaagatgcgtttgctattctcaccaccacctggtatatagaaaatgatctgattcgttatgcagttgattaattgtataccctttaccaatattctaagctaacaccaatgcgggaggacatttattctgatgatgtcctttcaacggatcggatttgagtaccatgtgtcacattatggtacattttgattcttgaaatttctctattacattaatattttaagtgtatacataccacacaaacataatttgttttaattaaattaatttcataaagaatagctttaatggattaaaagtatataatgtaaaaaggccaatccaatcaaatttgaagtatctacccgaaaaatggatcatatgataatttgttttaatggatttaccttttatttatctaaaaaccaaatctgaatttgaacctaaccctaaaatataaaaagttattcaaaaattaaattattaaaaaggtatatattaataaaaaaggaaacaaataaatttaattctcattttgaaaaatcaatactattgaccagcttgcaaattcatagtaccatatttttctacaattttttgtcgacacaatacatgactctcttttatcatcctttcaaaaattattttttcaaaatatattactattatccttcttctctttattatccgagtcaaacgccgaattctcatattctacataagacatggctctctttattatccttcctgtatattttttccttcataatatattactatccttctcgtttattaatacaaacttgaattcttcttcttcttaactttgtctgtcaattcacatatatatagtaccaccatcacataagtatctcataacacatcatggtgaacgaagaa

SEQ ID NO: 1717 - DNA, 3000 bp, Unknown
  misc_feature (1)..( 3000): cDNA_ID_2142769_gDNA_ID_1620439_Annot_ID_157110 3000 nt of promoter + ATG
atctaaaacggcatgatgtgcacttacgccgatgcaaaatccttggtttggaaataacgtgacttggaacgacacaatggaggccgagtcgtcggagctttgtaacgcggggactaacgggtacaactcggtggaggggaatggttcattgccggataaactagagaaatcagcgtttgtttcggcgacgctgaatgaaacgtcgtcgttttgggagtagacaatggttggtttgtgatcaagtggttcccatataagtttgccagcgagtgggagatagtgagagaggcatgaggatagagaggttttgagatttgggacgatgactgagtcaaagaaagggcgagttacgttggtgattcggtagaagatgactcgttcgacggcgcgaagtttataatagataaggtcgaaataagtgagtgggagactgagtgactcggccgagtcagagtttgaaggggtgactcgtgccacttcgatgatgttaagtgatgaaaccatttctccaacaatcttgtggtaagagatgtacttaaccggtgatgatcctataaatagatagtatacgatgtattaaaaaaaacaagtaaaatgaaaaataaatctaattactagaaaggataaggaaaaggataacataaatttaatgtggttgatatcacatgatattcgtagattttccaacattgtttgtcgagtagcattaattaagacacatgcattcgattaattaagacttttctgtttacatggttctgtttagtaaattagaggatcatatatcgagtttttcatagttcatttattttacaatttttcatataactctacgtctgaaattatagctcgaaaacgttttatggcatagtatttagcataatttagaaggtcagcaaatgcccatttcgagctaataaaaaatcatatcaacatgttgccaagagatcagaggatggtccccctccgaatgctttcgacaagttgcactacaatatcaaatcagaagaccgactaagcatttaatatccattaattgtttcaccggtggctacgcatgacatcccatactcgtggctagccgcacacgactctaaactctattttttttatggtgacattctcttgtgagtttcagacaatattagggatgttaatgataggtaaaagtctagtgggtatccaaaacccgcttaaaatttaaagcttaaagattcatgttttgtattaaaattaaagtaggtttaaaacggacgaattttatttaaatagagtgttatgtgggttttactctgttgggtttatgggtacccatggacttttttctaactaaacctaatttactaaaacgatctcctccttctctcttctctctctctcctcttctctcctctcttccttcgcggatctcttcttccacaagatgcatttgcagcatgtgttgagagtgtagggattaggagtggtgctggattgtatttagacgtccctacacgttggaattcaacttatgacatgtttgctagagccttaaagtttcgtatgacatttgctagtttgaaagagtgtgacagaaactacaagtcattgccttctgaggatgagtgggatcgtggagagaggatttgtgacattttaaagccgtttgcaaactacaagatgtgtttgagcttgagaggagcatacaacctggttctgacaacacaaagtccaatttgcaaaattatttggatgatccaaggctagatttgaggtcttttacagacatggaggttttgagctattggaaaggtgatggacaacgctttggtgatttagcttctctagtttctgctatacttagcattccaatcactacagtggcagttgagtcatcattcagtattggaggtcgggctttaaaccctttcagaaaccgccttcttcctagaaatgttcaagccttgttatgtactaaaaactggttgcatggttttgtagagttggaaggtaaaaaaaagaatagtctatttttttatacttaatattttttatttgttgatttatatcttcaaattgtaggtgacattgaagaatactttaatgatggaattgaagatactacatcgatagcaagtagctttggagtatgagaagaagttgtttagattttttttcactacttttgtatttctgttttaaattagaaactttgatgaaactttcttttgtataatcttttaaattattaatgtttgagtggattttgagtttataaatttgttagaaactttgatgaaagtaaagaattaaaatcaattaagggtaacaaattaagttgtttttacaaaatataaaatacatgattaaatttaaatacatatcagacataataaaagtatgggtatccactggtagttctgaattacatgggtttttctggattttacccacaagtactaaatcttattcgggtttcttttaatctaggttttttatgggcaggtttgttggtttgggttgggctgaggttttttacccaccacaacatccctagacaatatggttgggaagtctctagaagaaaacgatttattcttttgataactctctagtaccagactactaggccggacctctcttaagagcccacattggttattttcttgtgggtgtctttaaatataaaaccaattaaaaaaatataaaataaattgaagggtgtctttaattttagatttgtgtctttagaaaaacattttagacaccgaaaagagagggtatctttgattttattactaaagacacacatcaagagttgtccaatgaggatgctctaatactcaagtaagatgagagcaatacaccaacatgatggtggtctagtagtagttaaaaagggttggtttctttgtgcccaagtttagtcctttttttgagacaagagatattatttaaatcggaatggagacttgtacaagtatcgaaggagctaatggaccaaattaacaaataaagatg

SEQ ID NO: 1718 - DNA, 3000 bp, Unknown
  misc_feature (1)..( 3000): cDNA_ID_2142800_gDNA_ID_1620439_Annot_ID_157121 3000 nt of promoter + ATG
ttgaaacgggtgtgatttctgtctctcgtgacgttgttttccgggaaacagaattcccttttccagcctctgtttttgactccacgccagactcgcagctctcaccctccaacgcagatcagtcattttttttaccatcagaattacaagctcctacaccggtcagtattactacaactctggaattaacacagtcatcgtcctctaccaatctcaacgatgataattttcgtattccctccgacgaatcaagctctgttaatgagatgtctgacaatgaggatttgaattctccaactaccaatgaatcatctccgttcttgtcaccggcatcaccgtctctgcctttatcaccggcatcactgtctctacctctatcaccggcagcaccctctccgtctctgccaaaaatagcagaaccagaacctgaacctgaactacttggaaaaggaaaacgcaagaaaacacaacctgtgaggcttgcggattatgccactacattacttcaccaaccacacccgtcagtgactccatacccactggacaactatgtatcaagctctcaattctctgctgcttatcaagcttatgtttttgccatatctttgggtattgaaccaaagagctacaaggaagcgattcttgatgagaattggcgttgtgcagtgtctgatgagattgtctctcttgaaaatcttggtacatggacagtagaagacctacctcctggtaagaaagcattgggctgcaaatgggtgtttagactaaaatacaaatcggatggtacgcttgaaagacataaagcacgtttggtggttctcggtaataaacaaaccgaaggcattgactactccgaaacgttcgctcctgtcgcaaaaatggtcaccgttcgtgcttttcttcaacaagtagcatcattagactgggaagttcaccaaatggacgttcacaacgcatttctacacggtgatcttgatgaagaagtttacatcaaatttcctccgggttttggtagtgatgataatcgtaaagtgtgtcgcctgcgcaaagctttgtatggattaaaacaagctcctcgatgttggttcgccaaacttactactgctttgaatgattacgggttcatacaagacatctctgattattcgttatttaccatggagagaaacggcatccgtttacatattcttgtctatgttgatgacttgatcatcacaggctcttctctcgatgtcatcactaagtttaaagggtatttaagctcatgtttctacatgaaggatcttggtattttgcgatacttcttgggaatcgaggttgctaggagtcccgccgggatttacttgtgtcagcgtaagtacgccattgatattatcacagaaacgggtttgcttggagtctggcctgcatcacatcctttggaacagaaccataagcttgctttagcttttggtgacacgatctcggatccttctcggtatcgtcgtcttgttggcagacttatatacctcggcaccacacgtcctgagttgtcttatgcaattcacatgctttcccaattcatgagtgatcctaaagccgatcatatggaagctgctctcagggtcgttcgttatctaaaatcaagtccaggtcaaggtattcttttacgctccaatacacctttggtactcactggttggtgtgactcaggttttgattcttgtccgattacacaaaggtctctaacgggttggtttattcaactgggaggctctccgatctcttggaaaaccaagaaacatgatgtggtttctagatcctcagctgaagcagagtatcgtgctatggccgacaccgttagcgagcttctttggctgcgggctcttcttccagctttaggtatctcgtgtaatgaacccatcatgttgtattctgatagtctttcggctattagtctagctgccaatcctgtttatcatgcacgtacaaagcatgttggtcgcgacgtacacttcgttcgtgatgaaattatacgaggtaccattgccaccaaacacgtctccacgacatctcaactagcagacattatgactaaagcattgggtcgtcgtgagtttgacgcttttcttctcaagctgggtatttgtaatctccatactccagtttgcgggggggtattgggctatgaggcctctcccgagcccacttagattgtatagctacactaggttaaatcatgttgttgtatataaggcattgcctctcttacgtatcaacatgaaacgtctttttacatcttcatctcctttttgacaagatatatcaagcaaacatgaaataaattcgtaatattgctatgctatatgctctactcatcgcttgatattgctatgctaaatctgtcagaaatatgtcaaaatatctcatatatatgcttgactttattattagttagaaacattattttttgtaattaaaggttgctatctttgaaaataaatgaagttattaattgttcattaacaagtaaataataactttatttagtgataaacaactaataaaaaatgttatgaatagtgaggtgcatttacaatacgtaggatggaatttacgtatttaccattaaactgctacactactctaattttttttcttaagaaaaagatagtactagaaattattaccacacacatatattctaccagacttgaaactagaaggtgcatgatacaaagaaaacaatattacaaatcaataaactgcaagctctggtcattgaattgtgtaaaatccaattttaataaaagattgattatcgatagactggttaaacgtttttgaactgccactttgaaacatgtgagttacaaaatgtatatgaataacttggaccacgtcaaatatgacaccggcctttttcctataaatactgagctcgaatgcttcctcattcacaaacaacacactacatatctagaaagcattagaacaaaaaaaaacctttgtttgaaaatg

SEQ ID NO: 1719 - DNA, 3000 bp, Unknown
  misc_feature (1)..( 3000): cDNA_ID_2142793_gDNA_ID_1620439_Annot_ID_157119 3000 nt of promoter + ATG
agaataagatttaccaactatattcccttaatttgatattttagtgttagcattagttttactcaatgttcaaaaaagtttataggtgctaagcaagcggtgatccaatgcctagtacctaaaacgcttaatcgggatttatacaatttttaggcggttaaagcgtttataacataaatactataaatataatattacatataataaacatataaaaatatctattagaaaaataaataaatatgttaatacataaacaaaacatttatttgatttatatcataccttatatgaacatttataactatatgtatagaaacaaaacttagttgaaaattgataaaatacactaaaaacaaaatctatatgattttaggtggtcaaagtgcatggttgtctagacgttttccgagaacctagcgcctaatggaggtttacgcgaccgcctaaatcggtttttaaagcacttcttttactacattgaattactctctttttctaataaacaacattgaattagtctttgcatactatatgctaaaactattccaaaagtaaataatcaacacaatgcacgtaaactttttaatattattctagcagtagcagtccatctaaaataaaagcagacgtttacatagaagatttgttcgtgttagttgtaaatatgcttgtcaatgcagattaagcaagtcttccggtaaacgtaaacttgacgtagtcatagataacttatataaagtatgctctagttttacctacgtcaaagcaaatttgcaaaaaattgtaattctatctatgatatatctagaagacaaagatataaatatgtcataaatctgctcatttcaacagtcttgcatggtctataacgtgggcagttgagttgtctaaatctgctaaaatatatttgtttggcttcttgtatataatttttgtatggcggttttgtagttactgacaagttgactaatgataatttatttgttttcaaaacaaaatgttattagacaaaacaagtgtttttaaaagcagtctatacactatacagttgcctaggtcccgattagacgtttagacgatgcatagatgaccgctttaatcgtctaaaattacataaattttgttttagacgatgcatagattggactacgttagtaatatacaactacaaataatttatttaagacctaaaataattgaaagaaaaaaccaaaaatgaggtaccacttgtaggagtatgtaatcttaactagtatgaacaatgagaagtcagacactcagaccttaaataattgaaagacaaagccaataatgaggtatcacttgtgggagtatgtcatctttactagtatgaacaatgagatatatatataatcgcagaaaaacatattggtgttattttcgttagcgactgctccgatctactaagatggtgtatgtgaatgtcggattcgcacactcaagtatttatttattttgtgagaaagattatttttgaagacaaaaattaaatgtaaaagctagagattaacactcaaatgactatagtatgatttagaaaaattgtgtgtgtgttagatagtcccaaacctctactacttatactaaaacatcgtatttacatgggagaccatagtttctccaagatgtataaatctggagaactcaccaatttcgaatatactgcttcgccctatattagctactataacaataacattgataacaaaattgctccgactgacgctggaaccaaagaagtcaatataaccatggtggaaaccggaccaaaaaccggtaatcgagatggcttaaccaatgttcctaaaccggatccacgacaacagattcctatttctccaaccaagtcttgtcactccgaaacaagtaataacagtacaacttctttcgcatttcccacgtaagtcgttctctaatcttccatgccaatttgctcggttaaaaccagactggttggactgaaaactcggttttaattaattgagttgtgcttatgaggtctattggtttatttttaaaatcctttgtagattaggagagtaccaacaagagcgaaagacatcactaaacacgaagagtgaaagtggaaaaagagaactatcaagacttgactcgaagaccggattgtacccggatgattcgaaacagggcggtgctggtgctggtgctggtggttggctttcttgttgtctctgtttttcggtaaaaaattgaggttattactctttgtcatgtcaattatttaggtcatagctgtccaagagacgcgagacattagacaaggtaattaccgattgtatcctatatattcctatgtaacgaaattcagatactacgtaatcttaatgtgtcgatggaatgaaaaaataaagtattctgtaaatattttctatatattatttagcatatatacgctttataaattataaatttggtccctcccaaatacatgaaaacaatgtagtgataaaaaaaaaaacaaattctgtatatatgctatttttataacataacaagcatttttcttagtcggttaaaatttcaagtgtttaatacttttatataattatgaacgtaagttataatctatgttttttttggtcagtccattattgattattccattcacactatatgcaacctatattcttcctatgaaacttttgatcgtgtgttaaataataatacaaatttgatttcatctaataggtgggtggggactctctaattacgttctttgacatctactcatcaacatttggctaatctttctaaaggaattccatctaccggtcatttttgtttaaatgctctcttgtaactaaaagtccgtaccaaacttgtgtaatttcattaaacattaattatttagtccattccatgtcaaatatgacttatgctcttgtcctataaattttaaagcactgaggattcaccaagtatacatgcataacaaatttagagcgagcaataatg

SEQ ID NO: 1720 - DNA, 3000 bp, Unknown
  misc_feature (1)..( 3000): cDNA_ID_2142765_gDNA_ID_1620439_Annot_ID_157108 3000 nt of promoter + ATG
cccaatttcttagtacattaatctttgaacaagatcttgcatctatgaatttccgtggatagagcattttcaacacaacactcgaaaccttcacatacttatagaactaagaaaataattaaaaagagttaatgtttgactcaaacatgtatattagattgtgttttgctctgaatagatactattattcatatatatatatatatataaacaaaaacctttgcccaaaaataaaataaaaacagaaaacctaaattaaaaatctagattggactacgttagtaatatacaactacaaataatttatttaagacctaaaataattgaaagaaaaaaccaaaaatgaggtaccacttgtaggagtatgtaatcttaactagtatgaacaatgagaagtcagacactcagaccttaaataattgaaagacaaagccaataatgaggtatcacttgtgggagtatgtcatctttactagtatgaacaatgagatatatataatcgcagaaaaacatattggtgttattttcgttagtgactgctccgatctactaagatggtgtatgtgaatgtcggattcgcacactcaagtatttatttattttgtgagaaagattatttttgagggcaaaaatcaaatgtaaaagctagagattaacactcaaatgactatagtatgatttagaaaaattgtgtgtgtgttagatagtcccaaacctctactacttatactaaaacatcgtatttactctcaattatactccataattcttcttttaatgcttccgtttcagtcctcgggtttaatgcctcaatgttcgaatttgaattaatttcgattctcatgggcttctcagttcggcccaacaccccaggccaaactatccccaattcggctttgtcaccatctcgtagtgtcgacacctcgctacatctctgaccatcattccgggtttttttttgggccatacctctcgtgggcttcctccctgcttacgtgacaatctttggttggttccggactacaggtgtgggatccgacaccaacagcgtctacccccacataatgattagtcttttaagatttatctaaaaaaagtagagaagagtaagaaagtgttctcgtcttttactattcccctgtttttcgtaacactagtgttaaaacggatcttttaacacggaacgtccgtgttgtattatgtatgcaaacaatatatttttcaattaggtttccaaatcctctatatgtatattaaaatagagtatatttgatgtttatatatcaagctcacaattattctcaatacagtatttttatttttctttatttaattataatatctttcttatcaaacattctcatttcctagtaatacatattttgattattctaacactaattgccaaacattcaagaatcctaaatttaccaaaattaattattttagatatttttatacgtacaccggagtttaatgttctaaactattctctctctttcacaaagagtgttattcttgttttttttttttcacaaagagtggcattctacattttcaatgtgatacactaagtttcttgatttacctttacccaaagctattttattgaacttcaatcactaatcatgtattaattagggcatacatatatagttcaaaatttcttaatttgtgtaaaatatatcaaaatgacactagttgtgaaacggaaagattacaaaaaatatttttctaaaattaaggaagtgtactggtttaaagattttagagaatttggtgaattttacatattttgagagattttgataggtatacggatgatttgctagatttcatatttaaaaataacaaaataattggtcatttggtgaaatttactaactttcattttcaaatcaattgttaatgtgaagatcgatcttgtatcgatccaatgactctaagcatttcctatttcacaattaaatctctgattctgatcagcttaactacgggtatctgtagaagagagctaaaccattcacgatgttaatcacttttaaattgcaatcatctttgagttgaagttgggttagatgttgatcaattagactcgtcaccgtaagctctctgactacattcaccattgttttttatagactttttttttttcaatcctttcaaatactattttagaggcgtgattgtttactcttatttttcaactaaaaaatattcaaagtctctcaaaatcatttttcattattttttaaaaaagttgttaagcttgaataatagtggattggatatggttttaataaatctattgaataacaagtgattgtgaagaattttgaatgattttccacaaattttagtttcaataacatgaaatttgtgaggacattttaaaatcacaaattgaataaccagtgatttaaaaaaaaaaaaaaaaccaaaaccttcaaaatcctagttccaaagtctatataacaaattttaatacttttctactaaataaacataagaagaaatagtattgttaattagtcacaatccaaatttacagaaccaaatacaacaactttgtaatttcttaatgtattaaaaattttaaaaatttccattagagatagattctgatatataaaacttggataaaataaatatcataaaattcacaagtgcataacacgaacacttgcctagttttcagttaatatacatatgttgaccaaaaaattaagtcttaaaaaaaagaaaaagtaatagtttatacctttattggcttaccaaataacgtctgacgtgtaatcttgactcttgaccttaacttaaatttagatttcatttgatactaattaaactattccctaaattaccaggaagtaaccaaattgtggagagaacaaaaacaccaattcgatattttcattcatggcttagaaataagaatcctctaagttctcctctctattgaaaacccaaaacaaaagttgagaacttttcatatttcag

SEQ ID NO: 1721 - DNA, 2509 bp, Unknown
  misc_feature (1)..( 2509): cDNA_ID_3063951_gDNA_ID_1620440_Annot_ID_157127 3000 nt of promoter + ATG
gatcaagaaaatatcaactcacgagaacaattcctattcttgttcttcttcttgtccttttgagttgctgcaatggagcaagaaccacgaacgtcttcaacacaagctcgccacccaaacaaaaggacgtcgtttcgccacctcatgatcatgtccatcatcaagtacaagatcacaaaagtgtacagttcttggggtccctgccacgtcagtttccggttccaacttctggtccttccagaaaacataacgaaatcggtttaagtagtactaagacttaatcttcaccttgtagttcaaaggtttgattaatgaatcatcctttttacttctgtaagttttttttgttttagtttttgccccttttgaatttggttcaaactgatgtaaatagatttcagtttgatttatttatgggcaatgctgtggatacgatcaaattttttagtttaatattggaacttgtttgatccattgaaatattgcaagtacgtaagagcatccacattggtggttatttatacatgtctttaaatataaaactataaaaaataataataataaaataatgaatgtctttaatttgagatttgtgtcttcctaaagacactttatacacaacaaaagtgaaatgtctttaattttattatttatttatactaaaaacatatataaaaagttgtctactctaagtgtacaagagccgaggatagaagggtcggtttctaattaaacaattattgttctttttattttccgtcttctaatttgatatatatgaaattatatatcatatgttcactgtatcctaatcgtggattattacggacataatgataattgttgagatatatacaagtcccgatcaatttaggctacatctgtttggtagaatattgatggatataagccgagtagtgatttcaatattttatatccactctcttcttataagttatggtaataacaaatagaaggttattctacatatactagtatttgagttggtgtttaaatacctcgggttattcggacatgcatagagaaaatatatggtattttaagataaacattatcccataatatatggacattgacaaatacaaataatgtgtgttcgtgcgtaaaagaattgtcatttctttaaaataagaaggaatgaaagattgaaaggtatatgttctaactaaaacgtgtgattaagattggacttatatacatagttgattactttggatgtatctttttgtttaatttttgtttcaataatgtcattgagtagtcgttgtgaatacgattgaccaacggttgcagagatatattggaggatttgatgtgatatctcctaagaatttcagaagttcattgaacgtttttttggggttagtgaaatagtatcatttgtatctttttgcataatttttgaaaaatcattcatatccacttgattctcattcaaactttgaatacctttattcgaattccatgtgatgatttatacttttcaagaacactatggtcccttgactccattgtctcgcttacaactttagtttacgtcattaacaagtaattaggcttgagctatagcctatagcctatagataagctagttaaaaggtcaaacaaggagattccataaactgtaaaataaaacttccaaaaatgggttgtatatagggaattgtatcttttacatacgttagttctgactgtattattttttttagtactgtccttttttgttcttatataaaaatggatcggatacacatttaaacattagtacttacgggtacatgtctatcctcatatgtattatccaatacatacacttacggacatatgaaagtgaacgatcgactctaattcaagtgaagtaattctgctaactgcaataatctacattttataaagtttgcactttttttttgttttagctacgtttgaattcttaacttactatatatatattatttaaaaaagcttactatattaaaacatcttatatttattgatcaaccactcatgaatcgaattaaaagtacttccacatatatgtattcaaattgtttagataacttaaccatcctttacgtgacagcgctattcaattacaacatgggtcttacaacatttggatttattttgacgccttgttggtaatgagtttattagataattgaaatttttggtcaccgctgtccgctgcgatggtgtgtgtattattattaatcatgcatgcgtgtgagattgaataaattaatataagtcaaattggctgaaaacgttgtgacaaatactagagtgtctatatatatcaggattatgatatgcgggcatgtgatgtgtctaatgcgtacgtgtgcactcgtgtccacgtgcacatacacgtgcggtgtaccccgcgttgatagggtctcgattatttccaatcacgtatatcaattgtttttgtttttgttctttttgataaaaaaaatttttgttacttcacaattcacatatg

SEQ ID NO: 1722 - DNA, 3000 bp, Unknown
  misc_feature (1)..( 3000): cDNA_ID_2142684_gDNA_ID_1620440_Annot_ID_157134 3000 nt of promoter + ATG
cagtttactgaaatgggaatcgaaggagttgtcccagttgaactattgccgcctgaggtccggtccaaataccaagctaaaccaaacgaaaaagccaaacgagcgaagaaagaagaaaccaaaggtggatctcatgaaacagagggaaaccagattggtgtttctaatagtgaagctgaagctgaaggaggaaggggtgatgcagagacgatggagagtgatgctattgcagacactcctacgcctgaggaacagcaaagactcggtggttctgatacagaaaacggtcaagaggccggtcaaatcgaagacggagagacagaagaagctggtctgatggacactgatcttgatcatcctcctatgcccgtctcatgaatacgctttcagtttgtcgaccctttcttcaatggggaatcctttggatatgaagttcaaaagtattgatgtttaacaaattatgttaaaaggtattttctaaatatgtttgtatgagtgcaaatctgctagcttattacctgtctttccatttctatatactcaacaaaatcatcatacaattaagttcttttgcgtaatttatcgtctaagtgtaacactagacacatattcgcagctaataaacattggattcaattgcaatccactaaaaatacactcaaacaaacaaaaaaatcaaatacttgaggaaccaaaagctaaaagtgttactattatagctatcaacataaactttatgttttgccatcaatatttatttagaatataaatgagtggtttttaagtcgtgtcacgatttttaaagtccataaacaccaccgatctccatataataataaggtttcatcatatgccaaatccaataatacgtgaaactataccagttcattgtaggcttatttggttatattattactacctccaatcattgaaaatgtatatactttgtttagtcgttatcacttgtcaatgcatatcaaatcaccttataaatttacccaaattcactattgaattgttgatgcactgtcacataagatcacagttgtcttatagtcgtcgcactgttatgacaaaaaaagtgtcgactcatattgaaacaaaaaaaagactaaacaatgttggcacagcgatgcgataaagaatcgaccaagagacaaccgagtgatttgtgttgtcaacgacaaatgaaaagttgcctatttttgttacttatcgtttgaatacaaaaccgtagatcgatctaaacataatccgaatatactaattttttgtttaaacatgatttattaacaaagtcatttaattattgtaatacaaaaggtttttgccaaaacaacaacatgctactttttcatcattttcccggaagaaactaaagatacatgtggcaccgacacttttctaattttctatcagatcatgtggcccaaaggatttggaaacaaacagtacctagaatgcattctaatcatagatatttatttttataaacctactacgtctttaggcatatattagcttaacactaaaaattacatatgtttttttatatataaagaagacgaactcacaactttattagtactttattgaaatttaagagcaggttaaaaacattgaaaacatcatatattgtgattttagtgttacgcaaatattgtctaaaaaatacgttagtttttcttgacttaacttatagtgtacatatataggtatatagattgtcggcaaatgtatacatatggatgtatggcatataaataaatatgatgtgatatgatagtctcaataatttgcacattgttttccacttgtacataatattttgtggtcaacagtacattaaatttgtatatgcaaaacaggagaaaagacaaatgggaaaaataatggtgtgggtggagcctaatttaattgtatctacgcaagagctagtgaatagaattagagaatttaagtctgtatcaaggcaaatgaaagaaataaagaaagttattccttgaacatttctaattttatatttcaggttaatataaagtacattgataaaacacagttaaaagtcaaaaccaatgtgctcaacatcctctaagcattatatatatagcttttatttttgtgaatctatttttattgtgattagtatagtcatcactcaggagacagaagaacaaaatagagggaaataataaatgtaaagggtgatccaatgtttaccaaatctatataaaattttcgtccttttccgataaaaagactcagtgagtcaaaattattcatttaatttttcttacgtcaatttaaagtcaatttatacattttaatttttgtgtctactttataagtactcagtattttttttttttgtataaagaatttaacgaaattaccaactgttaagacaaaataggagtggaggacagagagcgccaagcgacacacttttactgggtcccacattttaaattcatttattatcttttatttattttctaaatctctttttatttttttgttggtagtttgtgtggttttctttctctactttggtttggtagttgattacttgaggaggtacttcaatatcttccgtctgtgtctctctctcttcgtcttcttcattacgcgtcttcttctttctcctcttcttctacattagcccctctctctttaattagctgcagctcacctttcactatctcttcttttatattgattgtgaacttgtgtgtgtgcgtacatttggagtttcagagaaaaacagttggattcactccaatacctaacctttcacccatcttcctcattacttcttcagaagaaactgagaaatcttctctgcaaagcttgtaattgcatgttttgatgggagttgtaacgactggatctctctcgaccaacctgttgggttgacttgacccggttgcagacctcggaagctagagattgcgtgtgtgtgtctgaatttgacatactgtctactgttttgtcggtact

SEQ ID NO: 1723 - DNA, 3000 bp, Unknown
  misc_feature (1)..( 3000): cDNA_ID_2142696_gDNA_ID_1620440_Annot_ID_157138 3000 nt of promoter + ATG
gaaataaaccgaataataatcatcaagtttgaataggcaatgattttgataaagttggtataaatttttgatttaatagcaaaaaaagatcaaaattgtttactacaatcatatattctgcaagaaattgaatatcatcataacaggattaattagaaatatatttataattgatgataaatagagaagaacaacaaaatttatcataatataatttgattaaaaaaaacccaagttattttatgatttaacataaattgagtagtaacatagaatttggaaaaatatttgaaaagcacaaactgaataacatgtgatattaagaacaaaacaaaatcttctaaaacccacgacaaattcttttcttaatgggtatactacgcctttctgcttcttcccgaccaatcttgcaacgaggacaatcgcaatgcccctctcgaatttcaccttcttcaatcccatcatcattctctgcttcactccttgttctttttcttgcgactgtttccggattttcgttaccttgcagttcttggatctctgttttcataagtgcgttgaacatttgagaaagaaccacgtctccttgaaacagattttgaagagactttatgagttcatctccttgtatatgccgggacctaaattgtttcatcaaccccatgtattccttgagtttcgcttcacttagtctttctttgatgaactccgctatatacaaaaaccaatgcttacatacggcttcactctcaatctttgttgtcttcatcgtttggatacaacactttgttttttttcttcttctttgtcttacaattatgattcgagtgtatttataaggaactgagttgtttacaatccgatttagtttgggattctaaattctaactgatcaagcttatacttaccaacttaaaaaaaaaaaaaaaaaaaacttatcaagtttttttcacatgattaagataattatcacacgaatcatgtattatttagaaaaaaagaatacttagattatgtttggagtgttgacaaataaaagaagataatgtttggaagattacaggaaaataatgtgagatttgatctgtgttttactttcagacgttaatatccatccgcttagacctgccattaccattgctggtttcctctacactggaaagagagaatctcggaatagcgtaattgtaacggtcaggtggttgctgcggatagagtgtaggagactgcatgagattgtgttgcggtaatgtgttatatttgtaagcatctccttcccttaggctgcaaaattcaaaagaccaaaacccgataaagaaaagaaatccgattttttttaggatgataaatatatataccttgttcttttatagaactgatcttcatcacttgtgccctcatctaaccgctgggaaggtgcatgggaaagagaccatgctgaagaaggcgacggtagttcgtctgagaaatatcttcttcttatcaactgaaaacgaaaaacgttcattaggttgaagagaaagagagagagggagagagctattgtaaaacatggcaaggtcagaaatgacaccaaccatatggaaaattttggtcagagcttctttgtcatatctagcttccttggcagcctgtgcataattttaccaaaattatatgacataccgcataacactaaattcaaataaagcaagtaatttagtctgtggttaccattatgagaccaacattgctagggaagctctcagagagaggaagttcatcactatggggaagcagaccctgcttctcaacccaatgacgagctgcatcaacaagattgccactgcttccatttgttcctcctttggcagcaatatcagctttgtttccaataacgatgtatgggacgggaagaccaccaggcccaccagaagaaaggggagctgaaaactccccagttactgaaacttcacccgcccatttctgcaaattagtttttgtagtcctttgcgaaagatcatgaacaaaaataactcctgcataatcaaacagtcgcatcagtgacaaaacagggacagagatgacatttgttgagacagaccattgatttgtgaatagaacagtgagcggcaatctttgtatcgttcatgacctgaaacatcccaaagttcgacgaagaaatctctctctgagtcacctttaatgatacttgaagaactagcaggacttgcgtaagttaagtgctgcaccaaagagagttccagaaactaagtagggaaacttatcccatgctctctttaaccatatcgagaattttttttatagaacagcttaagttaccttgacaccaactgtacatccaatagtttgagatgggcgaacaatagaggagcctttgacaatgagatgcacaagagatgattttcccacacctaatttgatatccagagataaaactttgctcaatagtggagaagatgtagtagacttacgaaacttgactcttattaggttccacaagtagaaactcatatccaatcatcatgagaaatcttctcattagctccttctttaaggatgagtttgtgcactacgacaaactttctttagttccattaaatggctacttaaaaagctagaaccattaccaaatctatggaaacgagaatttgttaatattacctgaatcaccaaccaccaatactcgaatttggccgcataatggcgctaccatatgttccttattttccctgccacgttccctccaaaaccgcattttgattactccagcaaaatcggcactgcgaaattaagtcccatagtcgcgtcttcgaccaaaagagaagcttccagaaatcatcatttcgaaactctgattcctagctgtaagcagattattctaatccatcaccttgcacattgcaaaacagagtctcggctacagttccttcaccttcctagtgcaaataatctctagagcacaaatcgaaaccaataccgaagttaacacaattgatg

SEQ ID NO: 1724 - DNA, 3000 bp, Unknown
  misc_feature (1)..( 3000): cDNA_ID_2142739_gDNA_ID_1620440_Annot_ID_157152 3000 nt of promoter + ATG
attacactcttaagctagaaagactcaagcggactctgaaaaagggtaaagagaaaagtggcatctgattgatcaccttctaggcttctactgcttagcacgctttgcaagataacttgtagtgattttagagaaacgagtgattgtggagaacaattgccataaagagcgtcccttaacaacaccttctctaaagctcctcgcttgtttagccaacattggttctgtttcatctgtcttggtttgacgcatcacctcctgcattgaagctactgatgaggtaaaaatggagttaaccatgaaagtccatagttcgaatagaagagttcagaagtgaaaggtcagacctggattcatgtttgttaaccgtcttagtctatcttcagctacacgaatagcccgtgtcgagcttttaacaccttgagtgataccttggctacacaaacactgaaagagttacaaaacagatatgaagaaattggtaatcatcatggtgggatgtgagacaaaccctaaatcactgagctccatagttaagtcactgatctccattcccgataaacgaacagcagccattgtatctggtagctcttctctagttacatccaaaagcttttcaagagactcagctgctttcttgaaagcctttctcaacattccaaagtaaaactcaaatcaaccttcaaaatccatcaaagggttgaagaaatctgtaaaagcaaaatgttggagaacgaaccagaagagtaggaatcgcagcaaagaagagccacgatgctgaaattgctgtctgcaacagaacccatgatgatgattgtttacaaagtgacataaagtccagatctttattgagcaatttgaatcaaaacctaaatccaagagaggcttaccacgcaagcgacgacattgagcaagacgaagtgcttctgtgtgaatgtccattgagagagttggagaggaggctgtcccacggacgatgttaattgggaagagatcgatggctcctgaggattcgagtacaatgcagagggagtagaagatgcgattgagtctgaacccttggtcaatcgtgaaatcggtgaagctagccggagagtgacccgtcggcgaaaggagagatttttatcgatgaatccgttatggagaatcggattccaagagattagagattggggtgattgcaatttcgaaggcgagaataacattgtgaatggttttagctctattcgtcagaaaccattgttaagcttcgagtcgacgataacaatggatttcagttgtgtcagcgagaaaatttgcgtcaagtttagaaacaacaatatttcacgaaaagtcctctgtttatgcgttaactattgaaaataaccccattactatcatttgagttaatttgaccttctttgcgtcatatgcaaaatcggaacaccaccacattggtttggaggtttgtgagctacaagcctataaactacacgtagcacctccctatgcacgtgtcacatgaatgattttaagggtttgggctgatgtttgagctataactacatatatacatttggtttgattcgtttttcttacattatagtttcatcaaaagccaaagcataattgatggatcaagtactctactcctcttacatcataaaaatccctgtaatatcacgaatatcaccatcacaagctcaacttacgaccaggctcaataacacgacttattttggcttgtcatcgtcgagaggcaattttgggaaggtgtttgcaaaagagtctcgtaaagtgaaactgattagtccggaaggtgaggagcaagagatagaaggaaacgaagattgttgcatacttgagtctgcggagaacgcgggacttgaactgccatactcgtgtaggtcagggacttgtgggacatgttgtggaaagttggtgtcagggaaagtggatcagtcactagggtcctttcttgaggaagagcagattcaaaaaggttacatcctcacgtgtatcgcacttccactagaagattgtgttgtttacactcacaaacaatccgatcttatatgagttacacatgcctgccttgaacttttgaaatctcagtattaaaatatgtatttcagtatttgatgtgttttgatgtatttttatgtattgatatcattttacatacgttgattcaaaatatttaaatcggattccacttacaaaatcagactagtaatgtatatgtgcttcgatcatctttgttcagtagttgaggcttttatccccatcatgggtctgtaattggtatcaaatatactatataggcccattaaggattcgtaagatatgggaaataacgttgggctttatttcgtcaccatgggtttagttgttgttgttgagttgtctttttcgcatctggacggatattgtccgtatgaatttcttagactataaagattaaatgtaatttcaaattattatttgatatacttaattcaattttataaatttaatatcttcaaaaaagtttgtgtccacaatataacaaatgttatcaaagcaaaaaaaaaaaaaaaaacttcttctaatataacaaatttccctaaatagcttgcaaattatctgtaaacatgatgaaaatattaaacatgatgaaaaatattaaattatcatattattcaaaaaataattaattagccaaaagctatatatgaattttgggccttacaataatattttcgcaaacggcgcctaaataatttgggggaaaaaatcaaaaaccctatttccttttcatgaagagcgctcgttgaaatcacgcaataagtagaacacatttggacaaaaagaaaagataaaataaaataaaaaacaaaacccccaaatttgtgtctcctccggaaaaaaaattcgaaattccggatccaccgccatcaatccctagctttctctctctttctctatcttcgccggcgaaaccagtagggttgctcaattcgttggtagagtactgtggca

SEQ ID NO: 1725 - DNA, 3000 bp, Unknown
  misc_feature (1)..( 3000): cDNA_ID_2142734_gDNA_ID_1620440_Annot_ID_157148 3000 nt of promoter + ATG
acatgatctatttatcttctatcaacaaatttcatataaaaaatttctatacttttttttgctggtatcaaacttttctatacttgatacgtacgtacacatataatagttgaatttttgactaactgtaattacggtaaatattaattagtttcacacatgcacccgttttcaactgctatatatgttaatcgtataaatcgttagtaaacattttttttcttggtaaggatcgttaataaacattttagtaatgtttatattcacaatttaattaaatctattgcagcagctggttttaatttgttgacatcatcattagaatattatgttagcttagctcgtgggtcatatattaatcaatcataattactcggcgtttgtaacgcattattccccttagcgagacatttttgtcgtatcttattgttatatgctacgttctataaacatatccctaattattgtgtaaatagtcaacgtttgtattgttacatatgtacatgtaaatcagtaaataatgactcataaaagtgcaaaatcgtttgatgattagaccaaaaactgtttatcaaattacgatttatgacaatataatctaattaatgttattatactttgtttatcagtattatggattgttttcacgtttcaaattcggtttatattattatgatcaccacagacgagtatatagtattcaatttcactactttttttacacgagtacaggacataaacaaatcgtaaacaggaagatgcaatataggaatagatgcgaccgataagctgttacaatcagattagtatatttaattatcatattttagttataaccactcaatgtaattgctgtaagttgactaagaagaaatgatgagtgatttgaactctatttatgacccaatctcttgtagttagaagaaagaagaaaaaaaatggagggagagggaagaagagaagatggagattgctcttatctctgcatcccttttaactccatccgcgatatctttcaatcgttcttcactaggtttcgcggtctaactcctgataattctccggtgacggtgagtaatatgaatcaacaattcttataagttaatatgcacggattcatacaaaatagatttatgatcacttctatcaaaagcaattttctcgttttccttttaacgtgaaattcacaatcctatatcatatatattaaaacgatgattaatttgtttaatattcgtcagtgttatgaagtaaatatttctgataactgtttgtaatttcggagtttctttaatcgttattttttgtattttacaattttacatacttgtggaattttgaataactatttgccaaatgatcatgttcttaatcgtgattaaatttactcggatgggtacgatattaatatatggtagttggtacttgtataaagaaaatggtaaatggtttcttgagctcattcatataaaatcaatcatttaaaaaatcaaatacatgtttcgaatccgtgggctaatttatgaaacttgatttggaaactaagtctaaagtacgacatgaatgtttttttttttgtttctgaattattgtcacatctttcttttcaatatgaaatttctaatggaaaatgtgtatatgtaataatgttggtgacgaagatatcacaagaagtagaggaagagacagaggtagtgaatataccgaggagtgtggtgtcggggaacgttgcagcgcgaaagggtaagcagcaaacgagttccgggaagggtggaggtaccaactaggcaccttcctaattttagcttccacaagtcttcgtttcaacaaaaagtcaacttcaacattaagttaataatattgttaacatttacaacttctcaagcttatgtatattgttataagtatcttatattttatgtgaattatgtgattattgactgtttgtaagctctttgagtcatttcatgtatgaataaaagataaaagcaaattccctcttatgatatatgaaaaagttgtaaaagaaaaaataattaaataaggatgaataaaaagtttgggattgtgactgtaaataatagtgctggctagttaagattgtgattcagaactacagatcttggccaaggtgaataaaaagtttcacaaatgggcacaagaatgtaaaaagacaatgagttagataaaaataaatcaagattatttgttgtttttatttataaataataataaaagttctaattgttttactgatatgcaactacaaaactgtagagtgagtgggtcattcgtacgcaaaccaaaatattccctttatctgtcccaaaatgaaactaaactccaagggttttatgggtttgcacagttggccactgatctctgcatctgaaattcaaactccacattttccattgtatgtgaatacatgattaaataaaaaaacaattttgccaaaaaatgaaactaaacactctacaagtaaggcagcgtaacaatatcttttaaagaataataagaaagcgattttgtccactaccttgaatatttttatgtcttgatttctatagtagacttttttgataattcccaaaaacagtgatatttattcttttaaattaatttatatatttttgattgaatagtttgataaaacttctcacagctagtttatatatagaagaaagatctaataagataaattaagactttcatcgatcattggccttcaaaaccaatttgatctggtcaaccttattgtaagtagagcacatgtgtacatcatgttgaaaaacataaataaatagtaatattttataccgaacatgcaataatacgaaaagacgcgccaaatgagctgttattagtagattaatatatgtaattaccattttataataattagtgtaaattactaaatactgatgagcctatattaataaactcaagtcacacctcagtctctcacttagctctcacgaagcagaattgaagaaaaac

SEQ ID NO: 1726 - DNA, 3000 bp, Unknown
  misc_feature (1)..( 3000): cDNA_ID_3063937_gDNA_ID_1620440_Annot_ID_157136 3000 nt of promoter + ATG
acaaaaatcccctctatttttgttgtttgagaatagtagtactagcaagtgcaagattgatgcctgatatgagctgataaacttcgtacctttttcttatcatttgactggcttcactaggttgcttgcagtttttgtgcttgtgaagaaacaagtgaataattggacactttttcctttaattggttttgtgtctctaggtagagcatgtcaggtccgagaggaacttacttgcagaagttgacagccgttacattgtaaagcttttttactcttttcaagattctgaatgtttgtatcttatcatggagtatttacctgggggtgacatcatgacactactcatgagagaagacattctttctgaagatgttgcccgtttttatattgctgagagcattcttgccatccattcaattcatcaacacaactatgttcacaggtataataagttttgacatcatttttattgctagtgatttagggtgtaaaagagatctctacgtattgttaaaagtccatgtatactatttggctctttggttcttgatttgagtttgtttcttcttgcctgtagggacatcaaacctgataatttgatactagacaaaagtgggcatttgaagctttcagattttggtttatgtaagccacttgatgacaagtattcttcattgctattagaagacgatgaaatgttgtctcaggattcagagaaccagtcaggaaaatcagacgctgacaaagcaccctggcaaatgcctaaagagcagttactgcagtggaaacgcaatcgccgtgcattggtacttatgctgcttctctaattgaattacatgggctactcattttatgctacacaatagagatcagttaccacatccaaaatatcttgggtaatcaataggtctctcaattttataggcttattcaaccgttggaactcttgattacatggctccagaagtactcctaaagaaaggatatggaatggaatgtgattggtggtctctcggcgcaattttgtatgagatgttagttgggtatcccccattctgttctgatgacccccgtataacatgccgcaaggtaggtgtatacaattggttagtcatataaaattttatctatatttgaaatagtcatgcttgcttaaaaagacttgtgcttcttatctcagataattaattggagggtatgcttgaagttccctgaagaaccaaaaatatcagatgaagccagagacttgatttgtcggttgctttgtgatgttgattcaaggttgggaaccagaggtgttgaggagataaaggtgcgacttctgaaaaggatatgtaaaattacgattcagtttcatgatccttgatatcattgtattatattttgttcatgtttcagtcgcatccatggttcaaaggcaccccatgggacaaactgtatgacatggaggcagcttatagacccattgtcgatggagaactagacacacaaaattttgagaagtttcctgaagtaagtttgatagaatctcaaaaaacttgtcatgacataatttgtggcatgaggcattatgttgaaaccgactagtttggtgaacctaaaacttgttttaaaactgcttgttagaagtcaaaactgtcttatggatcttagtattgctaaaatgagaaagtcaaaccgtctaatatcctcatcaattttcttgatattttcttgtaggttgaaggatcaccatccgaagcaccacaagttggtccttggagaaaggtgaatcactccactagattcctatcgtataatctgtgttgcaaattgacatatgcgaaaatttctctgaacatgataaaactagcagattatgttttgttatggttgagactagtatcaacgagtttggacagtatgctattgatgaaaacaatttggtgctaactttataaattgggttgagcagatgttgacgtccaaggacaccaacttcataggatttacatttaagaagtcagacatcacaagatcaatggaaagttcaggtagtcttcatatctcttgtctctactgcttatgtgtttgcttattataacttgctcttaagataaattgtcttctagaaaaaggtccaatagttggatatagatctaagtatcagttgtgacattgaaatgtaggtgcagacatgaaatcaaatggatcaggggaagccccgtcgttgatatcattgttaggtatgtaaccaaactgtaaacgccgcaaagcgagtgatagttttgtggttgtagaagagagattgaatgtgaatgtttatatgattcaggtcggatcaatatggaagaaggtgaaggtggtgagttaaaccacaagacatagggaaaatacaaatattattgattttttatccgcttgcagttgttttgatcatttggcagaggcaatggagaggcgatggtagttttttaaccagatcacttatgatggggttcataaaaacttctatttccttttttttttcttgtaacatatttgtttttttttcaatctaaaaaagaaactgtaaagcatggaagaataatttctggaacattttacccacaagttatcaaatacatcaaaaaatgaagctcgcttttctgccatactatttctccatcaaaataatttgaaccaaacctaaatattgtgtggccgtaataagttgtatatataggttgataaaaaaaaacaataattagtgagaaaaaacaatttaggacgttttaaaaattattaagataaatgggccttttctatacaactattgggcccatcactgtcgtaactgattttatgtacgaagtaccgtttataacctcgctattattcggaatttacgattaaatcaccatcttctagatatcgatcaaacaggcacaactaaattcaattatctcattagcttcttccaattcgaaaccctaacaaaagccctaatttacgaaatacgccgaatcgttgacgagaatg

SEQ ID NO: 1727 - DNA, 3000 bp, Unknown
  misc_feature (1)..( 3000): cDNA_ID_3063945_gDNA_ID_1620440_Annot_ID_157132 3000 nt of promoter + ATG
agaattgtcatatggagataaggaccaaaagcataagaaaaaaaaaaatcacttgccttttggaggatctttttcatatttggtttcattagatgtattaaaaacaccttttatattgacggctgaaagaataagtcacgcaagtaaacgttacacaccttttaaacattcacataccaaataatcgtatatgcacgagaaacccttcttacctgagcgctcagataacggaaaaaagtgagccaaaaacataagaatccttccacagaatacaacatcattggcctgtatgccaaatagtgaaagcaaaaaaaagaattaaaaaagagtggatgtgttatatatgaaaaagtagattatgacttatggatatttgacaaagggaactagaaaagggtgcagatagcgaacctttgagagtcggcggagaagttggttgcaagtcctcaacatgacaagttttccgcgtgcaaaaagctcttgctgcaaataattgcaacatccaagtcaaaatacaagatacaactaaccgagaaaaaatttgatttcgtttaagaaataccttgcccaatatatcttgtttgctttcaatataaccgaaaacatctttacagtttttcatagtagacatttcggtcaaatcctccagcagctggaatatcatgccaccttctacatgctctttctcacaaagataaagcacaacatctaacaaagcaatcaaaacatgaagatggtgagaggttagacaaaagtagtgaggacaagatgataagcaatagacaacaagagaataagaagttttacggggacaacgctagcacttgtttgaacgaactatgcaaatcagactagagagattgctaacctagaagatgaggaatctgtccatgtatatcatcatcatcatcatcatcgtcaatcaactgaccatactgcataatttgctcccctgattgcgcagcagcagcctgaaaccccgaaaacagaaagagaaatccacacatatataaatgaacaagtatatacgcataccacgaaaatataatagtggagaaagaagagaccactagctcctgcagcaatgtccggagcatgttttcaagcatttggttttcatcttgagccaactttgtttgtttctgtcaaattttacaataaagacaataagtaagactaaaggagtgaagaaattgttagttgattcgaaagagttacctgaggttgtataaagtgttgaacagtcttgagtgcaaaggtttcaattggagctcgctgcaatatagcatctctaaatgcatcctgcgaagaaccacaaattgcagaaaacaagtttttataagctatatagatttaacaagaagcaaaagaaaacaagtctcataatcccaaaagagttaccattatttctcaatgaaccagcttccactgcaatgaagaggaatttaccgacgacaccaaaaccggatatgccggtcaaaattcacggactatgagtcgccggattttaaaagttgattaagaagaattgaataaaaatctggaaacggaggccaaacttgaagaagagtggaggaagaacaattttaatttagggtggatccggatccggaagatatcctcccaacaatcaaattatccgcaaatatccgggcttggatctggatccgaaatatttttaatttataaactgaataacaacatgttcattgggcctttcatagtaaaatgatatccgttgggtggtgggcttcacattatttagttttacagaagacctttgcctgtatatgttggatatggcgtagttttaatgtgtggaatcaaatcaattagaaatttaaaacatctgtattcaaaaattgctcgaaattgttcatggtatgttattgcagaagaaatcataatagctcacatgagaaggatttgaagatttcaaaaattgctcgaaattgttcgagataaatattaggttccaataattgcataaaagacattgtattcataatctacactcaacaagtgataaataaacattacttcctaacaaagtaaactttgatggatcgaacacctccttcaacacctaaaaactcggatgtgatcttctctttgggggttttgattgtaccgtcgacgtaaattcactaaacgattagtgagtggcagtggctcatgagatgaaagtcatgaaacaaacactttgagaccaaatgaaaatattgatttgacatattgggtccacttgctatagggccaaaaatttagaggcccaataaccaaaaaagtcgaaacatgtaaaatgtttctcgtcacttgaagaaaaactaaaaaaagtaaacgccattattgaaagaaaaacactcacatctctctctctctctctctagagctgttcatctccccaaccacaacaaaccaacttgcttagctttgctctgtccagggcaaagagcatcatccctcaataaagcaattcccattttcttcttttacttttgtcctaaaactgttaattgattctgtctgaatattatttttattaacggaccaaacaaaaaaaaacttgcagaagaatgaaagaaaaagcaataaccctccaaaccaaattctaaagcctcaaatttggaatattccctttcttcttcattcccttttttttttttaatttgccatttactcattattgatcttatgtgagacgacctcctctgtttctttcttcctcgtaacagtaaagggtcttcctttttaatctgaatttaccaatctgattcttctgttttttgttttttttatttgtctatcttttaaactatttgaaatctaaactttgtttggttcttcacgatttttaatctccgatgaatcaaattcatcaaaagattcatcttttagatctggttacgtaattcgatttgctctgttttttgtttttcgttttgaattctttattaagtaaccaaatttggggaagaaggaggagtgtgggtgataatg

SEQ ID NO: 1728 - DNA, 3000 bp, Unknown
  misc_feature (1)..( 3000): cDNA_ID_3063951_gDNA_ID_1620440_Annot_ID_157128 3000 nt of promoter + ATG
acattatatattgatcttgatcgtatgatttcatttatatttagggactgaattatatattatattgtaacatttaacatacagtatatcatgtgttgctagttatgatttacatgcacttcgaaaatggtatctgattttttatatgatttagaacttatctggcacacatcattgaataggatctaacacattaaaacactgtctaacttatttgtttgtatgtgtgtgttaaatcatcattttagctaagatttttaaccataggcaaagaaatgactcaaatgagcaaacgagaaactgcagacagcaacatatatcaaactaactctaataggcccaatatagcccaataagaagtgtgaccgatggagggaagaatcgaatttaaatgatacagagtttttttgtttggagaggaatagactgatatgatagtccgtgaaaatattttcatcttgttttcaatgtggagatattttaaagtttgaaaccaatccaagttctaaaacatcaaaagcttttattctctgtttaaaccacttggttggtcttggtcttcttgaaatatacaaaccagacccaaacgataatcagtgaagatgactgcatcattgggtctttaagtttcctattgggccaaatcagcccaactatattattgttattatttcagtccattaaagattttcggcccgttttatcgttgggaattcatctatatttccccaatttgatgatacacagaacaatttcatgtgtatacgataagaggcaaattcaaaatttgcaatcaatgtaaagtggaaatgagaagcatggtggctcaaatcaacttatctttccttggaatacaaactacaaatgatgacggatttggcttccctttgaatttaccttttacctctctctttttttttttttataggtaatgttgttattggacaaaaatgttaagaaaataaaggtgaatgataaattagaagagtacccataactattttgattatttaagttgccaaccaagctagaccactttccaacttttatagacaaagtgtaagaacttagcacatgctttccaacaaggaatatgaaactttatttcaaaaagattattgttaaagcttttaatcattctaaaaggtgattaatatttgaattattggaagtaacttgttttggacatataccaaattaatcaatagtatcaatggacatataacatgttgtgagactatatcaatgttatattccaagccagttaaaccaatttataatgataccatttatagataaacaatacactttacacacattattttcttagaattgggtctcatatagaacactcacaaaggtgacttataaaaaatgcttcaaagatcctagtcttttagtgtgcattcctcaaaatcgtagttgatatgtatcttgctcctattcgggttttggtctagaattttggtttcaggaattttcaattaactcattaaaacatttataacataaaaagatatatcacgaaaaccgatcaatcatttaatatatttttattttattttattttttgtcacaataaaatctagacaatagtgtttaaacatttatcaaaaaattcaccttacgattaatttgttttatattttgtgatgatgcaatttaatctatataaattataaaacatatcgataatctgtgtttttctttttctacatataaaattcataaaaatgagagttttgaagctcttaaaatggactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctctttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaaa

SEQ ID NO: 1729 - DNA, 3000 bp, Unknown
  misc_feature (1)..( 3000): cDNA_ID_2142672_gDNA_ID_1620440_Annot_ID_157131 3000 nt of promoter + ATG
agcaatttcttcttatggaaatgagtttgaaaaaaatgcagtaaacattttggtataaaagatttaaggtttctctattctttccaaaacaaaaacattccctttcccatctctccctacttgtaaatcttcgtctaagtatctgcaataatttctcagaatcaaggaatccaatccataacaaacacaattctagttacgattttggattttaattaaaaaaggatacgaaatctcgaatagtccctcggggttgaagattcccaaaagaagatccatgttcttcctaaatatgttcatcaactgattccaacacgaaacaatttttttattaccaaaaaaggaatttgattatatatgtcggagaaagaaaaaaaaacaacaacacagacctggtctggtttgatcgttgagctttcataagtaatctctacactctacaaacaaacaaacgcaattccgtcaaaacgcgatttttccaagaatctaaaaaacctaaaaacgtcaagaaaacggtaatgtaccgatttggacgagatcttgaaggaagcgacgattctaaactcgccgtcgagtagattcaatccccggacatcgaatttcaacacatggaccgttttgcccttcgttaattgaaaaagaaacacattaaaaacgtcatcactaaaaagctgaactgatcaatttcttttttatctacctgagcaatgtcaatctgttgaagaagatcaccaagagagacgaaatctcgaagacccaatttagttcgtttagaacccaatacagtgattgtactgtaaatgagtttccagcaacctccgatcttgtctaactctccagtcggctccggtgtcggattccgacattccaaaagcttcaccagtccctcgatctctgtctttttatccgacttaactccgaatatccctctattgatccctttaatcccaatacaatcagataacagaatcaaagcatttaaaatcaaaatttgaactacgagctaatgagtttcgaattaaagattctgatagtcgaaaggaatctgaaaggagcgaatctaatcacctttgagagcttcgtagagctcttcttttatatgagaaactgtaatctcttcttgttcttgttcttgttcttcatcttgttgttgttcatttggggaggaacaagaactctgttctgtgactttcccgatgaacatgggtctgagcctaaatgagttgtcactaaaactcagcgttttgccattagaactggtgaaagagactaatactttcacgtttcctgttcttctcgagattgctcctcgtgaagctgccattgatggtggctggaaaaggttactcgtcattagcagtttatacaccagaatctctaaacccaatggagcttaataagaagtagaagaagaagatgggatttgaggaaaaagagagagagatagatttatggggaggagaatggacagttttttttggttattttatccatcttttagcatctatctctcccccccaccatacactgcactgactctattataaaatttagccaatcccattggtcttttttttcttttttaagatggtgtcatggtaaaattctcaaaaaaatctccatctaaattgagaaaaacccaatttttgttatattttgcaaccaattgcatatgttttaaaaaagtgtttacacttcatcaaaagcagtaatcggagtacagtaaccacaaagtatcaacatagtaaatgctctgttctttgtcacaaggcttttaaaaaacagaaattcaggcatctttggttaaggttgcagagtcttgtgatggtggcttccattgttgtggagtctgagctttcttaatagagagagcatgaatctctttcatttcttcttctagcgcagcattcaccatacgatgcctctccagcaatctcttcccttcgaattgttcagagacaacctccacttcaaaactcgaaccacaactgcaataaacagttttgctgatattaagaacaagaaattatgccataagccagagaatcaaatgtgtattgacaatccggtacttaccctccagatatgtcaatgacttcctggtacacacaaaaacaaacaatgtcactaaaaaattctaaaagctaaagattgaaacaattggaacacatgaatcaagtgaaaagggaaatagattgacattgaagtaacttcaatcttcacatgttataaagcaaagaaactatacacatccttggatctgctttttgagttctagttcacaaaaaaccatgacacaaataaaattttccgacaagaacactcactactaagttgctaatacatcaggaacactacgtcatcaaatcctgagctcagtatcacactgcatcaaattacacctaactacgcaaacaaccaccttttatattctgtttcagagctgaaagacaacacatagtgatgtataatctagatgctgagattattacaatacatagtacctcttatgatccaactatcaaagtgtatgattttgatcaaagtgagcaggtcaaaaatctcaaatttggcaattttcccagatcaatttgatgattagggtttcaaagtttcccacaaaagtttcaaaccctaatcaatagatgaaattgaaagaagaaagcagtataagaacactcacgagatgaattggcttaagtttcgaagtcaatgaagcttcgacttgctccttcgtcaccatctctctctctctctctcaaacaaaaattgaaatccctaattactgtactcattgaattagaatattaaaccatacgctatttggttttggtttagcgagagtacggtttagtttggttcaattgggataccattcggttatcgacaattccaaaataataactagggtttaagctctgctttcctttacttcgtcttcctcactcctaaaaccctctcagtctctccatttcccggagcaaaaatagctctccgacc

SEQ ID NO: 1730 - DNA, 3000 bp, Unknown
  misc_feature (1)..( 3000): cDNA_ID_2142667_gDNA_ID_1620440_Annot_ID_157129 3000 nt of promoter + ATG
ccttaacatccttctggccgaccagaattgggtcttgagaactctctgatgattcttctttaacaattttatcactctccaataccttttcctgcttctttccaagtaagccatctcttcttctttcagcagcaagctctacatcgctaattagctttggtgatggagcattaacagtttccttatctttaatcttctgatcaacagcagtagacaaacgaggactagaatcaagccgcatcggaggcttcttttcggtaacagcccgaatcataaacaagccttcacttactgtagtaacctgtaagatatctggcatggataaaagaaacttcgaaaacttcttatgtccatagaaatctttatcaatagccaagttgctcttactcagctcagcacgtagttctgtaatggcagcccccttgggatataaactcactatcgaacgaatcttatcaacaacttcttttggaataggacgaaggttaacaacagcattcgaattcacagactcggatagttcttcgattttcacactagacgaagattgctcagtagtggtagcaatagcaaatggatcaagaagaggaatcctatagtgaccataccaagagttataaggaccatcaggaggctgattaaaatgcttaccagtaacacactctcctttaatcaaagcatcccaatcccacataatagaagcagcactacacaaaacaccaggagctgatgatttactcgcaagcaaaatgttgtaattgttcatcctcaatctatgtaacacacttgcaaactccttatcactagagattagcaaaagatgagctggtggtggattctgagaaacccaacacataagatctgtgattagagatctatcagcactgttcttaccaccgttaggaacatgagtgagactgattcctgtagcggagagagcgtcttggtttgatctggggagctgtaaaacgtcaccgaaggctgtgattgtgattggtcctttgattccgctgtttctgatagcggcggtgattgattgtgctactttgtagacattggtgtctacaggtaagttacagctcaggaagtcccaccagaccgaaaccctaacggatcgggactcttcgtcttgctgaggacgtcgagagggagaatggctggatccggagacgaaattggagccggaggtggttgtggtggagaatggagaggaatgaatgttagtgatgaaaagggtaattgttcgacggtgagattgggttgtggaggaagaagagaggcggaagagaagggatttggatggtaaagatccaaacttcatggtcggagagctatttttgctccgggaaatggagagactgagagggttttaggagtgaggaagacgaagtaaaggaaagcagagcttaaaccctagttattattttggaattgtcgataaccgaatggtatcccaattgaaccaaactaaaccgtactctcgctaaaccaaaaccaaatagcgtatggtttaatattctaattcaatgagtacagtaattagggatttcaatttttgtttgagagagagagagagagatggtgacgaaggagcaagtcgaagcttcattgacttcgaaacttaagccaattcatctcgtgagtgttcttatactgctttcttctttcaatttcatctattgattagggtttgaaacttttgtgggaaactttgaaaccctaatcatcaaattgatctgggaaaattgccaaatttgagatttttgacctgctcactttgatcaaaatcatacactttgatagttggatcataagaggtactatgtattgtaataatctcagcatctagattatacatcactatgtgttgtctttcagctctgaaacagaatataaaaggtggttgtttgcgtagttaggtgtaatttgatgcagtgtgatactgagctcaggatttgatgacgtagtgttcctgatgtattagcaacttagtagtgagtgttcttgtcggaaaattttatttgtgtcatggttttttgtgaactagaactcaaaaagcagatccaaggatgtgtatagtttctttgctttataacatgtgaagattgaagttacttcaatgtcaatctatttcccttttcacttgattcatgtgttccaattgtttcaatctttagcttttagaattttttagtgacattgtttgtttttgtgtgtaccaggaagtcattgacatatctggagggtaagtaccggattgtcaatacacatttgattctctggcttatggcataatttcttgttcttaatatcagcaaaactgtttattgcagttgtggttcgagttttgaagtggaggttgtctctgaacaattcgaagggaagagattgctggagaggcatcgtatggtgaatgctgcgctagaagaagaaatgaaagagattcatgctctctctattaagaaagctcagactccacaacaatggaagccaccatcacaagactctgcaaccttaaccaaagatgcctgaatttctgttttttaaaagccttgtgacaaagaacagagcatttactatgttgatactttgtggttactgtactccgattactgcttttgatgaagtgtaaacacttttttaaaacatatgcaattggttgcaaaatataacaaaaattgggtttttctcaatttagatggagatttttttgagaattttaccatgacaccatcttaaaaaagaaaaaaaagaccaatgggattggctaaattttataatagagtcagtgcagtgtatggtgggggggagagatagatgctaaaagatggataaaataaccaaaaaaaactgtccattctcctccccataaatctatctctctctctttttcctcaaatcccatcttcttcttctacttcttattaagctccattgggtttagagattctggtgtataaactgctaatgacgagtaaccttttccagccaccatcaatg

SEQ ID NO: 1731 - DNA, 573 bp, Unknown
  misc_feature (1)..( 573): cDNA_ID_2143175_gDNA_ID_1620441_Annot_ID_157163 3000 nt of promoter + ATG
aaatgctgaattcaagatttgttagcgatatttggaagattggaattcacttggaaggtcggattgaaaaaaaggagattgagaaagctgtgagggtgttaatggaggaaagtgaaggaaataagattcgtgagagaatgaaagttctgaaagatgaggtcgagaaatcggtcaaacaaggaggctcatcttttcaatctattgagactctagctaatcatatactattgttgtaagttgggaatatttgctaaagatacctcaacgtttctataaattgcaaaaagaaaagcacttgattatattgtctgttgtctaaaacaaaccaaacattcaaaaaagctcattgctattttattactgaatcaaaaacttgagtggtttcacttgtcatcaccaaaaaagaaaaaaaaacatttcgtgtcatagtcaagtacacttgtcactgccttagcaatgtaggccagtggttgtcttattgaatagactccattctccaaaatcattgttttgctttctgcagataagaaaagaaaaaattgcaaagagaggaagaacaaagaaacttgaatg

SEQ ID NO: 1732 - DNA, 3000 bp, Unknown
  misc_feature (1)..( 3000): cDNA_ID_3063988_gDNA_ID_1620441_Annot_ID_157178 3000 nt of promoter + ATG
agcttgcttatgaaggaccttccttcaggtaatagaagaaaaagttttaagcttttgatgttaccagaatcaaagcgatgatctttgatggtttctttctgcagggttttggatgaaaagctaaggaaggctttccataggtacattgagattagagggataaagccgagcatgatcaacttcttgcacgagtacatgatcaacaaggatagtagagagcacttactgtggttgaaatctctcaagaactttgtcaagtattgaaataagaaaacaatgttattttccgatgctctttgtcttccaaattttgtacttgaaacaccattcaattatgtttggatctatttatataaaaaaagagtattgtgagacagtgagaaaagtataaacatcactacaccaattagaagtaacttggtcaagtatgtccactatttcaagtgaatctattctgtctgctatcgaactgccaataaccatcttaaccatgtaaaaatagagctacatctgccatcataagaataaactgcgaacatggttgagggaaagcatcccctcacttgtcagatgactgttttgtttgtttctagattgtgtagcgcgacctgtgacttaaagttcactgtagttacgccagacagcccggaattcttcacggaatgtgtttaagcgtgccttgagatttggggttcttatgcttgcatgaacaatgatcactgtggagaaaaaatgttaaggtcaaaacataaactccatcaaaggacatctatgatcaaacaggaggaataactttaccagcaagggaagtgagaagtgcatagaggacccacaacaaaccgcaggaagaaaaccacatgacaagactggctatatatacatgagaaaattaacacattgatcagtttttaacaccaatattacattaactacataaagaggaattatgagtattcaagtacctgtaaggaaagtaataacgaatacccatcgcggtttcccacaaacgtatactgtctttcttgctgtcgatcttccacggatgacaggcctgcagtgatcacatattaaataaaattacaaatgtaactacgaaccctatttatatcttccatgaacctaattaatatggaactcacatgtggggaggtctcatttttgcagccatgtgtggggagaaatgcctaatcgttcttataaacttctcattaaaactagctgcaaaactgcaaaagacaacatttaaccccgttaagtttgaaaaactaatagattatgctagggagcggaccacacacacacaaccacatactacaatactttctgatccaatctcataaaaaagcaactaacatcgatgtatgattctaacatgaacatcaaatcgccacagcgggaatagaacataccaacttgaaaaactcaagacttcaagaaccaaaattagaaaacctatcaattccaatactgatatccagttctagagcaaccattatatacaaaggagcctaatatctaccaatgcatgtgaatacaaatggaacaaacgaccatgaagttcatatgaatacacatggaactagccaccacgaaacactcaaatttcaaaaatcacagatcataaaaacctatcggatgattcgaatccaatactaagaatccagttgaagagaaagcactgtatacaaagtagcctaatacccttctaattcatgcaaaactacaccaacttcacattaccatgaagccttaaacgcattgcagagcagatatatataagtagaaaccaaaacaagtcacatgagatggtacctgtcgttaaggaaagctatacttaaagctgttagagcagcacccacaagagccagaggtctcgtaacaagcgcaagacctgtttcaacacaaacatggattaacaaactgcacaagatcttgatcaaaacccaaattcccaaaaatacagctaaaagcaataaaattctgcaaaactataacttacccagaacgaaaatcaccaagataaagtaattcgtcctatagctgcaacacatataaaacaagcaaaaatcaacacaagatcaaaatcataaatcctatcgacgcagacagaaattgagaaagagagagaggtaatactagtagagattgcatttgagacggctcttccatttagagaaagagcgagggaacgcgaatctagagaagaactcgccaaacgaacgaggaggcgtcgaccattcaacttctctaagcgcctcaatcacatcctcagctgctacgttgtcccaatccatatctccctcgcctcttctcttctcttcctcttcaaagacgaattcgagagactccgatgagtttgattacacgattcgtgattgtttggttctccggtttgcttttgcctaagaaatggagattagtacacacgtgtgcgagtgagtccccacgtgcaaactaaaaaatcccaaaaaaaagagtaaaaaaatgtctgagcccgggttcgaaccggggacctctagtgtgtgagactagcgtgataaccgactacaccacccagactttttattaattcaattaagtttgtatttaataaggaagcttaacaaaattgtgatgcgctctgttttttttttttttttttttcgtctttgtgatgcgccgctttcgtcaacaaattgccgaaaaagagtaaacaaaaagcaaaagaagtgtagcaatgttagtgacaagagaatgtttgcagtttcgatagtacctcgaaccacatcgtgccgtttgagctctgcctttctctgtcaactctcgattcctctcactcttcggctccaccatcactaccaacaccaccagcctcacctaccatctcctctctcttttcaggtttccctttctctttcgctctctgtctctcatattccgagaatctcggagtttcggcatctctgatattctctcttattcgtgtttcagattcattcgttaagaaagcagatcgacatg

SEQ ID NO: 1733 - DNA, 3000 bp, Unknown
  misc_feature (1)..( 3000): cDNA_ID_3409060_gDNA_ID_1620441_Annot_ID_157180 3000 nt of promoter + ATG
agttcacgatttttatttggtatttttatttattctttacttaactaattaaattaaattttaaagtaaaaaaaaagacttttcagtttccaccattgaagattgaagatctctttatttttttagtatagtaaaagttcatgattaatttagtgttttcatatattcttcaaagaattaaattgtctcagattaacaagtttaaagaaaaaaactttgtcaaaaaaaaaaaaaactatgatttctaaaaccggctatccgtttaaattttataaaacccattaggcccgcgggtttaaactttgttccatgttggatatagtttaaattttgtaaaactataattttgtaaaaactatgttccatattggatacagttccggctcaattcatttttggacctttggcaaaactcaaaataaaatataattattttggtaaaattagggccttttagtcttaacaattttttctgaaacttgttcaagagatgttaaagtgattaaaatattcgatattgtacaagtactagcattttgatttatattttcttgtgttaatgaacgaattatgaatgtgtttaggtccaatcataaaacgttagtttcattatactagacaagtagttgctaagctttggggtgattgttcttatgatcccaacgaaaggtttcaaaagcaaactttctcttgtcagctaaatcgccagggactgtcatgattccgtaagtcgctaagagcatatcgattgtctcttcgctcattttctcatagtcttcttttttgtaacacggatagagaagaggcatctcagacgaaggtggtggtaatggctgctgtggttgcgattttcggatcaattgcggtggtgactgttgaggctgaggtacagcagcaatctcctctttcggattggttgaagaagaagagcctttcgagtccttgtttcccatctctttgaatttgatgatattcacttgattaattgcccttacttggtccttcccttatgatcatttctaagtaacatgcttgccgtaataaagagagttttattactttttttgcacgtattcaaccgaaatacatttagtaggaacttgcatacgagaccccaacatgaattactatgtatcgcgagaacttataatcatgaatgacatatattcaacaacttacaaagattattataatcagcgaatgaaaacggatctaattgggttttaggagtggaccattcaaccctaagaatgaggttatcataaccatagccattcaatttgttgattgctcgctgtgcatcttccctgctcacaaaactgacaaaaccaaatcctctgctcatgcttgtcttctgatcaatggctacatgacaacgggttacagcaccaaacggacgaaacaactccatcaaatctggtccacgggtatcttcagacaaattagtcacacggacagagttctcatcatgtctactcctcatgtctgaaccaccagcttttctgtctgcaccttctctcatgcttggcgggacataagccgccctgccagttccagttatggtcgatgtagaagtttctgctgttaaaggctcgtccattaaggataagagatccttctgtgggcatcttgatgtccagtggtcacctttcttttggcataacctgcagaccatgaggaccgcacccggtttgcccaactgagacatgctatctcctgatacggtcgactgttccgcgttgctacctgagatattcaaaagaataaacatcttaaaacctcaaaataatactaccctttaagatggtaatgcaaaaactaaaaatgtagttggcagctataaagtgaaagcagaaatctactttcgtgcaagaagccaccaacaaaacatctaggtgggcattacggccacccacatatagaacaatatggctgactaacgtgtccacctataaagaaacttatgtaaaaatgaatacttgaatgtgtacagttaatagcctagaaaagagaacacagaatttgtccacattcagaaaaggctaccaacaagatacttatattggtgacatactgaccaatcacagaaagaagcagccatatatggctaatatgtgatcggctaattgggcacctttgttatgttacacagttacaaaaaaaaaacttgaaccaaagatatagttgatgatccataaccaaaaactgggttaaatcctgttctagtgttgaaacgaatcaccaacgacattgctataggtgtgcttactgaccattcacacaaacagtagccataaagctaacatgtgactggctaattagccaccctaatcaaaacagagcataataacaacgaatcctaacaaactaaaatgcaaagttgaagattttaccaggagctctaattcgttccaagatgatatcctctgttgaacgcattgtgaggtaactactggattcttcatgagctgcgtctccgaacttattccagctccgtcgctccacggcttgtttggtgagagctcgcttctgaacacgggtcgtggtagtgattttgacctttttgtcctcttcgttgaatttgtactcaatcaccttctttacaccgttctggtccggactaatcatctgcttaggcggaagaaggaaatcatagtcgccttcttcttcgtcaatttctccccaccgaagcttttttgttttttgtatcgtatcaatcgccatttttctcagatttagatatgccgcttattaagttcgttagtttagtttaaaaggcaacaactaaagacagaagcaaactagggtttcggattatggaaacggtctcttaatgtcgtaatgggccactaggcccatattggcccgtatttttagccggtcctgattttctgtgatttttaatttaagtcccgctaaatttgtaatttgctatattaaaccctaaagggaaataaaaaccctcactcttccaatttgagcttcaacacaaaaaaaatg

SEQ ID NO: 1734 - DNA, 3000 bp, Unknown
  misc_feature (1)..( 3000): cDNA_ID_3063986_gDNA_ID_1620441_Annot_ID_157179 3000 nt of promoter + ATG
ataccacaggtttctgaacctgtaacaagtcagtagtaaatcaccatgagaacttaattaggcacaagaagctctacttacacccgtcctgaaagttattcatattttagtaattggagtcttttgaggatattactatacttcagtatacgattagttaaggatttgggttccgatcttatctaaggttttcatataactttcctctttcgtaattcaggatgttaggtaaagggatatgttcagacaaaagcatttcagctgaaaaaaggtcaaacataccgcattggtggcatcaaactttccacctaatccaacctccaatatagcagcatctacctgcataaagaagcaaaaagcagaaccccttatatcaataaagagaacatgatgttagtttatctatcatgtcactgagtaagaaaaatagtcagccaaggtaaagactggtatcaaacctcttctgcagcaaatattttaaaagctagcaatgcaaggaagcggaaatatgtaggcattggtatctcctcgttagttctctcctgcaaatcaaatagtcggcaaccttgtattttgagtaaaaaactaaagcatgtatcttaatttgcaactatgcacaccattgtaaattcttatgagttcatatcatgaaatactcagaccgcaaaacaaaaggtgacttcaacaagatacagggaagacactatacatgagctctaccgcatcaccaccccctcgatgaaaatagttccaataatacaatttctctaagtaccaaaacttcagtactgaacaccatggttttaagctaaaatggaaaaacaaaataagtgttcatgaaaaagggtgttttacatgtttatcacattctatatggctttcatcactaagattccaagtttacagaacgttactaacaactagtctactagtcaatcgagataaccaaactacagatattgagttcaaaacaaatgaatcaaatagctgaaccttcttttctcacgaacataccttgagcctgttatagcaccaccagaaatatcccaaaaatttctcttcacttatgtccacactgcagcaataaatagaacatatcagattaagcgaatataagcatttctcagtaaagaagagtgaaaaacaggattatgctagcgaagtattgttggttcctgattatatgagggccggtaactatatatttattttctcaaaattttcagcaaacttagaaaaacttacccatccaaacgaaatctttcccggacatcaatgaggtgaggtgaagtgaagagtccagttcgaaagccatagtttcgaataatagactctgtaaaggtacatgtggatcccttcatgccacataagaaacaaaaaggaatactgttaggtgctggatcagatagtaatcagccatgctaacaatgaaccactttcatcaaacaagttcactgaaggtttgaatcaaaaagtaagcaagtactagtttcataacaatttcctttgtgctatcccaaatctactatcacataagtgatatgagtcaagattaaagtagcaacttttgcaaaactgacactccatcagatgaaaccatacgcatctccaagcatgcaaggatctcaaaaccaatgttcttctcgcactcactcaaattggaaaaaagctcaagatgactcagtccagaaacgtatctctaatccccacagagcaaaaaccttaggcttcttctgacaaagcagtcataaggacgtaacggtcacaactagtgtagaagctgacacgaattcagaagatatctaactaactaactaaagtaacaaaaccaactcctaatattgacaatagatgatttagtatcatttattgagctttaccagaaaaagtaaagttgttgttgttaccttgcctttggtaccagcgacatgaataacattcatctttaaaatgtcttcttccaggtcaagtagctgccaaattaattacaagaagcgtattcaatcagaaaataaaacaaaaggtgcaataaatattcaaaactctacgagaatccaatcgaaaagagaaaccttgagataatcaaagactaactcaaagcgatcccctttattgctcttatcagcacgacttcgtttcgtgatcaaagacgacaaagcagccaacgcttcctcatatgaatcacctcctgtcaccaacaaaaacaaacaagtgaactcgattcgattactgttatcatcaagtgaggaagagctagagaagaataagaaaatcaataacaaaccttgagctgccatgtcgatctgctttcttaacgaatgaatctgaaacacgaataagagagaatatcagagatgccgaaactccgagattctcggaatatgagagacagagagcgaaagagaaagggaaacctgaaaagagagaggagatggtaggtgaggctggtggtgttggtagtgatggtggagccgaagagtgagaggaatcgagagttgacagagaaaggcagagctcaaacggcacgatgtggttcgaggtactatcgaaactgcaaacattctcttgtcactaacattgctacacttcttttgctttttgtttactctttttcggcaatttgttgacgaaagcggcgcatcacaaagacgaaaaaaaaaaaaaaaaaaaacagagcgcatcacaattttgttaagcttccttattaaatacaaacttaattgaattaataaaaagtctgggtggtgtagtcggttatcacgctagtctcacacactagaggtccccggttcgaacccgggctcagacatttttttactcttttttttgggattttttagtttgcacgtggggactcactcgcacacgtgtgtactaatctccatttcttaggcaaaagcaaaccggagaaccaaacaatcacgaatcgtgtaatcaaactcatcggagtctctcgaattcgtctttgaagaggaagagaagagaagaggcgagggagat

SEQ ID NO: 1735 - DNA, 3000 bp, Unknown
  misc_feature (1)..( 3000): cDNA_ID_1444196_gDNA_ID_1620441_Annot_ID_157187 3000 nt of promoter + ATG
attctccgccacttagactgatgtggaaaattgatcccccaattgataggtttatttcgcactttagaaaaagtttggaaagaaaagtagacggaactggccaaccgctgcttatcacaatctctggtgccggtggatcgtcaaaatattggaaagaagttaggggattccggcgcggatgatctgtcttagagggcgcggatgatctcctcccacgtgagggcgaagtcatgactcgacgaggccaatcacgaacgctacaggtgtgggagcgatcctggtcagggaaggctaagacggcgcctcgcatatgggtagcactactcgtactatcttgaatgttgcataacagttagaggcctagctagcattagtttgagcagctagccgaaaatcggacaccaaattattgtagactgccctgccggaagaaaagtaattaagttaaagagtgtcgagtaggaggagtcagcttattctatagatactgtaaaagccaactcatgtaggttatttaacttcacatatagcccatcagcttgtgacttcttacaaaataacaacgggggatcctttatccccctgtcttaggaatcacttccccttcattgaaaacgtcctatccatcgtctcgcaaagagacgcccaagatttatagcaagttttgacttgagcgctgccaccgatcggtggcccgttccaaatgtaaaaattttaaaatcataactttttcaaaaaaccccaaaaatttatcatctactacttttacaatttcatgatctctttcaaacgtttcgtctttactctctataaataaaataaaaatcctacattgaaaaatttacacattctcattaatcatcatcgacataggcacacggcgactccatcattctctcccattaaaaaaaatattcaggtaaaaacttttaaaaaaaagttttttttttctttttttcaattggtaggaggttaattcccaatcaattttaggtttaagcatatatagaaaaagaaaaaaaaaaactcaaattcatccattttttttgtgtttttaaattttttctttaaatgatataggagtgtagatgaaaaaattaaagccattttccaaaaaacaattgatatgcatgaaaatcctggaaatgagattcatttaatttgttgtctatatctcacttactaatcttctcctttttgtaattccaaaccctttttattactttaggttagtcacttactctcggctctctcttttcttagctctgttttttatatctaaaataactttttaaaattgttgtgcttgatttgcagagatttggagaaaaacatgattgttgaaagtttcttataatttggagaagtactatctcaagtttgttaaattagtttataattcaagagttttagaaaaccatattttttccttcatttttgtgtgtataggaaaacatacatttttttaacatagatcatttctcatgtgtctcaagacaaatagatctacaaggtcaagcaatcatatttcttttattttcagtcatcttcttaggctaactcaatttcggaaaggagatttataggaccggacaagaagaatatacagtaaagctaaacaaacaaacagagaccaaactgaatatagtgaagaagaataatgaaagaacaaattttaccgcatgttttttttttcttttgtcaatctaccgcaggccataatgtgactcttatattggcttatgatagatttttgtatgctaactcatttagcaaatcgaagtatttttagtttaattctttaatgtcttataacaacttcattaatgaatttaaatcacaaattaaagttacaattaaatcagttttaagaaaataaaccattttaatataaagtttattgtagaaaactggaacttctagattaatgtttgttaatccaatggaattttacatagttcatcattaacgaatgtgtatgtatatattatcttttaaatccaaacatttataagtaaaatattgcatgtaattaatttgatataaatctaattatccaaaatgctatcatataaataataccaatctaatttttttcccgtacgtcgtacgggtggaatactagttctataataattcaacaaaacattattactaattatttggattaataggtttaatggcggacatcgagaatccaccagtgtgtaggatttgtctagacaagggagatcttatccacctcggctgtttatgccgggatgatatgtctcttgtacataaaaaatgtgcagagatatgattcacacagcaaaatactaggtaaatttatttaataaattatatatatatatatattaaaaatattaataactatttgattaaatttttgaattacaagatttgcgagatttgcagcaccgaagctgcaaacattcacgatttcgtcacattgcgatttcggcttcctcgagagttattattttttaatttttatatttttgtaatttttatctttttctgtttatttttttttgtgttgtttcattttcgtattataactattcagatgtgattgtaaacttattttcttaaacgtgaaaattggatttatacataatgtgactgaaaaaaggttgaaaacatcatttcttaaattgcgtaaaatttatatttttaaaatttttaaaactataattagttaataataattcgatccgtagacggtttgtccgctccgaccaccgtaacaattcaaaaccgaagaaaattgtttatacgaatctattccgtaatatatatatatatatatatatatatatattataagaaatttctttttaaaaaactaatccatttaatctataataaaagtcactcgccattcgacaatatatatatatatatattcttcttcactgccagtctgaggatttccggggaaataaagaaacttgactgctaattgctaaaggtaatgcttctgagaattggaagcta

SEQ ID NO: 1736 - DNA, 3000 bp, Unknown
  misc_feature (1)..( 3000): cDNA_ID_3063982_gDNA_ID_1620441_Annot_ID_157181 3000 nt of promoter + ATG
gttctgggtaagttatagttttgcagaattttattgcttttagctgtatttttgggaatttgggttttgatcaagatcttgtgcagtttgttaatccatgtttgtgttgaaacaggtcttgcgcttgttacgagacctctggctcttgtgggtgctgctctaacagctttaagtatagctttccttaacgacaggtaccatctcatgtgacttgttttggtttctacttatatatatctgctctgcaatgcgtttaaggcttcatggtaatgtgaagttggtgtagttttgcatgaattagaagggtattaggctactttgtatacagtgctttctcttcaactggattcttagtattggattcgaatcatccgataggtttttatgatctgtgatttttgaaatttgagtgtttcgtggtggctagttccatgtgtattcatatgaacttcatggtcgtttgttccatttgtattcacatgcattggtagatattaggctcctttgtatataatggttgctctagaactggatatcagtattggaattgataggttttctaattttggttcttgaagtcttgagtttttcaagttggtatgttctattcccgctgtggcgatttgatgttcatgttagaatcatacatcgatgttagttgcttttttatgagattggatcagaaagtattgtagtatgtggttgtgtgtgtgtggtccgctccctagcataatctattagtttttcaaacttaacggggttaaatgttgtcttttgcagttttgcagctagttttaatgagaagtttataagaacgattaggcatttctccccacacatggctgcaaaaatgagacctccccacatgtgagttccatattaattaggttcatggaagatataaatagggttcgtagttacatttgtaattttatttaatatgtgatcactgcaggcctgtcatccgtggaagatcgacagcaagaaagacagtatacgtttgtgggaaaccgcgatgggtattcgttattactttccttacaggtacttgaatactcataattcctctttatgtagttaatgtaatattggtgttaaaaactgatcaatgtgttaattttctcatgtatatatagccagtcttgtcatgtggttttcttcctgcggtttgttgtgggtcctctatgcacttctcacttcccttgctggtaaagttattcctcctgtttgatcatagatgtcctttgatggagtttatgttttgaccttaacattttttctccacagtgatcattgttcatgcaagcataagaaccccaaatctcaaggcacgcttaaacacattccgtgaagaattccgggctgtctggcgtaactacagtgaactttaagtcacaggtcgcgctacacaatctagaaacaaacaaaacagtcatctgacaagtgaggggatgctttccctcaaccatgttcgcagtttattcttatgatggcagatgtagctctatttttacatggttaagatggttattggcagttcgatagcagacagaatagattcacttgaaatagtggacatacttgaccaagttacttctaattggtgtagtgatgtttatacttttctcactgtctcacaatactctttttttatataaatagatccaaacataattgaatggtgtttcaagtacaaaatttggaagacaaagagcatcggaaaataacattgttttcttatttcaatacttgacaaagttcttgagagatttcaaccacagtaagtgctctctactatccttgttgatcatgtactcgtgcaagaagttgatcatgctcggctttatccctctaatctcaatgtacctatggaaagccttccttagcttttcatccaaaaccctgcagaaagaaaccatcaaagatcatcgctttgattctggtaacatcaaaagcttaaaactttttcttctattacctgaaggaaggtccttcataagcaagctcatctttggaaggatcatcaggaaatgtaacccacatgtccttgatcgcaatcctgtctggaaaagcagtacatctaaattccaaacttggtcctgtcttcttggaaagagttactaagagaggcacattcgattgcttaggcttcaatggcttatcctcatcttcatcttcttcattctctgcttcttcctcatcatcttcatcatcttctttgtcaccagtcacaagattagtcatgtgtacttcaactttaacagtctctccttcatattctctagtcaatgtcacaatcttccctcctggtttgtcttccatttcgaaagggaagccacttggagtttcttcaacctttattcaaacaaaagaagaaacagagagattacacaccattgccattgaaacagagcttcacgaaacacataaatcttaataaacaaaatttgcagaaactaaaacatgaaaatggtaaggatttactcgatgataatcatcagctttctcggcgtatccaatctcctcttcaatgattcgaagaagcggatcagttggagaagctctctttttggtcgatgtggtaaatggaacattccggtcaaccgacggcgtcagatgtcgcctccggccagaagcggactggtccaacaatgagtaaacgaaagaacggtttttccaataacttcccacaaaccgagaagctgcgcgacgtacaagagtcgccattttttttgtgttgaagctcaaattggaagagtgagggtttttatttccctttagggtttaatatagcaaattacaaatttagcgggacttaaattaaaaatcacagaaaatcaggaccggctaaaaatacgggccaatatgggcctagtggcccattacgacattaagagaccgtttccataatccgaaaccctagtttgcttctgtctttagttgttgccttttaaactaaactaacgaacttaataagcggcatatctaaatctgagaaaa

SEQ ID NO: 1737 - DNA, 3000 bp, Unknown
  misc_feature (1)..( 3000): cDNA_ID_2143213_gDNA_ID_1620441_Annot_ID_157177 3000 nt of promoter + ATG
gaagcagctttggttttcttgatgtccattttatgagtatatgtagtaactaaacttcacaatgtgaatttcttgtgagagagactagagaaggagaaagagagagagaaatgaatgttgatattttgatgagtgagaaatggataatgatagttttggtttttgccctaattaactccccaacggtccgttatataaccaacttcttctgatgagaaggagatgggttcacgtgatccccacgtggctctgccgccgtcttcgactctcttctcaccgccacgtgtgctttctcgtagatgctatggataaactttgcttttactacttttgtactctttcttctcttcttctattttgtcatttggataagttcttttaccttcttcttttcttcctttatacaatgaagatattaaactctcgtttttattattgatctttggcacattacactgacaacaatctctatcttcttcgttttctttaaattaaataattcgatcatgtgactcactatcgacttattctcgaaaatgtcgctttgattttattctaagacttgtaagtttgacttccattattatggagtatggactaaaggtttattcattgacatcctcaaatctcgaatattaaactttcattttaaaatcttttatatatcggaggattttgtaggaggataatggttattcgacctttttttggtttttgatgttataaataagaaaatgtctagtctattggtattgggtccgagaatgtcatttatatacggataatgttggatagtgaaacaaattttatgccgttgatgtggtttacaggaatgtaaaatgctatactatacatatgatcatttaacctatacaaaatataatggttcatctaagatcacaacagataaaaataaaaaattatttcaggtaaaagattgattaagagagtccaccattgtggggattaatttgtagaaacttctcatggaatctatttcccaccttattcttcgtcgacttatgatatagcacattcatttctttagaatatatatatatatatatataacctgatattgatattttggtctctctactaattaaccaataaagaatgtatatatttcatctttttaccggaaattccgacctcagccaaatatatatatctgcagattttttgacggtgaagtgaagctaaatcatatcaaaatagatctgataaattgatatattccaacaaaaaaagagaggtcgcaaagcaaagcaaagcaagctgaaatgaaacagtaatgaagcatattccacgtcaatctcttctttaattttgattgcgttttatcttctccaaatctagtaagattcgccgtataacaataataaaaaacattgggatataagaataaaaatcacttgcaattctaatttcggcggatagatttgatattccacccacatacatgcagacacatatatgccgacatcaagtgaacataaattttatcaaaaaagaagaagaacagaaatggctttcacatgttaacaaacagaaaaagaggacagaaataatgcatgcttagagtattcttatccactttgttggaccaacttcttatatgcttttatgtcgtatgttgtttaggtttcatcttaatgcagaaaatattagttatagctaacgaatttaaaagtgtttaacctattgtaggtttatattgttgtgaatccgatcattagtagtttacggttgcgaatccgatcatactgtcgacagattattaatgggagatgattctcgtgttaaatctccggttaaactatcgctagacgagttccaaatttatattattacctagaaaacaaattagataatattcggctccgatatattggggtcaaatgacttcaagggccgctgaagctaagaatcggaaaagtggtcagctaattaattcgaaggcagcaggagttaggaataaaaagtagataattaattcgaaggcagcaggagttaggaattgtaatgtcttctagagttcgaatagtttaaagtttagacgaatgattcgaatctatgtgaagttaatttatacacaaatattaattcttccactcctaaatctctcactcagtcactctatcatggatatcaaatcatggtgatctaaggatcggttctcgattcatgttttacaattgtgttaagcgtagtgattccactattcaacactaatatgtttctaaatctcacatgtgtagatagcaaatgaaactgaaattgagcttctaatcactatttaaaccaaaatgtaacgttttccctctattttgactcatcaaatcctaatactctttcaaatgtgttattttcattttgaaacctcttaaacaagaccaacaacacagtatatagtcgaataagtttgcacaaaatacgttgaggagctaattctagtaagttaataaaattttgtattttatcatactttcaactttaccgtacataataatacattaggaacctttttttaagaaaaaaaacgaaaaatactcataaacgttggaaatctaattatagactgtttagtagatgttgttcaaaaaaaaaaaaaaaaaaaaactgtttagtagatttataatattttgttttatttcatatttttaaacatttccatagtatgtagcaaaactatatttttttattcagaaaatattaatattcactgctctttttttttcttcaaaggaggaaaaagcctttatcatttggacggacaagcgctcgagaaactaatttaattcaaaaatactttttttttgtttttctgtcatttcgaatctgtctctaatctcatagggttcaaaatttggtttctgctgttctctcgagaaaaaagtacagttcccgcattgttcagattctctaagattcattcatcaatctgacttttcccgggaaaattcactgtctctgagtccaaacccgaatccagcgatg

SEQ ID NO: 1738 - DNA, 3000 bp, Unknown
  misc_feature (1)..( 3000): cDNA_ID_3064007_gDNA_ID_1620441_Annot_ID_157167 3000 nt of promoter + ATG
tagccatgcatatgacatgttgtttctttgtgttttaagtttttcaaccgataaattgtttgtgtatcagaaatttcttcttttgtgtgttttgcattgttggaataaatttttcttcttaagttggaatacacatatacttaccactatattatcaggccacgttttcagcaactttttactattatcctgcaacctactagtccaacggatcttggaaagaagcttaaaaagagaaaggttcaatggagaagagaaagcaccatattgtgaacagaagaaggaataacaagaatataaacacaaacactcttgtgacatgggcaccacaacaggaggttcttaaaaagttggttgtttgctagatgttgaaaaagtttaaccatgaaaggaagaacagagcacaataatcactcatttgtccatgaacttgagcaataattattaatcgaatagagagacatggtcgaaagaactgaagtatctaagtttgatgcgactttacagagcaagatacatgatttttcataactgttatattattgatagtagtagacgccctatctttgggttgaaaacttgagtttccttagcagcttttgtgatattttgaatcatttttatgggatatgtttgagttattttgtttttacgatatggtattggtaatacatactagttactacatagtcgtagactttcatgtttatttacaaatggatacaggtttaaaaacatttacttgcgactatttgatacacgttagttacctgttaaaccagattaaataaaactaaaccacttgcacttgttaattgttagtgcttcgttagttgtaaagctgagtaattttgtttccactcgagagagagaaaatggatcttatcttcttttttttttttatcatcacatcgatcgagaagcgtagagttagggcctaggggtccactctcatattaataacataaatgatttcttgtgtgatatagcttcactgatttatcagatctttttgcatttgggtcgacaaacaagaaagaagaagaaagcttcaatggagaagagtaatggccttcgagtgattctgtttccacttccattacaaggctgcatcaaccccatgattcagctcgccaagatcctccactcaagaggtttctccatcactgtgatccacacgtgcttcaacgcgccaaaagcttcaagccatcctctcttcaccttcttagagatcccagatggcttgtccgaaacagagaaaagaactaacaataccaaacttctcctaacgcttctcaaccggaactgtgagtctccgtttcgtgaatgtttgagtaaactgttgcagtctgcagattcagaaacaggggaagagaaacagaggattagctgtttgatcgctgattctggatggatgttcacacaacccattgctcagagtttgaaactcccaatattggtcctcagtgtgtttacagtctccttctttcgctgccaatttgttcttcctaagcttcggcgtgaagtgtatcttccacttcaaggtattgttatttcttacatttttcgtatagaccaagcaactcgttaacctaaaaacatatatctaaattttctcacagattcagaacaggaggatctagttcaagagtttccgccgcttcgaaagaaggatattgtacgtattcttgatgtagaaacagatatactagatccattcttggacaaagttctacaaatgacaaaggcgtcttcaggtcttatattcatgtcatgtgaagagttggaccacgactcagtgagtcaggcacgtgaagatttcaaaattcctatctttgggattggaccatctcacagccactttccagctacctctagtagcttgtccacacccgacgagacttgcattccatggttagacaaacaagaagacaaatccgtgatttacgtcagttacgggagcatcgtgaccatcagcgaatcagatttaatagagattgcttggggtctaagaaacagcgaccaacccttcttgttggtcgtacgggttggttcagtccgtggcagagaatggatcgagacaatcccggaagagatcatggaaaagcttaatgagaagggaaagatagtgaaatgggctccgcaacaagacgttctaaagcatcgagccattgggggattcctgacacataatggttggagctcgactgttgagagtgtttgtgaagcagtccctatgatctgtttgccttttcgttgggaccaaatgctaaatgcaagatttgttagcgatgtatggatggtcgggataaacctagaggatcgggttgaaaggaatgagatcgagggagcgataaggagattattggtggaacctgaaggagaagccatccgagagaggatagaacatcttaaggagaaagtaggacgatcgtttcaacaaaacggttccgcatatcaatcgttacaaaatttgattgattatatatcatctttttagccactgacatgttgtttctttgtgttttaagtttttcaaccgataaattgtttgtgtatcagaaatttcttcctttgtgtgttttgtattgttagaataaaattttcttcgtaagttggaatttacatatatacttaccacttaattatcagccacgttttcagcaactttttactattattttgcaacctactaatacaaacgcatcttgtctttttatgtcccttaactaatgaaaatcaaatataaattagaccactagttacatgccctagagggaaaacgaatctggtctttctttattagcacatcatgaagagtatagttttgtctcactctcgagtaataaagaatgcgaagtgctaataaagaaagaccagattcggaaatttctttatgttatatatagatgtttgttatcaaaagggaaagaattacaccattcactgaaatatcaggagatttacatttggaaagaaggtcaaaaggagaaagcttca

SEQ ID NO: 1739 - DNA, 3000 bp, Unknown
  misc_feature (1)..( 3000): cDNA_ID_3063996_gDNA_ID_1620441_Annot_ID_157171 3000 nt of promoter + ATG
gatgtgactcaacccaatcaaaaccccaacatctaaaatcgagaaatctgtgatcaagttccttacgattgatgtaccaatcgattggaaggggagagaagaaggacatacctttgattaagatgcaagggagatgattggcgagagagattatgggatctgcagctcaatgaggacgatgagttttctaattactactcaattttcctgggaaaatgaaaaaggtttggaatttggataaaggagacgggagctgtatcttcacgtttctcgtgttttcatttgtttttttgctcttgggatagcgacgaatcctgagattattctaatttcaatcttttcttcttcttcttcttattcttgtcttcttcttattcatccttcaatagttttcttaccaaataaatagcagcaacaataaaacccctttcaaataagttggaacgtgattttttcacgttctcaattacttgaaaacgtgatttatatcaatatttcaccgttcagatttcagaagataaaatcgtttaccactttaacgttttcacgtttccaaacatgattctgattttgattttgtgcaaaatgtattttattagtctaaactataaaacagtttatgaatattctagaaaaaaaccctctattcagctataatatttgtttgattcaataattttatgagattttaactatcaatctcacatataccaatttgtcttcttatgaactttatggttgtatttattatgattagtgagtatatattttctagggttgaggttggcaattggcatatggctaaacaaccctattgcttaaggcttagtttatgtaggttaaacttgtacttagatctaagatatctatatgcgggcagcacaacatgctttcaaccatgtttagatagtttcaattgcaaacttaagcaatgattcattactactgagtatatgagaattgaagcaaggtttagtcgtttagatagtttccttagttttcttagcttagatctcaacaccgaccaaacataatcatttatttggactataagaactctcacgatatcttggtttgatttttacttgttggatcaagggtttgagggcaatagtttatatttacctaacttgaatggagcattcgtccctgaattgcattttgcacctatagaaggtgagagagttcatgctcgggtataagaagtaatggacttgaacaagagggcgccaaaacttttgtctaatctccattgatactgtaattaaaaaaaatatcttcataaccaaataaagagtctatagactatatataggtcagtcgttttcctttaaattcaaacctcttatgagattttttaaagaaatatcgtaagaaagaaaattttcaatcatgaagtctataaaagttgtatatgccaaacataaaaagtttgaagacaaagggtttgaaaaccgagattgaatgtagaaggcgggacacataacaaaaaaagtttgtaagagtcattaagagagtagtaagtatatcaagttatcaatatagatcgatatcaataccttttttaaaaaaataaaaataaagttacaacatttgggaaaagtaaaatttaggtgagtgctgtgtcgaaaaagtcaaaaactgtcactttaataaaagtactataccttatacatataagttcatttgaatttttgtaaaacacatccgtttaacaattcgaatttagacagtccataacctttcactttattttgactagtaatcaatagtattgctttatcgaagttcaaattttagaattgttagatgtgatggacaaatggacatgagtcgttatgacgtaacaaaatcctaaaaatacagatgtttgttctttgttttttttaacgcaatggaaactatacatttttttgaaaaacctaacaaattttgtttataaaggatatcaaattgttatcgtagaaactagaaagtaggaaaactaatttaaattagataattaagctctcaaagtcattaagctacgcctaattgtgggaggttaggcccttaaacggctacgaacttcaaacgaaatcgatatgggaccatgcgtttgaattaaaacctcagattactatattgcacactacagacatccatattaacgaaaatgccactcacttacccattgcattatttcctgacaacaaacaaaaagatggctgcattaaatccacttaatcctttttaaactcctaattattacttatttactttaatattggcggcctatgtcacattaaattttggtactcttcaagaagaatgtctccactttcttttgtatgaacatttttccggtctactctgcattcaataatattcagaaagtggttttgttgatatttgttgccatttttcgttcaataaaatcttataaactgaaattcaaacttatcttagacccaatgttaaaaaataaaaaaaaacttatcttagaccctgaatacagctatattcgtgtttaactaaaacaataaaacttatatttgaagttattacttccaaacaattaaacgtacttacatcttgtaagatttctttagttaacatgtcaattttggaaattcacctgtctcatttacgtaactaattattgccttgtaattaataaaccacaccgagtcaccaattgctatttgtggtaaaatactaaattcttgatttaaaacatgggcagaaccgtaatatccacaccattcaagaaatttgtccgccaaaaagataatttaatattttgaaagaaaaaaaagtcaaatatattctctttctactcgtgactgaggaagagaaacagagagcataactttatatccagccgattttttttcaaatttcttaccttttgctctcactaaagccatgttcttacctttatagtgagtgttatctaaactcttttgggtcttttgcaaaagaaaccagttttcaaagttcaaaattttgtttttaaaa

SEQ ID NO: 1740 - DNA, 3000 bp, Unknown
  misc_feature (1)..( 3000): cDNA_ID_1021304_gDNA_ID_1620441_Annot_ID_157173 3000 nt of promoter + ATG
taaccgaaatggatgttcctaaatcataccttgaaacccttccaaaggtctacatctttaactcaaaacatccctataaaaaccattgtaaggttttttttttgttctgacattaaacttttggtacagaacggtaggtcctgccttggggatgttatctacaggtatgtaacatctgacaaattttctgcggagtctcttctcgattgccttgatctgtcctctgagcatattgctcttgatatcgcaaaccgtgtggaagcttcgatatatgtttggaggagaagagttcaaacaaaacttggagtcaacaataatacttcaagcactactccaaagttaacatgggaaatggtcaaagaactaatggctgctggtgacaaaaggggattgcttgtggagagatcggaaactctcttacgttgcttgaagcagcggtttccttctctaacgcagacttctctagacataagcaagattcaatggaacaaggtccagacacacaaatcctctaaatacattacagtacaaaatggctttgcttgttcttatatattcagtcctttgaaaatttcaggatattgggaaatcaatcctcgaaagctactcaagggctttggagagcttagcatcaaacatcatagcacgaatcgatgatttactctacgtggacgacttaacaaagcaatcagatgataacaatcttttgtcaagtccagcggtcagcagcattatagctcacaagaaagtagtaccactcccttatctaatatctgcatcaggaactccatatagaacaagcttctcaacaacaccaggcttctctccttcaatgattagccccaagaaaggagagaggagaacaccttactccagcaaggacactaacaaaatcattgagaaaggtcttccttctcgaggatatggagtgagaagagtcttgaacaattatcttggcatggaatcaaaactgaaaatatgcgttaatccgtcagataatgcagatacagcagtgattaaccaaatcagcaaagacgtggaagaagagaagaaaagaaactcaacatcagtccatcaaaagggtcctccaaagtacactgtctcttaaaagctaatagaagaaactcaatagagtgtataattaatgcagacatggattgatttgtttgatatttacttgtagtttctgtcttatttggaatggtaaagtgtctatctttgcaaaccaaatcagatcacaaaatagacaaaaatgagagtggttgtaacaaatattctcatcaaatttgttctggtttggtttactagctttatttatttggtaaacaatcaccaataacgtgtataatttaaagttatgattataatgtttctttttgtaacccactacaaaatgtcgttgtagtatagtggtaagtattcccgcctgtcacgcgggtgacccgggttcgatccccggcaacggcgattttttttttttttaaatctcttcctccttttttatttcctttctgaacgaagctctctctctgattggccggatctgccggagagaaaaatgacgacgagtattcacatcacagctctcgacggaatcgtcaacgtgaactcactcttcacactcgccgtattcatcggattagcttggaaccctaccgatccagacaacagcctcgtaaccgaccctaattgcgtccccacagctcgtatggctgagaatctcgtcgccttccatgtgtactctttcgcatcattcctattctcaagtctcatcgctctaggtctcaaacaagcaatgaggctcaacatagcttcttcgtttcacatctctactcgaatcgatcctgtggtttactatgtgaacaagacggctcttagatttgggatggttacatccggtttgggatcggtttgtggatgtgggtttctcatgttggctttgattaatgttgttcagatcaagcttgggactttgggctgtggtgctagtggtcatacttatgcagctgttgtgccgcttgtgattctggttccttctgcacttttcatctatgtttctcttatgttatatgcttttactcgttagagacatggtttttgattccatggttgatgcaattagggttatgtttgtatgatgatgatatgatggaaatgagaatgattctatgtttgatatggttctttgtaaatctcttggtttggcttctgatttaagtttagtgtctgagtttttggatagatgatattctagatttgattggagttaggcacttatgtgtgttttatcaggaatattaactggtggattcattcaaactgatttgatcccaggaaatgggtatgagattatgctggattctgatgcctgtttggtttgatctcttggattattgataaagcagagtctacttggaatcattcatcaaaaagagacaacttttctctgttcctcatttggatagagttttttcacttgtttatagttttgtgtcttctgactaagctgaatgattgatttcctctgtatactatcccattcccacatatctcgggaactgctttgtatgcataattgtatgaaaaaatagctttgaggactggagaaaaggaacctgatatatctagatctcatgaggtgatcagtgaattttcagcttaaaacttgaaggctcataaaaccatacttttggaagctttttctttggtttatgctattacatttgtcatgtaaaaatacctctttgctttcttcaaaggttcaaatgattagcttagagactaaagggcagcatgatcttactttagattaaaatagctatgcacttagaggctcttaatgcgactgattaggtgaagtaattactatgttcctttagtgcttcttccactacttctgtgtggaatttctctgatccttccaaatcctcctgcaatttcagttgctataaaacttaggttccataactagtagtatatgcatcaactcatcactcaaga

SEQ ID NO: 1741 - DNA, 3000 bp, Unknown
  misc_feature (1)..( 3000): cDNA_ID_3063992_gDNA_ID_1620441_Annot_ID_157172 3000 nt of promoter + ATG
aagaaaaaaaagtcaaatatattctctttctactcgtgactgaggaagagaaacagagagcataactttatatccagccgattttttttcaaatttcttaccttttgctctcactaaagccatgttcttacctttatagtgagtgttatctaaactcttttgggtcttttgcaaaagaaaccagttttcaaagttcaaaattttgtttttaaaaatggagaatttagtgaagagctgcgcagggatcgagaagaaaagaagcaatttgactccatcgatggaagatatacttacagagtcaaaggagagaagcagcactagcggagcgagctacgaaagctcctccaccaccaccgtcgcttcgtcttctccaccaccaccaccgtcgcagattctgggttggccgattagaaaagcttcatttcggaaaaattcgaaggagagtgttaattttgatcataagaaattaacccttcacgatgattctgggtttaaagcgaaagagatgaattctgcaggttagtgagaaaaaatcaaaaattgaaacttttttactcagccctaagatctcatgtgttttctttgttgttgttgttaatctgattgtggattagatgtggagatgatgaaggagagatttgcaaagttgttacttggtgaagatatgtcaggttctggtaaaggtgtgtgtacggctttagctatctccaacgccataacaaatctctgtggtaagtcttaaaaaaagacgaagctatcttgtgtttgttaaaatgcttgaaccaaagtgttgaatttgatgtttcttcttttagctacgattttcgggcaactatggagattagagccactttcaagcgaaaagaaggagatgtggagaagggaaatggagtggattcttagtgttagtgatcacatcgtcgagttaacaccttcaacacaaacttatccagacggcaacaagtttgaggtaagctcttgattttttaagattgttgcaactgcaattactggagtttgaattgtgaatcttcttcaggtcatgacttgtcgaccaagatttgatcttttcatcaacctccctgctctccgtaaactagacaatatgcttctcgtgagtttcacttaactttcttatacgatgatcctctcaagtgaaacctgttttgatctctgatgtaattttcttttgcattaggatatattggcgagtttcaagaaaactgagttctggtatgttgatcaagggatcgttgcttcggaaaacgatggctcagcttctttccgcagaaagattcagcgccaagaggagaaatggtggttgcctgttcctcgtttagcaccgaatggtcttactgaagaagcaagaacagaattgaatcataagagggaatgtgcgacgcagatacttaaagctgcaatggctattaacagccttgctttaaccgaaatggatgttcctaaatcataccttgaaacccttccaaaggtctacatctttaactcaaaacatccctataaaaaccattgtaaggttttttttttgttctgacattaaacttttggtacagaacggtaggtcctgccttggggatgttatctacaggtatgtaacatctgacaaattttctgcggagtctcttctcgattgccttgatctgtcctctgagcatattgctcttgatatcgcaaaccgtgtggaagcttcgatatatgtttggaggagaagagttcaaacaaaacttggagtcaacaataatacttcaagcactactccaaagttaacatgggaaatggtcaaagaactaatggctgctggtgacaaaaggggattgcttgtggagagatcggaaactctcttacgttgcttgaagcagcggtttccttctctaacgcagacttctctagacataagcaagattcaatggaacaaggtccagacacacaaatcctctaaatacattacagtacaaaatggctttgcttgttcttatatattcagtcctttgaaaatttcaggatattgggaaatcaatcctcgaaagctactcaagggctttggagagcttagcatcaaacatcatagcacgaatcgatgatttactctacgtggacgacttaacaaagcaatcagatgataacaatcttttgtcaagtccagcggtcagcagcattatagctcacaagaaagtagtaccactcccttatctaatatctgcatcaggaactccatatagaacaagcttctcaacaacaccaggcttctctccttcaatgattagccccaagaaaggagagaggagaacaccttactccagcaaggacactaacaaaatcattgagaaaggtcttccttctcgaggatatggagtgagaagagtcttgaacaattatcttggcatggaatcaaaactgaaaatatgcgttaatccgtcagataatgcagatacagcagtgattaaccaaatcagcaaagacgtggaagaagagaagaaaagaaactcaacatcagtccatcaaaagggtcctccaaagtacactgtctcttaaaagctaatagaagaaactcaatagagtgtataattaatgcagacatggattgatttgtttgatatttacttgtagtttctgtcttatttggaatggtaaagtgtctatctttgcaaaccaaatcagatcacaaaatagacaaaaatgagagtggttgtaacaaatattctcatcaaatttgttctggtttggtttactagctttatttatttggtaaacaatcaccaataacgtgtataatttaaagttatgattataatgtttctttttgtaacccactacaaaatgtcgttgtagtatagtggtaagtattcccgcctgtcacgcgggtgacccgggttcgatccccggcaacggcgattttttttttttttaaatctcttcctccttttttatttcctttctgaacgaagctctctctctgattggccggatctgccggagagaaaa

SEQ ID NO: 1742 - DNA, 3000 bp, Unknown
  misc_feature (1)..( 3000): cDNA_ID_3064011_gDNA_ID_1620441_Annot_ID_157166 3000 nt of promoter + ATG
tataccttgactgaatttatagaatctttgcataattggattggaaaaagaaaaaaaaacagaaagaagaagaaaggttcaatggagaagagtaatggcctgcgagtgattctgtttccacttccattacaaggctgcatcaaccctatgattcagctcgccaagatcctccactcaagaggtttttcaatcactgtgatccacacttgcttcaacgcgccaaaagcttcaagccatccactcttcaccttcatacagatccaagatggcttgtctgaaacagagacaagaactcgcgacgtcaaacttctcataacacttctcaaccaaaattgcgagtctccggttcgtgaatgtttgcgtaaactgttgcaatctgccaaggaagagaaacagaggattagctgtttgatcaatgattctggttggatcttcactcaacacttagccaagagtttgaatctcatgagattggcctttaatacctataagatctccttctttcgaagccattttgttcttcctcagctccggcgtgaaatgtttcttccattacaaggtaattattcactttaccatcttatatgatctatcaatattttactctaatattgactttcttggtccaattttcttttaaaatattttaaaatagccttttttgcgaagtacattaacactggcaatgcatatgaaaacatctaactactacctccacttctaaggttggttttatcggtcattatagatgtttttcttttttttggcaaatgtcaagattgggtgttttaaattgtaaaaatacccaattttctatatatttcgaggtttaatctatgtttcggtccataatctactcagttacaaaaaggtcattgtttagcaaaactagcatttttggttctattagggtagtacaagtcttttagagacactaattaaagattttatagagataaattaaaattctttggtcccaaaatatacagtcttaaaaaaaaagtattttcgtggtgaattaatgctgatatcccgaaattatgttttgattgtatcccaattgctttacagattcagaacaagatgatccagttgagaagtttccaccgcttagaaagaaagatcttttacggattcttgaagcagattcggtgcagggagactcgtactcggatatgattttggaaaagacaaaggcgtcttcaggtcttatattcatgtcctgtgaagagttggaccaagactcactgagtcaatcacgtgaagattttaaggttccgatatttgcgataggaccttctcatagccattttcctgcttcttctagtagcttgttcacaccggacgagacttgcatcccatggttagacagacaagaagacaaatccgtaatatacgtgagtattgggagcctcgtgaccatcaacgaaacagagctaatggagattgcttggggtctaagtaacagcgaccaaccatttttatgggtcgtccgggttggttcagtcaatggcacggaatggattgaagcaatcccggaatatttcatcaaaaggcttaatgagaagggaaagatagtgaaatgggctccacaacaagaggttctaaagcatcgagctattggaggtttcttgacacataatggttggaactcgacggttgagagtgtttgtgaaggcgtccctatgatctgtttgccttttcgttgggaccaattgttaaatgcaagatttgttagtgatgtatggatggttgggatacatctcgagggtcggattgagagggatgagatcgagagagcgataaggagattattgttggaaactgaaggagaagccatccgagagaggatacaacttcttaaggaaaaagtaggaagatcagttaaacaaaacggttcggcatatcaatctctacaaaatttgattaattatatatcatctttctagccatgcatatgacatgttgtttctttgtgttttaagtttttcaaccgataaattgtttgtgtatcagaaatttcttcttttgtgtgttttgcattgttggaataaatttttcttcttaagttggaatacacatatacttaccactatattatcaggccacgttttcagcaactttttactattatcctgcaacctactagtccaacggatcttggaaagaagcttaaaaagagaaaggttcaatggagaagagaaagcaccatattgtgaacagaagaaggaataacaagaatataaacacaaacactcttgtgacatgggcaccacaacaggaggttcttaaaaagttggttgtttgctagatgttgaaaaagtttaaccatgaaaggaagaacagagcacaataatcactcatttgtccatgaacttgagcaataattattaatcgaatagagagacatggtcgaaagaactgaagtatctaagtttgatgcgactttacagagcaagatacatgatttttcataactgttatattattgatagtagtagacgccctatctttgggttgaaaacttgagtttccttagcagcttttgtgatattttgaatcatttttatgggatatgtttgagttattttgtttttacgatatggtattggtaatacatactagttactacatagtcgtagactttcatgtttatttacaaatggatacaggtttaaaaacatttacttgcgactatttgatacacgttagttacctgttaaaccagattaaataaaactaaaccacttgcacttgttaattgttagtgcttcgttagttgtaaagctgagtaattttgtttccactcgagagagagaaaatggatcttatcttcttttttttttttatcatcacatcgatcgagaagcgtagagttagggcctaggggtccactctcatattaataacataaatgatttcttgtgtgatatagcttcactgatttatcagatctttttgcatttgggtcgacaaacaagaaagaagaagaaagcttca

SEQ ID NO: 1743 - DNA, 1306 bp, Unknown
  misc_feature (1)..( 1306): cDNA_ID_3064036_gDNA_ID_1620442_Annot_ID_157194 3000 nt of promoter + ATG
tgatcaacatgactaatcttccacgagactagaaccactaacccacctcctctagataaagctaaacaattctctacaaaaaatttccattaaatgtttctaattgtaattgaaaacatcaacttaaaatattattaaataaattttgtataaacgtgattcattttaactttttttttaatgaattctaaatccaaatgtgtcttaatctactgctatcacaactccacaatattagaaacaaaacatatagagcttgggccattttctgcttttatgattttcacgaagtgttttcaccaatatacttacatcactagttcagttgaatctacttaaaatcataaggtacgtaactcaaatcacattaacgattcaagttcattttcatggaattagatattttagtaaaattactacctattgatgaatttggatatttctagttttaaaacgggaggaaaaaatgattaacgtctttcatagcactatataaatgttaatttttatttgaattaaaaatattcagttaacgaaagtgtttgtgattaatctagagtttatttggagaaatagtcaaaaaaaagtttataatacctttttcctggttcatttttttttttttttgccaacatttaaattccaattgttgagattttagcccatcatttaatggtgagaagaatgaaagtgctaaactatttgtcttaaatgattatactttgattataaaactgtgacaatatgattattatacatattgttaaattttattctatgtgatacatatataaatgttttagcaagtacaaaacatggaaaatgtgagcgacttacaattataacatcaattctcattagcatttccgcttttactgaaaacaaaaacgagtgagtacaatttgtcttcccttttttttttttttggacacaaagtacaatttatcttctatttcctcctttttgtgtaatttgtctcttgtcgtatcacctacattttcagcattggatgttataaatgcgaacaaactataatgtaaaaaacatgtcagcagcatcgggccatttcaaactatgtaaataatgaagaaattatatgatctattctaaataattaattaggccaaatattattctaagtgaaaaatgtcacgctcaatttctcttatataataactccttcccttgaagcctttctttaactcttttcatcttccttcttccttcttcttctttaaacacaaaaaaccgacaaaagcctctgtctcggacagagacaaagaaacagaacagagcaagaacaatg

SEQ ID NO: 1744 - DNA, 3000 bp, Unknown
  misc_feature (1)..( 3000): cDNA_ID_3064030_gDNA_ID_1620442_Annot_ID_157205 3000 nt of promoter + ATG
aagtaaattatgtccaaaatcaactgcaaattgttcagctaccatttcttgtaataaaagaacgtacctgtgcataagccagagcctctgaaactgaaaaaaatgtattgagaaactcccatcgactctggttccgcaggtcaactaactcccttccatagatctcactttcatccatacaaagacaataagagaatgagacttccttcaaaacagaacaatgactttgcaactctcttttttcttcacattaccaatggtgttgaaaagtcaaatatacctgacagctttatttgataacatctttgtaccgtgcatggctctcttcacatacccaaatctatcggccttaactaaattacctttctctttgtcaatcatgagacccctgataacctataataagagaaaacatagtttgagtactctaaaaactagatagggtactacaatgtggaacctttcaactttcacaagaaaataaacatatcaccagttccggatcaaaagcaagtccatcaacagggaaacccatgctctttagattttccatgcaatagtcataagcctttccttcccaagcctgaacaagaccataaattagcatcaaatatgggtgcataaatgtttcctacttatgtctgagaaaggaagaactcaccatgacattgtagtgcatcaaagtgtaatccatatcatatccaattgcactaatggaccgaagattcaatgtacgactacaaaatataccccgaggagagtgctgtgcagagaaagggccctgcaataccaggcatgagaatgtgacacaaaagaaaaagaaaagtccatataaaaccagacacaaataactcaatacattcatgttttcgcaacaaagggatactcaaacttcaaatacataacacaaagttgtaaggattagataacgaacttggatacccaactctctaatcaaattttcagccgcttgagcctctgttctcgctacctcctcaatgggaccctccaatgtagcctgcccatctcctacatagatacaccaaagttacattttgctcatacaacgtgacattcacaacaaaggttcgatctttttagctcttatttatctcaattaaacaaacatcaaccaaaatcaagttccctaaccaaagaccaaaactttatcccacatttcactaaaaccaatctgaatttcgaaaactaacaaaacaaaaaggaagattgtatatataccaaatgactgaagagggtcaagcttgagattcaaatctcccttagtactttgacccagatagtcaacttcatacttagaagaagtagtaaccgaaaacacatcatccccaacagccacgcgtccaccgtcagctccggcggctctgcacttgatcatcctaagagatcccctcctcttgttacttttcctcaaatcaggtaattccgcagcagaaaaagaaggaaatttcatcttcgttgacatatctctccacagaagctttttatcgaacacctgatcggcacatagattcattctcactttgggcgtttttgtactgtaaagagatgagagttggggaacgttaactgagaaattaggcatctttacgctcgttccaatatgtgagacagaaaacgacagaacatcggcgtttgaattcggaagatggcgtgatgttttaacttctagaagatgagagtgagagatgatgattctctcttaaataaaagacacgacacaaggagaaacatgtgctcttaataatatccaaatttggcatcagaatctattcgcacgaatcgcgaaaaagcaactactaatttttttttttaataatatttatatacatttattcacacttgatgatatatttacaacttcttatggattatgtcgaataatctctgaccaatagtgtgacgtttgtttgatagtcatgtatcaaaaatatgataaaatatatatcttgatgataaatgtcatattaacatatttgtcactcagcgaaagaattaattaacggaaaaatgtgacatttacaaagttaaaatcaaataagaaagaaagtaaattcttgaaaacctttttaaggccaaagcaaggtacaaggggcgggttagccctcttctatatggatgaatcagataatcatatacatgatcgatgttgagaccaagtttgaaggccataaaatctttatgacattcgtttatagagatcatgtagtaaaatagattcattttgacttgttgaatgaagaaataaaaaatagggcgagacacatgtgcaaagacaagaacatgttttcgggttaaagaataacatcaattttccttaaatgtggatttggttcaaaatgatgattggcattgaccaaactatctttaatttatatggatcttctttcagtagtgctttctatttattttcatatatattagatttattaaagaaatttctgtgtagttcttttttcttaaatctaaaatactatgatttaatgttcatttaaataaaatggtatatttaaggtaacaagaaattttattaatgttttctttgttaattcttgatatgaaatttcagtttctaattttcttacataaatgtttcttaattgtatttacatatgatatagccttaataatttttgaacccactttgtttctggtataatataaaattgagtaattattttactaaaaattaaatgagaattatctctttcttaatatatatatagtcaatttcataatgcgttatgcaggtttaaatctaaccaaagttgacactttcatgaaccatcatatcaaaattatatcttagcttttataaatttattttgtgggtatagaataaaatccagctaaattgattaattttatctgcgaaaaccaaacccctatataagagcactttaatctcaatggatacatctaaaaacaaagagaaaacaaagtaatagctattagctagtgacacctcaaaacaaaaaaatg

SEQ ID NO: 1745 - DNA, 3000 bp, Unknown
  misc_feature (1)..( 3000): cDNA_ID_2143361_gDNA_ID_1620442_Annot_ID_157207 3000 nt of promoter + ATG
aaaaataaattttttttaaatgtaaaaaaaaaaattaatattttgttgaagaagttaaatataattctgcaatttgagagataacataagataaattttcacgtattagtaagtaaaagtgacaagttatgttttataaccaggtgatttttaaaaaatgaaatttgttttgatgcaatatcgtgtgaaaagtaagaaaactaatatatgcaataccatatttaaattgtgaaccttattaatttcacctaaaatgaaaattggaaaactttttcatgtatttgatagacttgtgagtttgaattgtataaatttccggcaagcaaaagcagctcgtgtaccaagttgtcggaaactttaattttgttagcatgcattggactaaaccaacgcaaatattttattttatttatcgtagactgaagacctaaagagtaaaatgaatgtgaaagtgacacgttgtgtggagtattttgtatctaactaggtgtgggaggtccggttatggaaagctaagaaaaccgagacaccggacaacaaaataatggtatcaacatcacgggttactctcttctgcggtttacctataccggaccatgttaaagatgctccagacgagctgaagaaagttatatccaaattataaattcaaattgtatctatctcattttgttaggaataagaacaattttagtttggttttattgtacgaaccaaacgttttaataaattgttgtaccaaacatgagatattataaggttataaaaattgacaagttattgtgggtttagtttgtagatcattttgaaatatagtattaatagactattttgttgaaacgtccaaatcgtatagatggggtaacaaaactaaactcctttatatgattcttttgcataaaattctgtctttgtaataactgaatcatacatacttttttagtttgatacgcataatataattaccacaactatgtagtgcatttaagatatctttcttcatattataaatgtgtatcaataccatttaaatcttcgtatacaaagaaaaaaaacaagatggatattagtttttcgatggagatattatttggttgagttctttcttcttgagacaacaacatccagtgtggagtctaaatgttccacaataccatccatttgtatacccgtggcttaagcaaatctgatcacatacgcttgtacactcggaccgataacacatggcgtcatgaacgtcaatagcgtttattttagctgtaaaagatatcataaaaatctattatatatgatagatcatcatttatgtttatatttagagagctctacattgagattcgatcacgatcaaacggtaaggttacttcacgataaactaacgaagatagtgtattttgctgaatgatgtaaattatattaaaaaaaaatataaggtatatatataaacaaacgaaggtaatatggtttagatcaagaaaataccctaatagaaatcaaaaagtttgtgtatatgttttatgaatttgtaaattgacttaccggccatcgcaaacaagagaacaattgttatggcagtcagtatatgtgaatgtttctggttctgcatttttttgttttgaggtgtcactagctaatagctattactttgttttctctttgtttttagatgtatccattgagattaaagtgctcttatataggggtttggttttcgcagataaaattaatcaatttagctggattttattctatacccacaaaataaatttataaaagctaagatataattttgatatgatggttcatgaaagtgtcaactttggttagatttaaacctgcataacgcattatgaaattgactatatatatattaagaaagagataattctcatttaatttttagtaaaataattactcaattttatattataccagaaacaaagtgggttcaaaaattattaaggctatatcatatgtaaatacaattaagaaacatttatgtaagaaaattagaaactgaaatttcatatcaagaattaacaaagaaaacattaataaaatttcttgttaccttaaatataccattttatttaaatgaacattaaatcatagtattttagatttaagaaaaaagaactacacagaaatttctttaataaatctaatatatatgaaaataaatagaaagcactactgaaagaagatccatataaattaaagatagtttggtcaatgccaatcatcattttgaaccaaatccacatttaaggaaaattgatgttattctttaacccgaaaacatgttcttgtctttgcacatgtgtctcgccctattttttatttcttcattcaacaagtcaaaatgaatctattttactacatgatctctataaacgaatgtcataaagattttatggccttcaaacttggtctcaacatcgatcatgtatatgattatctgattcatccatatagaagagggctaacccgccccttgtaccttgctttggccttaaaaaggttttcaagaatttactttctttcttatttgattttaactttgtaaatgtcacatttttccgttaattaattctttcgctgagtgacaaatatgttaatatgacatttatcatcaagatatatattttatcatatttttgatacatgactatcaaacaaacgtcacactattggtcagagattattcgacataatccataagaagttgtaaatatatcatcaagtgtgaataaatgtatataaatattattaaaaaaaaaaattagtagttgctttttcgcgattcgtgcgaatagattctgatgccaaatttggatattattaagagcacatgtttctccttgtgtcgtgtcttttatttaagagagaatcatcatctctcactctcatcttctagaagttaaaacatcacgccatcttccgaattcaaacgccgatgttctgtcgttttctgtctcacatattggaacgagcgtaaag

SEQ ID NO: 1746 - DNA, 3000 bp, Unknown
  misc_feature (1)..( 3000): cDNA_ID_2143390_gDNA_ID_1620442_Annot_ID_157216 3000 nt of promoter + ATG
gattgaaaatattgcttagaaggaaatcaacattgccggatctttttatatttaagacaccaagtgttatcttacacaagctcggattgaaaccttgttatgcaaacttgactcataaaatggtagaggtaaactgagaaaagaagaaaaaagttgctaaaatcgattgtttacaagtcctcagcagtcagcaacatgattatttggttataggagttttaaatgtctttcgcataaaacacaagtggcgtcttctacaagctcggatcaaaccttattatgcaaacaagactcacaaagtggtaaaggtaaactgagaaaagaaaaagaagttactgaagccattgcttacaagttctcggcaacattggttatagtacattcacgataaggtttaatttctacctcagctttgtacatgatcaagctctttgcaaggtactacaagtttccaaagaacaaatttaattggaacctttcaattatgatcatatagaataaatgtaaaaatgttctaagaacttcatttttatgcaatatatacagaaaaaagtaaggagattaataacacaaagaagaggcgattaatatagtgaatatatacaatgagtatatacattagagctaagctattaacgttgaaatggaagatgttggggaagaagagtatgcacaatgttcgatagatagggtcttacttaagaaaacagaatggtaacatatacgaaaatcacgtcgtcttgttcctcattgctgtttattggtagaagtaggtttatccttaggcttcttgatgatcagaacggaggaatgtgcttaatgagctaaatagttacgcacacttgacgctccacaaaaacatcctcttgacgtcagctccataaccatggctaccaaggacaagaactcatgcatgatgtctctccacggcttccaacattatgtttctcggatctccttcaatcacctccaaagacgagatctcaacggacttagccgagcacacttcggcgcacttcttcttaaccaagtccgcggtcttgtttaaatcttcttccaccattggtataatatcgaccgttcccgggccagcaacaccgaggaagaaggtcgctgttggtcgagcgtgaaggacgacaagtttgaatcgtgggttggccttgaaaggtatgaaaaagagatcaagagccgtctcgagtgcatggtagctatgggctgaatcatctactccgacaaccaccacacgctcacttccactagccattttgattttctttagctttcttgatttgctttgtgattgtagagtagtgatctctatttgagcgttgttgtctggaccgatattcacgcgaggcatattgttccaactaaaacaggtcagtttcaatactttttgttaaagaaacatttaaatagttaggtttgttttcctttcccgattatatcggtctattaaggttatgaccaaggtgtttttattttctgtttggttttatatgaataaacaaaccaaagtggagagagttcaattattcaatcttttgcatgaaataaaaaggtaaagcgtgagatttaattaaaaaaaggatataatattgtttttgtttttaagaatttaacaccccaacaaaagactcgaaatcaaagcttagaggaatcgtataacttacaaatgctcacctagctatactcatctaaatactttgccaatcaaacttttagaaactgatattgattgaatcttttgtaacttcccccataaaatacaatattttacactttattcacctaacaaaatcaaataatccaaactcactttattttctagaagatttatcaaatagcacgtcttcttctatatgtagacactcgtttatctatttcccctttttaattttcacactcgtgatctcatctattactcgatatatatagcacgttgcacagttgcagtatatacacccacaatttacataaactatcattctatcaacaacaaataaaacaattaaagtacgacaccagaaaactaacatgtcaaagctcattctcatcctcaccgcacaaatcctcctcctcaccgcaaccgccttagccggaaaaaacggtgaagacttcgcaagaacaataaaccgaaaacacctcggcctcggcaaaaaagagaaactcacacatctccgtgtctattggcacgacattgtaactggtcgaaacccaagttccatcaggatccaagggccggttgcaaaatactcaagttcctcatatttcggatcaatcaccatgatagacaacgctttaacattagatgtgcccattaactcgactgtggtgggtcaagcccaagggatgtacgttggagcagcccaaaaggagatagggttgttgatggcgatgaacttggcttttaagactgggaagtacaacgggagtaccataacgattcttggtcggaacacggtgatgtccaaggttagggaaatgccggtggttggaggcagtggaatgttccggtttgctagaggttatgtcgaagcacggaccaagttgttcgatatgaagactggtgatgctactgttgagtctaactgttatatcttgcattactgatgatatatgcctataaattcacccgccttatctaatggttgtttttgtttttgtttatatttaatctatttaccatacatgttaaaagaatttcgcctcttgttacttgttagtatatttatgtatttaaacgtgattatcttttactattatgagcttgaagaaaaaaaacaagagatttagggatttaacggataaaatccaaaaattgaaaccgagttctgaggtttggttttagtttcaacttttcagttatccacacacatacacacatacgcttccctgaatttggtgacgttagtcttcttccttccttctcactctttgtttcgccgtgaaaatgagctctgatagatagaagcgacagagagaaacttgaagcagatg

SEQ ID NO: 1747 - DNA, 3000 bp, Unknown
  misc_feature (1)..( 3000): cDNA_ID_2143376_gDNA_ID_1620442_Annot_ID_157212 3000 nt of promoter + ATG
gactcaggacataggtacgaagcttcttttatttagtatgtcacagttgaaagaatgtcttgtatctttttcggaatgcagttgtcattgttttcgccttacaaacacctgcactcacttgcttgtagatgattaagcttattttgtgactgtctctttgataattcctttgatgccaaactctttctcctactgttttttgctctgaatgttgtgttgcaaaatgcctatatttatgtgactatgatgaatgcttctctcatgcttttagcggatattgtttcacttctaaacatatgcactcacttgtagactgtttaagcttactttgtctatgagaatacttttgtttgtcttgcatagaaaagtactgttatctttacatttcacgataagagctagaacaagatacacagttagtgcttgttttgttgtttaaactgaggcttatgttcatgtcttgtacttgtagccaacctaacctacaaagaaattgctactgtaacaatttgaggatcttgtgtgaaaatacgggtggacttgtcaagccactctttcttttcttctcaatcgaacactattattatccaattatatactctctattttttatgattcaattcaagttagattccattatgcacagaaaattaaattgatcatatgtccaaagctctactgtcatttttgaattttgttgaaattttgaagggttaacttattttgtgccattgaccactatgatgcatttgaaagactttttttttgttgttgaacatacgtgattactagcttcataggaagaaataagtgtaacaaaatatatatatttgacgaatttttggtcctctactggtaattttgagttgtgttgtagaaatttgtggtgactcaaaactattgttttaaggctcattaagattcaatacaaatgaattagataattctataaggcccattaagattcaatgcaaattatttagataatttctaaaggcccactaagattcaatgaaaatctgcaagtcggagtagaagcagaagaaatcgactaatctcgccaatgtcgtctccagagaggaagaggaagaaacggtcgcttgaaccgtcaccggaatcgaccccaaacccgtcacttcccgatgatttgattgtgagcatcttagcccgagtctctagattgtactacccaattctctcgttagtctccaagagctctcgaaccctcgttacttcgccggagctatacaagactcgatctttcttcaaccgaacggagagttgtctctatgtatgcttagatttccctcctgaccctaacccacgttggtttacactctaccgaaaacctaaccaaaacatcaccgagaagacaaagaactcaagcgggtttgttttagccccaatcccaaatcaccattcacatagttcgagtatcgttgctattgggtctaacatctatgccattggtggatccattgagaatgcaccctcttctaaagtctcaattttagactgcaggtctcatacatggcacgaggcaccaagcatgaggatgaagcggaattatccagctgctaatgttgttgatgggaagatttatgtagcaggaggcttggaagagtttgattcatctaaatggatggaggttttcgatataaagactcaaacttgggagtttgtgttaagccctttagcggagagatttatatataggagcttggtgattgaaggagaaatctacatttttggggataaggttgtgacttacaagcctaaagaagatagatggggaggtgtaggagaacatcagagtatggatttgggattgttttttcattcttattgcgtgatagataatgtactgtattgttatcgtcctggtggaatcaaatggtatgaatcagagaaaagatcgtggaggaagttgaggggtttgaagggattgtctaagcttgctagtagctgtgttaagttagcggattatggtggaaagatggctcttttgtgggacaagtatatcccttgtagtgggaataagagtcattcgatttcgtgtgcggtggtttcccttgagagatgcaagaatcagggtattaggggaaaggttgagtggtttgatgatatgcttacggtacctagctcttataactttgtgggtgctcttgctgctactctttgatgatgattgccatacgaggcacacacatttgattgtctagctagcttacagataattgctttctatgttgtaataacttaatgatgggattcttcttaccatattatttcaaaatgcaactggcttcatttccttcttcatttttgttttcttgtcaagatcaaacaaagattattcagttatagcgtcttttgttgtctagaaatcactgaactagtagttagttattacaccttcaccggttgaaacaacaacttgatgggacagggaagtgagaatcttttttgccttctcggtcttagaaagaatgtacatttgcgatgagagtaagagcaagaatttaaaaaagaacaaagaggaaaagccgaagaaattgacattgtttttgcttataaacatttgcagtcacttgcttgttgattaagttgattttgaggttaattgacaactataacaaatcagaagatttaagttgcaattatgtgcgctaagctaaggcttttagactcttatcatcatgtagtaacatcaagccaagtgccaatacctttatatagatacttcctgaatacaacaaaattggacacaatgatctgagtttcatattatataatataaattaactaaaccgatttctcaaccacacatttgctaaaggctcaatataaattaattaaccctaaatccttcttcttcgaccttttatttggcgccaaacccgcagttacatgtttttatttcccgctcgagcaaattgatctgatccgagtctttcaagcggggagagaaagagagagattcgttagtacattgatcta

SEQ ID NO: 1748 - DNA, 3000 bp, Unknown
  misc_feature (1)..( 3000): cDNA_ID_3064019_gDNA_ID_1620442_Annot_ID_157199 3000 nt of promoter + ATG
taatgatccggtgagataattctgtgacaagtcaagagcttgaagattctgacaaccagctaactcgtccggaatattcccttctagcttattctgccatcccaagaagatgttgagctccttaagcaatccaatctctggtggaatcaaacctgaaatctgattggcgtcaatctggaactgaacaagctttgtgcagttacttagaatcgaaggtattgacccggtgatgttgttgctgctaagcataagctcttggagattcgacaagttaccgaacgatttagggatggttcctgagaaatagttcatagagagatcaatggcgtttaagcttttcatgaatccaatctcctcagggataggtccgtggagattattctgccatagaagcatcttctctaggttttgaagctttcctagttcttttggaagcgtgccggacaagtcattgtcgtatagaaacagattgataagttcagagcagtttccaagctctttagggatctcacctgagagcattgtagaatagacagataaagactggagcttgcttagttgacccaacgaaacaggtaaagaaccggatattttcgttgctgctaaccctaagaccttgagattcctacagtttccgatctcctccgggatcttccctgaaagctctgagtttcctccggctcttatgctctcaagagtcgagatctttccgagctccaacgggagattctcggataagtagttatcgaaaatctcaagattcttgaggctaacgcagtcgccgagttccggtgggatctttcctgtgaggccattggagtttaaacaaagttcttgaagattcttgagcttccctagactcgaaggtatttcaccaacaagactatttgagcttaaatcgataactataagctccgaacaatctccgatctcagaagatatagctccggtgagattagtgttggagataacgagtttctgaagtgaagtaaacgaagaaatgttaggagggaaaggtaaagctaactgaacagagacgacattgatctctgtaacgagtttgttgtctgaggaggaacaagtaatgtaaggccattgacatgggtcagaatcagaaggattccagccggagaagactgacggtggcggcgagttcgagctgtgaagccaagaaatcaaagctgagacttcattggttgatgcagaggtcgaggagatgaagaaagctaaaaacagagacaatgtaatggaaaaatgagaaacagttaaggctttttttcttggaatcggcatttgcaaagacataagagtttttttctttgcatttggctctcaaatccaaaacaagccttcttggttctgcatcgatctgagtcctttggcttagggtttagggaagtttttgctttagagataagcaataagaaagaatgatatattaaatatataaaagtactaaacttcatgtgctctgtctttttcttttacctcggggttctgtttctagcttcagattaattaattacagtcattaacttttctttgaaatatgtttgccaagagcccgagacactatccatagatgacaaaagtcaatagttatatatacataaaatatcacaaaacaaaaggcattggttatatatatacagaatcatttcacttagtagtgttttttcttataagattatgatagaaatatggaagcatgcatgtggttttgcattgttttcctcaattaagtcaggattgtgagttggtttgttttcgagacctgaaccgagcgtttaagattcttcctcgtttgaagtaaactccataattgtccacacctaagctaaaagaaagtaataacaagtttaaatattcatgacaaggaaaatattgcattcagaaaattgttaacaacgaagtaaacatttttttcaatccgatgccaatagtctctagcggcatcaaaagtccacaaactcgatacctctgggtaaatgagcgaatgggccggtccgttgtagcccagaagagaaattgtcctctaaattccatacttccatgaattttctctgtatatcctcgtttgatgtatggtatatttgttccgctctaaatcatgaccaacccaaggtactaaattgtcatttaagctttgattggtatttggtagcatgggttaccattgaccaacccacggtactagttgcttttcttttagttttgcttttgctttattttcttagagagtgggaggacaaaaggtttggatcattaagccaatgaatgcttcaaagaaattgaatttttattagatcctcaaaccaagttggatcatcaaataatggctaagaaataattttagaacagaaagcaaagaaaagctatccgcaacaacaaccattagttaataaattaaaatgaaatgtgaaatttatgactaattgaggtatgttttcatataatatagtatagttcggatataaattcaacataatttatttgtggtgtactgaaaaaaagactttcttggattctgacgtaattctcttaacacgtgagtttacgccgttagatgttattggtggttgttgttatgctctgctacgtggtaatgagttaagttaagccaaactttggcattcgattgactaacttgtacggtagctataacaatcaacttgtcaattttttttccttcttcttcattcgaactttatactatttaagcccattagtattatttgggccttaggacagagggaacgggtttaccaaccccggatagaaaagtaggaccgagtgatgagatggaccaatgataaaccttctgagagagttggtcgacagatggagtaggcggggtcgtggggcggtaggtgaaggattacgacctttccttttttgttcacacccacttatatctacccctcctcgcttctcacacaatttctcagatcaaactcaaaacaaaatttgtttgttcgtttgatctttcttaaaaatatg

SEQ ID NO: 1749 - DNA, 3000 bp, Unknown
  misc_feature (1)..( 3000): cDNA_ID_2143342_gDNA_ID_1620442_Annot_ID_157201 3000 nt of promoter + ATG
taggacgaccccaaccaaagtctgcatcataaataggtaatctaacccagcttgtgattcccaaatttgggcacttgtaggtatgtgcaccgcggacaagggctgacagatcaggctgcatctccaggtagtcaagagctgacctcagatagttatcatccatacgaaccaagaaatcatgaatctgtcctgcagcataccatgttggcttagataacaaatcccctgcaacagccaatggtgttgcagtgaatatcacattcccaaagtaaccaggaggcagctgcggacgtagtctagaccttccatcagttgcaatgtacagtttcgtctcttggtcgtttggaagccctcgcgcctttcccactgatctccacacatgccctgccaacatctcgtatgagctgtagctgacagtgttcccatcctccttggatttcgccttaagagcaacaagctggtctcgtgttaatttgaatatagagacagtggtattctcaggtcctgatttagacggatcaagaggtatcttcatacttggtgcaggctgatattcaacatgatgaaaagcaggctgtggcgggtccctagctcggaggagtgttcgatcaatgaaaggtggaatggttaggtcaagaccacgagccatatcagaccatgtgttgataaaatgaagaccagagaaaccatctgccgcgtgatgttgcatcccaaccccaagtgaagctcccccacatttaaagaaagtcacctatatcatcaaacaatatcattacataactaaaaacagaacatacatcatcaaagaatatcattacagaactaaaaaacagaacaacacaagcattcaataaattaaaaaagggaaagactttaaattaagctgacctgcaaaacgagaagcgggaaagagtgaatgccagcggagtgatcaacttcgggaataagctgacggagattaagggtaggagcaaaatcaccaaaatcatcgataacagaaggagtatcagccacaacgaagagaacaccagcaccgttacaatcgatctcaatacgaccatcatcgtctctcttcaagcgaccagccatagggtaaaaagggacaagggctttggaaagagcttccttcatgacctgagggtcaaagaaattggaagcgccggtgggtctgtagaagtagacactaggggtatggaatctggggatgacaaggtcgacgttggagttccaaagattagtgattggtgtctcggtggcaggccggaccatggtggaatctctgatgttaattttcatatttttaagaaagatcaaacgaacaaacaaattttgttttgagtttgatctgagaaattgtgtgagaagcgaggaggggtagatataagtgggtgtgaacaaaaaaggaaaggtcgtaatccttcacctaccgccccacgaccccgcctactccatctgtcgaccaactctctcagaaggtttatcattggtccatctcatcactcggtcctacttttctatccggggttggtaaacccgttccctctgtcctaaggcccaaataatactaatgggcttaaatagtataaagttcgaatgaagaagaaggaaaaaaaattgacaagttgattgttatagctaccgtacaagttagtcaatcgaatgccaaagtttggcttaacttaactcattaccacgtagcagagcataacaacaaccaccaataacatctaacggcgtaaactcacgtgttaagagaattacgtcagaatccaagaaagtctttttttcagtacaccacaaataaattatgttgaatttatatccgaactatactatattatatgaaaacatacctcaattagtcataaatttcacatttcattttaatttattaactaatggttgttgttgcggatagcttttctttgctttctgttctaaaattatttcttagccattatttgatgatccaacttggtttgaggatctaataaaaattcaatttctttgaagcattcattggcttaatgatccaaaccttttgtcctcccactctctaagaaaataaagcaaaagcaaaactaaaagaaaagcaactagtaccgtgggttggtcaatggtaacccatgctaccaaataccaatcaaagcttaaatgacaatttagtaccttgggttggtcatgatttagagcggaacaaatataccatacatcaaacgaggatatacagagaaaattcatggaagtatggaatttagaggacaatttctcttctgggctacaacggaccggcccattcgctcatttacccagaggtatcgagtttgtggacttttgatgccgctagagactattggcatcggattgaaaaaaatgtttacttcgttgttaacaattttctgaatgcaatattttccttgtcatgaatatttaaacttgttattactttcttttagcttaggtgtggacaattatggagtttacttcaaacgaggaagaatcttaaacgctcggttcaggtctcgaaaacaaaccaactcacaatcctgacttaattgaggaaaacaatgcaaaaccacatgcatgcttccatatttctatcataatcttataagaaaaaacactactaagtgaaatgattctgtatatatataaccaatgccttttgttttgtgatattttatgtatatataactattgacttttgtcatctatggatagtgtctcgggctcttggcaaacatatttcaaagaaaagttaatgactgtaattaattaatctgaagctagaaacagaaccccgaggtaaaagaaaaagacagagcacatgaagtttagtacttttatatatttaatatatcattctttcttattgcttatctctaaagcaaaaacttccctaaaccctaagccaaaggactcagatcgatgcagaaccaagaaggcttgttttggatttgagagccaaatgcaaagaaaaaaactcttatgtctttgcaa

SEQ ID NO: 1750 - DNA, 3000 bp, Unknown
  misc_feature (1)..( 3000): cDNA_ID_2143416_gDNA_ID_1620443_Annot_ID_157230 3000 nt of promoter + ATG
aatacacaagacatttgtaaattgttatcacatactcaacaccatatatattttcaatacctctcgagcatcttctgttatgatttttcttattttctctaattttattacaaaccttatggttactaaatactatgcagaaccgtgcctacttgaaagaaaatgaaacattcgcctacgatattcaaatttccaaatttttacataactcatatcaaaatcaagttaatttcttcataaattttgtgcattttgtgtttgtatttatactgtacggattttctcttacatacgcaaaaataaaaagctttttaatattgaaaaagagaaaaaagaaaataaccaattatgtaataattcttacaaagagtataaatatataaatacagacaaatcttcttctttttgcacacccgaaaagccttgtcttcctatctctctaccaaaatttctctctttctctttctctctctctatagctctagagtgcgtcgtgagtatgtttttattgacgccattgaaattgggttaaatcggtttgaatcggattgaacaaaaactgtattaataataactagatgagtacccgcactacgtgcgggtttacgtattactatttataaattgttttatataatgcatgttcatataaagtaaagttaaatgcataggttttgaaacataaatatgatttgtaattgtttttgaaaagcccaactatattagttcatctgaaaaaagaatgtgcttgagttgttttttattgttgttttagatttttagttttttttttgaatttatatatccttgcttttttaattatatgtatagattgtgagacggtgaaattttagaaaatttatttcttacactaaaaatataacatgtctttattaatcatgtctctgcatatttaatctaagcatattcaacttgatgttcttggaaagtttagttaaattcttgtcataatcttatatcttacgtattagttataaagatagctcctcaaatatctttcaaattacttgttttcttagcataaatcttgaaaagcttagatatatttaatctgcatattcatttagtttctttcataataatcgtctaatttttaggccaggaatatgtgtaaatctttggattttatcatcactttagccacttaagtggatctcaaaattaaagaggatatattgaattaaaaaatgtagaaagagtgatggttcaagttctcattaattatatttttctattttaattgttatgttgaattaattactaattatgtattacttattttatgaagtctaggtggcaaactctcatgtgctaatgtgtcaagttgtggaagagagttagtcttctttcatatatataattcttcctctacttttctctcttctgattgattccaatcttctttcatttcttcttctttttcttatggagagggggcatgttaaataatatcaaatttatttttatttatactttatagtatatgtttaaaatttgaaaaatacattttttattgaatatcccatttatataccaagttttgttatattcttaccattcactaaataattcacacttgtttgatttgtactctaaaaaattatgcaattacttataattcgtttttatttattataaaaataaataaacactaaaagatattttttatgatatatttctaataaaataatttgaaatataaacttttattttgcctatgttcttaaaactcattggcacggctctgataccaactaccaactcaagtgtctcgtcaggtatatttgctcatgtcaagagtgaagcaaattgacatgaactccccaagccgtcttgtaaggacgaatgtctctcaagtaagcaaatgaagcagtcatttcgggtggtaagttttgtttgcttgtgataaaagtaaaaatagtttggtgcttggtgagagtgtatttatattgattttagaaattggtcttgttttaggttagaaaatataagaaaaaaattggtgaacaagtataagatatctttaaaaatcttttaatcgaatcaaaaatccatagaaattttatctttagcaacaatttaatcttaggctttagcacaaacacttaactccttatttcacccctcttcacctaattttgtaaaactgaaaaaaatagattattgatttcatcaaaatataaacatatagttttgtaaaatattaatttcatttattaattttatctttaatgacaacttaatccttccttataaaaccttagcaaaagcacttaactcccttatttcacctctctcacctaattttgtaaaagtgaagaaaacagattaattaatttcttcaaaatataaacatagttttgccataaacgaaaggttggttcttctcagttgattagaccgataggttccctttttgtagttactttattggggtggagaaattatattattcgattccttatgatgtcaactaaaaattaaagaagaattgctttgctgattgaataacttaatactgtactacattggttgttttgataagagattttcaattactactgattattcaattaagtgacatcgttcaagaaaaccctaattaaatgctaatatataaaataatttcatttaaaaaaatctcctaaaaacacgaaactgccctaaatcttggtaaccttatttaacttgtactccgttaaaatagaaaactttacgttatataaatcttttttttttgttatctcataaacgttagtttactaaatatatttaaattaatgctattgaatgtaagaatattcatacgacagacacaactcaacttatcaattcttttttgggtccgtctcttgcgtgactcaagaatcaaacaacacaagtgtcaaagccaccaagaacacaaatcgtcgaaaccccaaagaaaaaagtctcagcaaaatccttctttcatcgtctttcgatttctccaaaaaaatg

SEQ ID NO: 1751 - DNA, 3000 bp, Unknown
  misc_feature (1)..( 3000): cDNA_ID_3064040_gDNA_ID_1620443_Annot_ID_157232 3000 nt of promoter + ATG
aaactatgtttatattttgaagaaattaattaatctgttttcttcacttttacaaaattaggtgagagaggtgaaataagggagttaagtgcttttgctaaggttttataaggaaggattaagttgtcattaaagataaaattaataaatgaaattaatattttacaaaactatatgtttatattttgatgaaatcaataatctatttttttcagttttacaaaattaggtgaagaggggtgaaataaggagttaagtgtttgtgctaaagcctaagattaaattgttgctaaagataaaatttctatggatttttgattcgattaaaagatttttaaagatatcttatacttgttcaccaatttttttcttatattttctaacctaaaacaagaccaatttctaaaatcaatataaatacactctcaccaagcaccaaactatttttacttttatcacaagcaaacaaaacttaccacccgaaatgactgcttcatttgcttacttgagagacattcgtccttacaagacggcttggggagttcatgtcaatttgcttcactcttgacatgagcaaatatacctgacgagacacttgagttggtagttggtatcagagccgtgccaatgagttttaagaacataggcaaaataaaagtttatatttcaaattattttattagaaatatatcataaaaaatatcttttagtgtttatttatttttataataaataaaaacgaattataagtaattgcataattttttagagtacaaatcaaacaagtgtgaattatttagtgaatggtaagaatataacaaaacttggtatataaatgggatattcaataaaaaatgtatttttcaaattttaaacatatactataaagtataaataaaaataaatttgatattatttaacatgccccctctccataagaaaaagaagaagaaatgaaagaagattggaatcaatcagaagagagaaaagtagaggaagaattatatatatgaaagaagactaactctcttccacaacttgacacattagcacatgagagtttgccacctagacttcataaaataagtaatacataattagtaattaattcaacataacaattaaaatagaaaaatataattaatgagaacttgaaccatcactctttctacattttttaattcaatatatcctctttaattttgagatccacttaagtggctaaagtgatgataaaatccaaagatttacacatattcctggcctaaaaattagacgattattatgaaagaaactaaatgaatatgcagattaaatatatctaagcttttcaagatttatgctaagaaaacaagtaatttgaaagatatttgaggagctatctttataactaatacgtaagatataagattatgacaagaatttaactaaactttccaagaacatcaagttgaatatgcttagattaaatatgcagagacatgattaataaagacatgttatatttttagtgtaagaaataaattttctaaaatttcaccgtctcacaatctatacatataattaaaaaagcaaggatatataaattcaaaaaaaaaactaaaaatctaaaacaacaataaaaaacaactcaagcacattcttttttcagatgaactaatatagttgggcttttcaaaaacaattacaaatcatatttatgtttcaaaacctatgcatttaactttactttatatgaacatgcattatataaaacaatttataaatagtaatacgtaaacccgcacgtagtgcgggtactcatctagttattattaatacagtttttgttcaatccgattcaaaccgatttaacccaatttcaatggcgtcaataaaaacatactcacgacgcactctagagctatagagagagagaaagagaaagagagaaattttggtagagagataggaagacaaggcttttcgggtgtgcaaaaagaagaagatttgtctgtatttatatatttatactctttgtaagaattattacataattggttattttcttttttctctttttcaatattaaaaagctttttatttttgcgtatgtaagagaaaatccgtacagtataaatacaaacacaaaatgcacaaaatttatgaagaaattaacttgattttgatatgagttatgtaaaaatttggaaatttgaatatcgtaggcgaatgtttcattttctttcaagtaggcacggttctgcatagtatttagtaaccataaggtttgtaataaaattagagaaaataagaaaaatcataacagaagatgctcgagaggtattgaaaatatatatggtgttgagtatgtgataacaatttacaaatgtcttgtgtattacaaaagtctatgacctctcaattacctataattttttgttcacgatatatgatcaagtaaatatccctaaagagcaaattcttgctgcttaaacaacataaaaaccataaaaaccgttgatgtgtgacttctaattgtacttagttatcttgtaccatcaacttttttgtaatacttttgtcaccaatcgcagtttctaattgcacataggtaaagtcttatgctggattttaaaaaatttaaaactctagggaccaagcttttaaagactcgaaaaaatcccaaaagctttctttctctcccgagcacctgaaaaatcaaaaccgcatcggcgcgtgaacaacactctcctcaggaaatgctaaaacgacagcgaatcttccctcgccaccaataaatttctgccacgtaaccgtcgtttccctcgattttcttcccctttccataaacccctctaaaaacccttcttttagggtttcaatctcatccatctacaacctctagctcttcgatttcacgtcactcttcactcaataaaaaagctactgcttcaaagctggctacttcttcaatttactctcattcgtttgcgttgatgtagcaaaacaaaaaccaaa

SEQ ID NO: 1752 - DNA, 3000 bp, Unknown
  misc_feature (1)..( 3000): cDNA_ID_3064087_gDNA_ID_1620444_Annot_ID_157242 3000 nt of promoter + ATG
tctaatgagatcgtccatagaatattcttcaacgatttggtctacctggagatcgcttatgtcttctcctccgacgtccatggcgaagcaatagctaggtttcttcgcctgtgtgattgttgggctatccgataataaagggagaaatatacgcgggaaaacaaagtgtaaaacgcagcgttttaagtatcccctccatgtccaaaacgcagcgtttatatggagaatgatatacattattagcattttgctaagttggagaactaaaataaatatgcatctccacccacaagtattcttaagctatggttgagtaatgtaacaatgaaacaaaaattcagtggaagagataaatataacatttagaggtcagcggcacggacttcactatagccatacctactttttgcttgttaccgatgttaggtccagcttcctcgatcatcatacacctgtggctttatcgattaccatcctcgttgccggcaacaacatctatgttttgctgatgatttttttgtgttaacaaagtcaatggcaagatccttatcaaaacttttcaagattctagctatgtttgagatagacaaggaggatgcataaaagaaagctaattgcatagttatacctttgatttaaggaaacatagcactctctattacgcgcctaccaggctagcaatttaaataaatatttagcgtttcgtttggcgtaagaaatgttaaacatgtttatgaagttctatatatcaacatggaaagtcgttttgattcttgattaaatatgttccttatcagttatccataacagtacaagctttttgctatatgattttcaattctcaaagaggtgtttaggaaaaactaaaagtttttctaatgctgtcttctggtccaataaccactataaatctaaagtatcttgttggtaagccatgataaaaggttgatcttggactacgtaggtgtagccgtgtaggttcgtcgacaatttcattacctatcaatttaatttatttctattaacaaaaaacgaaaaaatcatatagtttatatcaaaacttttatactaagacatcactattacttcaaataatatgtatgtatagggtgggaaatatgggatagatgcaatatggatagacatcactacacaacttcaatatagtttctttctttctttattatgaaaagtacatgtcttaatgcgacaagatatttctagcctcattttctatatagttttgtttatagattatattcatcaaaaaagattttgttagcttttgtttaggtttgtcatcctctgtttctcaagtttaggactgttgtctcacaaaattttctgacttgttgtctttgtttctttgagattccggatttcgttaaccggaatatgcagacattgttttcggttttttcccacctttgcactatacttttgcagtttaaaaggattttacaaaggcggtttatcaaactggacatgcgattttaagccaagatttgtattcatgcaactaatcaacaaaggataagaagaaaaaagttaggaattttgttttagcaatacaatcattcacacatgatattgacacatcattgctctctaggattaaaagcccccttacagtcttcaaagtccgtagctaagttggaaatttcttacttttataacgtttaagtgtttgtattttggtctataaacagaagataattcccataaaataagaggttgaacataaaccatgtcacactctcaaataagaggtgcaagtaacataagtggcaacgtctagacttaactaaaaagattcgtccgccagaagtaaaaagtaatcaaaaataaaaattcgagaaaatggtctcgtacacggaacctctaacatcaacgtaattgactattgagcccccggtccagatacatagcgactagcgagagaagaaaatcctcagggtagaatagtcattaactgcctaaccaatcatgaaatgtcacgtgtcacgatcttagagcctctaaaacggacggtggtgaggttgtcaagatccttaccgtagttcttcttcttttgtggctattacaaaattggtttaattctctaaaccgacaaagagagaacccaagtttaaaattttaagtgatttgaatgatacatattgtatttgctacttaaattaaaaaacaatcaaatggagaagtttaatgattttttctgataaactattgaatttactgttcgtttgtgggtcggttggtctaaaccggccgttagattacgtaaaattgagttggtaagtaggtcggtttaccacgtgatattttcttagctagagtttggaagtattgctagcgtgcacgatggtgcaccgaacaagtgttatagacccttaccgtataaagaaaaaaaataaagaatcagaccggagatagatagagagagagataagggagggtgaaaaaataagcacacaccattatccatctgtttttttttttcatctctctctctctcttttcttcttcgattcgtgttttctccatttcattctctgttacgcttcaatcgaactcggtgagagtttcttcacttaatctctgtattcggattcttcgttggtttctgttgtttgttcttgtagcttatggcttcgtatttgttcaaagctagggttttatgtttactagtttgtgtggtatagttcgaatttgtacgatttagtaagctccagatcgtgaattttgatggagatggagttttttgtaaaaaagtcaattccatttgctgatttatgttagtgttttggttcgatttctcttatcttcattatgagctgattttatagcttccattgatctgagctaagtgaaattcaactttccgagcttacttgtgtaaatcgaatctgtttttatgtgtacaactgtttcttgaagttcagtgatatggtttgtttactaactcgttgttttcttgttgaatttatttaggaagtcatg

SEQ ID NO: 1753 - DNA, 3000 bp, Unknown
  misc_feature (1)..( 3000): cDNA_ID_1022127_gDNA_ID_1620444_Annot_ID_157251 3000 nt of promoter + ATG
ggataaaaatatccgacctgccggaatcgaaccagcgacctaaagattttctgttgcaaacaactacagtcttccgctctaccaactgagctaaggtcggatttacaatctaatcaactttttaacattataaacctttcttagtattttgcaagaattctttaatcagctcatcaacctcttcttaagaaaaaattctactattaattttttttttttttgtaattctataaaattcagcttcataataatatgcaaaagctgatattttattcacaagccatatgaagaaaacacattgatgaaagtctcaattttattcttgattttaacaacatcacaggttgtacccatccccttctctgttttcaagctatgatttataatattttggctctcttattatatcattgacaaattaatttgttctagcatacttcattaccctcccggctccaagctaggtgacttgatcatgtagcgttggtgctccacacgagcttgatatcttctctcttacttctcggttttggcctttggaggagaagcacaaaaccttctctaccatttgtctttctcttctaaattggttccactataaaacccattctttataatttatttcttttgttgattaactaatgtaacattttttttaaaaaaggaccatgaccatcaagatggatgtataattctcaagatcacaaatacaaagcttatgttgaagaaccacgaaaacctagaaagttcatagatccatatatatatatattaaagtttcatttcccatcagcaaaaccctgattgaccagtcttgttcaaaaagacatgagaaaacttgagagaagaacaaaaaaaaaacataaatgaatgaaaaggtattatcgtaaactatgtaataatagaccaaaaatctcctcattttctttcgcatcttgcaagtactggaaccttactggatttgcaccaaacttggaacataagaacacataagtagacacaacctttggattttctaagatccacttctctgtagtatccattctctccgagaatgtaagttttgtagttcttacacgtttctatgtctaattcactaaccattgctactttcttcttctcgtcgacgaggaagaaactcaaatcttcaaaccaatagctgttaggcaatgtcatatcaacttttaagaacttgctccacaacactatattgagctcaatcttagttgtaatccatattcccatctcatacgcatcagacttctgaaataacactgcaagctgctcttctctaacagtagatagaagtacagtatcctcatgacaacagtgaaatggaagaggaagactcggtccaaatctttcacatgtaaaatcaaaagaaagtaaaaatgcttcctctttcaatatgtcatgagcaataaagtaaacattacccttcaaggacacacgctgattatctattatatggtcttggtcggtattgacatcaataaccgtccacgcatcagacttaaaatcgtagatttcatactcacggtacatagacgaaaaccataagattttgtggttgttgttgctgtcgtatcccatataaaatctgccagctggtctatgattaaacctgccagctggtctatgcttatgcgagttgtttctaggttggatccacctggtttgacccaagtaagggttccaaaccatgagcttcgagttatccttagggttgcataacaacaataataataagccatcacaatgaaacacactatctatttcgacttgattaagtttacctatttgctttatagatggatctgccaagtctttgtgattatggagattgacgctcattaaacaagcctttaaatcacatatcatgatcacctgaatctccttggcttctttaccataatggttttttgtaaagctcgaatctttggataaatcattccattgtttacaagttaatttcactgctttcaaagatgttattggaaccctagagagtatctcttctaccaaatccgggaaaagatcagacatcgtcgacattttttcaaatagagattagggttttctactttcacgcttgcccacactacttttttttttgtttatatatacagtaaaaaaaaattgtgaagaaaaataaatacttacgtataggtgtatagccttttaaccaaaataaaaggacgtgatttacattttttttttttttgaaatatttcagtaaaattgttgctactaaattagtttttctgtaagacatttcaagtaggtaaagtagggcgcttaggctggctgaaaacagataaaggattgcgttagcctaacttggtctgttcatcgcgacgaggaagagcagcggcaaaattttctagaattgattcagcttgcttccaattccgtatctactagattctttcaacattgagtttctttcattaggtcagctcaaagcataaaggtgttcttcatataaaagacattaaaccagatagtaaaccataaacttaggtaacattaaatcagaatataagacttctaatactcgtatttcccattctatcatgtgcttgtgacctctataacattctcaatgagagaagcatccatgtgaacttgagaagcatgaaactgaaatcacaatgaacttctggtggtcatggtaatatgacccataacgttcattaccacttaagcaaacgatcttaaaaaatctctaaattcgtttgattatataataagactaattaatcttgtttgatatgatcataaagcgtcttaacatcatcgcatcaatgtttgtttgtctatgatttttcagacaatttagaaaataataaaaaaaaaataaaaatggaaatctgacgtggcgagtgagagggcttgtgaggagcacactcttccacatctttttcccactcttccttcttatcactttcctcttctctcttctcctctgatcccaccacacttttgaactttcactca

SEQ ID NO: 1754 - DNA, 3000 bp, Unknown
  misc_feature (1)..( 3000): cDNA_ID_3064070_gDNA_ID_1620444_Annot_ID_157254 3000 nt of promoter + ATG
catattgataaaccaaaaaaaatgatcaagaagaaaaataaattatattcatagagaaatggtttcttcatatcgattcttgtaaatatagcaatcaactaaaaaactaacttcaatataaactcttgtagaacaccaaacaagtcttatccaatcttttccttagaaactgatctcacgtctctcggcgaagaactttccggtgatagcttgatcaggaagcaatgcaagccagactccagtgtcagctccatcttctgctgaaacgttccctgcatagcctgtcattgcggttttcacccaaccgggacaaaaacagtttgcatatatcttctctccctctggtctctcggatagttctttagctagtactcttgtgtatgcgttcaccgccattttggagacagagtagtctgtgaaggaatgtggccaacctccagattcccatgttccttcttccacttgtttcaaaaactctgatactgttttgtcaacgatttcttcagttagagagtccacatccataagcttggctctcacgtcttcattctcaagtttctgttgaagagaactaggtcaaaattcgttgctgccataatttttaaggaagatgaatcgagttagagagatatatagatatatgtacactgtgtcggccttttaatctaccgagccttgaagtgacattgacaatacgagctccttgacaagcatgtctcattagtggaatcatggcgttgattatgttcttggtgccatagtagttggtagatataaccatatgcgagaattcaacagagttatctgatccaacattgtagtttactcctgcattattaatctgcatgacaaaaatatttcacatcataactcatcaagagaaaagcctttagtatcaaagtctttcaaatgaaaagctcatttggttatgtgaattaatgaacaaaaggaaccaaacttactaaaacatcaataaatccatatttttctttaatccattcgcaaaactcttggattgaggaagagtccaagatatcgaggcggtggaaatcaacattgaatccaccttcttgaaggatcttggcggcttcgacgcctacattctcgtctcttgatgttagaataactgttagtccatgtccagccaattgtctcaccatctcaaatcctattcctctattcgcacctgttaccaccgccacggtttcagaggtccaccacctaaacaatcccccattcaagaaataaaaaccaatatgacacttagttatcagcaagacaacaaaaaaaaaagatcgaatgaatctcatatataagaaaccaaaaacttatttaaacgtccaacaaaattgttttcagtttgagatatcgatggaacacagaatttcataattgcatctcgtggacgataagcttgtaccaagtaaactagtttatatgttttgactagacctaaatgtaattcttcctactgagtaagggatatatacaaacatttattataatcaaaatttcatagatatgaagacataaaaatttagaatgggaatattgatacctctggtgatcagaatagggaatagtacgaaggagggagatctcttggagtctcttatctcgtttctctttcgatttttctttgcttcctaccatctttcttcttattttctctcttctacgatcctaagtatgtttattttcacgataagaggaggcaagaaagaacacagagcttcgtcgtcgttctcatctccctctcacataattttctcatcctttttgtgggtcaaaaggtgcaatcccccactttctgcgtaatttttttgtggcctctcatttcaaattcatctgattcctatttttagttatagcatctgttatgggaacataaattagctggggcctagctagggtgtgggctctcaatacgaaccaaagttttgttcattctgttttagttcctattaataattcgaccatttcttaacaaaaaaaaataataattcgaccatttggttttgtggcggtttaaaattgagaaaacaatcttatttaagagtctctcgtgttacacactctcactacgaatctatgatccacatgaccacatgcatgtcacgttgcatcctctcacattttgataaaatttatttgggacattttcggtatatagctcaaggctcacaatctctcatataacagctaagataacgttcttattctggtttagatatatataatgaagaaattaattagtttcaatgtgtcatatccacaattattctaatttttcttatttattatatatttaattctaatatctttttttgccaaacactattaattccatatactaattatttttatcaactaaactttttttaattgtggtatatttatttttggtatattattttttataggtaaaattatgttatatttattatttttatcaaaagtaaataaatatattttgaatagataagataagatattttttctttcacatatttttgggattaatattagattaaaatatagttaaaatcgagtaagtttggttaaattctggataaatagaaaatattgtctatttactgatcgattcaattagaaacatagttttaagaataaatccaaaaatacatataattttattagttgcaattagtcaaccctaaaaacaattgacaaaaaacaattaaactaaatatcctactacagtttttaactctggcataatattgaatcaacaatcaaatcatctaaaagaatatgtagttctctattcctcaagattttatgtctactttcggctcgtcatatcaatttgtactgttgtacatatctaagccaaaaagaataaaaattagttataatcatatgtgatcaagagaaggccacgacaagtataggcccattaatgggtccataagtacccactttcattacagaacaacactttcctgccgaaaagagagagagaaaacaaaacaaaaa

SEQ ID NO: 1755 - DNA, 3000 bp, Unknown
  misc_feature (1)..( 3000): cDNA_ID_2143501_gDNA_ID_1620444_Annot_ID_157259 3000 nt of promoter + ATG
ttatattccttcttctagccaatgcatcaaacagttccaaagcaaaatcctttgaagtcattcctacaataccaaattttcattcaatcagtacaaaaaaaaaacattctaatcacttttcaagattataacattagtctttacctatgcattcaccgaactttgtccgaagaagtagtccaccggtagtcgcggtaatctgattaaaccgcttctccacggcagaccaaccggcgccaccgtcggttttactaatgaacttaagtcccttcaacgcttgactcgcggcggatttagtccggtctaacttagccggtcgaggcggctttcttccaccaataccaccagaaacagatgtcaaacgcttaagctcgtgagaaacagacgccaaacgtttcaccaccgttgttttcttctcaagacggtttcgtttcagcaaagtaagctccggactctcttcaacgctagatccaccttccattttcaagctatgtacagagactgtatcgtcttgtacatctaccgtgaggtccacgtatggtgccgtacgtgttctctgactgttctcagcagtgaatctggagttccccggttttttatagatcggtggtaattgaccaccgctcattggtccgctgtttccggcttctgcatcagagtgatagcctcctgacacttcaaaactcactctagacattttttaacacactctacctgaaaattttctcgtcgccgctaaatttcaccgggatctcaaacaagagacacaaaatgatgaagaatttgttgtctactggttatggtcttatggaatctctcactacttttttagaggaaaattttgtaaacgcagagacaacatttttcccgagaaaatgagagaatttttccgggaaaatatttgatgttattcttctctctgaaagtaaacgatctctcaagtaatttttgataggagaatgagaaaatggattcgtataaatagtgaagagaagagacgagtaaaagaatttgaataaagaagagagacgtggtcggacttggcccaccaactttgtcatctatgatgcaaaatatttaacaaataacaactaattgaggttgtaacgtgcatttgtaatgcaatacattgagaaaaaaacaaatattatacataacaaagttgagtttttttcactagttgtttatttaagaattagaacaatagtccactgttttttaacaagtccatagcgaatgttggaaacttattttaaaaaattattaattggaagtctaaagaattacgaaaacaaattgtatttgattaaaacaaagtacaaattgcatttaaaaagaaatagtctatagaacatggatgatccttccatataaagtttgatcatgcacatagtatgacaataatcaaagagcggggatagctgtgaatctttagcagcgaaaacttcaaacatatatttcatgaatacaacaatgttataaaatgaatttcgtacgacataataaatgttatagtaattcttatgtttgtccaaaaaaaagaaagtaattcttaggttaaatatataaaaacatgacaaaagtgtaactattaaagatatttgatgtactacatatatataacaaattttatcaaagatgtacatagacaactatgttcttaaaactccacaaacattacggcagttagaatttaaatttatcttggaatattgtttgtatattattaacaaatgtaaattggtgtaggttttcagattttcataatgaaaacagttttaaattatggttacgagataattttgacgaatatgaatacatatatagaaaatgtttgggcctatatctatgaaaatgtttgggcctatctatatctatgaaaattgtatgagataccaacaaaataaaatatttaaagtagcaaaacattgtgttacttttctattatcttgtcttaaataaataaaaatcaattttttttttaagaagtaacacaatgtgaagaatacgtgtgtacttttttttttttggcgtaaataaaattagtaaattaagacaagattaatagaaaagtacacacgtattcttcccattgtacgttaaaaagctcgtgaattcacatgcatgaggacgatttgggtaaccaataagttgactatatttttgtatgtctttctatttttcttcacatggaaagaattttccaacgaaaagttgaaggggagacaattaggaacactaaattgtcaccattaggctcttaagttttaatttggcaaccaatttcattttctctattctgtatttttggattgggaccgttttatttgtttgtgtgtgtgcaacttgagctcttcttctgtaacacgcatgtgttgcgtttggtttttaatttatttgcctacttttgcgttttcaacgtttgttaccacatttgaactataaagtccaattccataccgatcctctacaaccatataaatgtgctacaacaaaagttaatctttgatcttgatcaactcaaagatgactatacatgattagttctcctaaaagctaatgttgtagagtgcaattgccgacaaacctccaagttttgtgtcaacttgaatttgtacttaattgcaatctttggaacgtgttcattcgaaaacgagaataaaaagaaaaaaacatgactacgtctataacaagtaaacaaaagacaacagtgaaaagaatcttatcaaaagttcaaaacgcaaacgtggctaaacctgtacccaaacagtcccataagaagccagaatcaaagtacactgtgtatataaatgagcccaacaataaccgaataaacaaaaacaaaaaaataacgttgccttgacgtgtcatcttactccatcccttccttttgcttcttctcctttacttccttttttttttctttccatcattttgtcacaaaccggaaaaaaaatctcaccggagaaaaaataaatctcaccgacgacgaattcgatc

SEQ ID NO: 1756 - DNA, 3000 bp, Unknown
  misc_feature (1)..( 3000): cDNA_ID_3053837_gDNA_ID_1620444_Annot_ID_157257 3000 nt of promoter + ATG
tattagatgagtcaattatctatggaactgcaacaattcgaggtgagctatacctcttgagaactctgccggcgctaccatcatcaacggtgaagagtccaacggctatatgctccggtgcgatatattgacaatccatagtcctagagtactcaaccgcagcttcaaagactcgtttcgtgctgatagagaaaggcatgtccgtcgattttgaatacgaagtagaagaagcttcctcctgtttcgaatcggaattagcttcgtcccaaatactccaaacagcttcacgagccttgtcgatggtgataccggatccaaggaagccttgaggatcacgatcctcagcgatcaaacctaagagaagatgctgcgtgtaaaccatatcttttcccaacgatttagcttccttctgagagaagattatagctctgatcgctcgttcggtgaaccgttcgaaaaccgctgaaatcggagtgaatttcttccgttttctttgaggaaatcgtcttaagttcgtcggagttgtggagaagcggtggatcgtgcggttagaaagggagattccgagatatgaagaagcgaatgaagaaagtgaagaagcggcgatggaggtgacatgtgaagaagaagaagaagcagagaggagtcggtgggagtgaagcgttagaggtgaggaagtagataacacctccatgatcgaattcgtcgtcggtgagatttattttttctccggtgagattttttttccggtttgtgacaaaatgatggaaagaaaaaaaaaaggaagtaaaggagaagaagcaaaaggaagggatggagtaagatgacacgtcaaggcaacgttatttttttgtttttgtttattcggttattgttgggctcatttatatacacagtgtactttgattctggcttcttatgggactgtttgggtacaggtttagccacgtttgcgttttgaacttttgataagattcttttcactgttgtcttttgtttacttgttatagacgtagtcatgtttttttctttttattctcgttttcgaatgaacacgttccaaagattgcaattaagtacaaattcaagttgacacaaaacttggaggtttgtcggcaattgcactctacaacattagcttttaggagaactaatcatgtatagtcatctttgagttgatcaagatcaaagattaacttttgttgtagcacatttatatggttgtagaggatcggtatggaattggactttatagttcaaatgtggtaacaaacgttgaaaacgcaaaagtaggcaaataaattaaaaaccaaacgcaacacatgcgtgttacagaagaagagctcaagttgcacacacacaaacaaataaaacggtcccaatccaaaaatacagaatagagaaaatgaaattggttgccaaattaaaacttaagagcctaatggtgacaatttagtgttcctaattgtctccccttcaacttttcgttggaaaattctttccatgtgaagaaaaatagaaagacatacaaaaatatagtcaacttattggttacccaaatcgtcctcatgcatgtgaattcacgagctttttaacgtacaatgggaagaatacgtgtgtacttttctattaatcttgtcttaatttactaattttatttacgccaaaaaaaaaaaagtacacacgtattcttcacattgtgttacttcttaaaaaaaaaattgatttttatttatttaagacaagataatagaaaagtaacacaatgttttgctactttaaatattttattttgttggtatctcatacaattttcatagatatagataggcccaaacattttcatagatataggcccaaacattttctatatatgtattcatattcgtcaaaattatctcgtaaccataatttaaaactgttttcattatgaaaatctgaaaacctacaccaatttacatttgttaataatatacaaacaatattccaagataaatttaaattctaactgccgtaatgtttgtggagttttaagaacatagttgtctatgtacatctttgataaaatttgttatatatatgtagtacatcaaatatctttaatagttacacttttgtcatgtttttatatatttaacctaagaattactttcttttttttggacaaacataagaattactataacatttattatgtcgtacgaaattcattttataacattgttgtattcatgaaatatatgtttgaagttttcgctgctaaagattcacagctatccccgctctttgattattgtcatactatgtgcatgatcaaactttatatggaaggatcatccatgttctatagactatttctttttaaatgcaatttgtactttgttttaatcaaatacaatttgttttcgtaattctttagacttccaattaataattttttaaaataagtttccaacattcgctatggacttgttaaaaaacagtggactattgttctaattcttaaataaacaactagtgaaaaaaactcaactttgttatgtataatatttgtttttttctcaatgtattgcattacaaatgcacgttacaacctcaattagttgttatttgttaaatattttgcatcatagatgacaaagttggtgggccaagtccgaccacgtctctcttctttattcaaattcttttactcgtctcttctcttcactatttatacgaatccattttctcattctcctatcaaaaattacttgagagatcgtttactttcagagagaagaataacatcaaatattttcccggaaaaattctctcattttctcgggaaaaatgttgtctctgcgtttacaaaattttcctctaaaaaagtagtgagagattccataagaccataaccagtagacaacaaattcttcatcattttgtgtctcttgtttgagatcccggtgaaatttagcggcgacgagaaaattttcaggtagagtgtgttaaaaaatg

SEQ ID NO: 1757 - DNA, 3000 bp, Unknown
  misc_feature (1)..( 3000): cDNA_ID_2143478_gDNA_ID_1620444_Annot_ID_157253 3000 nt of promoter + ATG
agttatcgttgaagaaagaatgatgtaaataagtaaaagaagatggtcctagagcatcttgtcatgggcaatatgaaaacccacatcttcgtcaggtatgttgtgttgttcgaagttacatttttttgcatcctgatatattatttctatactagcttatggatgtgtattagttacatatttaacaccctcatttctgtgtatttaattttcatatgaactttaacaagcttttaaaaatgaccaaattcaatcttggtttggtgactgtgacaaatgtaaaccataatatcttttgacagatatcttaccatcttatctctttaaatttggacaacattttatccaaaactaggcaaaatctagtaacaccaaatattagcttggaaacttcaacaaacaagacacaacactgtaattatctcaacgccatggaccttcttcacggcctggttctttattaatacaatagtaaagtaatggttgctactacttggtatctattttcatatcataacttattttcactttgatactttttgaaaagaggagtttatgtttactgattccctgaaatgggagcatcacggcctctcttgaaatcgtcccatcctctgacccagggctgtccagccgctgcacgagtctctggcgctgcatgcttgttcagattcttcatgactttctcgtgtaacgccgagaacacctttaacatcacaacaaggattgttttaatcactgaagtaaacaaaagacgatatactgtttaaacgtagactcgattaagagattgtgattaccggatttgaactcactgcttccggaggctgttcctgttcagttagccatttccagagatcagggttttcctgcatagaacaaaaaaagattgaatgcaataatctaacaaattcctgattacaccttttgacgtcactatgaacataataaagttttcaccaaccaaattacttgtatggatcatttcgagattagatcacatcacagaaacaacctcaatctggttaaacaactcctccatacaagtaatttggtagcttcagattctacctaaacatgcaaatattcatatacataaagataatttttactgataagaagagacaatgaaacataccaaattgaggacatgaattagggatttaacaccattttcgtccatggaattaacattctcctcaacccaattccccaaaacaagatcaagttccaaaaaccctctttgcttgctcctatacaacaatctatcaccaaaaccctaacaatcaatcaccaacatttgaaacaaatcgaatccaaaattataaccatacctgttgatcgttcttctcttattctcttcgttagagagatcaatatcgaaattctgggcagacgcagtgttctcacagaagaatctcgcccccaaatcaactccattcctagaaaaaatatcaatcccacaatttttttttcaggcgtgttcacgaatacacagatcactattattacggtggagagaaagttaaagtaccggaatataataggatatgaccggttagcggcggcaggaatgatagagctccggccaaccacggcggtggagcgaatgatccggtgaacgttgatcagagcttttcgggtagccattttttgttttgttttctctctctcttttcggcaggaaagtgttgttctgtaatgaaagtgggtacttatggacccattaatgggcctatacttgtcgtggccttctcttgatcacatatgattataactaatttttattctttttggcttagatatgtacaacagtacaaattgatatgacgagccgaaagtagacataaaatcttgaggaatagagaactacatattcttttagatgatttgattgttgattcaatattatgccagagttaaaaactgtagtaggatatttagtttaattgttttttgtcaattgtttttagggttgactaattgcaactaataaaattatatgtatttttggatttattcttaaaactatgtttctaattgaatcgatcagtaaatagacaatattttctatttatccagaatttaaccaaacttactcgattttaactatattttaatctaatattaatcccaaaaatatgtgaaagaaaaaatatcttatcttatctattcaaaatatatttatttacttttgataaaaataataaatataacataattttacctataaaaaataatataccaaaaataaatataccacaattaaaaaaagtttagttgataaaaataattagtatatggaattaatagtgtttggcaaaaaaagatattagaattaaatatataataaataagaaaaattagaataattgtggatatgacacattgaaactaattaatttcttcattatatatatctaaaccagaataagaacgttatcttagctgttatatgagagattgtgagccttgagctatataccgaaaatgtcccaaataaattttatcaaaatgtgagaggatgcaacgtgacatgcatgtggtcatgtggatcatagattcgtagtgagagtgtgtaacacgagagactcttaaataagattgttttctcaattttaaaccgccacaaaaccaaatggtcgaattattatttttttttgttaagaaatggtcgaattattaataggaactaaaacagaatgaacaaaactttggttcgtattgagagcccacaccctagctaggccccagctaatttatgttcccataacagatgctataactaaaaataggaatcagatgaatttgaaatgagaggccacaaaaaaattacgcagaaagtgggggattgcaccttttgacccacaaaaaggatgagaaaattatgtgagagggagatgagaacgacgacgaagctctgtgttctttcttgcctcctcttatcgtgaaaataaacatacttaggatcgtagaagagagaaaataagaagaaagatg

SEQ ID NO: 1758 - DNA, 3000 bp, Unknown
  misc_feature (1)..( 3000): cDNA_ID_3064076_gDNA_ID_1620444_Annot_ID_157247 3000 nt of promoter + ATG
tcttttcacaaggacgtcacacatatggagctctttaaaaaatcaccgttggaagtggtcttatctaaggataaagattccaaaaagatgtctagtacactgagaaaggagaaagaaaatatacatcataacatggctctatagaagtatagttacatgtgtctatctgtcatctatatttgtttttctatttgaattattgtgtagtgaaataactatggttttgctaattgtggtcgacgttgtatttgtgcatgctaagacgaaaacataattattcgctcttttgaaacagcattactgtgtttcgggttacgcacatgcatgtgttgttgccctttgatttgtactatcatcgcttagccgcttacgatgatagcttatgctttatattttagtaaatatttcataaaaaataggttttcttttcctatgaattgtaatgttatcctgttaacgtttgtgaatatttctcaaattaaaattgtcacgtcttcgtatcggctttttactttatgttcatgttggtgtagacgttggccttctgacggttcatgaaattgttaagcatgtaatgtgactttttaaattgctttcagaaagaaaaataaaaattaaagacttgaagcatgctatatttcacgctataataattgaggtcccgatagtcatgtgaggtctatcctaatacccttatagtagaaagagccttttttaaaaagttttcaaaaaatattataatctgatttgggcaatactttgcattacatatggatgaactaataagagagaaggtttttaattagtagacttttgtcacttcaattctaatcatgaaaaaacttacaacatattttcattctttaatatagtttacaatctaggattggttagaaagaaacaactgagagaagtcaccaccggatgcttttggctagtggtttatcatgttgttctcgtagttgaaaccttggtgagagctagggatgcacattacgtcatatcataaagtattagcaaaggctataataccgagccatgggaggaacactgcctcggccgggccctctcctagttaacaagaaaagaaaaaaacctaaggaaatctgagttgggtcttaatttcctaggttgtcaagtagaatctgacaaatgtacaaaacagagggtacgtgatcgtttaggataagggaagacaaagtaaatggactgaatacacctgaaaatgttagacaattaaatattgaatagacttgaaaattacaagtcgttacaaaggcttcacaaatttgcgatgtatcaatctttttatttattttaataattggaataaaggaaaactattgaatggaagataaatagttcatacagctatatgattatgatcattatgatggcaggacacggaaggcaaaagagatacaatcagtttcacaacaataaatcacgtgtaaaattttatagattctgaaagggacaaagggttacgtaacccatcttctttaaggtggcaagtagcatcaaattcattggttggcaagcattttgtttatgcacgtgtggataaggttttaaatgataacattgacgtggcctattatggttggttaatatctaatgttatgtggaagaagaatttactcaaaatgaatcttgtcctagttattgcagaggtatagaaacaactaccgaatgtgtttaatgatggtctccaggtaatgaatcttccgccttggaacgatttcctgtcaatatgaattttgaaaggacttcaaattacgaatctttggagcagttgcaatagcatgatagagacagtcctgtgagcttggataaccaaagttgagctggacagtctcttaactgctcccaagagagattagtgtttgaagattcaaagaaactctccttaggtcaagaaagattagtgttagaagatttacgtggtggcaatagttactgtttaaggtgttgaaattacgtttttatatatataaaaagcaaattaccccgcgtattgggatattgagggcatatatttaattaatctgtttcataagaaaactaaagacacattttaaaaaaaaattaaagaaccatcataagaaaatataattaaggaaacaccataagtggaaatgacttgtgaggttttgtagagagactgagtagactttagaactgtagttgttacaagaagttgtttccaaccaacaaaggtgtttttgggtttgtgtatacttgtgttaaagtttttcgttcttttttgatcaaaaaaagacttgtgttgagggtttttttttttttttttgataagtttaacgttgtaatgttgcttaaaaaattatactagtaaactttggagttggggtgcactaaagttctgttatatctgaaagtatctctgcatgggttttacatacatctatatagaattgccatgattgtttttgtagtgatatttatattagctaggcctatattttctttcttgttcctatagatgcaatacgtaaatattatagaaatgtttttagaacaagtagtaagacatttcaatcagttcacacaaaatgattgaatgaaaaaataataatataaacagctatctgattgtgattgcaagatattgggggcagacaattaagagagtacaatcagttccacaacaataaatcacatgcaaacaagcttttatagatttttatagacccacacttcttctcaggtggctctacacattcatacgtgtagataagagtttgaataataagttgaagtggttaattctgattggttgatatttaaatctcgaagaataattttattacttaaaaaaaaaaaaatgaaacttgtctcttcagtttcatcactagcctcgtgctccaccattagacaaagacattttagaactccgaaaatgtcaataaaatggatgatgattatgagaaaaacttacacgtttaataggcccgaagttgctatctagcagttgtagcc

SEQ ID NO: 1759 - DNA, 3000 bp, Unknown
  misc_feature (1)..( 3000): cDNA_ID_2105242_gDNA_ID_1620444_Annot_ID_157248 3000 nt of promoter + ATG
ctaaggtgactcatttgatgtagtcactaaattgcaatattttaagatgatacttgctctgacctaaatggtgtcagggaacactcttgacctcagttcaatgtggtactatttatatttgggagttgctttgtaaatgttgcaattttacatttaaggaacatcttctgacctttgacgtcattttgttatttaatccaaaattcatatactctattttctctgcagtcttaacattttaaatttatctcatcttattcggttttggacagtccttcgagtttaaagatatagtgaaaatcggaagaactcatactcaagatgctacacctttgacattaggacaagaatttggtggctatgctactcaagtaaattatttgttctgttttctatccttatataacaaaagtgaaaattacatgtcattaagaaataacttataaatttttggatttcatgattgtaggttgagtatggacttaatagagtcgcatgtactctaccccgcatctatcaggtttggaaatgatatctcttgaggatctgatttcatattattctcaaagtttcattgagctctgacttgttagaaatgtttgtctagcttgcacaaggtggaactgctgttgggaccggattaaacactaagaaagggtatatctcgtttctagttttatatccattccgatttcatcctactggtaacactagtactatatgcataggtttgatgtaaagatcgctgctgcagtagctgaagaaacaaacttgccattcgtcaccgcagaaaacaagtttgaagctctggttagcctctaaataactttcatcatcatcaatgtccaaatttagtcttagcgtcttccactgggttctaaatcaaacaagatgcttctgaatggttgatgtatatgaaataagttgttgagttattacgcctttgtaggctgcacacgatgcttgtgttgaaacaagtggatctcttaacacaatcgccacatcattgatgaagattgccaatgatatacgttttcttggaaggtacgttatctaatattttttaatctttcttcaagatgtacatgttcttatgataatttaacatgtctttatatatactttatatagtggtccaagatgtattcttatgatattttaacatgtctttatatatactttatatagtggtccaagatgtggtcttggtgaactttctctgcctgagaatgaaccaggaagcagtattatgcctgtatgaatgcaattttttcctatggttcttatgtcctttccctctgcggctctgcctataccttttatttttcatagattttgattcaattgaattttaatctatctctcagggaaaggtaaatcctacacagtgtgaggccttgactatggtttgtgctcaagtaagttccattcaccaatacatattttactaacatatgaatttaaattgctaaggtagtcttgttcatgactcttttggttgcatcaaacaaaattgtaggttatgggaaaccatgtagccgtgacaattggtgggtcgaatggtcattttgaattgaatgtattcaagccggttatcgcaagcgctctcttacatgtacattaatctctttacttgtgatttttttgtcatttatactctattaaaatttaatcttaactatttgatctcatgtctttactagtccattagactaatagcagatgcttcagcttcatttgagaaaaactgtgttagaggcattgaggccaacagagaaaggatctcaaagctattgcacgaggtaggcttcttctcgttgattggccttaaaattattcatgtgtggaaatgatttatatataggaactaagtctttgttttatgtatttctctctagtctcttatgcttgtgacatcattgaatcctgtaagtctctaaatattaaacttctttgtcaagtcatccatattctcattatgattacaaatgaatttacctcaatgctaattcctcctttaccagaaaattggctatgacaatgctgcagcagtagccaaaagagctcacaaagaaggatgcacattaaaggtaaacaataaactattaacgttttcatcactaaataaatcggaatttaaacccatttttagcaagagaaaacatgttcatgtttgttacaatatatttgttgttctattttggatttaaaccttctccagtgaaaattatataatacaatacctttgagatccctaaatctttgctttaatttattctatagcacgcagctatgaagttaggtgttcttacttcggaagagtttgatactcttgttgttcccgagaagatgattggtccatctgattaagtactttataatggagccaaaagcttcaaatacaaagtggatgtttgggggcttttgcatcaagttgtgtttattcttttgtaataaattgctgcatgcatgtatgcttgtgttcaaaattttggatttgttttagagtcatgtgattatagtattctaagtaatttatcataaagtttgtcatatatacttaagtttaataaaaaataaatgtgtgtgaaaatgtcacatattggtgtttttgttataaaatgtcaaatattctaagtacatgtcaaatacttaagtcatgtataacatgttttctattatttatatttatgtccaccaataaagcacttatatatcaaaaacagattgggattaaatgatagactttgatttatatgagacttttgcgacattttatcaaaatatgagaatagacaaacaatatcatcacgacatgaattggtcgataaggcccatgaaggtccagtaatcttaatgggctttatacagataaattataccgaccaaatcgattatatacgcgccgtcgtcttctcaaccatcgcatattcgccgccataagcagagagtttcacatataaacgaaaaattcccttcgagaagtctcaagtcgacgat

SEQ ID NO: 1760 - DNA, 3000 bp, Unknown
  misc_feature (1)..( 3000): cDNA_ID_2143519_gDNA_ID_1620445_Annot_ID_157277 3000 nt of promoter + ATG
ctccaacatttgtgagagagggacccatcgtaaacatcacatcagattcttaagcttttcatttcttttgatatacaatttttggttttgttatttgtaataataataataaaaataataataaaatattatatttttggatctctatctcggccaccggagaattgttctgatttgcttccgcaatgcaattttgctggtttggtacagtttctgaaatctctctctaagcatatagcttctagatatctttgcgtcgatgatgctgttgtgtcatttggagttttttcggactgtgagtgtgcctgtagacagatggtgatttggttagaaaacgttcaacagaatcttgaactttggtgctcacgttgttgactttggtgctttacttatagtaaccatggtttggtatgtggtttactatggtcggatcctactggagacgtcaaagcctggggcatgaatgattgtggtgaatcatagacttttggagctgacaaagtcgcagagttttttgaaaaaaatgatatggaccttatctgccgtgcccaccaggatttaacttgagttatatttgtcattgagtttattctgaaaactgttcaaccttaaggtgagtatcttgactatctatatttagaccatcattattggtgattatattgatttttatgttaagaatgactcttatataagagccaaaactatccctaagagatggacgtgtgtcaatttttaagtgggtgaactatttatcagaagaaaaaaataaactttcgtgttctcttctcacttcctctcaaactttttgtcgactttctctctttctatcaacgagagccgatggcgataccatcgtcaagtaaagtacaaagcttttcgatcttattcgtatcctttaccggcgaggattgtctttttctcttcctgaattacactctctttttttaaaggatccatctttgatttgggtttcgttttttcttttcttttttggttttaagattcgaacaacattcaatagaaagaacttgttgtcacccccatcgagttgttttaatgtgtattaggtatagttaaaatccctaattaaagtctatgagttctcctagagattcactaagtagtttgctagttgagataacttcgcaaaatcttgtctttggttctgaaaaaagtggctgcttccacatggattctatccaagagttgtaggaatctgctaggtcttgtcgaccaactttgctttgatgattcgatggttgtgtatcccaacaaataagaagctttgattttcttttgattttgctctggtgcaaaacagaacaagcgattttgctggaacaatcgtgtgacctttttcttgtcaaacaccacatcagcttagacgtgtgttgattgttatccgactcatgcaatgcttgagtccgttcatttgcttatgttaaacgtatggaattttaagtaatatctttgactttctagaatgtgttcaatgtgtttttgttgttgaagacatcaactctctgtcttcactatgcttcaaaattacatgcgttcttcaacgtaattggatttggtgaattacatacactgtgattatgaatctttgttttgcatttgagaagttgttgatgttgattatgaactcttttttttttaagaaccccagtttaaatactaccattggacattgcctaaaattttaattcttacctaagctcttaacttcaaaattttcaaattcagtaatagaaatattgttaagagcctttgctaatatactaccaatattgttaagagcctttacatggctttcaaacaagtagaaattaaaaacttattttttcttctccccatgatgattaaaaactctctacaactttacatatattttttcgcaaaatcgtttttgataaatgaataatatcaatttttttctttcttttaaggtctattttacaaacaactattttctttttatcatcaccattaatgtgttcatacacgtcattcaattatttcattaactgcttcatcattaatagtactcaatatacagctactcactaaaaaaaaaaacatttcaacaattaaaaaacaattttttaattagcgatcattttggaactaatttgtgtttgaaacacggcaaaaatagtttggataatttgaagaagcaattcaacatttatcattataatctcaaagttccacaacacccccgcccccaaattttcttagtttatctcacttcttatttggttattaaaaataaatgaatgaataatacatatccaatttatttgttgagaatatttatttagtcatttatttaagaatttctatgatgttatttttattattattaaaatttatttttgttactatgttgcaacataattcaattttaacataatttatattcataaaaaatattaaataataataaaaattgacattcacaacttctacagtttttagttactaatcttaactgtaaaatttttgtaagttgaaacctctatagccaaaattaaccactcaaaccaataagtcccaacatccacattggttaattttttatgggtgtctttagtataaattagtaaaactgaagacatctttcttttcagatgtttaaaatgtctctaaaaatacacaaaactaatattaaagacactctttattttattatcattatttttattagttttatatttaaaatcatccttcaaaaattaaccaatgtgaatgctataacgaattatatattaaactcgattgtgcttgtcccagagaacaacttatttgattatctattcttaaaaagtaatgacgtcagctttcaatatttcacgttttttcaaagagaaaacatattatatttaggtaataaacaaagcctgatcattgatcaatgcatgggatctttttttgtattataaaaggctactctgtgtcatttgcatctctccactttgagcaacaatggcatca

SEQ ID NO: 1761 - DNA, 3000 bp, Unknown
  misc_feature (1)..( 3000): cDNA_ID_1013144_gDNA_ID_1620445_Annot_ID_157283 3000 nt of promoter + ATG
catcaagtttattttgttggtatactagagtatttgcaaatcctgtagaggggctagagtggttcgaggacagaagtcagtgaaagtcactattgatccaggtaaatttctttttccatagttataggtaatagtaaaaaatattgtgcagttttcatcactttgatctcacatttatttcatctcataggggttgacaatagtgatacattaaaggtggcaagggtgggtggggctgatcctgaaggtgaccagcctggagatctttatgttactctcaaggtgactttactaaagtcaactttctaacggacagtcatagttaattatttacttgcgtctcaattatttggctgtattccttttcaggttcgtgaagatcctgtgttccgcagagaaggatcggatattcatgtggacgcggttctcagtgttacccaggtgaaataacatggttttgtcaatcctgtctttaaaagtttatagacacttttgccttcagcatctattttggacttctggtgcagtatccgtgagttcgtttaccgtttatgtattgttcatgataaccgagtatatttttcatcttttgtcaggccattcttggaggaaccattcaagttccaaccctcactggtgatgttgtcgtgaaggtatatcaatttttttcacatttaaaaaaatgctttaagattttaactctagttctatcaacaatgaaacatgcttgccagcaaactgaacaagctcgacaatgtgaaatagaattcgccatccagtgattcgtaaatgctttgattctaaactttagattgtctttttctttgatgaaaaagaagatcagattttgcttgctagctaactgatagttaattccagctttgggtttctgctcccacttgttgtcgtttaggacctggtcttggaacttctccagcattctaacttggaaactcttttgttgcaggtccgtcctggaacccaacctggtcacaaagtagtgctaagaaataaaggtgagctcttttgtttatgtcgataagttcagtcgtagaatacctgtaagatgaaagaaacttttgagtatgattgtcttggattgagctaattagtgtctcacactggttattaagagcaagacaacagattgagaaaccaattgtgaagtggagtcttgtttgtttacttttcaaatgacatgcttttgtttacgatacaaacaggaattagagcaagaaagtcgactaaatttggggatcagtatgtgcatttcaacgtcagcatccctgcgtaagtcctacgaagtcctgagtaaattgtgtctgacaatgatatataatagtcaagctccacagcacaatcttttcttattcttgttcatgttctttggcagaaatataacgcagagacagcgtgaactgcttgaggaatttagtaaagcagaacaaggtgaatacgagcagcgcacagcaactggatcttcccagtgaaaaatgcaaatgctgctataagcctaaaaagctattgttgtggctgtatcaatggatatataatcaatcagacaatgattgagattatattgcgtaggattagtggagagtattgtctgggttttacttttaactaattctacaatgctacaagataaaaagaaggaaaagcctgtgctgttattgccttctcaaagttatagaacttttgatacggttcattcttttttgttttttactatcgtcgatcctttttcacgcttctcaatttcagtgtctaatttgcaaatgcttctgtcaaacattttgtagcttacctcttttctaagtgttgtgattctagcgacaagaaagagaatgcataacaatagttgttcagttcggcactaggtacagtttttttgtttttgtttttgtttttggaatgtaatgttaaatgatattcaaaagataaataaagtttgtacaacgagtgcaatggtgggtgcaatggtgtttggtagctattgaagtttaaagaatttcaaaaaataaatggcggatttaacttcttgccccgaacaagagttcacttggtacagttttatattggctatatttggtttgttttagttgatgtcagtgatgggctgatacgtttccttatttattttgtttatacagtggcgaaccgatcagaatctggttatatagttattggtcaactacataattgcaatcgctagtgacaaggaaatgaacatagccacattatttggtgtaaacaacactttcaaggaaatttaacagttgtacacgtctggtcttcgtaataccgtagcagatccgctaccttaagctaaaaaaaggaacactagatgatgactatcatgcatgttgtttgttccttcctactttctttgcttatggcttatcagccaaaatattcatcttcactatttaattttctttttttaaataaaattattatgttggagtaaaaatgtcaggttagcttccaaggattttagtcccgccagtttagtttcagtaaattttgacccataaatatttgggatttatagtggtttttaagttaataaagtttggattttagattttaaattttgcataaaagacggtaaataaatagacaacaaaaataaaattgagtcatatcatattttatacgcagttgaatcgcatgtcttcgttcggagccgcactttagtaaattctctattgattcatatgttgactttacaaaaaaaaaaaaaaaatagaactatttcaaattttcaatattccttttttttttcaaagtttgaatattactttctaaaaagtaacaaatcttcctcaacaattttctcataaaagatacaatgatgaatgaacaatggagtggggtatacatagaacacacgaaggtacaaatccactcaatctcaaactcctataccactgcaacaacaacacacaactacagaactggtcactactgtcccttcctctcttttgtcggtaaatg

SEQ ID NO: 1762 - DNA, 3000 bp, Unknown
  misc_feature (1)..( 3000): cDNA_ID_3064113_gDNA_ID_1620445_Annot_ID_157293 3000 nt of promoter + ATG
tgctttacaaccgttacatcttcgatccccgcacaaccgtcatatcatctatatatcttctttttgtcgaaataaatgattgtagtttgatatcatctatctacctcaaatacttgagtttatcacacatgactgtcttaagtagtttgacaattctaagcataatactaaaaatggatccttttatctgtatacgatatcactaaaatctcattaaatttaaatattaattaggggttacaaaaataaaactaaaccgtaaatctgtatttgttatgcaaagttatgtgcaagttggtcaaagagtatcaatgattcgtccagttgcaattacccatcaaaaagtttggtagatcagatcgtctaagtgattaaattaatgatttaatcatgtgtgtatataggagtatttaaaaatggtctgaattgattactatctatattattcaaaagaaaagattctatctgtctactattccacgttcatggattgttgatatattcatctgctttttcactttgagcaacagtggaagcaataatgaactttgactttcaaaatttgttcatcttaatcctcctctgcctactttcagtcctctgttactctctcttcttcaagaaaccaaaggatggcttcaatttgcctccgagtcctccgtctctaccgatcattggccactattgttgattaaattattgatttaatcatgtgtgtatatagtatttaaaaatggcgtaaataaataatatatatacatcttaacaccatcaaattattttgtatattacaaaaaatgaattgaaattgcatatctataaatttaaatttatgaatgatgtaaatataattttatttgtgtaatataaatcaataaagtatttgaaatttaatttttaaatttatttataagttaaaaagttatgttattgtcatatataacattttttagtttaaattatttaagcttatttacaaaatttatttataatactgcagaatccaaaaacatattttatgtggggaatattttttttatatatacatattttatgaggttttaatcgggtaatttaatatttttctatttacaaataaacgttgagtaaatttagaaacaaatttgttaagttaacgataactcgaggattaaatttgtgcagacgatagttaggaaacaattgtattaattgcaaataattgaggaataaaatgattattttctcatccattatttaagtactccttttgttttacaatataagttgttttagctaaaaacacacaagttaagaatatttacttttaaaaagtttaaccaattataaaagagactgcattatagaaataatcataaaatattaaaattatataatttgtatagaaacttgaaaacaactaatattgtaaaataaaaaagttagtccaaaacaaattatattgtgaaactgagggagtattaatatataatcttttgattatttaaagacaaaataatgaaataaaattgacgtttaataaaaaagcctccagattctcatatggattcccaaacacgtggtagacatatccacgaatttgcaccattgatttgagtcattatttcttgagatatgttactttaatcggtcttaatcgagataagaactttttttggagtgggagaggggaaagttcgagataagatctggcgacagaaagataaattatataattgcgtagatttatataattaaataataaaaaatactggcattggaaaatgattatataaaatgttttgtttcctgatataaagaaatgttcgagttttagttctagaatattttagttattcaaaaaaagaagaaaacaaaaattaacgagaaaaacaagagattaataatactataatattttaatttgctatcttgacagtaatttactattatattttgctattgacagtaattttacttggtagcatgtttaagatcggtcggaaatttaaccgttcgtttgattaccaatcagataagccgttgaaatgtaggaataaaacgagttgctgaaataggtgatcaaaagtggggttatgaaccatcaaaagataagtgagcttagaaccatcttgtttataaaaacgggcagttgaaatctgtgtaattatttaatattttaattttcttaacaataattttatatattattacttttggaaaaagtttaaaaatgaaaataaatttaaaagtttatctttaaatttaatgtatttagtattacaattataataatgattttgctccaccacttgttactaatcataaatagtattaaattttaaccaccggtacagcgtgactatttatttattaaaagtagtgattttaaaatttaataattatgtattgtatataaaagtttgttaagtgtaccattttataaaacataaatatattatataatttttattaagtaatggtatatcatatgacaatttttgttttatataattttatataaattaggttgatttgatatgtctaatattaatactattaaaaataataaaatgaggatttagccagtcagtattagtatttagctgtcaatttatttttatattaatgttgatttaaacctgtccacatacccacatacgctcgttttaactcaatcgtcatttctgttccatatttctaaccgtcttttctttgaccttcatcttaaaaccgcagaaactttttaaatgatgttaccaatccaacttaacaatgtttttaccatttagtcgcttgttacctatcataactattatttaaccactcatttctcgtctgctatcttttaccatcttctctttaactgcctttaattttgcacaaccgctaaaaaacttttaaccaccttgtttgaacgatgttacgatcgaaccctatgtcagttaaacttgtaaataactctataaagagccttaagtttagtttgcttctccaatccaaagttcgagaagaaaaatg

SEQ ID NO: 1763 - DNA, 3000 bp, Unknown
  misc_feature (1)..( 3000): cDNA_ID_2143560_gDNA_ID_1620445_Annot_ID_157288 3000 nt of promoter + ATG
tgagttccatgacttcatcgagattcttactgcggaaaactggtcgtcagaagattatttggaacaagctaataatgtgaaaattgataaacgaaagatcaaaaataagaatgtgattgatagttttatatcactaacaatgagtttaaaatagatccaaatgttttcatgacaacaattagattgataaaagaaaagacaaacaaaaacagttagattgactaatgaattggtttgtctctggaaatgcagcatcgcgtaacatattatattaattattatttttggatcaactaacatgttatattaattaaaacaaaattatatatatatataccagaatttctattaactatttcacttattcacttgtttgtttatgttgaatatttttctcataacatgaatggctttttcaaatctatatatacatttttcagccattttgtgaaataaatcttggagttggaacttatttacaatggctgccactggcttttaattattgtttttttcagcaataaattgattaacaaactaaaaacattccaaatatattccaatcccatatatcacgcagatttttccaaaatttgaactagattttggcaactatttaaaacaaaaatgtttgacaacccaaaagacaattgcaatcccttaaaatgagcaaaacgcaactaaatacatttattatcaattcactaaatcttatttctccaaaatttgaactagatttcgacaactatttaaaacaaagttttgtttgacaaactaaaacacaattgcaatcccgtaaaatatttattttaattataaatttaaattagcggggtaccgcggttttttcttacagaacgggtttgacggaacgggtttggaaggacgttacttaataacaattgtaaactataaaataaaaatattttatagataaatataatttgcaaaattttatatatactaatttaaaaaaataaattgtcggttaaaatctagttttactattatattctaaacaaagcgatattcactgattttcaaaacttttccggatattcattttttctagagaaaagtggctcacgaatattggtgtttcgcaaaatatctataacacaatcctactatgtcgtgaaagattaaaagaagttttaacatacgtttatgtatgatatattatatgtacttttgtaaaatatatatatatatatatatatatatatatgtacttttgttttatagatttggaataagataatcaactctatttctcttttggtagttcttaaacatgatatgctaattcagattacaacttctattatatgtacgtacatatatacacatcgatgtatattaattttgttagtaaatagaatgttgaaagtcttataatattttaaaacagaaataatacatagaatgattatgaagagatagtggagaccttgaagtttttaaccgacaaaattttgcaaatcaaaatatcaaaaggaagaatgctttcctaaaaaagaatgattactggtcaaattagtcggcaaccggtaagtaagcaaacaatcgggaacgtgttactgttacagtgttaccataacgtgtaggttgggtaacacaaaggtaactgtgaattggcgggaacaaaaaaaaaacttttgtcgtaaaaaaaacaacaacaaaaaagttaactttgaattcttaggacatgttaagaaagccttcataacatatttgtttagttctcaaataatgtccgtaattataggaaaataaactttctggtttttatcaatcatcaaaatagaacacaacatagctctttaacacatagttgtaagaaagatagtgctccgaatcttcatagatttcataatctatacagtgttgactgtttgagaatatgaaaggatatgcatcaaaatagtgaaactctaaacaccaaaggtcaaaggaaaagacttgaaaccaaaaacaaagagttatatacactgcgagaagctgatcgagttaacttcgtcgctggcgatggaaccttttactcatgtcaccaaaaatcatgcaacaaggacgttttctaacgattgcatgtatattgttttgatttgaattgttaacgttaggcatttcaaacatatatattatcttctaattttctgatagcatacttattacgttgttatatagtataattattcaataaactatatcttcagtatattctaaacactgttttataatgtgaaatatgattatttttgttgtttataatatgattttctaagatatgtatttcttactatacaccattaattggatgatttatgtaattatcatgcaatttgtagcttgacgtttatagagcctaattttcaatcttcgaaaacttatatatacttctaattgctagcttctgcaaactcgattctgattttacgtaacatatgctaatttatgaacactgactgtcgagaatgattttatattttctttctatatacatatttaaacaaaaagttttttgaccgacaaaattttgcaaatgaaatatctaaatgaataatgctttcaatataaatatgatttatggtcaaaatagccggaaagtataaaacaatccatagggcactcatagttgtatgttaccatttacgagtaggtggccctgattctaaattaacaaacatatacttaagctctttataaaaaacgcgacataccaaccaaccaattataaacataagtgtttctcgtattaattttttcttatgccggcatacaaaccaagtaatggagttatatatcttggtttcactttctaacaatcaatatactatcaaataatgaatatacatattatcacttgtcagccttattagtagacccacacaaattccttttcatttccaacagctatatatactaacgtcctttaccttcattttcacatcaccaatccatctaagatactataactactctttccaaaagcaattttaa

SEQ ID NO: 1764 - DNA, 3000 bp, Unknown
  misc_feature (1)..( 3000): cDNA_ID_3064138_gDNA_ID_1620445_Annot_ID_157280 3000 nt of promoter + ATG
atgaaagaataaatgggtggtcagccaagtatttgtcaaggggttggaaaatagacaatgatcaaaacagttgcttttgcccttccaacctatagcatgtcttgctttaaactttctcaaaagttaacatgtaagttaacaagtgctatttcaaattattggtgaagtttcaatgggcgagatcgtggaatccttctaggtatcatactatcataggagaaactgtgtaaggataaggaaaaagagatttaggatctcattaccaagataaatttaatgatgtcagtattggcgtttaatacatttttccaaactctttagtagctaagtgctaaaacataaatattttaggaatattcatcatttacaagaaaaaaataaaaacacaactctccatcgtttgatggagagtattttttcgacaaagaaaaaactaatgaaatgggagcgagatggtctctaggtttgggggtcaatcttttgttatggctagatccatggactctagatattatccacttccagcaaacggaataggaaaatttctccatctaaatctgatagttaactacttaattaatctagtatctaaagaatggcacctacccattttacaaaagtttatagatccggtagatatacaaatcattaggggtctggctacatgttttttcttttctaaagcatctagaaatggaatccaaataatccagggaacggaaataaaggatatttcaatggataatgtctatatacacatttatctacaaaatttggtgaaatagggtttttaaaaataaaacccccaatgttacctctttttgtcgaaaatttaattaacaggattttgaatttatttaacagaaattttaacaaaaacaatatttcctaatttatttacaataattcagataaatttatggttttcaaattctctagttgaaatggagtcttctcctacacccttaaggccttaattaaaacctgtttttgcttttttcaatctcattatctgaaacttgaacaataaaacactcatctctttccgccggtgaagtgtttcgtggctaacaatataccaattcaacgtaagcttaacaaacaatatactatttaaacgtaatatttacaatattactttttcaaaaatacactttttgtatctaggaattctaaactttttagaatctaaaatctaaattcttttagaaaatgaattctaaaagtagaaaacattttttagtgtttttagaacatatagataaccgtaaattacattttcacacaaaaatgagaaaattaaagaaagtgtagaatacatggaaatttgttatccagttttctaaatttgttagaaagaaaaactagtctaaatatcgtggaacatgcacaaaagtttagaataaaaactctaatattagtagaacactaaaaaacattttctaacaaatttagacaaaaatttctctataaaagaatcatcttttgtcaactaaatcaccaattgctttttttacaaatcaattatattcttgtacatctacatgttttttttttctttttttaaaaaaaatcgtacatatatatagtattctgcaattacgcaaccttttagtataaaaataaacttttaaattaaatttcaaatattttaatgatttatatatacaaacaaaattgcatttatgtcattcataaatttagacataagtttacggttttactgtaaaatgtctataatatataaacgaatttatggatgttgaaatgcatatgttatatgtttgtatatattgtttaattttcaattggaaacacattggatttaataaataaaaaacattatatagaagttttcttatttaaaacttcgagatatttaagtttggtaagtttacttaataagaataaatagtatatgaattaaaagtgcttggcaagttgaatagtagaattaattaaatgaaaaataaaaaatgatgataataattgtgtgtttgacacataagtattagagtgtggggttccaacctaaaatcaattggcaataggtggagagactcatatcttatatataccacttaagatcctactcaacttccgatgtgggacattgtccctaatacgccccctcgagatgatggctcttctagccattgatctcgatatgtttgggcatggatcgacggggcaagtattgggccggaccgatgtggatcgggttgagtatgtgcggatcgggctctgataccatattagagtgtgagcttctaacctaaaatctctcttttttttttttcgaagtatactatacatgttaacgtaaataagtatattggcgtgtctgcactctgcaaaaaacatatattatcttctgtttttttttttttctttttgcaattacaaaaggtgtttacaaccttcttcatgaaactattttatattgaaactatatagtatcatgaaaaaggtcatcagacaattaatttataaaacattttgaaaatgaagaggtaacaactagcaagaggttccagtacttaccaagttttaaaactttaattatttgtcatttgaataatgatttgtcaaaagtggggtgctatgtgtcaaattcttgtgagacacaacttttcttcatagaatatattgtagaactaatatatattgagtaacactatcctgaagaaatatattaaccaagaaatgtataggttataagagaagtgtacttgatattcggaaaaaaaaaaaaccaaaaactaggtataatttgaggtaaatacaaaaactaggtctaagttgaggtgaaaaaaaacttaagaaggtctagtataaagttatttgtaagtatgactttctctatttaatccaaaggtaggttaagcagtcgttgaatgttttttgtttgttatattgagttgtttgtttgtaatgactttctctatttaatccataggtaggttaagattattcaaacttcaaaggcaaaaccaaatg

SEQ ID NO: 1765 - DNA, 3000 bp, Unknown
  misc_feature (1)..( 3000): cDNA_ID_2143537_gDNA_ID_1620445_Annot_ID_157282 3000 nt of promoter + ATG
attttctatgcaatatttattagttattattcataaatggtaaactttaataaaaataattaaatattattggtgaatattattggtttaaagttataagaaattgtaaattacaaaataatacattttaaatcaactttaatatgtttaccttaatatgtgtgtttttcctaaacaatcaaataaaaaggaacagaggaagtaagacttttatatctcgttgcttctaattcttaacattaaaaagatacgcccatcaactttcttattgaagtctagatagcttttaatatttttgaattgaaaagtaattgaaaacaatgaatataaaacattcacgcatcataatcatacgacaattagtcaaatttatgccatgatgaaactaccaaatccaaaaatttaaatttggaacccgtttggaaaaaaaacaatcatagaaaatatccaacggatcttagatttaggaattttgcacatcggataatacttgaacaaaacccgaaaatagtacagtaaaaaactcaaagctaagttaacttattaaccatttttatatggaaaaagttaaaaaaaatttacgtacttttaaatttggaacgtttaaatcctatgtaagaagataaaaaaatcgtaatgcttttgttaactttaaatttaaataagaaagtttggttaacaagccattttagtcatgacgttatgtaaactaacagaaaacctttacggtgttaaaatctcgttagtcttctttattatttctaaacaacatcatttatcgtatagagaaaacgacgtcattttgtcgatttaaaaaaacaaaaaccttaatccctaaatcgaaactcatttttccctaatcgatttctaatcctagaatctttatgtctctcttttgaaattccgattgaaatggttacaactcgtgggggggggggggaaggggggaaggttcgtcttcatcggtcacagagactaaatgaaacagcagccgtacaaaatgacgacacatgatgtgacagagcttgaactcatcaaaacatactgaaaggaagaagtctcgagctaatttcaacatagagatctttggggattgtgttttcgatttgggaaatttttagctttcagggattgttttttcgatgtggggattttgtctattttcatttatcaatacgacttcgtttagtgtacaataaaccgatgacgtttagccataacagaaacgactaacgggattttaacaccgtaaagtttttctgttaacctacttaacgacatgtctaaattggcttgtcaaccaacattgtcatttaaatttaaagttaacaaaaactttacgatttttttgttatcctcgcagttcatgatttaatcatcccaaatttgaaagttagtgatttttttgacattttccccatttttatatagccttaagtaattaagatattttcgagtatttttggatagctttttcttatcaagtttttcggttaattcaaatattttggagtactttcgaatacttatgagtagtttggatttctttttgaccaaattttccggatgacagatatttgaatgctcgcttgggttagcgggaagtctaagtaaagaaggaggcaagcaaatgaaattcggatatgttgtagagtatttttgatatttcctcatagttcttttaaccttaaacatataaaaaaaaacacaaaaaaatatctgaaagtttgaaccctatctgaaacaaacgtaaatattatagatacccaaacggggctatgagcctcacccaaaaacccgaatcgagtccaaaccccgaaccctagtgaaaagcatttgcagtaaaagattataaacatgaagtaataaattagttggaacttataatattgatttatatcaccagttccccacacgcaacgtggtttctttcatcaatctatatagtattataagtagaatgtgtactctctttccaaataaactaggaggattcaaaatagatgtggaggctaagacttggaccgaaggccggtgaggatactcgcttgttcaccaccaacaactaattaagccaggaggcagatttgggtgttgaataccaactcaggatctccacaagaaattgccgagatagagaacgctcgtcagaatttttcaaacaacatgtcacgtttcaaaacgatgcagatatatatgtaccttaaaaaatcctagatatacgcaacttgcaaacaaagcaataatttgttatcaaagctagttagtttttttttttttgtaattccatatgccttgtttttgagattaacaagaaaacgacttcttttttttcttaaattctactttccatttctctcaactctcggaatcacctatgctgattctactcgcacattgcatatagttcttaatcttaaactaggtacggcgaacaactttcctatagatgtctacttggcttataatatttttgtattgaaaaactaattagaaagatatgaatatcgttaagcaaatataaaacaattactaatacgtcaagaagtcaaagtgatgacaatgcgaaacgtagttgcttacgaaataaacgttaaggaataaaattatttgagaacttataatttatattcacacccgtttctcacatgcatcgtgtttattaacaacaatctatataatattcttttctacgtatttttgtggttgatgtttaaaatttttacaaaacaatttttttttttttaatttttgtttttctcaaaactaacacattgtttataatctattataactcaaacaaaccaataataaaatcatttacataatagaaatcatcaaaaataaaaataaaaattaattggtttgtattaaaatttgaaaacataatttaattgcaagaaaaaaaaattcctaaaacatcgactataaaaaatacgaagcgagtataaagtataatgtgtcctccttgtccaagtaaacttagagcaaccttacaaa

SEQ ID NO: 1766 - DNA, 3000 bp, Unknown
  misc_feature (1)..( 3000): cDNA_ID_2143584_gDNA_ID_1620446_Annot_ID_157299 3000 nt of promoter + ATG
atgtctagtctaaatctggtccaatattataacggttataaagtgaaataattggaaataattagcatgtcccatactcccactagaatgtcacacaacacgattgttgagatgattaatttgctatatgcctgatcttgtagctcatctgttttaagggcttagatgtcaattcttgtttggacatgtctagtaactatgatttttaaaataaatttatataagtctataattaaattatataatttcatttaggaacataataatatattacaattaaaggaatactttagaaataaaaaaaattggagcaacaatactatttatttctctattttttgaagcaaaatataaaacaccatagtaaatggttttatatcaaatatagagtttagagcaaactttgaagcattatcggaaatgtttttagtgctaaacaatctaaacggcgacactaggtgatccaaacatccgattatcacctaataatctgtgaaagtaaagatgctcagaggctatatatgaagaagataagtttcatttctcttatttgttttccttaaggtttgaggttacatcatgttttccttttacaggagttacattgtcagtgacactagggtttattctgacacatgtcaggtctttattgattctaaacagtcaaaacggttttgtaaaaccactccatctttgccagcacagctcgtggttttggtcacttgatccaatcctgatttacttttggttttgtcttcttttgtaggtggagatgatcgttggaactgtgaactgttttgggtctgcgcttggatcttctgcttgttgggcttgatctgtgttggattctcaatttggcccaatcgctaaaccttcttgaggatgtcgtttggtaagcttgtctatacagcttcctcttcttcatgtccgatcacagctgtggtttgattcttctcttctctaatccgagccgttatctcaatgtaagctgccttctcactaataatctgaacaacactaaatattatttcagcttatgaaaaaagacataaagtaacatcaatggaaataattgacatgtcccacacagacacacatttgacagtcccatcaatatatatgctgacgacaaaaagtaaaatgacccacctgaattttcaaagtaattcttcaaataattgacatgtctaattaagaccaaattagttgaaaacgtttgcaatggactgatcgtaatagttagtcacctgtgaacgagtttgttatttatccaccaaacaaaaacaaattgacggatttggtgggtttgggcaaaggtatatctgatgaattttttctacatctcattccaaaaagtcgacctaacccgaaaagtcgacataatagaacaagatagtgtcggtatatgaaaaaaagatgaaaacaatagttaaattcacaaggacaggcacgaaatgaatatgttgaatttttgtgatatttgtgatttgtttttactctagaagtgttttcttactaatatatgttctaaatttaactagatatccagtgtcaatccatacattttcgtcaaaataagatttttttatttattaaaagagtacatacatttggtcgttcatccacggtttacagaatcaaagtgaaactcataagtattacaccatacatttctagattatgagctagtatattacattctatcttaatgcatggataaagtgaatatttgaaaattttcaagcccaatacttgatatggtgaagaagattcgtaccagaaatattttctgtagtatcgttgaaaacaaattgatgaacaacctcggatccacgtttgatgcattgctgccaaaacataaaattttaaatattcatttaaaatcaactaaatttctttcttaactttcaaaatttttaaacaatattacacaatttaagttacacaatatatgaatctatatataaaatacatatatatatatatatatcctcattttaaattttgactttttaatattttactgcgtttttcgaacaaatgttgtttttgaagatgacaattacgttgtcgggaattagcaaattgcatctaaatctaaatttaaatttaaaataaaaacagcttaaaattacggatatatataacacgaatattttgctacctctacttaacgtatacttccagttttctacaaacacaaactgcaacgtttttgaggctacgagaagaaaaaaatgtccgtcacgttgcgtcacttgagacaatggctgtcgtcacattcacgccatagaaaattttggccatcttacccgtggtcgttgacctggaaagatatcaatagtctatttcatatacattcacacctatgtcaaataaaatttgactccaaaaacacttgaatataatagtgaattagttacaaataagcaaattttagttaggtaaagaacaaatagtaaatttgacaaatgagaatggagaagattaaaggtaaaaatatattggaacgactctaaataaagttttgtatttctctttttctttcttctctattactatatatttctcatagtcttcattaccctaacaccacactagtcacacacttaaatgttcttccgcctttgacgccttaatctcatctccacaacccttgcagtcaagttggtaagtctcttaaaaatgactttcttttgtttaaactttaaatggcactgagtttttgtggtatcactaaaatcaaacgattcatgatgaaaaacttgacttggttcaatatttattataatcaatgactactttatgtaaaagagtttaggcctttgagcaatgattttcaaagagaagaaaataaagttggacatttgtggaaactttaagatagaggagaaggtttagattttttccttattaatacactgaattttgcagatgctgttgggatcaaagagtagcaaacaatacgagagcagaagaacttacttatagaaaaaaatg

SEQ ID NO: 1767 - DNA, 3000 bp, Unknown
  misc_feature (1)..( 3000): cDNA_ID_2143659_gDNA_ID_1620446_Annot_ID_157319 3000 nt of promoter + ATG
ataacgtggctgagaaggcaagtaatctcagccctaagagtattttgcagctcttaccgctcgtagcagccaatgtaagctttgaaaccgccattgtttgaagatgaaaatggtcaaattgtttttgttttgcaatgtgtagagtgtttgtgtctttatatatattgagtatttgagtgttagtgattggtcttttgtctgaccatctaacttttggagggttaattttaggttttggtggttgtgaagattcagtgaaaacgttagatttgaaccttttttttttttttttaaaatgttttgtggcaagttaacttgctcttgggacagtctcatctacccaaaacttaaaccagtttgactttttgacattttgtggaaatataaactcaattagctgattgcgtttactgtatatctttttaatgaacctactaccactttctatattttaagaaaaaacatgttacttaaatgctaaaaaaagcaatattattttttgaaaaaacttcatttaaataaaatatgatgtgaattttcaatttttttttttcaaataaatgcaaacttaaaggctaaaattgcagttgaaaccatgtgaatcttatgtgattttaatgaactagttggaactttttgcttgccaactcggataagttcttttttgtcttgttttattattatttttaaaaattttaatcccaaaaagtgtaaatcttctgtaaatcttctgtaaacacacaaacacaaaaccggaaattgaaagtgaaagcagtctatatagaagaaaagtttctgcattgagttgatttgtaaagtttagagatttaaatgaaaaccagagttctaaactgagaccggttaaagtcaacacagatgaataacatgttggatatgataaaacattatatcaaatgtgaaaagtgctgtgtaagctcaagagtctaaattcaataaaagagataaaatccatatgtttataaacacatttttttttttttttgtgcgaaatgtttataaacacattaaaacaaagatttttaagaaataccaatatttgtggttctgaaaaaggaaccctgaggttttgagacttaattatgaacagatgctttgtaggtgttacgtaaacatgagaagaatacaaacacaacaaaataggaagaaatcaatcatttttcacacatatatccgataagttctttcgattagtttttagtttttatcggttgttactaccacgacattgctcaccttaagtgttctatatcactccccacagttcttattcgaatgaataatactttagtacaagatatgctaagcaatacactcaatacataccagtttctcactctcgtccacggacaagggattctctacaacgactgttttggtttgagaaaataatgaatagagtctaataatgaatagagtctaagtagtcaatattttcttactaatgttactcgtctcatgaaggtggttgtggactctcttttaattttagtaactgctcattcgatcaaaacataagaaactgcaagtttattgaatacttaataaaaatttgaaagacgtttgtataaagacaaatactattagtaccaccataactcatttcttcccctataaataacaactgatctttgtattgttaatcactcaacaacaaacacaagaaagaatcataaattggaatacttcaaacatcttttttcttttatcatggcaatcaaaaacgtgatttttcttctatcgattgtatgcgttgcaatgtctgcaaatgctcaattacctcaatttccggcaccgtttccttttccatttccattcctacccattcccggtgtactggtataacaaaatgtttatcatcctttatgaatattgcagggtgtatcgcagagttttcacaatctatactcactggaaagtttggcaacataggccctgtttgttgcaaagcaattttggaagctgaaaccaactgtattccgcaacttccattcaatccattttttcctcctctgctaaaggaacaatgttcaaaaaccgttggcgcaatttctcatacgagaaagtagaattcaaaaaccaataatgtaatcgttgctcttttttcaaaattagaaaaataaggttaggtttacgatttgtattcaaaattttcaaacatctaataatagcattataaaaaaataggcacatttttgtgaacagtcatgaaatagttcaaagtgctagccatctacatattgaaaaaagaagcaattcttatgcaaattctaacaatattgctattttgatactcactaagtggatattcacattaaaaatagttgagcatcgttctgtaatattcgtggtatgattacaagatctatctatgtaattaaactgaaaacggagcagatatccgcttttaaaaaattgtagtgtgtgattattttttatttttttacgaataataatttttaatatttgttttgcatcatagaattacatatatccagacttttaaaatcaaaatgaaacagataacaaattgaagcgaatttaacagataatttgtctcatccctaatgtaatctacatttccatcttctatttacacaatgagattttagatgataaaaaaaataaaactaaccagagtttttgtaggttcatacaatatacaaaaacaaaaacaaatctgaaaacaattaaaattaagaaataggtttttttttttgttggacacaaaaattaagaaatggataaaaagaaggaatattaggaagatgtggacttctgtaacggctagttccaaagtaccgttctttttttggttttaattattgtattaaggcacgctctgacacattcacactcacacatagcgagaagaaaagaaaaaaaaaaactcaaaacttttgcttctactcaattctctgatttagggttttttcttgactttacactatctcgatttgagaagtgagaagagaaatcgcc

SEQ ID NO: 1768 - DNA, 3000 bp, Unknown
  misc_feature (1)..( 3000): cDNA_ID_2105664_gDNA_ID_1620446_Annot_ID_157305 3000 nt of promoter + ATG
taactaaaaacaagtttcttcaagcgcaagcaagtgaaactaaataaaaagacatcacagaaacaaagattaggtgtgtaattaatcctctcctcgttaaaaccactgtttcttcaagaaacatttatgctggaattaggtcaagcaacgaatctcgaaccctaatggaacattaacggaatttgatagttgaacaaaaacagagattagatgttttgacctgtatgaatcttcttcctctatttggtcttagatctatctatggtaataatcttaatcgatttaattttaattttaatctaaatcattcattatcttaagtaggtcgacataatgtactcggaacactgtaattcaccatctcttatttttatttttgtgtgtctagtgataattttgaaattatttttttataataaaaaatcaaaaacattattaaaaatagttctaagaaaaacattttgatgatagaaagcccaattgtcttttaacccaaaggccaatttgtctttctttaggcggggctggtatccttaaagttctagtttcctcttctacctttataatctctcattcaacgaacgtcggaaaatctctgccaatcactacaacttatgttaataagacttgggctcacttgcaaaaaaaaaaaaaaaaaatcagagataaccttcttaattatatttttttcatcgaaaatagaatatattgagtcttgaacaagtcaaattaaccagcagcccatgtgaacaatcgaacgatgaagcattacctcaaagccaacgcagcctcccgcttaagttacattagatagatgatagatcaggcagcctttcatatgtaaagataagtggtggagaaaccagccatcaagtattgattagtcaacatcatgatatcttctattattagctatttacgatttaatatctactatagattacagtctgtgtttactacgtggggttgacatgatgacatgtaaaagactaactcttcttcatcagttcactataaatagaggttgatcttatgcttatttcttcacatcccacattcaaacatacaaaagacatacattgcaaagcaaaagtataatagtcatggctaagtctgctaccatcatcaccttccttttcgctgctcttgttctctttgctgcttttggtgagtaaagatcttatataattgtcatatatatgcatggaaaaaaaactttgatttttctttctcttttagattgattgataattaacaaggggtgtatatatatgcagaagcaccaacaatggtggaagcacagaagttgtgcgagaagccaagtgggacatggtcaggcgtttgcggaaacagtaatgcatgcaagaatcagtgcattaaccttgagggagcaaaacatggatcttgcaactatgtcttcccagctcacaaatgtatctgttacgtcccatgttaatctaccaaaaatctttggtgcttgatcgtgtgtgtattttactttaaataagtcggtgtcactctatgagtgactttatgacatgcatatatgtttatgtttttatgtttggtttctccttgttataataatactaaaaaattatgtacgacgttggactgtttcatcatatcccataaaaatacatgattggggtgaaaatcttgaacatattaaaaaaatattaaatcaaaatgataaagatagggatttataaatgtaaaacgggcgtgtcgagaattttatggacattgggacaagctttatatgcagcatgcatcgccgcatcgatatcccgaggtgcatcgtttctactttcatgtccaaatttggggttaactcacaatatatatcatgttgcctatgtaaatttataatcataaatctaaacccaaattttaatcctcattccaaagcaaaagttctaagccctacaaaaatatgtatttcccaagtttaaaaagaattaatctatacttttacaaatttaaattctgatctcttataatgttcggtttttccttttttatttattaagttagttaaaatttgcagttattttgttgaatgtcgttgtttacgaatttacgaataatacctttatagctaatctacaaaattttgatgactgacaacaccgttaatgtttttttttaaattaccctgagcctctcacttgcggtcagaccatgcatgtcgatagtccattacgtttaaggccacaatcaactatagtttgtttatcaatagccaactaagctaacttttaggttcctgccctctccgttcctccggtaccaatcgtttctttgtcccttcgatagtttgaaaacctaccgacggtgagagcaaaatattgatgaatcatccaattttcagtaataggtgtgtcccagggatatataaatggcgaaactacgcgagaacggttccttgttctgcaaacttggcggaacaatgctgctcttgagatcaaccaaaccatatgtttagtccacaacgatctatatgtctaggggtgatcctctaatcgaaaaatgttgtatttgttcgacgatgacgaaggtcagactatgaactgcacagtctgcacttgtcctaaccgcgagaatctctgacatcaatatacttgtgtaactatggcttggttaagatattattttcttgagtcttaatccattcagattaaccagccgcccatgtgaacgatgtagcattagctaaaagccgaagcagccgcttaggttactttagatatcgacagagaaatatatgtggtggagaaaccagccatcaacaaacaaaaagcaagatcttatcttttgatattggctacgggaagatgatgtctgtttaatgtgtggggttaccacgttattgtacgatgcacaagtagaagattaacccactaccatttcattataaatagacgttgatctttggcttatttcttcacacaacacatacatctatacattgaaaacaaaatagtaataatcatcatg

SEQ ID NO: 1769 - DNA, 3000 bp, Unknown
  misc_feature (1)..( 3000): cDNA_ID_2143607_gDNA_ID_1620446_Annot_ID_157306 3000 nt of promoter + ATG
actcttgtcaaaacttgaaagttttcttaatttttaaaattttagggttttctttctcgacgtcaaaactctgtagggtcgaaaaactttttccctataaaatcactcaatctttacattctcaatactatccacctatcttagaaatggagttctcaagctttttgtttactattttactcttttcactgaatatttctcctcttgtttcagctcatggctccaaccatgaagactttcttaagtgtctttcttaccgaatgaacgacaacaccgtcgaacccaaagtcatacacacttccaaagactcttcctttttttccatattggattcttcgatacaaaatccaagattctcggtttccgaaacacctaaaccggtctcaatcatcactcccgttaaagccagtgacgttcaaactgtgatcagatgcgcacagctgcatggaattcatgtaaggactcggagcgccggtcactgctacgaaggtctctcttacattgcgtacaacaaaccattcgctgtcatcgatttaaggaatcttcggtctatatcattagacgttgataaccggacaggttgggtccaaaccggagcaacggctggggaattgtattatgagattgggaaaaccaccaaatctcttgctttcccggccggtattcacccaaccgttggtgtaggcggacaatttagcggtggtggttatggcacattgctaaggaaatacggtttagctgcggataacataatcgatgcacttgtggttgacgcgagtgggaggattcttgaccgacaagcaatgggcgaggattacttttgggctattcgtggagggggcggatcaagcttcggtgttatactatcgtggaaggttaaattagtcgatgttccatccacaattaccgtgtttaaagtccagaaaacatcgaagaaagaggccgttaggatcatcaagaaatggcaatatgctgcagataaggttcctgatgatcttttcattaggacaacattggagagatcaaacaagaacgcagtacacgctttgttcactggactatatattggtccggtgaacaatctattggcgttgatggaagaaaagtttccggaactaggtcttgagaaagaaggttgtgaagagatgagttggattgagtctgtactctggtttgctgatttccctaaaggagaatctcttggtgttctcacgaatcgtgagcgtacatctctatctttcaaaggcaaagatgattttgtccaagaaccgatacccgaggctgcaattcaagagatatggaggcgattagaagcccccgaggctcggcttggaaagatcatattaactccatttggtgggaaaatgagtgaaatggcagagtacgaaacaccattcccacatcgaggagggaatctctatgagattcagtatgtggcttactggagagaagaggaagacaagaacaagacggagacagataaatatctgaaatgggtcgatagcgtttacgaatttatgactccatatgtttcgaaatctccaagaggagcttatgtcaatttcaaggatatggatttgggtatgtatcttggaaagaagaagacaaagtacgaggaaggaaagagttggggagtgaagtatttcaagaacaatttcgagagattggtgagagtgaagactagggttgatccaacagatttcttctgcgatgaacagagcattcctctggtgaacaaagttacctgaagatatcatttgaagttttttattagtcccttttctctgtgaaatcatctgtgcgtgttgaatattatgcgtcaagtgtgtaacttatgtgtgtgattgtgaattgtgatatgtgtgttgaataaacttttcatgtttgaagtgtgtaactaaaaacaagtttcttcaagcgcaagcaagtgaaactaaataaaaagacatcacagaaacaaagattaggtgtgtaattaatcctctcctcgttaaaaccactgtttcttcaagaaacatttatgctggaattaggtcaagcaacgaatctcgaaccctaatggaacattaacggaatttgatagttgaacaaaaacagagattagatgttttgacctgtatgaatcttcttcctctatttggtcttagatctatctatggtaataatcttaatcgatttaattttaattttaatctaaatcattcattatcttaagtaggtcgacataatgtactcggaacactgtaattcaccatctcttatttttatttttgtgtgtctagtgataattttgaaattatttttttataataaaaaatcaaaaacattattaaaaatagttctaagaaaaacattttgatgatagaaagcccaattgtcttttaacccaaaggccaatttgtctttctttaggcggggctggtatccttaaagttctagtttcctcttctacctttataatctctcattcaacgaacgtcggaaaatctctgccaatcactacaacttatgttaataagacttgggctcacttgcaaaaaaaaaaaaaaaaaatcagagataaccttcttaattatatttttttcatcgaaaatagaatatattgagtcttgaacaagtcaaattaaccagcagcccatgtgaacaatcgaacgatgaagcattacctcaaagccaacgcagcctcccgcttaagttacattagatagatgatagatcaggcagcctttcatatgtaaagataagtggtggagaaaccagccatcaagtattgattagtcaacatcatgatatcttctattattagctatttacgatttaatatctactatagattacagtctgtgtttactacgtggggttgacatgatgacatgtaaaagactaactcttcttcatcagttcactataaatagaggttgatcttatgcttatttcttcacatcccacattcaaacatacaaaagacatacattgcaaagcaaaagtataatagtcatg

SEQ ID NO: 1770 - DNA, 3000 bp, Unknown
  misc_feature (1)..( 3000): cDNA_ID_3064164_gDNA_ID_1620446_Annot_ID_157311 3000 nt of promoter + ATG
atgttattgtcaaatttcaaagtctactcccattttggttattatggcgaatcttgaaatgcagaaatgatctagtatttaatcgcaaaatgatcgaagtaacggaagctgtagaacaagccgttattgacacaagagaatggattgaaaacattgctacttcggaacaaggtcataacgacattcaccatcaccgatctcctagagtgaaatgaaaaacaccacaaagaggctgggtaaaatgtaactatgattcatctcaccataaaggaaccagtgggtctggattagggtggataatccgcaactcacatgggactttcatggaatgcggtatgagtaaattccaaggtagggcaccggttgaagaatcggaatgtacggctctgatatgggcactccaatcatcatggaacctaggttacataaagatcgagtttgatggggacaacctctctatcatccggctaatcaacggcaaagctgtaaatcctcgacttcgacattacctttgatgaaatcagtcattggcattgcatgttcacggaggtgaagttcactttccatcatagagagcagaacaaatgtgcggatatactagcaagacaagctctcactggtccaattcactacacataatagttgttgattcttctaattcgaatacatttttatccaaacaaaattattaatcggaaaactaatcttcttctttttcgttttaataactttagatttatattgtaaatacactagtgtcgcactttaagtgttcactaagatgaacaaacgattacatatataactaaactccaactttgtagttgtatatattttttgtatatatgttaaagtgtcaaacgaaaaaaactccaacttagtagttgcgtatatatgtgaaaattgataaaataattgcatgcaaaatgtaggatcaaataatttgatttgactacgatggccaaacacgttagatagttgggcagtcgctacaactaagcagccacacttattttacttccatttatcatcaataatttgtattatagttatttttgtttaatatccaagagagattcataactctttgtttgactttgattaaactatagggtagttagccactccacattggcttctaaactatatttgtcagcctttaaaattaggttaggtggccaaacgaaaactttttaattatttttcttttattgtgagacatactaagttagaagaagaaaaaaatcagttacttttcaaaaaggtaaatattggcttaaaaagccaaactatctacgtttatattttttactcaggatttgattgtatgttgataaatattttttttctttttctttgttaaacaatttcttgttggtacatttaatattttccaaaattattacgtctacgaagaaacctttttttttttgtaaaataaatctatacgtacggaagctttagaacgctagtatatatactttatagtaacgtaaataatttgttcaagtgagatatatttttacaccaaacaaccactatatttacaaaacattatattatctttcttttattgcttgttaccttttataattatttttagttcaaaataagtagattcataaattatttgcacatttataaaattaaatcctaatagtgtccatttttagagtcattttaactatttccaaatttatggatatgttctatatagtctccattgtataagccataatgaaggttcttaaaatttatgcatatataaggagataaatataacaaccttataaaaaggagattcttaataagagataaatactaaaaattatttccatgatctaaaaaaataactatattctgaataccaaaaatatattaaagaagaaaaaaaaaacgcttatagagagaaagagagtgcgcgaccaggtcgtagtcgtgctctcgttttgcaattcacgtttcctctctgagtttcttcgtcttcttcctctcgtctctctttctctgattctctcgtacgttattcctcttcacgagtttctctcatacttcgttattaacatcgcccgttttataccccaaaccttcttttaacgccttcctctgtttctctcgtcttctcacaattctcaggtgcacaaatctctctctctctctttctccatgtgttgtttctaatctgatcatgatcatcatattcatattcatcatcatcatcaccaatcttctacataggtttttaactctgtttttactgattaggaccattttgtgatttttcctatttttataaaattgaatcgaaatcggaatcggaatttggatcaaaatgttttcttgaaactgatcggcgttttagtcaattttgatgactattgttacattttcaagactctttctgccactttttgttttactctgttctgttctttttcctaatgcaactttttttgactaaagtattttgttataatcttttcattatttttatataatatatttataatttatcagttgaatgtaaaagtaactccctatattctcacttttacataaatggtttcataaaattcaactttttctaactgattaaggtcccacttgcaacatatattattatctctctgttttctccatgcatataaaaatgtatgcagaatttggtagctttgaccttttatatttctgttagcaataattttatttttttggtaaattcttcctttgttttgcagcaatctccagcaacatgatcttcattgttgctagatactgatttttttttgtgggattttctatgttgctttggtctcaagtctatgtttcaattctaagaccagaacaaatttgaggtttttttcaatgctaaattcgtctggagtaagaactcaacgaagaagcccaagacctttgtctctaggaggtagaaagattattactccaacaaaatttgcttatgatcatcataatcctgataaagttttggattttgtagaa

SEQ ID NO: 1771 - DNA, 3000 bp, Unknown
  misc_feature (1)..( 3000): cDNA_ID_2143645_gDNA_ID_1620446_Annot_ID_157316 3000 nt of promoter + ATG
cttttaccgaggcttcgaatcggagttgtaaatataacatcaagaatgttgtgaccatcactggtaactataggaaagtctcctccaagagggccttcattttcaacagaagctcttctccacaccttttccaccaagtaaaatacaatgactcaaacaaggcttgacacaatcgatagaaccaaaagcccgagaaagcatttatgaaagaagcagattcacacctctgcatcgcctagatacaagtcatctatctcctcagctatggccaaccaattaagctgcaatcaaagttcaaggaataaaagttttgaatcatatcaccaagggattaaaacgaagttcatcagtagaaatttacttacagattgaactaaaacagggatagaaccttcaagaccggctttgtattgttcttcctttatcatgaagactgcctcatcagctacttttacaatagactgtattgtaaaatctctcttttgtcagcccaaagctaagcaatgagtattcaaagactgcaaaaagtacacgaaactgcatacaccttttgtttcagaatatagtcatcttcctgtgaacttctccgccgtccaataactgcaataagcgtattctcttctacagcatcagcatcatgaaatgcaaaatcaatctacaaaagtgtcacactgcaaacattacccctagatgcagaaatagatcaaaccgctttagaaaacacagagaagcagctacctgaacaccatcccggtaatattccaaggggattccatactttgctgcttcactcgcacttcgagcagacctgaaaaagggtcaggacaaatcatcatgaagcctatcaaaactcaactcgtaacataaaagattgaatatagagagatcaacaactgaacaaacaaaaagattgatactttatttggagtcatagaagataaccagcagcagaatcagaatcaaaagactcacattggtacaccaacaacaaaatcattatcgaagaactaatgaatagggaaattcaacaactgaacaaacaaaagattgattttttattggattcatagtagataaacatcagagagagaagcaaaagacttacattggtacaccaacaacattatgtaaagaaccagaaccaagttgttgacccaaataacgtatagcaaaatctgaagcttctccagatcctaaaccaataatcatcccactctttacataattatccacctgaaaacattaccagacaaaagttttgtaatcaagtatcaatctttcttcaattttatgaattttcaacacaatttcaaacaatacccatttgaaattgagtttcaaggattcaattttcccgatttaacccttacagtgtgatgagctgctctgagaagaggagaaacctccggagaaagactggcgcaaactggaaaacgtttgaaattacgacggcgcgtgaaaaccacggacgacgagagtgaaaatggagttgatgctgtcgcagtaaccattttttttgtgtgggaagaacgatttgagtcactgagtcgtgactcggtggtttttaccgctcttatctcccgatcagttttgtggtgcatgtggagtacgaactacgacgatattacacgaccattttctttttggagaattacgaaaataggctaaattatatatattttgttccaaaaaaaatgataaaatatatattaaatatttattttcatataattttataattttaaagcaacacataaattactaagttccaaatattatttttgaatttttaaacctaaattttaaattctaactatatccttaaattttattttatggtctttgagctaatccgtttttttttaatctaatgttaaattatattagaaaaaaaacatcggtttttacaacaagtacgacaaaatttgaatttgagaaaaaactgaaatttgaaaaattaaataaatttttaacttctagaggcaaaccacatttagagtcctctatgatatctcctatctcctaaagtctgataaaggaaagagtgtttcaggtttgcttatcaatccaacgaattagtcgagctgtctgtcgtattagaattctccccatgtcttctaccattttgttctcgccaaatggtgtagactgacactacatatcacatttgtgacgtattaaaactatatatcacatttatgattacgataaacagtacctatcaattttacgatacagttctctgcaacattaaaatccacaatggacggttatgcatatacgatatattttgatgaaaatgtttttctcaaacggttctacaaatacgacattctctagatgaacatgttctccatgaaaacgaataactctacgtgccacattctacaacctttcattaagtatacatccactaattggcaagaatctacactttttgggaatcaaaaccctatcttgtatcattttggatatcttattagtattgacgatccaacgaggaaaaaaataaataattgaaagaaaacaaaaaggagagtcatttaagtttgatcgcacttatgagtgttccttgcttcctttctcctctactttaagcacatgtgggaaccaaattcttcgtaaccactcaatttggctcacaatttttcaatatccaataaaaaacagtttcatatattttctcgtgagattattcagttcttcctaatatctatctatctctatattacatatatacaatattatataaatacgcactcttctttcaccgacctccttacaccaaaaaggtgtcaattccacttgttcaccatgaatatgatttaatgggttcttcttcttttgcagctttctttcttttccttaaattatcattgttttaggtggggttttaagtgctttcatgactcattcattctctgtataaaacctagtggaaagtgttaaatcaaaaacccttttttcccactttcttaatttagaagggagacgaaaaaa

SEQ ID NO: 1772 - DNA, 3000 bp, Unknown
  misc_feature (1)..( 3000): cDNA_ID_2143641_gDNA_ID_1620446_Annot_ID_157315 3000 nt of promoter + ATG
gcttggactacgaagattccggcttttacagcggaaagtaatgccatgtcgataggattaaagaaagtggcaacaccgggaggtttccgattcggtgtaattgataggcttaatatatctactccatcttgagctgcctgaaaaaaaatcacaaccattatattaaagtcttcatatttgaaagaaaagctaaaatgtttattcacatttagtttcttgatttgtaaacctgatctatagctgctacaacatctgcagcaaaacctccaaaactcttatacaatgccttgtaaacagaaatactgaaaacaaagttcaaaaacataaaagtttaagttagttttgtatagatttcgacattgatctaagtcttattattttacttacaatgcacgaggagcgattccactagcgtatccaaagttatggttagaaactatcactggaactccgtggttacccgctgcaaccgaagctgtgtgtctgcatatatatccaaagcaacaatctataagcttcaaactctgtttttatatgatacattcaacagttacacttacgttccatgtccatctccatcgaaaggagaagcgtaatcttcagatgagttaaagattcctctggttacagcggattgcgcgaaatgccgtgctccaataagcttcttattgcaagatcctgatggaaaatccggtgtaacttcacaaacacctgagaaatgcttagggattggatatgaacgcttagagtcattgtcattgaaactaggatgattcggatcgatcccagtatcgataaaaccgattataactccttctccagcaatctcaaatccaccttctttgacccatgctccttgtggtaaacccataaactgtggagtataagttgttgctgtcctaacagagtaatccaacactatgtttgctacttcttttctcattgaaagcttctcagccttaaaaaaagaaaaaccataacacaaaaaaatcaagatcaagaactcaagattatttctacaattatcaataactcaagatttttacctgttgtgagttaataaacagagcaaatccattgataagataatggtaactataaagctttatatacttctctccttttagagtctttctcaagaaagagtcatgagattgaacaacagatggtatctttgacttcccatgacgtttccttgaattgttcctataataaaaacgcagaatacaaaaagggtttaactaaagcttcacagagaatctaatgacaacaaaaagaatagaattttatcagtaccttggtcgcaattttggtgtaaactttgactttttgtgtttaagctcttgttcttcaaagagatggacaataggaggttgtttaagtgtgacaatgtacacagcagaatcatcatcatcgtcttgttgttgtcccaaagtgttattagacaaaaacacaaaagagatcataagtaataaaaacccaaacctcaccaacattactctaaccatttttttcgtctcccttctaaattaagaaagtgggaaaaaagggtttttgatttaacactttccactaggttttatacagagaatgaatgagtcatgaaagcacttaaaaccccacctaaaacaatgataatttaaggaaaagaaagaaagctgcaaaagaagaagaacccattaaatcatattcatggtgaacaagtggaattgacacctttttggtgtaaggaggtcggtgaaagaagagtgcgtatttatataatattgtatatatgtaatatagagatagatagatattaggaagaactgaataatctcacgagaaaatatatgaaactgttttttattggatattgaaaaattgtgagccaaattgagtggttacgaagaatttggttcccacatgtgcttaaagtagaggagaaaggaagcaaggaacactcataagtgcgatcaaacttaaatgactctcctttttgttttctttcaattatttatttttttcctcgttggatcgtcaatactaataagatatccaaaatgatacaagatagggttttgattcccaaaaagtgtagattcttgccaattagtggatgtatacttaatgaaaggttgtagaatgtggcacgtagagttattcgttttcatggagaacatgttcatctagagaatgtcgtatttgtagaaccgtttgagaaaaacattttcatcaaaatatatcgtatatgcataaccgtccattgtggattttaatgttgcagagaactgtatcgtaaaattgataggtactgtttatcgtaatcataaatgtgatatatagttttaatacgtcacaaatgtgatatgtagtgtcagtctacaccatttggcgagaacaaaatggtagaagacatggggagaattctaatacgacagacagctcgactaattcgttggattgataagcaaacctgaaacactctttcctttatcagactttaggagataggagatatcatagaggactctaaatgtggtttgcctctagaagttaaaaatttatttaatttttcaaatttcagttttttctcaaattcaaattttgtcgtacttgttgtaaaaaccgatgttttttttctaatataatttaacattagattaaaaaaaaacggattagctcaaagaccataaaataaaatttaaggatatagttagaatttaaaatttaggtttaaaaattcaaaaataatatttggaacttagtaatttatgtgttgctttaaaattataaaattatatgaaaataaatatttaatatatattttatcattttttttggaacaaaatatatataatttagcctattttcgtaattctccaaaaagaaaatggtcgtgtaatatcgtcgtagttcgtactccacatgcaccacaaaactgatcgggagataagagcggtaaaaaccaccgagtcacgactcagtgactcaaatcgttcttcccacacaaaaaaaatg

SEQ ID NO: 1773 - DNA, 3000 bp, Unknown
  misc_feature (1)..( 3000): cDNA_ID_2143603_gDNA_ID_1620446_Annot_ID_157304 3000 nt of promoter + ATG
taataataaaattgcgcttgaaagatatatgggctaccatacccaacttatattctttatattttttttttgcatcttttctattccttatcatgttcttatcttatgagttatgactcatcatataggagtacttcttcatcaaaaaaataatcatatgactcatcatagtagtactaaatagtgatatgtatactttaaaccaacgtttctggacctgactacattttatatacctttcttttaatttgaaatattcgtttttagaaatgaaaaaaaaatatatagttcaatctactcattttgtgattgaatgacgatttatcaatttttatatttgggattttctttgacgtcaaacctctttagggtccaaaaagttagggcttctccctacttcttttttctataaattcagtcaatcttcacacactctctaccatcaccaatctttacaaaaatagagttctcaaactctttgctctctctcttactctttctactgtatgtttctcctctctctactcttgttttagctcataccaataaccacgaagactttcttaagtgtctttctcaccggattaacgacaacaccatcgtatccaaaatcatacacacttccaaagactcatcccttttttccatcttggattcttccatacaaaacccaagattctcggttcccgaaacacctaaaccggtctcaatcgtcactccggttagagccagtgacgttcaaaccgtgatcagatgcgcactgcttcacggaatccacgtaaggactcgcagcgccggtcacggctgggaaggtcaatcttacattgcgtacaacaaaccatacgtcgtcatcgatctgaggaatcttcggtctatatcattagacgtcgaaaaccggactggttgggttcggtctcttgctttcccagccagtatccacccaaccgttggcgtcggaggccagtttagcggcggaggttacggcacgttgcttagaaaatacggtttagcagcggataacataatcgatgcacttgtggttgacgcacgtgggaggattcttgaccgacaagcaatgggtgaggattacttttgggcgattcgtggaggcggtggatcgagctttggtgttgtactatcatggaagattaagttagtcgatgttccgtccacggtcaccgtgtttaaagtccagaaacatcggagaaagaggccgttaggatcatcaacaagtggcagtatgttgcggataaggtccctgaagatcttttcatcagcgcaacgttggagagatcaaacgaaaactctgtgcaggctttgtttactggactctatcttggtccggtgaataatctcttggccttgatggaagaaaagtttccagaattaggtcttgatatccaagactgcacagagatgagttgggttgaatctgcactctggtttgctgatttctctaaaggagagtctcttggtgttctcgcgaatcggaagcgtacatctctgtctttcaagggtaaagacgactttgtccaagaaccgatacccgaggctgcaattcaagcgctatggaggcgattagaggcgcctgaggctcggcttgcaaaggttatattaactccatatggtggaaaaatgagtgaaatcgcagagcacgaaacgtcattcccacatcgaaaagggaatctctatgagattcagtatctggctttttggagagaagaggaagacaagaacaagatggaaacagagaagtatctgaaatgggttgagagcgtttacaatcttatgactccttatgtttcgaaatctccaagaagagcttatgtcaacttcatggatcttgatttgggaatgtatcttggaaaggaagagacaaagtacgaggaagggaagagttggggagtgaagtatttcaagaacaatttcgagagattggtgagagtgaaaacaagcgttgatccaacagatttcttctgtgatgaacagagcattccgctactgaaatccgttgacgacatctaagaatatcctttgaagtttcatgtacgagtccttttcactgtgaaatcatctgtttttgtttgaatagttatgcttcaactgtgtaacttttttctgttgttgtgacatatttgcgtacgttgaataaagatttcatggtttttatgtttaactaaaagcagtttaaaaaaagaaagaaactaaaagcagtttcttcaagaacaagcaagttgagttaggtcaagaaatcaatctcgaaaccataacccaagtcaagatgaacttttatcacttatgccacttttttaaaaaaactgatctggactgccatcagttaatctgaatgccaccgaaaatgtgatataccagttgtacccttaatgagttgattaaaaaaatgaaaaagaaattcaaaagctaaataaagaatcgagatcctccgttctctctcctcttcgtcgtcgtgttcttcttctttggtcgacgttcatcttcttcgtcggccaccatcgattccggccgccgccgacttgaaatccggcgtaaaagccaacgaattaggtcagtttcttctcatatttcctttgacattggtgcattgtgattttagattgggattttgaattctatataattcccagattcaatttgatagtttgatgattggtttgcaaagtaaagagtaatcgattagaggttgccgaaacgttatttgaggtgatgagcaaaggaatgtaggttgaatgtgagttgaatttgaattccgagatttcatattaaagatttggggggtttgtgtttgcaaagtttagattaaccaattagtttaacgaataggtatgtattaacattggaaatcaattgaaaggtaacgaattaggttcagtagaatcgagtgcgacgagagattgatttcaacgtatgataagagtacatgtggtataactattaaaatgtttgattggagttgaactggttatattttcaggagcgatg

SEQ ID NO: 1774 - DNA, 3000 bp, Unknown
  misc_feature (1)..( 3000): cDNA_ID_2143588_gDNA_ID_1620446_Annot_ID_157300 3000 nt of promoter + ATG
catagcttccttgaacgagagaatcgatgtcccagggatttcaggttcaggtacagctggaacatcatcaacagtttcaatacgtctaccatcaatgtctgcttggtagagactacgccagaaaatcttctttttctctacgataagcctctctctccaactatcaacaattggatcgatatatccaataccatcatcaacatgcttctctacaacgcgtgacaacatttttctctcatccatatcaggttccaagatgcttgaaatatcatgtcaagtaaacatatatttcaaacaccacaaagattataaacatagatttcaagagaacaaagctaaccgttatatctccaagtgcttcatttatttcttccaaagtaaatcccttcatgcaactttcactgaacttgtgcttgcacattcttggacattccttgtctgcacgtacaacttctctaaatctcttcccaagctgcggaatgcactcaaatgccagaatctagacacaaaaacataaaagtaaatgaaagttcacaataacaaaatctagccactcatataatttactcgactacttacctcaagtggagtaataaatccataaaaagcagtctgtgccttttgtttcaccacacctttcatgttcttcattactctctgcaccccttccatacactgctcaaaggaaaaacgtccccacgggaatgtctcacaagctctgacattatccacaatcctaagcaaaaactcctctatcttcgaatcccctttagaatcagctttcataaccttagctaagaataacagaattgccaacttcaacctagcagtagacttctcactcttaaactcttccagcttctcttccacgtctttaatcttgatgtcctcagtcctcttaaacaacttctccacaaacttcaaactgcctaaagtcttatagttttttgggtactcacggcagttcaaaccggtcaacaatgcatgctctctaattgagtaccttataggtactccattgacaacaaaccaacactctctcgccaattctgtcttagccgtgcgaaccataagcatccacatgccttgaatcatgtgattgggctccttaggcatgtggaatatgtgcttaaattggtcatgattcctaaaccacttcagttctgcatccaaagtctctataaattccactgtttgtaccaactgacacctcgttcctatcttacacaccttcgtgtaggtagttggatcaaagtacataacttctggcggcaatggttgattatcatcatcatcatcatcatcatcctgcatattctgcggctgaagatcatcatcaccatcctgcatattctgcggcaggttatcatcatcaccatcatcctgcatattcaattcaaaatactttcaatttcacattaactacctagttgtactacttgttcctgaatgaccattcacaaatttacgacctagttgtactacttgttttatctgaagcaccattcacaaatccaatcatttaccaatgcatgcataatatcctaaaacgagcctaatcaaaaaaataacggtcttctatcataccttatttgctccatcatcatgttgaacaactgcattcgttgcctcttcttcttctgcacaagaatcggcatttgggtttgaaagatcgtcaattgattcccatgcgacggcgtttgaattacccaaatcggcggcgtcacaatcgccggttgtaggctggatttctccggcttcctcttctgttgtaagaagctctgcgccttcttcatctctttggggaatctcggcggcggtctcgtcgactgatggaggaatttcgccggtcgattcaaccctagttgattcatattctccagatgagtcttttactctagccattggaaaataaatttgcggatatgaaagagacaaagacgaacgaaaacggagaagaaagaagaatagaagagattgatttttccggtgaaagtggtatcgtcggagacgaaagaagacgacgacggagagaagaggaagaagtcgagaagtgaaaagggggaacttaggtttttacttaggttttttctgtaaataatacaactgagccgagtatttacatttttttttgggcccgagcccaacaaattaagttttcttgtagtttttgtggtttcgcaagggtttttcgtcctttcctcatttttcgatttaaataaaaatcaataataatattccaaacataagaatggcacgagtgattatttattctccaatagtggcataagaggtgagcttccagtcaagatcggcccataaccataacgcccataaccaagtcaacactaccaaagatgttgtcatgaatagatttatggttgattatgtagtgttgtgaatatgcattactattttctttcaagatgaattattaaggcgtaagacgaaactaattttactttgccactttactaaaaacatattttcaatcgtatatatatatcctaatagcactacagattttggtccaaaataaaataaaaaagcactacagattttcatataagctttttgaatgaaattataaaatcatcaaatgacacagacatttactactaaaatatactataatcatatccattaaacgataagagtggagtctaagatttttataatctttagaatcaatctaccaataactctctttttaagaacaaaactataggctactaatcatatactcatattataaaacatgtaatcatataaagtgacgtaaccttatgataacatttcagctgaatatgagccacataactgaatcagataggatcgatcatacatcaaaacataagaaacagacacaacacaacataagaaacagacacaacataaaaagtatctaacacatacccacttgatataaacaaaaataaaataaaagttctatagacccatgctttattgtcttctcaccgtctctgcattaagaaaatg

SEQ ID NO: 1775 - DNA, 1665 bp, Unknown
  misc_feature (1)..( 1665): cDNA_ID_2143670_gDNA_ID_1620447_Annot_ID_157325 3000 nt of promoter + ATG
aatattattattttttctcggcatcgtgcctctacgatatggtcttctttagatttgtgatgaatatgaaaatgcttgtaatggaatacttcggttctgtaatgtaaaccctaaatccttatcgtgtgctctaagattatagtatatatatagttattttgatagattctagttttggtaagttcgaatttggatttacgagttatggtcgactgctcaaaattgttatggtacagtatttccttgtctcaatatttaaaacgtttgatgacctttgatgctcaatgtaagcgttggatacaaagtttacttaactacatatctgacgctatccttttctttattttcagtattgggatacacatctagtctttcgaatgtcgattctatcccgatgctaagcggatcaaacttctcggaatggaaagaacatttgttacttgtcctcgcccttatggatcttgatctttccctcatgacagagcgtccaagctctcctaaggaactcaagcattgggaccgctctaatcgcgtgagtataatgataatgaaaatccggattccacaaggatttaggggcgttgttcctgatgatgttacaactgcaaaagacttccttgccagtttggagaatttctttgcgaaaaatgaagaggcagagagaagtagggtgcaagcagaaagttcctcgatgagttacatagaaaatgagaatgtaagggagcttattatgaggatgaaaaccctcggtgcgaagcgaaagagacttgggattaataatattttctccaatgacatgatgttagcgcattgtgcagtcaaaatgctgccattgcagtatattagccttaaaaacgtttacagttgtctcgaagggaaatttgttaatgaaaacggtagatggcacactggggagatatggtctactaaagagctcattagtcgttgtgacatggaagaagagactttaaggacggaaattgcagatgaagcaagaaaaagggaacaatgagagtgtttggttcaggagtagcaacaaaagcaatatatgcttaggaattggtattgaaatggtttgaagataagaaacaaagaggcctttcggagatttctatgaaataaatctgtgtgtgttgcattttgaagcatttcctttttttgtcattgtgtgtgttttcagatgagttttatttcaatttctacttaggatatgtaatattccattatgatcacttttcttattttcccctgttttgctctgttttaaaagaattgcctataattttttagaacttgtagacaatttgtttcttagtgatatttttccttagtttatttaaactctttaggagtccttgtttgactctgtgtcgccccttttataattagctacaaaatttctagtatcttctcgcaattcctatttgagatcagaatgcaaatattgtcctactacaaaatttctagtatcttttagaaatcctaattgagatcggaatgcaaatatttctctattctttatctaccctatgattgtgttggtttcttcttctatatataacacttttttcacacaccaattctctacataacacttttttcttctagggctcagattgttcgactttcttctttaacctttcttttactttccaaagagacatg

SEQ ID NO: 1776 - DNA, 3000 bp, Unknown
  misc_feature (1)..( 3000): cDNA_ID_2143699_gDNA_ID_1620447_Annot_ID_157334 3000 nt of promoter + ATG
tctaaggaactaactaaattcaattttgcaggggcatgagccgtttgtttcatatgaaggccttgaacagttgcatcgcttcatctttataatggcagttactcatgtaacttatagctgcttgaccatgctccttgcaatcgtcaaggtagtatctttcaacagctgaagttttcttttgaatttgaatgttaataacagtgtattttgtgtgtttatagtgtgcgtttttatctgttttgatatgggaagaacctctgttactaacaattttgtttgatctgcttctctatgcagattcatagttggaggatatgggaagatgtagctcgtctagatagacacgattgcttaactggtgagcactaaatggttatcttgttcttccaagtatggcacgaaagattccatctgctcctctatttaactaagagcacaagtgaagtgctgttacaagtagcattatagtttacttatttgatgggttgtatatctatcaagtggtaaacgatcgattatttgtgtggcagcggtggcacgtgaaaaaatattccgaaggcaaacaacgtttgtccagtatcatacatcagcacctctggccaagaatagaattcttatatgggtggtaagattcttagctctcttctctagaaaatatggaaaacaattacaaatattgaataatgggtggtatgtttttcacctccttgcagacatgtttcttccggcaattcggacgttctgttgatcgttctgactatcttactctccgcaaaggattcattgtggtgggtgatactatatgccgtatgatcattagctttttccactctcattttcaactatttatgaatgacaataatgatacaactacttatagttggtactgtttccttttcttctttaatgagcagaatcaccacctcacattaaagtacgattttcacagctacatgattcgttctatggaagaagagttccaaaggatcgttggtgtgaggtgagatacctcatcccatagaaacatagtgtgggatatccacttagcttatatctatcaggttctgagttcttaaaatcactaatcattttggataaatggatgcattagttattgactgaacaacttttgcttcaatgctcttctgcagtgggccgctttggggtttcgtagttgctttcatgctctttaacataaaaggtatgatcagttgatcactaaaccaaaagacagatgatcattctgttttcctttagttcaattgtgaaaaatattcatatttataagatttttagttttaaatctggcctcttgttactgcaggatcaaatctttacttctggatagcgattattcctgtaaccgtaagaactacattttcacagcattctcgctttcttgtattgtgtttgtaaacatcacaacttagtaaaactttcattctcattttatcagcttgttcttctggttggtgctaagttgcaacacgtaatagcaactttggcattggagaatgccgggttaaccgagtatccttccggagtaaagctgagacctcgagatgaacttttctggttcaataaaccagaactactcttgtcccttatccatttcattctgtttcaggtttgcaaaatcttaactaaccaccattgcaccgaaccaatatttctcggtcttggtaaaactaacagctacttgatttgcatttccaacagaattcttttgaactggcttcgttcttctggttctgggtatgacaaatgaaccatatattcttttaatctttcgcaaactttcgattcgggtttggaacttacaatgcatttgttattacttttcttcagtggcagtttgggtacagctcttgcttccttaagaaccattaccttgtttacttcagacttcttttagggtaactaaaccttcgtttttcgtctcgatttagactgttgtgcatctgcctcatagtgtaatgtaattcattcctctttgtaggtttgctggacagtttctatgcagctacagtacactgccactatatgcactagtcactcaggtaatttatcgagctttcgacttttggcagcttccgtaaactcctaggaggataacgaaatattgttttgattccagatgggaacgaactataaagcggctcttatacctcagagaataagagagacgattcgcggttggggtaaagcaacgagaaggaaaagaaggcacgggttatatggcgatgattcaacagttagaacagaaacaagcacaattgcatcacttgaagaatatgatcatcaagtgcttgacgttactgaaacttctttcgaacaacaacggaaacaacaagaacaaggtactactgagcttgagttgcaaccaatccaacctcgtaatgattgtgtacccaatgatacttcaagtagagtcggaacacctcttcttcgaccttggctctccatttcttcaccaacaacgaccatagagttgagatcagaacctatggaaacactctcgagatcgtcttccttgccaagtgagaagagagtctgaatataaataagttcgtaggagtaacagtagaaaacaagtatgtctcgatgaacatagattgaaaacttacatcaatcaagtgttagcaacactaatatttgtatgtgctctacaaaaaaattatattgcaatattgagaaacatttaaatttgttagaaccaaaaccaaatcttaccttttgtttaagctaagatttataaatcatcatggagataaaaagaggtataataagaaataaaacttttctacattggttaaaaatttggaaaaagaattactttaaattattttactcataattttgtttttccatttttctaaattaattaattaattattttgacctttgtttgggttctctgtttccgacataacttttaagttttgtagctcctcctcgacggcttcgaaaccctaaaccccaaagtttaagctgccgtca

SEQ ID NO: 1777 - DNA, 3000 bp, Unknown
  misc_feature (1)..( 3000): cDNA_ID_2143715_gDNA_ID_1620447_Annot_ID_157337 3000 nt of promoter + ATG
atatatatcggagcataagaacttgatgtacactacataatcgtcttcttggtctgggggataggataaggagacatttatgatgactctggaaggatcatacataggatcaggaagaggaggcagagtaatgactctaagggacccgagattgaacacgtcgcttagatgtacggttccatcatgtttgctcataaaagctatccagccacgcgagcttccaatgactcttgaatcttggtacaacaactttggaaatgacttgtggataacttcgatgatctcttccttactcagatcaaacaacttgaaactcatgatgatgttttcagcttctggagactctcctactttatcacctacaagtaccatatacggagtttgctttggagatgaggagaagaaacgagcagccttgtgatcactttcttcttcttcaacctgtgattgttcgtggaaggaactagaaaaatcatcataaagaaacacagcaaaacacttatatattttgttgataacgactagtaaaagcttacagagagatttgcgactagattgaaaagcagagacattgttatcctagaaaacaaccccaaactcacttgatttgttctaaattcgtaacaaccataaggttgtgatctcatgtgtttatgttttcacattcacgtgttatatactatttttgacgtactttccaagaaacatatcaaatactatcaaaaagaaatcaacagaaaagaaagtaattgacaaaatacatcatatgattcgttaaggaaacatataacaaaaaacagaagaaaaaaaaacagaaacaaatatgtaaactatatactcaccaaaaaaatatatacacttttctaaattaatagtatttatgggcattttgaaagtgtatattttataagttgaagaccctaacaacacgacatgtgtaaaagttataattcataaaattttgacacatgttaaataaaatttgttagtgttaatttcagacgtattgttcaagaacacatatccagtgatcaggataagaatctcaaaaattaagagaaaaggaaatctgaaaaagtctatataacatgtgtcgttgctgacttgaaaatgatagtgatcattcaaggttttgacattataatttagttttagatattagagcccatatataacatcttgcatttcttcgaggcccaactaggtgaaccatactttaaagtccgaattcatagcttatgttgcttatgtcacgtgggtcagccttcagccttgtttattagcaagattttacaagatattgttcgtttgaccacttaaccacttctttaatccggtcgcattagttaccatagtgacaaaaagcccaagtagtataaggtttcaagcccaattatattgttttagcaggccaggcttacttagatttaaaaccaaatttgtcttcattttttctctgaacgagaatcgaaagcattttttatacttgattcattacccattatttactaaattatttacaaaatttgccattaatattatatataaatatttcaacaacataaaaaataaaaagcaaattctaatttaaataattaaaaatgaaattccaatcaaaacaacttaataattaagcaagtaacatttcggaacttaatatttaactaccttcattttttttatataaacataaaattatatgttaacaactatattgatatcaattaatatatggattataataatttatatgccaaaaaatcctagttcaaataaaatagttatgtatattacattacataatacacaagtaaatttcagatttaatataataatccaataaattttgtaatacactcaatatatttacttaataattaatttgtcctgcatatagtaaatgtaaactatctaatgtattttagtgtatttttataaagtgtctacgcagcatttaaaatctcaccaacttatttattctcgattgtaaataattggtagtgtaatattttgtgtaagaaccagaaacttcgttttagtctatacataattcactctaaatcctaaaatcattaatgtacacaaaataattggggcaacgagcacataaaaatactaacaaggaaactatatgtaccgaaatctttaacatatttcacgttaaaactaacaaaatatgttttttatttttttttgtcgtcaactaacaaaatatgttagataattcgaaaatgatatcaaatataatccaaaataaagtaatgagaaaatacttcaaaaagtatagataaatataatcatctaaaaagtaaacatataacaaattaaagaatgagattaaaactatataactatgaattgtaaaaaaagaaacaaataaacattgagagtaatatatatactttttaaataaatattacttggttataagaaattaaaagtgtacttatataagtttaagaccctaacaacgcaacacgtgtagtaattataactcgtaaacttttgacatgtgtgttaagaaaatacttttttttaaaaagacatatgtgtcattttagagtttagactcacatatcattatcttttaaaaataatggtcacgacttatatttcagattattttcagaaagaaatcaacagaaaaaaaaaaaaaaaaaaggtgacaaatcccatttctgaaaatttgaagtataacattaaaaagtaactaattcgattttagaaagaaaagattgaaaaaaacaaatacattaaaataacatatttctttctaagtaaatatgaatagctatatgggaaatttgaatttatttttacatgtgtcacacaagttatttatacaaacacataattcaaaatcttaggattacaaaattacgtgtctgaagaaaatatatcagatttataaataatttatattatatataagacatagaggcatatagttgacgggtgtaaaaacaatagggtttaatacttgtagttaatttgaaaaca

SEQ ID NO: 1778 - DNA, 3000 bp, Unknown
  misc_feature (1)..( 3000): cDNA_ID_2143692_gDNA_ID_1620447_Annot_ID_157332 3000 nt of promoter + ATG
tagcaattgatgtgtgataaaataggttctcagtcttgtttctgagtataattatgtgcgggtaacaaagctatcttaacagccttatacgcagaaccagaacatgtgaaaacataacctgttagaacaagcaaagcagtatcattcatgtcccaataattgtttctttaagtgatttgaaacttttcttcctttcttggattacctttgatgaaacctagaacaattacagatgatagagatcattgtatataaataccatagtttgtgaatcaataaaatcaagtcagttcaataccttattctacatggtatcagagcagtcgatctttgtggatcataattaaagcttccgcattatagtttttgtaatcaagaaaagattatgaagatggtgatcactgaaggagaagacggtgcctccgacggtggaaatgaaaacgacgaagatgtcggcatgttaagggatggaggttacgtgattgtttcttaatcacatgggtattatttttccaaaactttaagtcgttggttttctatgtttttaataggattggttttggtttttctttttctttttatgttactggaattattcttgagttaagaaattttcagagtttttgtgttcttagtaagagagtttggtaatagttttaccgttacgggggagtttggttatggtttagccattagtagagtttgtggaacattcatgtttttaggtcatgtttagtcccgagttatagaccgtccaagataaagatgattgtttgtggagcagcataatttgtgtacacgggatgtattcccttttaccaagaccgaagacatgatgaagttccaccccaagaatgaagtttataccctaagatgtttatttacatgatttgtccgtcctcgacatattgtccacgacatacgtgttccgctttgtgattgcaaagtttgcgttttgcgtaccacgtttgtcgtgcgggggagtattggggatatatgttatccgattaggattagtacaatatctttgatgatagagtttctaacctatattttagggatttatgtttatcttttgatagaaatcattgtatataaataccatagtttgtgaatcaataaaatcaagtcagttcaataccttattctacatttacgtctctcagtgactacatggccactcgttagtaattaaatgcatatacgtacgatacacataaatttggctctatgtgcaatttgcaaattttaatgtcataaataaagcgttagaataatcatgcatgctctaaacatatagggatgatgttacttacctagaaaatgaaaataacttgcaagtagcaaacacaacacaaaaagaaatgttacaaaacttggccaacttgttccatgacgtacgacgttttaaggttttgaacaataaaacgtgtttttccacttcaaacgacatgaagagacaaaaggttggtaccagttacgaattctacaaagtacttattttggaattacttagccaaattagttaggctttttgtcttgacatcttttggcttaacataataagatctaattgagagttaagactaattatcaggttttacttacaatttggtagtttttttaggatctccagtaactaataaaatgtttcgtattggctcagaatatttggcaaaagagcatgagaaacgttaagaacataagacaattaattaagtccaacccggtgacagcttgttggagtaaaagtaaaattaaattcaaaagtggtgttaaaaatttgttttctatcattaaaagcgacaaaagtttatcattttagtagttttctaaccaaatagtatcataatcacataagtgtgttatgtatacatttcatgggtctcgattctcgaccaatagaaatctttcgttatcgtacctatcaaaaagtgaatatttttcattactttttataaaaacataactatcgagtatggacctttttatatgtatgttcttacaagttgttagatcacacctatccgcaaacaataggtcattatattttaactataaacattggggtcatatgtcctcgtattcatttagcttttgccccttatcggatatagttttagttgagaatcaaaatttgtttccctgattctctcaatatatatgagctagtttggtaaacttatgagagttttgtcttattatccatgtttaaatgttgatgtgaagattcgttaatagagtttttttttttttctgaaatttgacactgtaagtacaatgaaatttgttctaaggattaagatcaagagatattcctcagctataatatagaagaatgaatggaaatgtaatattcttctataatttatattcatctttatctctttatctttggaaaacaaaagaaatctctatctctttattcattcaattcatacttaccacttaccagtttagatatgagtcataagagaaggacatgatcaaaataaaagattagactgaagaaattgtatttaattttcgttttttttttttgtaaaaagagaaataaaagtatagtaaatcagtagtggagtaatctatgatttcattgatgaataagagattacattaatcttgaatatacaaaataaaaataaaaattaaatcattttactgaaaattatttgaatactcaattctaaaatataaagataattttttctagcctatcatagtttaacaaataaatcacaaaagttttcttagtcagcatattaattaaattcctaaacattatagtaaaaacaaaaaatctacctgtaataaacacaaaaaaacaaaaaggtaaaaaaaatctatctgtacacaaccctagaccaagtagttttgtgtttatgtactttaacaccgtacccatctctcttctcctttataaccacttcttcctctgtcttctctctccatcttctccttcacattctctgcaaaaaaaaaaaaaaaaattcttctttt

SEQ ID NO: 1779 - DNA, 3000 bp, Unknown
  misc_feature (1)..( 3000): cDNA_ID_2143695_gDNA_ID_1620447_Annot_ID_157333 3000 nt of promoter + ATG
tggttagattcatactaacttcgtaaatgtgaggggcaagtcatgattttcgaaaaagactcataacagaaaaaagaaaagattcggtaacttagacgagcattggtataatgatgatgtataagtataacactatatggtatatacgaaatgattcggaaacttatgcttggaggacattgtttctcttgcatagcttacataacctatatgaagtcgtggaaacaaaaaatatcacaaaacatctactgatctagaaatgctgaattgtcatatatatgtagttgcttctattattccaatgaatctattaggacatgtgctggatttccctaaagttggaccaataaggacacgcttttgtattttagacctcatgataactataaattctgatgcgtagtaaaacaccaaattaaagtggataattgtgtacttaattatgccctttttagtaccgatatgtggtcattgtaccattgttgattgattcaaagaagacaaattatttgaagttccaaaaaacaaataccgtctttttttgtttgttgattttaaacaggaaaagagaaaaacatgttatttcgattcatgtttgttacatattgcgtatgtacttaattatgccctttttataattttatttggtggtcctaaatttttgcttggacgttagtgatgggtctctttcacgagtctcctcaatgattgatgagatttacctctttcacaaattgtccatggaccctattttttttagttattcagaaaaaaaaaactgagaaggctaatattgagattatatgtttagttgtagttgacgactcaaactttgatgattctaaactatatatttttcgatttcacacgaacacgaagaagggaatgaattttttgatacaattcgacgatctacgttttgatggtgatatatataaagctgtttcacaagaattcactattctctaaggagcatccacattgtataactaacatatgtgtcttcccacactaattcaattattaaaatgtgaaagttgtttttaaatagagactcccttcccaaaatgttttaattgagacacattaagacattttgagagtgatatcatttaaaaacatccaaacattttaataattatatttttaaaggaagacacaaacattcagatgtgcaatgtggatggtctaaagaccttatagtgtatttcgattttaatcagaatctcaaactagtatgtactttttttttttagtgtgtcaatacttgatttcattcattcaaagacaaatgaaaaacatagtacaaggattcaaatatccaaagttttgtaaatgaaagtggaaaaacattcataaatgcaatataaagattgtaaagataattccacttttgcttcacaagcacttgaaggcaatatagcttgatagcttcttggcgcaagcggactcatggtgagtcgcgggcacatccacgagtacttggagaagtgagagattattcacggtcgagatctcaaactagtgctagatctctagctagttttacacatgcgacactcgtgacttgtgagttcattaaccaaagcttccaagcaaccaaagtgaatttacgggagctcaatctcttcatcatttgaagccctctaactctcccagtgtgaccaaattgaccgtttgcaaaaaagcaaattcttaattgggttgttcacgatattaaaattgcatcctcacatgcaaaacaaataaaatcacgaaatttcgttaattgttttccacaaaatcactcttcaccgtcaacatctacacaactaacaagatctcttccattatccaaaggatctcttatatcaacgagatgattaggacaacatatatagaggaactccatacacaattaggtaaacttatacaacaacatttaaaaaataacttttttttttttttgtgggcatgcacacacacacgcacacgtatgacttaaatctcatgtaactgtaaagactaatgtggagccctcctcgaaatctcttgcggattttcgctttttttcatgagaattaggaaaattctgactcatatgaaagcaattacgtcattcttgtctttataaaattgattaacaaaacaaaatataaaaaataacgagagtttcaagacctcatattccaatgcatttagtgcatttaggtaggttccaggtagacagcttatttaatcgtcattattttgctaatcaacttttttatacgatactttcaagaaagaaaataatagaataacattagatacaaacaaattaacgaaagtgagagagtatcagatgatcatgtggagaagtttgttttcggtatctgtcgaatcttccttctttccattttttcttgtcaacatttattatttatttttgtttggtcggccatttgtgtccaaaaataaaaatacgaaaaaacaagtatttttcactttgctcaagaccatctctgcacatgaagttatgaactaagtgagaccagaagaacttctttcgatcgatttctacagtgattctgtttgctcaagactacaactttgtgtactttctctttcaacgagctgtgtatcgtgtacttcatggtgtgttcctctgcttctgattgagattgaatctcctgtggtttttcagttgctccggtgatcggctccggtggattgaaatttcaaagcttttcctaatttcttggagtctacagatttcaaagtttctgggttactaccaaagtagaatctcagtttttgtctaagctaatcagatttctgcgattctgattgttaactaatccaagaacgatcgatgggggtttaaaggttagttttttaaacttgtagaatcaaggaatgtgattttgttactgggtttaccaaattttaaaacttttttgcattgtggatattacagttgaatttgggtctagaggaggaacttgttttgtttttgtgaagaatcagactttaaaagaa

SEQ ID NO: 1780 - DNA, 3000 bp, Unknown
  misc_feature (1)..( 3000): cDNA_ID_3064285_gDNA_ID_1620448_Annot_ID_157355 3000 nt of promoter + ATG
tttgtatttgtgtttcttcttttgcaattttgtcagatacataagctttttgttgctaaatctcttatcatcgaattcagaaatctgtttttgttgttataactctttctacaacccaagcaatgaagctattttgtttaagttctgcatcataaatatgcataccatgaagagttggatcgaataattgcagcctgatatgatcttttgtcttctggtccttattctaattcttggcatctcttggactgtttctgtatgtagtgatgaagtggttaagagtcttaggtcttctgatgtgtgatagaactccattgatactttcaattatttttaacatatatgaatataggacataacatgtaccatttagcctgtcttatttgttcaaagaaagctttttatcactacatttggtttggttttatgtaattttttttctttctaaacttactggacgaagttgctcattttctgctcatctacttcttcagaggaagcattggatcaccgtggtcactaaggagaagaaagcgagttcttcaacctaaacaatggaatgcttttttcacagaggaagggcgactcagtgatggaggtgtcaaatttctgaagaaagttcgtagtggggtatgttgctaaataagaaaaaaatctgctgtaatctgcagttgataaccttttgacactttgatatactaatttttatttttgtttcagggtgtacatccaagcatcagaccagaagtttggccgttccttcttggagtgtaagaatcagcatcttgtcacttttccttgttttttgtatacttttatgagttttatctttttcggctaccattgggggttttctgttcggccttatgttcatactcatgcatggtctattgatattagctttttctttggggatattgatgttatgtaggtttaaggttgaataaacagtgcatcagtaaagcattcattaactaggagatcagagagttgccttaatgtttttctatcaagagatttataagattagtcctagtttcgccataccaaactccaccagccgtcgccctacattccattaacttgataatgaaacctgtgcaagttatttgtagtctttatcatctcgacacattgtaaccttatgctacttacctctcacaggtatgacttaaagagcaacaaagaagaaagagactccattcgacagctgaaactgtatgtttgcttatacttattgagagtttaatggcttctcaactttctaccaaatgttacgtttcccatttatctctgttctcctaggtggcagctggttattaacttgctcaatgtgttgataaaactaggaataagaagtagtagtttggaactcctacactgagatttcgagtcagtttgtaagtaacgtcttttatatctgtaaatcctgcaggacggaatatgaaaacctgcggagacagtgtcgcgagattcatgaacgctatgaaaatgtctgcgactcaaaggagacagctcagagcagcaacactgaagacagtcaggttcttgaatcccatgatattgaggaagtcgagagttccacaagaaccatcaccgtagatgaatcagagaagttgaattctgaatcgattatgcaggatgagaactgtgaaaagagcgatgtcaccacagaagatgctgctggtaatgattcagactcaaccaatcctgaagaaaccgagacttcaccttttctagctaacgaagaagtagaaagccacaatactgttaaccaagaaaaagaaatttcgtctccatcatcaaagccaaaatctcaggcagcggacgaggatttcatgtcaacttggcagagaattatccgcctagatgctgtgagagcaaatgacgaatgggtgccctactcaccaactcaagctgctgtttctgagacaaaagcccggggaatagccattcaggttggtctcaatgactatgaccacttggaaccctgccggatatttcacgcagcccgcctggtcgggatccttgaagcctacgcagtctatgatccagaaattggttactgtcaaggaatgagcgacttactatctcctttaatcgcagtgatggaagacgacgtcttagcattctggtgctttgttggcttcatgagtaaagcacggcataatttccggttagacgaggttggaatcaggcggcaactctcaatggtatcgaaaatcataaaattcaaagacattcacttgtaccgacacttggagaaccttgaagcagaagactgcttctttgtataccgtatggttgtagttctgttcagacgagaactaacctttgagcagacgttgtgtctctgggaagtaatgtgggcggatcaagctgcaatacgaactgggattgcgaaggcgacatgggggagaatccggttacgagcaccaccgacagaagatttgttgctttacgcgatagctgcaagcgtgctgcagaggaggaagacgataatagagaaatacagtgggatggatgagataatgaaggaatgtaacagcatggctggtcatcttgatgtttggaaacttctagacgatgctcatgacttagtcgtcaatcttcacgacaagatctaagactacttatatctttcactcttgttctctctctttacttgtttgttgcattctttgttatttgttacataaaatgtgataaaaaccgttgtcctaaaacgcatgaaaatgtcttcactattgctaaaattaaatgtagaaaaacttagccaaacgagaacccgctgaggctaaaagaaggacttgactttatttggttttaagagcctctggttgagctagaggtgtataactgtaacaaactaactattcttcgttttcaatttccagatacatcagatctcttcttcatcttcttcctcttgggagacttgatttattttgtgatcagtctcggattgtaacatactgcgatcttttttcagcttctcta

SEQ ID NO: 1781 - DNA, 3000 bp, Unknown
  misc_feature (1)..( 3000): cDNA_ID_2143901_gDNA_ID_1620448_Annot_ID_157372 3000 nt of promoter + ATG
ctcattgatttgtggcaagaaaaggattagtgaggaagctgattcgaattcggggcttgttcggatgcctggaaggttatccttggctgagatcaaatccgcgacgtcgggtttcaatgagaacgcaatcgttggtcaaggagcttctgctactgtctatagaggctctattccttccattggatccgtggccgtgaagcggtttgatcgagaacactggccacaatgcaaccgtaaccctttcaccacagagttcaccacaatgactggttacttgcggcacaagaatctggttcagttccaggggtggtgcagcgaaggaacagagacggccttagtgtttgagtacttacctaacggaagtttaagtgaattcctacacaagaaaccctcatctgatccatcagaagagatcatagtactctcttggaagcagagggtaaacatcattctcggtgtggcttccgcacttacatatctacacgaagaatgtgagagacagatcatccaccgtgacgtcaagacctgtaacataatgcttgatgccgagtttaacgccaagcttggtgatttcgggttagctgagatatatgagcacagtgcgttgctagctggacgagctgctacactcccagcaggtactatgggttacttggcaccagaatacgtgtacacaggtgtgccctctgaaaaaacagacgtgtacagctttggagtggtggttctggaagtgtgtacggggcgtaggccggtgggggatgacggggcggtgcttgtagacctgatgtggagccactgggagacagggaaggtgctggatggggctgacatcatgctgagggaagagttcgatgcagaggaaatggaaagggtgttgatggttgggatggtttgtgcgcatcctgacagtgagaagcggccaagggtgaaggatgctgtgaggattatacgcggggaggcgccgttgccagttcttccggcgaggaggcctttgttgagaatccgaccggctaacgaagcggaagagatgattgtcgatggtttggttggggaggatcttccttggatgactcctaaatcgcactttagctgattcctttttttggggctttctgtaattggttacattttagtttgagatttggaaaatttgtaatcttttttatttgtctagttttggaaactaaagattataaacctcccggagtaatcagtatttcataactcaaataaatagatacatcaagtacattttgttatagtctaacaaaacattaattcatatttattacccaaacagactcatgatttgtacagcattacacggttgcaaaaaactgttaaattctattgacatacatacacgggtgaaacaacgtgcatgcaatggtggtaaatggtaataagtaatagcaatggattttaaaatactattctaatttactagttcaataacacacaaaaatggccttttggttgcatggtttaatactatactagtgataagcccgttattggaccaagaaagtcttgattataatatactgagttattggacaaaaaaaaagagataaataactaaatttgtatggtttgaaatatttttccattatatttgagataatttgatagttccacaaattgacccactagatgagtcaataaaataattcaaccattgaaaatagattatcgaacaactcgaatcaaatgcaccgttacgataataccacattccaacgccaatttgttttttttattaataagtacttctcttttttaattatttttgtaatggtggagaaaataaaaaggaagggcaatattgggtttaactgaaaatttgatattaagaaaagcctgaaacaaggcgcaacacgcagctccagagagtcggtggtggtggagagatccggcgtcgtcggatccgaagaagaagatgaaggtttcaagcggtgtggtcgcttctgtcattgccgtctccaccgctgctctctcttcttcctccattcttcctccagtctccccaaaggtttttctttcttttttaagatctgcgatttcgacgatttcaattgttctgtggtttgaaactgagatgtggatatgaattgatcaggtttgggaatcgaggaaaacgaatgggtcggacaatttcgagccgaggtttgatgggttaaggttcatagagacgctggtcacagcacacagatgataagattacaaataccattcttcttcttcttctcttgggtgatgcaaaagctttgttttttccattcaaagcgtgagtgcgtcacttaggtctttaatcttatcattctcatcttctcttttgttgtcttctattatctctgtaatgagaatttattaacattcttttgctttcaagggatatgctaaattgaactctttcttgttgtgagctaaactttattcatatgttggtgtgcttttactttatatgagacaaagcaatgtgtggcgatggctctaattggtgttttgaatcattgggttgtatctggttaaactttaaagagccgttcaaggtcatcaacctagttggatttagtcaaattctggtgtattggaaaaaagactagttgaagcaaacaggctgttgaaagacatgagtggtagatgttctagttggtgttctgtctccatgtagctgtctcaaatacctagcaagtgttgtaatgagagcaccgagagagaagaggacaagaatgatctgtcataagagaagtgagaatccgagaggaagcaaaacaagaaagatgctctctcctctactgcttgctccagagacactgacttccagctcatccaaaccaacattactctttctctttcttcttttcaattatttctttattactatttcactttgaaatttagtgaatcctaacgctctggtcccatcactgcctcctctatcatcttgctcacaaccactcactacgctctctctctctctctctcacttcatctatg

SEQ ID NO: 1782 - DNA, 3000 bp, Unknown
  misc_feature (1)..( 3000): cDNA_ID_3064247_gDNA_ID_1620448_Annot_ID_157379 3000 nt of promoter + ATG
tttttacgacggaaacttctatattcgtgaaattgaaatggtgaacaaatatgtgatagattgtggaagctacccgtgtgtgtcgtttggttgttatggtcttgacgcataatactaaattttataatccaataaaaatctctgctctctctctctctctctctcgtgatgcccatttgtttatcttttcaaaagcaggatggaaaggtcgaaacaattcggtggtttactttcaaaaggaattaattcctttcagttgtctttcaaatctcaaatataaaaaggtatacttaagaattattattcaactattcattagataaatttttaaattttactaaccaaatatcatcgcagttagctgaaagtcataaccttctatggaatcattttcttaaataatgataaattcagaaaaggaggagaaatgaaataaaaaggaccatggaataaagaataaaaaaagattggtctaaagagtgttcgagaactactcttttctagagaacatatgcggttatgcacatcattgatcggactttacattacttgtatatattcactactttctcattaatatattatatatatatatataatatgtatatatactaaatgaaaagtttttggaagtgttttgatctttgttgtattacttttaaaaataattgttttaattggtaattcataagaatgtaattaaaagtagaaattctttctaattaatatcataactaaaagttaataattaatgagaagtaaacataaaacatctaatgattttgaaaaattaaaaaattctattaaaaagttgtgatgaaagatattatgttaatacgtgccgtgccaagattttaattaactttatagatgttgtaattcagtaattaactttgaagatatataaacgcatatgtgataagtgcttgtcgatagtggctcgtgggtagcctttaagcatgggccagtgtgcttgtgcctacgagctcgagtgatcgagcacacacattccaaactaaacacaaaacacaaaggaaaaaaagtaaataataaaggcatatatatatgctccattagaaagcaatatatatagaaggcagatagagtttgaaccaaagaaaaaaagagagagagagagagagagagacaacgaggaagatggggtggtttattaaggaaagaagaggaggttcatggaagcgaggatggttagaggaaacactcctaacatcatcagctcctcctcttacactactagctctccttgccatcatatctttactactcttcctctcttcatatccgcgttacaagtacgaggttgagaaaaccgctgctaatctcaagctcttcatgctattcctcccaattctctttgtattcgtcctcgtctctctaagcttcgtccatcgacttctcttcaaatcctcttactccgttagagcaaaccaggctaagtccctttttggagaaggaaactttccgtggggagttttgcttatgctaattcttctacttcttttggtttctaaacaatcttactttcactccttatggtaccccaatttatgagttatgatcttccaatcattcatatatagtcttcaaatgtaatatttagattgatcattgcttcttgtaatccataattccacacatgttaaaagacattttgagaataatgataaaaatttatgtaatatataaatctcgcatatttgttaagaccaaaagtctaaacatacatagctaatttgcgacaaatttacaaatttatatataacacaatttttgttttgtcccaaaattgagagaaagttatgggaacacatatactgtaaacaaatcagtagtggtcagttaatctatataaattcacttaacacacctccattaatctatatatataaatttgtatttcttgaaatttgttttttttaattggtgtgagatatgtatataatatgatattcgcaattgggaggatggattatgcaagatagtaaaggcacaactcaaggctgaagttcgactaaactacgatcttggtatactccgatggaagcagaagatgcagcgttgttgttttcaatgcaaaaaacatggcctaaagggtttatacacgtttgttttaaaggcgattgcaaggtgctaatcaacatcatgaacggatctaccaacaacgacattgctatagaaggcttgtgtaaattaagatatccattattgggcatcgaagttcagagaattaaatttctcctttactagtcattcttctaatcatataagcccatatattagctaagcaaggttgcatagatttcagcttttactcatatagcccatactatactctcactcgaaaaaatatacaacagtaatgacaaaatctgtaaatattttagaaaagaataaaaatggtgtacttatttaaatggggtaagaatctctgtaagtgtgacacattaccatgcaattttgctaataacatatgataataatgttattaagaatatttcaataataataataataagggatatgaatgagaatttgtttggtaaaactgtttgagttattcttccatcaatttttttaactattgaaaatatttaaataactcatgaaaaaattagaagaatattatggaaatcttcatgttaaaattatataaactaacatgttataaactattctataattttaaaaatcgtaaagatttccaaatttcataagtttgaaatcaatttaatgcataaaccataaaagcccctaaatattttattaaaatgtatttttatacaagagataatttcaaagtcaaaataatttttttttttaaagtattttcgcaaacagccttacgaataatctaaaaggctctggaagtaaatcgtggacacagcttaaaccctaagaaccctttcgttgaataaacaaaaaatcaaacgccttcaaaaatcaaaatctcgatccagatctcatcttccgccacaagct

SEQ ID NO: 1783 - DNA, 3000 bp, Unknown
  misc_feature (1)..( 3000): cDNA_ID_2143915_gDNA_ID_1620448_Annot_ID_157376 3000 nt of promoter + ATG
gggacaaaacaaaaattgtgttatatataaatttgtaaatttgtcgcaaattagctatgtatgtttagacttttggtcttaacaaatatgcgagatttatatattacataaatttttatcattattctcaaaatgtcttttaacatgtgtggaattatggattacaagaagcaatgatcaatctaaatattacatttgaagactatatatgaatgattggaagatcataactcataaattggggtaccataaggagtgaaagtaagattgtttagaaaccaaaagaagtagaagaattagcataagcaaaactccccacggaaagtttccttctccaaaaagggacttagcctggtttgctctaacggagtaagaggatttgaagagaagtcgatggacgaagcttagagagacgaggacgaatacaaagagaattgggaggaatagcatgaagagcttgagattagcagcggttttctcaacctcgtacttgtaacgcggatatgaagagaggaagagtagtaaagatatgatggcaaggagagctagtagtgtaagaggaggagctgatgatgttaggagtgtttcctctaaccatcctcgcttccatgaacctcctcttctttccttaataaaccaccccatcttcctcgttgtctctctctctctctctctctctttttttctttggttcaaactctatctgccttctatatatattgctttctaatggagcatatatatatgcctttattatttactttttttcctttgtgttttgtgtttagtttggaatgtgtgtgctcgatcactcgagctcgtaggcacaagcacactggcccatgcttaaaggctacccacgagccactatcgacaagcacttatcacatatgcgtttatatatcttcaaagttaattactgaattacaacatctataaagttaattaaaatcttggcacggcacgtattaacataatatctttcatcacaactttttaatagaattttttaatttttcaaaatcattagatgttttatgtttacttctcattaattattaacttttagttatgatattaattagaaagaatttctacttttaattacattcttatgaattaccaattaaaacaattatttttaaaagtaatacaacaaagatcaaaacacttccaaaaacttttcatttagtatatatacatattatatatatatatataatatattaatgagaaagtagtgaatatatacaagtaatgtaaagtccgatcaatgatgtgcataaccgcatatgttctctagaaaagagtagttctcgaacactctttagaccaatctttttttattctttattccatggtcctttttatttcatttctcctccttttctgaatttatcattatttaagaaaatgattccatagaaggttatgactttcagctaactgcgatgatatttggttagtaaaatttaaaaatttatctaatgaatagttgaataataattcttaagtatacctttttatatttgagatttgaaagacaactgaaaggaattaattccttttgaaagtaaaccaccgaattgtttcgacctttccatcctgcttttgaaaagataaacaaatgggcatcacgagagagagagagagagagagcagagatttttattggattataaaatttagtattatgcgtcaagaccataacaaccaaacgacacacacgggtagcttccacaatctatcacatatttgttcaccatttcaatttcacgaatatagaagtttccgtcgtaaaaacatggtttctaacaaatttcataaaagtagaaaccatgttgaattttttgacaaccgagaatctaaactccatattcataaaatgaaattgaagcggtgaataaaatatgtgatatcttctaaactacatatgtgcattgtttagttattatgggcttgggccataacactaaattttataatctgataaaagtcataaaactgtaaaagttagcctctccgtaagagatcacagtttttgatgattttttgtatgtgatgattgtattaaaacttaacccaacaactaatccagttcattgggcgtgtgtatattgtaaattaactcacgttcttatataaaatgagatatggaggagactttagcacgaacgaaaaagaaacagactactaacctcctaaatttttttagataaaacaatcatgagacttagtacttcatttccaagctcatcgtcgtgtgttccatttttatagttctttaatcatttcttctaaagtcaccacttcgtgacttcctctaatctcaaggttcgacaagtagctttttaccgctacggttgaagttgaaatttccaattaatataagtcgattagacgaagtagaaatggttgaaagaatacaatgattcaattaataattaccaatgtgccattggattagtggtttttgaattactaattatgtaattttcttttgttttaaggtaagaaatataagctggaaagtaaaaaaaatatgtatattaccaaattaatgaatgaatatatatagttttctgtattatattacttttcaacattgactctttccgtacttggaattccacggcaaagactagtttcgtttgccggttgagacagacagtgatttcattctcgtgctcttcctcccgccatctccggtctctctccgaccatttcatcttctttaatcctccggcgaaaatttctcaagattagcaaaacaaaccgcaatttgcaagcacaccagagccgttaccacctgaaacaagtgataagctttttttctttggtttccgagcatacccaattcatcggaaacttcacaactctgaagctagggtttcaaatttcacctttttgttaaaataaaattgtggtttttttggagttagcacggaatttgatggttagaacggcggagacttcacgtagtcttgtttgcttaggatg

SEQ ID NO: 1784 - DNA, 3000 bp, Unknown
  misc_feature (1)..( 3000): cDNA_ID_2143929_gDNA_ID_1620448_Annot_ID_157382 3000 nt of promoter + ATG
agttctgaaaaagcaatgctaattattaatttaacctgcttaacttttttccaacaaaattataaattctgtttcttttaattattaatgaagaaatcatgagctatcgtattatacaatgtttgcggttgtatggccatttgtgttttgggccggtaaaatggaatttcaaagctagggtcgttgatttatttgcttttctgtgaccggtgaaatggaatttcaaaatttctctttaccttactttgagactaaaagtattttcttcttctatgcttacaaaaagtactttagtttgagagctgtataaaataatagcaatcatgttctaggaattagaggcgacggagaagtccaatccactaaaaagttaaagaagatagcacttgaagataatgcgttaaagtagttatttattttctaacaaataaatttcaattaaataggcgctatatttactagactggtttacattaatttacattaatataaagaacaatattaatttacattatgtattttttatattatttacattaatttattactaaaatgtttttattttcgtttctagaatcttttctacattcaaaatatacaacagaaattaaattaaaaagtataattacagaagcatcaatgcataaaatctctagagctgattatgtataaaataatcgacggtactaaaaaattgcaacaactgattttttcgagaaaaaaaattgactgctataaaattgaccatgtattcagttattcagacctggtcttgtcttgactccttcagcatagctgagaaaatccatgtttacggtctagtgaacaatatttgggttcacttattaggtaaatctttttatttatttcctcttatcttaagtttttaaccaatctgaattcgttatttaataaaagaaatttaaactcatttaattataaaatttaaatcataatcatttttttataaactcaaactcatatataatttagtctaattataaaatctaaatcctaatttttttatttcagccaatcagaatatactacctaataaaaagttaaaaaaacttatttaattataaataaaaaatctaaattctaaataaaaagtaaaaaaaaattaaattctaaccactttttaaaaaattcaaaccaaaatgtaatctcgtttaattataaaatctaaccctagttcttctttgtacacccaattcgatatttaaactcttttaattgcaaactctaaatctctaaccgttctttctaaacccaaaccgatatttaacattgtttaattataaaatctaaatccatttataaaaccaaacagacgttcaatctcgtttagttataaaatctaaaactgtttataactcaaatcgatatttaatagtaaaatctaaacttcaatcctttcttataaacccaaaactatataaaattttgttcttgtggcaaattagattttataataaaataaatttaatttatttattaggtataaattctaatttaatggaataaaaaggtgaataaaggggtgaatctaaatatattttttattggcccatattttttactaggataatggccgattatgctttggtgaaaatttagataacgcaagttagatttttctcactttatttaataagataagattttagcggggatgaaatttttacaagcgaatccctcaatatttcacttatgttcgtggatgatagcttcttttttgtaaaacgacaaaaaaaacaatgcgtcattggatttggaatactaaagaactatgaagaggtttttggtcatgagttgacaactcgatgatggacaaacttatggcaatcttcgaaatcactaatataggggacatgaacaactacttgagattatcgaaaagtttaggaggatctaagacaaaaaaaatttactcttttagaaaatatttacataatagaataaatggttggtttacaaaattcttatctaaagatggcaaagaagtattgattaaatcagtaccagatgcattgcttacttatgtattgtcttgttttagattaccaaaatcagtaacatcaaaacttaggaatgtagtaacgaaattttggtagagttccaatggacgaacaaaacgtttacagtggaaggcatgagataaattttgtcatagtgcctctctgctctccctctcctcctccgggtgcctctctgcttgctacttggttccgtctcttcagttaggtcctcctctgcggttcaggtttccttatgagttttttgagtccttgggtcgttccctcttcgttcttttggtttttgggcctgctatttttaagtttcagcttctttggttgttttgggctttgctcttgttgtcgggcctgcgcgccttggatttgagcttttggatgtgtatgttttcgagcctgtgtgcttatgtttggacacttgtcttataacttgttgtttgttttaatggaaatttaaaattaaaaaaaaataagaaaaataaaataaaaaataaataagttttgtcgtaacggtggacttggtttctagaatgtggatgattttaatacaacttaattagcaaaacaactgccgcaattgattatgattcttaactctttatttgcaaagatgttcaaagaaaaatattaccggaaatcaaatcacatgaatccaattaaattatacacaccatcctacaaatagaggagtttagtatctgttcaactactgattaatcaaaagttgatgaaaagagttgaattaattttcaggtgttttcctttgaaagaaaaaaacagagaaaatgttttaaaatgaaaatttataggtaaaaaaagtcaattgggaatcgttagatctcactggttcaatgtgtgagccgggctttaaaaacattttgatttaacccatacacacatctctctgttccacgattctcttcctcagcctccacgtcgtctctaaactcagcaaaaaccaatg

SEQ ID NO: 1785 - DNA, 3000 bp, Unknown
  misc_feature (1)..( 3000): cDNA_ID_2105722_gDNA_ID_1620448_Annot_ID_157381 3000 nt of promoter + ATG
aatagatatccatttgataaattaataatctacaaaaaaaatttagcatattatgagaaaatatcacatatcctgcaattaatactttaaggatattagaattcatctgataaatgtgatgtttatgttggaaagtaacaaattatagagaaaaattgctcaaactgtaatagttaaaataaaaatggataaaaccgtcttaattattctcttatgtttgcatggatctctatttcttatggctttgtctcgttatcgactatgtcaagtgatggtcattgcatttgtgttacatgtcgagacaacttatggtttttgtttaataatatatatggcagctgaaagactaggaatagcagaaacaataccagcatatttaaatccaaagctcaaaaatgaagatcttctcaagggtgtgaattttgcttcaggtggttctggttacgatccgttaacagcaaaactagtggtatttttaatatcgtttaaactttcttaataaattggagttttgattcttattttttagtcatctttttattgatatgtttttttttgttctgcgatgctccagaaagtggtatcgttatcagatcaactaaaaaatttccaagaatataaaaataaattaaaggtgattgttggcgaagagaaagctaatttcttggtgaaaaatagtctttatcttgtggtagccagcagtaatgatattgctcatacctatacggcacgctccatcaaatataacaaaacttcatatgctgattatttggctgattctgcttctaaatttgtcagtgtaagtacaaaatttgattatgttatatacctcatttatcttgcattttcaagttttttgatttttgattttatttataaaagtacaaatttgttgttctcagtcaatttaaccataaaaatgatatattgatcattcatagcaataacagcatttcaatcaaatttggattcattgtaatgtttacatcatataggcattgtatggacttggagctcgaagaatcggagtatttagtgcagtaccggttggatgtgtaccagcagctagaacacttcgtggaaaattgaagcgaagatgctcagaaaaacttaacgaagtggctcgcaactttaacgcgaagatatctccaacattggaagctttaggaaaagagttgccagatagcagagttgtgttaattgacgtgtgtgacactcttaatgacatgatagaaaaccctaaaaactacggtaagtatgaatacacatccctttttctcataataatttcatcaagttataaccgtaaagtaaaatagttgatcatttatgttgtgatacgcaagtacaaatgataattagtattttgaggattttgttttggtcccacatcagttaaatttaataagagactttgcaaattattatatgtgagacgtcacaaattattatatgtatataataaagtgtttagatggaaattttcaaaccaatgggaactacaaacaaattaacttacctcgtacaatagcacgggtcatcacttagttatagagaataagaacgaaagtcataataaccataatactaatataacttaatgcatatttataaaatatattatacacttagaattgatctaaatatgcatggatatttagtcattcaagatattgttttatggatccatgaatttaaatgttggatctagactcgcatacctccaatatcttggccatcgataattagtaccaaaaactaactttattacctactagttactatctttaacttctttcttttttattataggatttgaagtatcaaacagaggatgctgtggaaccggattagtcgaagtactatttttatgcaacaaaatcaatccttttacatgcaaaaattcatcttcgtatattttttgggatagttaccatccaacagaaaaagcttaccaaataatagttgataagttgttaggaaattacattacgaaactagtctaattctatatttttataatatactaagtaatattttttcctatgtaaaaacgtaaaaaaaaaaaatattttttcaataataagaaatagtatttaaatgttcatttagattaaatagattcaatatagtttgttaaaaatgatttatcaattaaaaaaacaggttatattggattagactagtttcgtaatggctaaaaaaaagaataaaacatacgtacgagaacaagacgaagaaatagaaggcatccactacacaattgtacatgtcgacaacaaagtcaacgacataccgtttgagacaccgtggctttcgcttttctctcaaaaaaaaaaaatcaatcatgtttttttggtttttatgtttcgacagtatttggtaggttgttttaatattattaaaaacatacttattatttgtgtgaatatgtttaaaagcaaacttggttgtttggaattgtaatatcaaatgtcaagatccatcaactttcataaaaattcgttaatttgtacgtgaacaattaataaatctctcataccacacatattattgctctagtcaatttgtttcctttgttttcagtcattttcaggaatcaaatattagcaatgctttaactctactccactgcaaccaaattggttgtttagagttatcaaatgacaaaactcgttaaaaactcgttaatatctattaaccaataaatctctagtgaacttttttcctttgttttgttctgtcattttcaggaatctaaattattaagtcttcaactctactccaccacaaccaaaattaaacgagtcttgtctacatgacctaatttgcttaacaaccttatcatctcactaacaactccatctcccaaaatttaaactcctttaactatgcctataaaaccttgatccattcttcatcacataagcaacccaacaaattcattctaaatacatttcttttcactcaagaaattaaaatttcgaaaagtttgttaaa

SEQ ID NO: 1786 - DNA, 3000 bp, Unknown
  misc_feature (1)..( 3000): cDNA_ID_3064244_gDNA_ID_1620448_Annot_ID_157380 3000 nt of promoter + ATG
atatgaatgagaatttgtttggtaaaactgtttgagttattcttccatcaatttttttaactattgaaaatatttaaataactcatgaaaaaattagaagaatattatggaaatcttcatgttaaaattatataaactaacatgttataaactattctataattttaaaaatcgtaaagatttccaaatttcataagtttgaaatcaatttaatgcataaaccataaaagcccctaaatattttattaaaatgtatttttatacaagagataatttcaaagtcaaaataatttttttttttaaagtattttcgcaaacagccttacgaataatctaaaaggctctggaagtaaatcgtggacacagcttaaaccctaagaaccctttcgttgaataaacaaaaaatcaaacgccttcaaaaatcaaaatctcgatccagatctcatcttccgccacaagctatgaggagagtcaccggacttgccgcgcgcacaatctcatcctccgtcgccatcaattcacgtctcactcaatccatggcgattacaaccatttcatcctccgaacctatctcccgaagattcggtggtcttccagagattaaaactccgtctttcgccggcggagtcgctggggttgtgttcttctctgccgctgctgtatcgtctcttggtcaagaagttcacgctaaggaaatggctcagaagtttaatcctaaagaagttgttctgtatcagtacgaagcttgccctttctgtaacaaggttaaaggtaatcttatcacactaatctaaaaattgctggatctgatcagaatttgatcttctactcatcgattcttgctttagacttaggttgaattcagtaggattgacttgaatgtgatggatttgaatggagaatggttctcattgtctatgattcagtaagagattggtgattgaatgaggtatctattgttgctggtatgatatttgggcgattgtttattttgtttgtagcgtttttggattacaacaagattccatacaaggttgttgaagtgaatcctatcagtaagaaagaaatcaaatggtctgattataagaaggtgcctattcttactgtagatggtgaacaaatggttgattcttcaggtttgtctcatgttctgtttctgacttgtatttttctcttcagatcaaaaatgtgtattagcttagttgagtaatcttttgttttatggtgcagtgataatcgatagcttattccaaaagatgcaccctgaaatttccaagtccgaagatgatgaagagactaaatggcgcaagtacgattgattttaatttattgactactgatattgagttcgagatttgtgtcactacaggaccttaggctgataatgtatctatgtgttgtaggtgggtggacaaccaccttgtgcatcttttgtcaccaaacatatacaggaatacttcagaggctcttgagtcctttgaatatatcaccacacatggtatggttatcgtcgatttagcttcttacttttttccctttctttatactcattttgtttttataacctttggaagatatgtatgggttaacattttaactagatgagttcatgggagtcccagttttgggaacctttatacgtcattacacatctagagaaagcttctggaggaggatagtcttcttgtctaagtcatagtgttgtgctctgtgcagggaatttcagtttcactgaaagattagtggcaaagtatgcaggagcaacggcaatgtactttgtatcaaagaaattgaagaagaaatataacattacagatgaacgtgcggctctttacgatgctgcagagacatgggtcgatgccttgaaagagcgtccataccttggtatgtccaacttctaatctaatactgaatctagtccctgctttctggattggtccatgattgtagtttctaatatcaggtgggtcaaaaccaaacttgggcgatctcgctgtattcggtgttctgaggccaataaggtaccttcgatcgggtaaggatatggtggacaacacacgcataggtgaatggtattctcgaatggagaacacggtcggagaaccttctaggatcaaagaataaaggatcattggtcgtatctcttagtggaaatatgaattgcataatgaatcgctgatttcacgggcgtaacaatattttaagctttaggactagagaaggaaacaaagaaactaaaggaaataaacgtctcttctttgtgaatgaaggattttgaatactgtgagtctgtgacatgcttggtttggtcactgttgctattactaaaaagtcgtttctttggtttctttcacattttaaaagattcattgatcagcttgttctctgttttctattgactgatgtttatatgaaaggacaacaactcaggtggtccgattggtaatcgtatggtcgaacaatgataatatattggtggaatgaataaagttttgcaattcttttcttagaaaaatgagtttgaatggtttatatacatatgtatgacccaatgatagttgtaacgtggattttctttgtggaaagatattatctacatatgtatgatagcaacaattttggcgtctctaattttgaaccaacctatgagaaaattttatagattagtacatcatcgttatgaaattgaatgtcaaacacaagcattaggccaaataatcggcacaattagacggacaggcatgcaattagtgaacatgtggtagtgccaaaactttggcattctattttcgaaaaatctcctcactatataaacatgtttcatcattcaatctcctttgatttttgctcacaataaaataaaataaaaagaaaaaaaaacaaaaaaaaaacaaaaaaagaaaaagaaaaaagaatctataaatatactgttcaattttttttattttttttttattaatatcccaacggtcgtggggaagaaaatattctgattttgta

SEQ ID NO: 1787 - DNA, 3000 bp, Unknown
  misc_feature (1)..( 3000): cDNA_ID_3064259_gDNA_ID_1620448_Annot_ID_157370 3000 nt of promoter + ATG
catcatcgatcttttgcaactgtaagacaaggggccttcgagtaacaatgcctacaaatagttaccgcaaatgcatattgtcattactcaaggaaataagcaatttcataattaaaactaagtaagaagtgttaacactgtatttaccagatccacggggtaaaaagtcctttcccacgatgctctccaggactgaagacttccctgagctctgtcaacacaataaggatacaacataaacttaatgccacatagaattatcaaagtacagaaacccctctccacaacaatcgtagcttaaattaaatggttcaagaccaactagtgaaaaaatatccaagtcaaagccaagtcaacattcctcaataccaattgcttgcaaagctagttcatagtagaagctattaaactataattcctcacgatccggatgttgataagcaaaaacaacgaagtttagggcaaatttatccgaatacctcagctcaatatcaattccgaatcgcaaaaaaaacgaacgaatcgtgagatagatcgtcaagcatataatggaaggggaaggagatcgagatgcaaacctgaccaccaacgacggcgatcgcaggcaaggaatcccaaagagtaggtaaagcgctggagtctccatggtctcctaaagccgtgcaagctctctgtatcttgttaaccagagagatcagattttccatcgtcctctactcctcgtttccccaatatcaaatgagaagcccaaaatacagtagctgctacaacagatcggcgagatctgatacctccgccggtaaaatttattgcggaaggagtagatctgcgatgcgacggtgagctatggaaccagagaaatagagatagagagagatgagtttttgaatttgagtcgatgaagaatttttgcttgctagtgttgggaaaaagtaaaggggaagaaagcggtttatataaaagccaatacagggtcttttcttttccaaagaaaatttgaaacggcatggtgtttatttcgagaattcaaagacgacgaggagttgaccaaaaacaaaataaaaacgacgaggtgtgtcgtatatattcaaccaatcccttaatattccacatctctctaaccaggtaaagtaatgataatactattgcatgcatgaccaaccatataaataaatataacaaggtcgattttcttgtaaaagaatgtaacgagttaaaattcgaataaaaaaactatcacttattagtagagtaaagtgatttcatgtggaccacgaacatcctcattacgattgcagttcaaacggtccatagattgaggattcaaaaaaaagataagagacgttaaggattatgattgtttattcaaaaggatgacactaaacaacaaaataactgtagttttgaaaatttgaatgtataaaataaagatcttttctagaacaaacccactaaatctgactagtaatgtcacatcgattttagatagcgtttgcattttggcaaatactatgtttggttggtgagatccaaacgctttttagaaatgtataaaacatagcactaacacatttttaaaccttatgtattgtttacgcaaatacacgttatttattttccagctaagtggtgaaaaaataaaccggttcacatttttttttttaaatgttactaatgttgtgtttgtctacacaatttttttaaaaaatgttactaatgttgtttgagacaaacacaacgtgtaactttgtatcctacatactcttgtatcaattgttagattttatgatgttcatacgttaacaaatatgtatcatgtgaccaacttctatccctcaaattagaattttgaagttagtgaaaacgtgatgtaaaataggtttaacatatgctttatgggaatatgttgagactaatatgaaatacaaatgaggttggagtgagacatgctatgtaatatatttaggtatgtagactgtatgtctccgtagcagctgcatgaatttagcttccaaaagcacatatacttgcacgggtcacacggtttatttgcagtgtaactttttcgaattgcgattcttgaacaaaatctctaagagtactcttctactactttctgatgtttttcgtcatatgtgagtggaagatgttggtttagtgtcgggttgtgtagagaggacaagagttagaccatagacactcaaacagtcaaaccaatctattataaatagataatatctctccggtttagtatttaagctttctttgtataccatttatgtttaatgaaggtttcgcgcttgttgatacaatctgaacgagatctaaagaaaccgtaaaaacatttagaaataatacatctccaaaaaaaagtcattcggaaaaacattttatgatttaaattgatggataatttgttctcaacttatacatccaatttccgaccaattcaaaacgaaattcatcaatactttaatttcttccttttttttttttttttttttttgtcaaccgatataaatttgaactcaaaagatccaatcccgagagatattgtttacatacgtgacatgatgcggtacggtacgaatctttcgtgccaacttatccgcttttacatttgcactacgagaaattaaagataaagagaaatttatgaattcttccctatcactctacaactccttcaaatacactggaaacgccggccattcggttggaatcggtgaattggtgaaatttttgtttctagaaatcaactaatccgtcaaagatggtttattcccttaatgatgaaggaaaatgggttctcttgttgctaataaaataatggtatttattttgtttcttagaaagaaaaaaaagactaatttaatttggttggtcacacacaaccgttttcatcggaagaagaacaagttggattgattttgctttggatctcacatctgagatcagattaatctctctgtgaagtcgaagaacgaaaccctagttccc

SEQ ID NO: 1788 - DNA, 3000 bp, Unknown
  misc_feature (1)..( 3000): cDNA_ID_3064269_gDNA_ID_1620448_Annot_ID_157361 3000 nt of promoter + ATG
tcctattttaatttaatgcttctttttaaaaaaattgtagaaaataaaaagcccagaaagagcccaaagaacgcagcagagaaaaaaaaaacaaagaagaaagaaaacttgctcaacgacgattcatcaatcatcatctccgatcttcttccaaatccctccggtgaaaaagacgatgtacgtaagagcacttccgacgacggatgtgaatcggaacacagagtggttcacatatcctggtgtttggactacttatattctcatcctcttcttctcttggctcctcgttctctccgtcttccattgttctcctggcatcgcttggaccattgttcatctcgctcatttcaccgtattattcccgatctcctccgatccaatttcgaaattgttggtttctagatttgaatttttgagtttttttgttttctaggtcacgtatcattccttccattggaagaagggaacaccatttggagatgatcaaggagtctataatagattgacttggtgggaacagattgataatggcaagcagcttacacgtaatcgcaaatttctcaccgttgttcctgttgtcttgtaagttccttctctcatatctcattaggattttgttttgcatcatcatctcttgttgatcttgttcagtatcgaaaaattgaatgccttaccttattttctatgattgtttctgtatttggtgtaatttttgcttaagttatgttttagagatacattgatcttcgtttccctacctacttgttctttatcttattgtagctcattttacatctggttatatagagatgctagtcaatgagcttaattacaattctattcctaggtgaagtggttgttttgacaatttgatttgcaattattactacacagaatacattttgacatgacaatcagatacacaagagtcaagacactaccgttcttctcattttgatttctgtttgttgactagtgcttcaaatctgttcactgattagggttggacctaagtttcctactatgattaaactcgcttgattattaaggtcttttagctagtgctcaagagccttggatttagatttagatttagacattcgtacaagacataaggtctgttatgagtttgctgaatctctcttaaaagaagcactactagattatgtgtagtggaatacctcaattgtgttgtgtgtgacgaatatgtaatcaatgattggatctttgtgacataaaagtctgaccaaactttgtatgtaggtacttgatagcctctcacacaacagactatcagcacccgatgctctttctcaacacactggctgtatttgtcatggtggttgcgaaattcccgcacatgcacaaggtccgcatatttggaatcaatggagaccaatgaaaaaacttgagaaaacaaagaaaaaggtctgtgtataatgcgaatcagagtatttggaatgtggaatccaacaacaaatgccatcatcatcattcaacatgtctgtactatacagacattgaatcccttaaccggagaaaatgtgttatttggtcacatcccatcatcgcatattcaaacctttctactctttgtttggggcttctaatcaattcatatttgatctcttttgtggttctcttagtttcttatttgtataatcccaaaactggttacaacagaaagttgtttagcgagcaatctagggtttgaatgaatagttggggaagatttatttatatataccgtttttgatatatatatatatatcatctttataactaaatccgatgattttgttgttgttggtgaattacgttagtgacaagggtaaagacattttagcacacgtgaggtaatgtattgagctcaaaagggaaattgacaaaatcgtgttcccaccacctgaaaacaatattttttttttatattcaaatttactgttagtgtgtaaatgaataattagatgacattaaaccaaattaaaaacaatagggaatttttaaaaacaatttgtccatttgtaccctgagttatcaccttgttcctaattgtttagtgaataggtgggtaacatatatcgatattgactcacacaaaaaagactagaatttgttcatctatcaataggcaaataactaaaacaaacaatgaccaaatcaaaacgtggaaaaacaaaaaaaaataatgggaaagatcaatttttcttaaattaagatgtagtataatgtcgtttatctcaaatcaagagaagaaaagtaaaaatacattaaagaaagacaaatcaacatatgattattgaaataaaagtgggattagaatattcatgttgactaagtaagtgcaaacaaatgtttgactatttcaaaattagttttttaataaataaaaaaacaagagagaagaaaaagacaaaagaagaaggaaaggatctttgttctgttttatttgtttctctcttcctctcttcttcttcttcttcttcgtacaatcgaagaaacaaaacctctcaatttccgaatatctcgctcttaaaccctctccaatatctttctttcaaaacccaaccttttgtttataaaaaccttcgcaaggatttgcgactttaagaaacgtgacccgaatcgtcgcaatgtttggataagagttttaaactcattcgtttcgatgcaatcattttgaccagacaaagactatttataagaaagagcagaattttgattcaaacccggtttgattttggtgaagatgtaagtaaatctctcataaactcttcgttttctctgttgggttctttgctttacccttaagtaatctcctttttgccgatggtattgatttgccatgagtttatcttactacttccttttggtgttacgtgtggattagttttattcgaaccatggttgcaaatttctgtcctttttcagcaattgtgtccgatatttgactttgtgaattctgacgaaatctgtgtgtttttgatcagaagctgtgag

SEQ ID NO: 1789 - DNA, 3000 bp, Unknown
  misc_feature (1)..( 3000): cDNA_ID_2105165_gDNA_ID_1620448_Annot_ID_157363 3000 nt of promoter + ATG
cattaattttccaactacaaatctttcttccgattttttcttgacttgtgtatttaataattgatggaatcattaataacttataaattaatttcttaaaaagcattttgataattgaaaagtgtgctctaaatacaatattccgggtcattatgttttgatttgtcgactgcttttttcaatttttaaatcctcgtaataaatttaatatattatttttcagtctttaatgaaatgtaatttggtattattagttactaacatttaaaagaaaataattggcttgtaaagaacgtatggaatgtgtcgagtatgtgtgtatagtgtctccacttggatctttcttacttactccattatcttcttctctctctttccctcatctcattaatggcgagctctacatctttagcgatagttcttcatcaatcttccaatcatgacgaactcttcatgaagcaaactcttcaattctcagaaaccctcaaggtttgtatgatcgttctctctatctctttctctcctcaaacatagattgatcaataggcaattgtgattttttgtcttcattcaagattcatcttctgttctgttttggtgttttaaggatttaaagaatctgcggaaacagttatactcagcagctgagtacttcgaaacatcttatggcaaagcagaacacaaagaaacgtaatcttacttgtctttcttgatactaacgatagtatttttgaactagtccatgtgtttgttgtggcgagtgattttgatgaatgattgcagagtgatagagacgttgaaagagtatgcagcaaaggcagtagtgaacacagtggatcatcttggttctgtctctgacaaattcaactcttttctctctgataactcaactcatttctccaccactcatcttcgtttatcttctcttgaacaagtaaacactcgaaatcttgaatcatgaatactcttgaaactgtcttacatttggtatgtgttgttgttgtagaggatgagactatgcagagattacatggggaagagtggcactcatcagcatttgcttctatttcaatatcctcgccatcataagcgttacttcttccctcgtatacctttttaacctcttttccccctcacacaattgatccgttcaatcataatccgcccttatatcgatggttttttttcacagaacaaggaagaggcacaagtttctctgcaggagatgactcacaccggttcacgagtggtaactaaatccgtttatctatatctgattgtttagtttgcttctgtttatacgatatctgaatctttctcctgatctgctgcttgaaagctgttcgatcaacaatactagaaaacctcccaaatactgcaaggtataatcttgattctcttcttcttcttcttgttttgttgtttgtaatacgattggtttgtgaaatgcaggaaagctaacaagacaggaagcttctcttttgcacctatcgtacacaacaacatcaacaacagaacaccaagtacttactactacaataactaagccgccatctttctttacttgactttaatcagaataagttcaatcaattaagtgtgtgtgtgtgtaatgttgcagataagagatcaaactctcctatgagattccctctcttacgttcaggatctctactgaaacgttcaagctccccaagccaaccaaagaaaccggtatatatagataatagcacttacaaagattattttacttcaaaatttcaacatctttggttagttaattacttttgctgctatcttttgtgtattgtaaaagcccttagcgttaccggaacctcaaagagctatatctgtgtcgagaaatacagagatagtggagataaagcaatcttcatcgcgaaaagggaagaagattctgatgttcaaggcattgatgagtatgagcaagtcgagaaactaaaatctctccttgtatttgataaatgaaaagatttgtacaaaactaatgtgaaataagagagagagatgcttattttgtcgatattagtacttttctttcagatgctttagttgcaattcaacagaaaccatacgaaaactattttcactgttagtttcgtcactttcttctacacaccgctctttttatctttgacttaagatagtcaaaatcacacgttaaggtaatctctctttatttctttaaggttacatccaaaaatatattagtacgagccatcaatatttttctaatagtgcaaataattatttcataatttcgaagttaattagtgaaaaaatttctttgttaacggtgatggttaggggtggacatccgggtacgcagatcggattcgagtaaaacctgattgggtacgagtcattcggatagataaatttatgatccaataaaataaatctaaaatattggttcggttttggttcggatcaattggctataattttcaggttcttttttggaatcgaaacccgaaatttcaagtaaatacttggattttcggattaaatttgagtatggagtaaaatttatatattcgaataaaatatttagatacgatcaggttcggattcgtattcgatttcaaatccaatttttcgggtcagttctgagtcggttactcaggttccggttcttttccactcctaatgatgtaatagaagaagactggcccaacaaaagctcattgtctaattaagaagaagaaacgaagtaaccaacggccacgattactccaacacaagaccaaatctgattggttgacattatagatcgtcgtaagataattggtccacgtcatctccgatgacatagttaaatttcttcgtcttccataaaaagcgactacttcaccatcaccttcgggcactggacctatttaagcatcctaacttcttcttcaaagcttaaaaaccagaaaacaaaaggaagctctctgttcaaatcaaaaagagagatcgtacgcaaaagtttccgatatg

SEQ ID NO: 1790 - DNA, 3000 bp, Unknown
  misc_feature (1)..( 3000): cDNA_ID_2143893_gDNA_ID_1620448_Annot_ID_157369 3000 nt of promoter + ATG
gttccagttttcttaatgtacgacttatcctcagcctcacaaagaaggttcaaagctttcaagacaacaactcccaacatgaagaaatggattgcgaaaacagtgagacgtttcttatagagaacgtagatccacgtggcggcgagagagaaatagataacagagaataagaaatagaccttaggaagaacagttcttccagcagagagataatcacgacctccctttttaccttcaaggttatacatagcggatctaacatccatactgattttgacctgttggagacaattagcgaagacgagagagtactgatccgcatcgttctcggtgaatacggtggagaatctgctcttatctcctcccttgagattgttgaaggtgaacacatgcttaacgagatctgattgtagagcgcacgtgatctcttcttcttcaagctgttggatcacatgaacccaagcgtctctagtgcagagaaagaagcccactttggagagatcgagatcgggattgctgttggaaagccagatcttggaagcgtcaagctcaagacgaccgctgtgagtgaaaccgaattcgtctaaagggatgattggacgatcatcggatcggatctctgatttacgaatctcagccgaagctatggagatggagatcaagagaaggataaggatcgatgagaagcgtgaagagagatccatgggaactagggtttcgttcttcgacttcacagagagattaatctgatctcagatgtgagatccaaagcaaaatcaatccaacttgttcttcttccgatgaaaacggttgtgtgtgaccaaccaaattaaattagtcttttttttctttctaagaaacaaaataaataccattattttattagcaacaagagaacccattttccttcatcattaagggaataaaccatctttgacggattagttgatttctagaaacaaaaatttcaccaattcaccgattccaaccgaatggccggcgtttccagtgtatttgaaggagttgtagagtgatagggaagaattcataaatttctctttatctttaatttctcgtagtgcaaatgtaaaagcggataagttggcacgaaagattcgtaccgtaccgcatcatgtcacgtatgtaaacaatatctctcgggattggatcttttgagttcaaatttatatcggttgacaaaaaaaaaaaaaaaaaaaaaaggaagaaattaaagtattgatgaatttcgttttgaattggtcggaaattggatgtataagttgagaacaaattatccatcaatttaaatcataaaatgtttttccgaatgacttttttttggagatgtattatttctaaatgtttttacggtttctttagatctcgttcagattgtatcaacaagcgcgaaaccttcattaaacataaatggtatacaaagaaagcttaaatactaaaccggagagatattatctatttataatagattggtttgactgtttgagtgtctatggtctaactcttgtcctctctacacaacccgacactaaaccaacatcttccactcacatatgacgaaaaacatcagaaagtagtagaagagtactcttagagattttgttcaagaatcgcaattcgaaaaagttacactgcaaataaaccgtgtgacccgtgcaagtatatgtgcttttggaagctaaattcatgcagctgctacggagacatacagtctacatacctaaatatattacatagcatgtctcactccaacctcatttgtatttcatattagtctcaacatattcccataaagcatatgttaaacctattttacatcacgttttcactaacttcaaaattctaatttgagggatagaagttggtcacatgatacatatttgttaacgtatgaacatcataaaatctaacaattgatacaagagtatgtaggatacaaagttacacgttgtgtttgtctcaaacaacattagtaacattttttaaaaaaattgtgtagacaaacacaacattagtaacatttaaaaaaaaaaatgtgaaccggtttattttttcaccacttagctggaaaataaataacgtgtatttgcgtaaacaatacataaggtttaaaaatgtgttagtgctatgttttatacatttctaaaaagcgtttggatctcaccaaccaaacatagtatttgccaaaatgcaaacgctatctaaaatcgatgtgacattactagtcagatttagtgggtttgttctagaaaagatctttattttatacattcaaattttcaaaactacagttattttgttgtttagtgtcatccttttgaataaacaatcataatccttaacgtctcttatcttttttttgaatcctcaatctatggaccgtttgaactgcaatcgtaatgaggatgttcgtggtccacatgaaatcactttactctactaataagtgatagtttttttattcgaattttaactcgttacattcttttacaagaaaatcgaccttgttatatttatttatatggttggtcatgcatgcaatagtattatcattactttacctggttagagagatgtggaatattaagggattggttgaatatatacgacacacctcgtcgtttttattttgtttttggtcaactcctcgtcgtctttgaattctcgaaataaacaccatgccgtttcaaattttctttggaaaagaaaagaccctgtattggcttttatataaaccgctttcttcccctttactttttcccaacactagcaagcaaaaattcttcatcgactcaaattcaaaaactcatctctctctatctctatttctctggttccatagctcaccgtcgcatcgcagatctactccttccgcaataaattttaccggcggaggtatcagatctcgccgatctgttgtagcagctactgtattttgggcttctcatttgatattggggaaacgaggagtagaggacgatg

SEQ ID NO: 1791 - DNA, 3000 bp, Unknown
  misc_feature (1)..( 3000): cDNA_ID_1009643_gDNA_ID_1620448_Annot_ID_157366 3000 nt of promoter + ATG
aaccaagatgatccactgtgttcactactgcctttgctgcatactctttcaacgtctctatcactctgcaatcattcatcaaaatcactcgccacaacaaacacatggactagttcaaaaatactatcgttagtatcaagaaagacaagtaagattacgtttctttgtgttctgctttgccataagatgtttcgaagtactcagctgctgagtataactgtttccgcagattctttaaatccttaaaacaccaaaacagaacagaagatgaatcttgaatgaagacaaaaaatcacaattgcctattgatcaatctatgtttgaggagagaaagagatagagagaacgatcatacaaaccttgagggtttctgagaattgaagagtttgcttcatgaagagttcgtcatgattggaagattgatgaagaactatcgctaaagatgtagagctcgccattaatgagatgagggaaagagagagaagaagataatggagtaagtaagaaagatccaagtggagacactatacacacatactcgacacattccatacgttctttacaagccaattattttcttttaaatgttagtaactaataataccaaattacatttcattaaagactgaaaaataatatattaaatttattacgaggatttaaaaattgaaaaaagcagtcgacaaatcaaaacataatgacccggaatattgtatttagagcacacttttcaattatcaaaatgctttttaagaaattaatttataagttattaatgattccatcaattattaaatacacaagtcaagaaaaaatcggaagaaagatttgtagttggaaaattaatggagcagaaagtagagaagaagaattatttaacattttgttaattaaagagaaaacaacttctcaacaattttgatattcttgtccctctttcttgaataaaaaaaataatacacataatatatttacaagcagtgggacacaagaatcaaaattcaatcacggactcatttaatggagttgcctttatgagccagaaatcattcatgtgaccataacatataagttgcattataaccagacgacaaaagaaagaaaggacagagctaaattatctgatgaatcaaatcaactgtttgggaaaatactagtgatgactgaggcgtgtaagtcaaacaatggtaacacttgaatgggatttacaagatacgctcgagctctctggtgtaactgagagtctggttgatgagttgaagtgacggtatctccttgcacggtgcggtttctctggttttttggaagacaactaacccgtctttaacttcccactccgggtgctcctcgttcacatatgttaacagttgttgatcagacgagaagagtaacatcttacaaccttcactgattgagagatgatcgtatgctttctcactgcatccagctatttcatctctacagataaacaatgatgttttaagtcacggcaatgagctaaagaagagaaagggtcaaatgacaaatgaagcctatttacctaatggtttttgccaagagatccatgaaatagacgtaagtctcatcaggtgcggtttgtctagcactcaacacacggttataagcaccttccatgaaggattgctcgagctccaccgcatgcttgatgcaaggattctccaaggttgcagatgaaagtaatcccagttctgtgtggaattcagctattctgttctgaacaagcagtctcagtaggttcaaccccatgattagattctcttgcggagatggcggaatacgattcctggtacatagaaaaaacagagcacacgtaagcaaaagcaatgcattcagtgagagtgatataagataatgatcaaacaactctaaatcaattggttcaacttaggctctctactcattaataaatcaaatctatattaaactttgacattgatatattcaaggttttatctattgatccgcattgaattagggctaaaaggaaacagtaccttaagctgagacaagagactggaacaggtatcgaaatcttttattataaacgcagctttaaacctctcgaactgctgtgaaacctccattagttgcggatccatctctttctctatgaatttttctctgtcaaactggcttcaggaagaagaagaattgaagaataagattgccttttctaattgggccgtacatgggcctgttgaatcagtaattgaatgggcttaaagtggggaatgtaacccaatagaagcttccggggaattttaatacgtgttatacagagtcgaaaacttgatgctgacacactcactgtctttctcgtcaacgcgtttttggtgtttggtccacaatccttagcctctaagacaaatcaacccaaattttcaaaacataaaattaattagttttgaaaaaaacaatattttaaaattagatatttgttactatcggcacaaataaatctcctctcaaaagtctgccacgtcataattgcaattgttccgcgtctctgctgctacatgctcattcactcgcaaatcgcaattttcttcttaaccaaatttttatacaaaaaaaaaagctcagacagaagtactaaatggtaaatttgacataattaattggtgtgtaattttataaatacagaagtacttgtgtcttgtatttattagtattccttatttaataaattacttttcacttaatcatccaactttgtcagattcacacgcaaccttgaaaaaataaaatagaatggtattgtgactttcgtggaaatttctacttagatgacacagttgctccaattaaaagcttacaactttttcttcatctttctttatatttctcacccatttttcaccaatttctctccacttaaaaccaaccccaattctcaccaaaaatcgcaaaaaagatttcaactttcgataaacccagatcgaaaaatcagatttttccagatcaatcagagagttagag

SEQ ID NO: 1792 - DNA, 3000 bp, Unknown
  misc_feature (1)..( 3000): cDNA_ID_3064275_gDNA_ID_1620448_Annot_ID_157358 3000 nt of promoter + ATG
tcaaatatgaattgattagaagccccaaacaaagagtagaaaggtttgaatatgcgatgatgggatgtgaccaaataacacattttctccggttaagggattcaatgtctgtatagtacagacatgttgaatgatgatgatggcatttgttgttggattccacattccaaatactctgattcgcattatacacagacctttttctttgttttctcaagttttttcattggtctccattgattccaaatatgcggaccttgtgcatgtgcgggaatttcgcaaccaccatgacaaatacagccagtgtgttgagaaagagcatcgggtgctgatagtctgttgtgtgagaggctatcaagtacctacatacaaagtttggtcagacttttatgtcacaaagatccaatcattgattacatattcgtcacacacaacacaattgaggtattccactacacataatctagtagtgcttcttttaagagagattcagcaaactcataacagaccttatgtcttgtacgaatgtctaaatctaaatctaaatccaaggctcttgagcactagctaaaagaccttaataatcaagcgagtttaatcatagtaggaaacttaggtccaaccctaatcagtgaacagatttgaagcactagtcaacaaacagaaatcaaaatgagaagaacggtagtgtcttgactcttgtgtatctgattgtcatgtcaaaatgtattctgtgtagtaataattgcaaatcaaattgtcaaaacaaccacttcacctaggaatagaattgtaattaagctcattgactagcatctctatataaccagatgtaaaatgagctacaataagataaagaacaagtaggtagggaaacgaagatcaatgtatctctaaaacataacttaagcaaaaattacaccaaatacagaaacaatcatagaaaataaggtaaggcattcaatttttcgatactgaacaagatcaacaagagatgatgatgcaaaacaaaatcctaatgagatatgagagaaggaacttacaagacaacaggaacaacggtgagaaatttgcgattacgtgtaagctgcttgccattatcaatctgttcccaccaagtcaatctattatagactccttgatcatctccaaatggtgttcccttcttccaatggaaggaatgatacgtgacctagaaaacaaaaaaactcaaaaattcaaatctagaaaccaacaatttcgaaattggatcggaggagatcgggaataatacggtgaaatgagcgagatgaacaatggtccaagcgatgccaggagaacaatggaagacggagagaacgaggagccaagagaagaagaggatgagaatataagtagtccaaacaccaggatatgtgaaccactctgtgttccgattcacatccgtcgtcggaagtgctcttacgtacatcgtctttttcaccggagggatttggaagaagatcggagatgatgattgatgaatcgtcgttgagcaagttttctttcttctttgttttttttttctctgctgcgttctttgggctctttctgggctttttattttctacaatttttttaaaaagaagcattaaattaaaataggaaggtggttgggtggctcaccgatcttagcctaaaacaatgattatcagtaactctgtctcaagactctcaacgcgtcactcgataaaccacgacgactcatatttttaatttattggacttttcttgtcagcttacatagaggcccattacaaaacacaccggttttccgacccgacccgtaccttttcatccgataatttaatttacattttcaaaatatgttctgaagttaattcttgaccatattagtaagagttatttcattttatttttgaacaaattttagctgccaaatttcgaaatccttttttttttgctaccaaattttccatccagtgcttccgtgaaaaatatttcgaataaaataccattttaaaaaacatcttcgaataaatatctaaaattatcagttttttgttcttctcatattttcaacttgatgaggattagatttagattcacctaatgattacaataaacacgattaagcctcgttggttttttaagacaaacttacaatttttttgttttttcttttcttcatcacacactctgtctcaccaacttattcaataaaagcaattggacttttaacacaaaatatattattcaacgacaaaatgatttcgtattaatgctatactatccaaggttcattaaatttgaactagctatatctttttattaaacttatagaatttagattccacaatttcttgatttccatgcacagaaaaaaaactttaaatagattactattccctctaattaaaatataagatgttataaaagtttatcttttaaatattaaaaaatattttgttagtttctatgaaaattaaatgtatttgataatttgtgatcatttatattctgcagttttttcttatgattagttaaaatttttaattctataaataatattttttagaaagaatgatcttaatatgtgtgattgttttaaacattttatattttgaaacaaaggaaataacatcgtatttctgaggatttacataatgttttttttttggtgcacctagcataatgttttattagtagaaattattcataacctgaaacatgtaattgcataaatggcctaaagtcagctgaaataaaatgaaaacagaggatacataattagtagaataatctcaaatataagagaaagtgcgttagttgataaagacagataatttgactttccgatttatttggccgccaacctttttttgttttgttcttcctaaattccctttctccgaaattcctttcattgatttcatcatcatcatcatccttcgttttttctctatcgatctagcagattctttcggggaccaaaatcaaaatcatggtggatcatcaatg

SEQ ID NO: 1793 - DNA, 3000 bp, Unknown
  misc_feature (1)..( 3000): cDNA_ID_3064319_gDNA_ID_1620449_Annot_ID_157409 3000 nt of promoter + ATG
cactagagaatactaaataccctaaatggatctcagtcacattatccattgaatattggttataaccgaacagaatatccataagtacccgaatggaaccaaaattatttggtcaattcctatacaaaactacatctaaacccaatacattttttcccaacctctaacccaataaattttgttaattttcaaatattttgagtcattacaattttgtcaaaaaagtctcggatattttgatgttttgtttttttgggtattttggataaaataatcgaaagtgaaccaaactgatatctattggagtggaaccaaatacaacctagtatttatgtattaaataattatgataatatattcaaataactgaattattatataaattttaccaaaacatgtgatattttaacgaaaaatgcgatactttaacaaaaatatatgacaaaaagacacgaccttaaaacaaaccgtaaatatcttaacaaaaatttgtgaaaaaaaaacacgactgtttagaagtgtaaaagacatttattgttattgttattagattccaagaagctttggttagatcatgaatttgaagaatttctttcatattaaaatgatgtatacgtagaaatagtttagagagtaaagaatttgaaaccattttccagattaaatttttgaattcatcatgaaacatataatttgtgtgaataaacaaaaatatgagaactatttatgaagaaggacaaatatatagagttcaaaagccacgaacatttaaataaacaactattcatacgaaaagtttgtgaaaaaaatgcaaagaaatatgatgaagagatgtaacttaaatgaatagatgcaactataaaaacacaaccgcaaactgaaaagatacgactatagttgaacaaatataactgtaaatataaaattaaccataaatattttaacgaaagatgcgataaaaagacacattcgtaaattaaaaacatatgaatgtagttgaacaaatataattgtccaaaaagaataaaggtaattattttaacaataaaatgcgataaaaaaatacaaccgtaaatattttaacaaaaaattacgataaaaacacacaaccatttagatgctaaaagatatgactgtagttgaacaaaatatatgtaaaaaaaaataaccgtaaatattttaatgaaaattacaacaaaaagacacaactatttacaagtataaaatatatttattttaattattattattattagattattattattgtactataagacttgtgcaatttcctttttgttaaaaggacatttataattaattaatcaactttggtctacaagaggtaaaggaaagacgtctggaaagtgtagtagtcatgcgtaccgagaaagttttgtttctccaagacgcaaactcaaccaaagacattgattgacactataagtagaaatataactccttagaccatctccatcggttagatactgtgtaggtttttcaacaatattatttaaatcagtttattataattaaattatttatttaaattttaaactataaaaagagaattcgaccaataatatagagacacgtggaaagacagtctctctaaatttctcaaaccagaaacgtctctaactctttctcctactttttcattattttatattttttcaatcaccagatactctccaagatactactgatggagatgctcttagaccatcgacgttcaacaatttttcacagatgtctttcatataaaataatattaaaagtaaagacatttcaaaaatagatgtctcaaatatttctgggaagacataattctcattctaaagacatttatatttctctctcttcttcttttatatttgaaaataatcatttaaaaatactcataaaaatatctaatgtggatgctctaagagcatcattaatggtagtttcttagcataatcttcacataattcttatgaatatttttataatggattttgaaaattttgaagttaagaatttggttaagagattgaaattttggcaatatgcaatggtagacttttaagtttgagttcttaaaaagaaaaaaatttgaattttttttagaaacattataattttaaaaagcttaataattattacaactcataaaatttgaaacatacatgacataaaaaaattaaaaaatatgacaaacaattagatttaatacttaatttatctaaaaattaagattaattgaattaaaacattatatttaatacctaatttatctaagaattaacctaagaaatattagatttggctcttatataagagtcattcttaacaattaattgaattataacattaaatttaagagctattttatctaagaactaatctaagaaactattaatgatggtcttatatatctgacctcacctcatgattcttaaacactgttaatatagtaacgaagctaggataaatcagtagtattcaatttccacatttatattttactgtttttttccgctaaagtatattgttcaattttccgagaaaaaaaacaaattaagttatactcaggaaagtacacatatcggtatgctaaagaaaagaaaaaggtacgatgttgtttataaaaaaaaaaaaaaaaaaagtattaattggttcttagaaaatgttaacgaaaacaaatcctagaggttcactttcgttggctactttaattatgctaaaaataggcgtctatcgagtgaaaagtatagattgtgacatagataccgcaaaacatatatgttttattccaaaacaaatacagaaaaaatgaaaataatattaatgatgcaaaaagtgaagagtaaactaaaattgttcccgaaatgacgcacgtccacatctgttggaaaaaaaaaacatcagtcatggatctattgtcttcgatctctatggaatgatcattatcgtttactttacgtcaaatcttattatgaaagattagtttgcatg

SEQ ID NO: 1794 - DNA, 3000 bp, Unknown
  misc_feature (1)..( 3000): cDNA_ID_3064310_gDNA_ID_1620449_Annot_ID_157421 3000 nt of promoter + ATG
ttcttatggtgtcttgaattatgatcagctgccccacaaactccacaatgcatgattcttttcttaccttttggctgcttcttagtaggagactcattcacaccgttcttccttttcttctcagcctttgtcattttcttgtcttcttcgccttctgttggaggaggtacatacactctcagaccattactctcgggccagaacttagggcccctttgtggaaaaaggccatccgtgtaattcttcctccacattgctgtcctaaaccagcaacatacaaagttctctggttcaagcttcttgtggatgatgacgctatatgcatgctcacatgggatgccacaaatttgccactttatgcaggtacaagtgtaagcctgcaagtctacacggtgaagatctccaccatgcctcacttcatacatcccattggtacttggagacaccttcgcagcagcagcgactttgtgctcaccagctaagaactttgtaacataaggtgtacaaacacctacaaagtaagagaaatatatgctttaaagggagtcaaggctatatcacatgttaagaatctgcaaagaacaaggcttaatagagtagctaacctgtgtgagtatgggattcaacagatcttttagcaatcctcaccatagccattcttctgattgtctctaacatcgcaacaaatggcttctctcttgccttgttcaaagatccgttgaaagactccactgagttgttgtcaacgtcttcacagaagctgcctatcttctggaatgccctaacccaactccttggttttgtcttcatcacagactcatagactttagtgtcatagcaccgtatcttctccaaatgctgcttatactctttctcattgtaagaccaatccaaattccatagcagtggttttatcattgttttactgccataaatcttcttcgagttcccataaatgtgttgtacacacatccggtgctctatcttgggtaactcaagttgaaccgctgctattaaacctgaaacaataagacaaacatttttttttgggaatatctggaagttcaggcctaaaggccctacatctccgagaggcgggacccacaccaggttaaattcatctcctttggagaagagatccctccctacgtgcctcgaacccaacacctccacctggaagatttaccactaggccaacaacaccttggtaataagacaaacattagctaacactaaagagacacaaatgacactaagctaccttttgcctatctgatatcatgatgaagccttcaccatcacttaatctgaagtcttctttcagcagcttcataaaccacacccagttatctgtgttctctactttaacaaccccccaagctataggatatatgcgattgtttgcatccctaccttaggctacaagtaactgtcccttaaccttattctttagaaaacaaccatcaatgcctattagaggcctacaagactccttccatgtccttctaagactgtcaaagcatacatagaacctattgaacatgtctttaccatcatcactcgtgagacattcaacttcaacccgtgaatccttgtttgcttcaagtatctcagccgcataatcccttaatcttgcaaactgatcatcgtactccttctcaatccattgcaaagccttctttctagcagactgacattgattcctagtgacacttatcttccattgttccctaatgatttcttctatctttgtgggcatgtaaaattcaggactatccctaatcttatcaacaaataaccgagctatatgcggcaccttaaacatctcacattctccattagggatacagctatatgtatcaacaaacttcctaatcttccacatattatcactcgggagaattgccgcataaattttccactcacacttagctccaccttttttaccgtcacaaccaacacaaatgaacccaattttatctttatcatacctgtattgctttatattgcatccggttttgagagcgtaatcaacaaccgcctctttgaacgcaacccactgaaaaaactctgcttgtggtacaaataaccatcaccacgccttatatctgtgtcaaatctttcggttttttcttcatcatcactctccgggtacatatcgtggcgaattggtggttcgtcagtccactcctttagcagttcttccatgtgaaactcatctctttcttcagcttcggaatcgacatcaccaacaagatcagggtcgtgaaggactaatgacatcgatcaaagcttctagggtttgggaaaaatcgatttgggtttctagggttcgtcgtgagaaatttgggaatttttcgatttggtttcgatttgttttttggtcttaaacgggttgtaattcgggtttaggctggttctaattagatttatttggttaaatcatcggtttggtatacagtaaaccaattaaacccagagctatggggttttaaatctcgaacttacgattcatggacattaggctctcgaactttcaattagtggggaaataagcgtttaacttctgtttcatgggtatatagatagaggtcaaagatcggggtttatttagccagatatgatagttatcgtggggaaatagaccgtttttctgccaaaaagatataccgttatcggtctggtaacgttaaataacgtcgtgtggattttgacctgattatgattacgtgaaatgaccaatcaacaatttttacatgtatacgaagttcacgtattaaatgactactttttaaaagtttgcgtattaaacgatattttctcgttttttttcccagctctaaccatatatatctcacataaaattagggttacgaagtggaccttttataaatagaggataagagaccatcatcgaaaactcaaagaaaaaggagacactagctaagaaatttaccttgcacttttgatctgtgttctcagtagattattcgtaccacc

SEQ ID NO: 1795 - DNA, 3000 bp, Unknown
  misc_feature (1)..( 3000): cDNA_ID_2046721_gDNA_ID_1620449_Annot_ID_157426 3000 nt of promoter + ATG
atctcttaatcggtgttctgaagaaaaaataacgtccgatttcagatctcttaataagttctcacaaaagattatcttttaatcaaaaagcctaaattttcttcaaaaatgatatatatatatatatatatatatttgagaaattcccacaaatagcacactttaaagtgttttggacaaaaatagcattacaaagttctttacacataaatagcactcaaataattatttcagaaatttctaaaagtgacaataataaaaccacaattttatattaaatatattcaaccaaaataaattagaaataaatttaaaatgttatatttgggttctctatttccaagttagggtatatatttcaactatttaaaagaaattttgattcattttaatattagtttatgatattatatttaggtttcctatttctaatttagggtatatattttcaccatttaaaagagatttttcattttaaaattagtttgtagtattatatttggggttttttatttccaatttagggtatatatttccactatttaaaagtttttttattcaatttaatattagattagtgtttgctctcatttttatttgggagattaatacaaatggtaataaaaaactttattatttaattaatttttagaggattaaaaactttatatgctatttttggaagtttcaaaagtatgtgctatttttggaatattaaagttttttagaggtatttgtgtcaatccccctatatctatatatataactcaccataaattttgatatatataaagagtaaaagattcatgagaagaaagatgaaggatcccgtgttaaaataaaaagaaaacatcttaatgaatgttcttaggaacttacattcaacaagatgttggtgattgactttaatgggtatttaaaaaaaaaaaaagctatttacattcaaccaactgatgaagatgttctaagttgttttagagatttatgtttttttcaggtaagattcttggtgtatgcgtaagatagatatcagagtaggatgaattggattttattaagaaatgtaaattgaatcaagagtacaaaggagccttaagatgatgtgcttgagagcatcttcaacctacctctatatttgcctctatactctattatagagatctctgtataactttgttatttgcaaaattgtacttttacttttatttctgattaaaatatataaaactaataatttggattgattttagaagttttggtttaagtatctattttaaaatttgagacttctatatgcaaaagagaaattatataaaatcttaaatatatagtttttttgtttcattccattatatttattttttaaaattatgtaatgtttctgttttctcaataaatatttaatttaaacaataacaagcattcatgaaaataaatgggttaatttgcaacttttgtaatttaaaggtactaatacaaaaaaaaaatagaatctatttgaattattcttttttagaggaaaaaatagagaataccattgaagtaaaactcatctctattatagatttcatctattttatagacaaaaataaggaaatgggttggagatggtctgagtgctactccttagaacttaaaagtaaaggtacgaagaggaagaaatatatacttatgctgatgtgatacattttgtaaaataacaaaacttaatgttacattactaatattcacttatattatgttttaaataattttaatatatctgaagtaatatttcatacctatattccacattgttttatataaaacataacgaatttgtacatatatgacattttgttatatatcataaatatagatgaatagaataaaggtatttattacatgtttcgtaatataaaaacaaacttcggatagcaatacaataatctatatttatatttttaattgactattgtcatatgtatttatctattaatattacaaattgtttttgtggcttctaaagatggtaataaattgattttgtttataaatttgattaattgctaatttcctaaattacctctacctaatttaaatattaatatataattattcattaatttttatatagtacgattttatatttaatttattttgaatttttataaaatacatataattaataaataatagattttttttatatatgatgtgattcaaatttttaaaaacatatatatatatatatatatatatatatatatgatgtgattcatgtagaactttttctttctcaaaaagagaaaataagaaatactagaaaacactagttaataaaactcaattattagggaaaaaaacaacaacttaacttttagtttttggtactcaccaaaaaaacttttagtttttggtgatgacgactagaagcggacaacttgtgtccaccactactatgagtgcattcttctccaagtcccgacctttcttgttccccgagccatttggatttttttttttttttgttaaaaggccttcttccatttggaaaattgacattactagttgacataatctctcgctaaaaaaaaaaagaaaaaaaaactaatgatttaaaatgcatgcacgtaatgtaactctgaatgcagactttatgcatgcaaattcaattcattggtcattacatatttaaattttaaataaattaaaaaagaaaatcgaattatattttcttggaaacggttgaaaatttaagatcattttcaaagtttttttggacccttcgtcttcgtcttcctttttaagtagaccaaactgatagtgagagtttacttcagatttctcttcttcgtctttgttgaatcctctataaagcttagctttctacttgtcaatctattttttcgtgcctactaagccaagttacgtatttaggttatttccaaagtaactcaggttagttcttgctgttgctttgcttcgatgaataatctcacagaaagacgaagggtcatc

SEQ ID NO: 1796 - DNA, 3000 bp, Unknown
  misc_feature (1)..( 3000): cDNA_ID_3064299_gDNA_ID_1620449_Annot_ID_157427 3000 nt of promoter + ATG
tgtaaaaattaagcctccatctagctggaaagtagcaagagaatgtctagtagttgttatgagaattatggataagaacaagctaagggaattagaacacgagcatgtttgatacgtatctaaattctcaattgattctgcatcaagtaggtgtagtagtagtagtagcctgttgatgaactctctcttcctctgtcttgcaggaaatatgccttcttagcaatgctaggtctggccgtttgcactactcatttgctattaccttacttcgcagctgagcctagcccctctttgtaagtttattgtttgatactttgattaatcttcactttgccatacatcgaggttgctgcttgatttgtggctcgacactttggttttgcaactttaaaactatagtttgtttttatgatttcgtaacatgtgtatactttcttcagataatgctttcaaaatgttgaatatcatagaatttgttaatctactcgctcaaactacaaattcacaaggtgatataacttttgattttggcgtgttacatcagtaagcattagtcctattctaaactaagttaaatttgccacttccattgacaaaataacctctcttgaaactcaaacaattaaaaatcatcaatctttgtaatagcatgattaattataaaataacaagaaaatactacgtatctaaattaatcttgaattatattaacacaatttttctttgctcaccacacaaaaaaatatatataaaaaatcgttttaccaaacaaggcaaataaaaaagatggatcagaaaataggcttggattttctcaaaaaagagaaatcaattcgctcagattgttcagcttcgatcatttggagaaataatcctcacttccatctaattatgtgaaactagttataaaattgattgtatataaataaataaaaaaagggatcagaaaattggcttggaatctctctgaaagagagaaacataaaatcgctccgtataatcagcttcgatcatctggggaaataatcatcacctcccaatcttttttccaataatataaaaactaatcagaacgaaaaaaaactaacatgcaaaaccaagaaaaaacaatttttgatacaaaaaaaacgattagggttcgtagaattaatgaaatgattaggtgatttatataggaacgttggtggctctgaccaaaaaaaagaaaaaacctacatcctccaagaataaaattagggtttatcaagtgggctgttctttgggcctattttgacctttttgcccagtaaaaaaataattgaagatggacctgaaccaacaaagtgtttttcaattttctgtagacgtacgagcctacgaggtggtctatagagaatgattcctcatcgtattactgatcagtgatcaatgtgacaaatgtgtataatgtatatgttataaataaaaggtaaatccaagaatgtataaaattaagtattgcattgtattatgttttttctcattatgtcgaaatgaagaatataacaatgtatgtttgatgactttttcaaacactccttgtataccagtaggggtgggcattggggtaagccgtttgtatttgggtaaaacccaatcggataccaatccttcggataaagaagtttaagatccaatagggtaaatctaaattatcagttcggtttcggttcggttccagtcgggttcagataagtttggtgtagaatttcaggctcttttggaaccgataccagaattttcgatttttaggtaaatatatggattttcgggtaaaattttgggtttcggataaaatttagattttcgaataaaatattcaggtattttcgggtagaggaatttaggacccaatagggtacatcttcgggttcagttttgggtccaattttttgggtcggttccggttcaggtaatcggatccagtttttttttccccagccctaataccattatcgtcaatgtttcctacttacttttggatccgctctcaagtgtgattcaagtaacttatagtttgaatatatatttaaacaatttttactattcagaatctaaatgtaaacattattaatggaagtctaaagattcaaattagtttaattgttgaagtattagagtatctccatcaaggagaaatccatttagtttctcaaacaaaaaaaaatattaatattttattataattttgttttatgattaaatttttattttagtaaaaaaattgaaccaattgaaagtaaagaaatattatgattgcatgtagagagtatctcatagtttctcacttgagaaactttctacattctctcttttttttaattattattttattagtgagaaactcaatattaagatactcctaatggagatggtcttattatctatgccggtttcactttttcgtttgcctaacattactcaaacaaaccaagaagcttaatccctaaataggtctatgcataattaggtttgctattgatagcctccacttagaaccacgtccgtcttcgtagattatcacgtgggttgtccagccaaagatatcactttaagatggttcacattgtatccatggtcaagtcttcatgaattacattagtcccttattatttttgttggtcatcaaaataaaagaaaatttgtaaggttatcatattacctcgagaaatttgagattttgcataattgtttgatatcaatcgatgcaagcaagatttagacgtttcttcaacataaaatttgtagacataaggtgaatttttagactgatgtagataatgctttcgttagcccctatgaatataaaattttaggcacaaatcgtagtcatgagtcaccaaatcaaatgtcggtactcggtacacttggtttgagatctctccctataaaatggaactaagtttacctgttgacaccatcctttctttccgactctacctttgttatccatcttattctattttctaaccaacgacaaca

SEQ ID NO: 1797 - DNA, 3000 bp, Unknown
  misc_feature (1)..( 3000): cDNA_ID_2046729_gDNA_ID_1620449_Annot_ID_157423 3000 nt of promoter + ATG
ttttgtcgaggaaaaagatgacccaataagtgaaaacgaagcttcggccaatgaatttgaagaagaagatgaaatagctaacaacgaggatgacgttgtaactgaagagactgctgctttagaagcaaataatgataatgagaagaaagattaaatacatattagaatggagttcagtgctgatgagattgcatatataacttataaaaagtatggagacaatcatggtttcaatgtaagaaaacaacggaggatgaaaacaagagagaaggtagtaaggcttctttatgtttgctcaaaacatgggtatagaaaagaacctaattgttgtgcttctttgaacactacgagagggtgttgggggatcaacgatataaggaattacttgctgattttaatatgatgcatacctctccggtattatgtgctactgtagagatgttctaacatgcagaggaactgtatacacacaaaagttttagcttgttccagaaacaatacatagttattggtgattatgttgccaacaaggttagtaagtctgagatgatatataaatataaagtatcttatcgtggtgtagcacgtgagcatttggtcaattatgatgttgcaaacgagacaatatgttgtagttgcatgaagtttagttttgctgggattttatgtcgtcattgttggggtcagattcccccacaagcaagaccgagccaaacagtctaagaattacaatcacctcatggttaaacatatgattggcccctagcctagaacaaaacacctcgggaccttattcgatcaaccgtctcagagagagttcaaaaaatggctcgggtgttaatcctatgaacacagcccgagccaatcgtgagaacgctgcggaaaacatctatatcgcctcgggagacagccaactgagtttaatggacagtcatcaagcgcgccccaagccggtacatactgtttgcccgaagccacctctcaaacaccaccgagccgtgagaaacacccgaggcaaagtcttgtaaaaatcattcattctcaaaggatcattttcggtaaaataggatcttttatgggactttcggaaatgataaaggagaatctttgaaaataatgtcgaataaggaaatcttcccaaagccttcggagaataaggaaaatatttttaagacgaatatcctctagaaccgacttaaagataaatggaaatctttcaagaatatcgctagagaggcggtttaacgaccctatataaagcgcctcagggacttcacaaaagggagatctttggatactcacaagaaacacataattatatacctagtgagaactacgaatggcttgatcccttcacaaggtacgtaggcaatccatcacggatgcagcaataccttttaaaaaccctaattctttctctgttcttgatcaaaaccctaatctattttacaagagattagaatctccttcgtaatcgagtctttgatgaaatacctaatgaagaaaaattactagatttgttttccccttttaaacaaatctattgtgtgaatcctttgttcaacataagttcttaaagagaatattttatttcctttaatttatcttacatttacaaaatatattgttgattatttagtatctgggtagtgatatgatgtctttcagtagatttattagagtttatatgatttattttttatttgaaccgacattcggaaatctttagtcaagttgtagggtttttttatattgaaaatcagtttaaatcatacgctttaaatttttgaatgtgaagaaagtttagctattgtttcgaatttagataattggtaataaattcatttccattttcaccaaaaaatagtaatactgaatattttaggtttgttttttttattgtaaaacataccattttcacaaaaaatgaaaataaaatttagtgcagcgaaattttttaatcaactaaagtgtctttttaaaacacactataatttataaacatcaaaattaatatttttaattatttttgaacgatatattagcaattatatataaaattttatatataatttaatataaatgttattctatattcaaaactaaaccaaatatataaaaactttctagttaaagatacatgagagtttcaaaaattatgttattcatatagatgaaggttgtagttaaaatgcgtattcatatgatggaaaaccgtgtgaaaaaaaaaaatatgtaaaaccatatcgtaggcacgcattacacatatcttgcaagttagaaagggcatcattatcagaatttgaaaacgtaaacgaaagcatttataaacgatcaagatctaatatttgtttatacacctaaatctcatcgtgatacaaagcttaatacttgctatttattaaagtaatagtttctctaaattataaactcaatccttttgtttgattattacaaaaaaaaatattctattctttattagtttctggttgagagagccagaaagaggactagaagcggacaacttgtgtccactaccatgaatgctttgttctcaaaatcccgacctttcttcttccccatgcgaaaaatcaacattacggtttattaaatctctcttgaaataaaaagaaacacaaaagaaagtaatgatttttaaatgcaactctgtatgtagactttatgcatgagaactgaagtgacatgttcgtttcattgatcactacatattggaatctaaataaacttttaaagaaaacaattccattaataagattttcttggaaagtgtcaaaatttaagatcatgctcaagatatgttggacctttcgtcttcgtcttcccttataagtagaccaattagatagtgagagttcacttcggagttcagagctgtcttcttcatctcttgtcttgtcctctaaaaaaaaattgctttcttcttgtcgttctattttcttgcttgtaaaccaagttacctatttacattcgtctagatcg

SEQ ID NO: 1798 - DNA, 3000 bp, Unknown
  misc_feature (1)..( 3000): cDNA_ID_2046770_gDNA_ID_1620449_Annot_ID_157412 3000 nt of promoter + ATG
ttgtatttggttccactccaatagatatcagtttggttcactttcgattattttatccaaaatacccaaaaaaacaaaacatcaaaatatccgagacttttttgacaaaattgtaatgactcaaaatatttgaaaattaacaaaatttattgggttagaggttgggaaaaaatgtattgggtttagatgtagttttgtataggaattgaccaaataattttggttccattcgggtacttatggatattctgttcggttataaccaatattcaatggataatgtgactgagatccatttagggtatttagtattctctagtgtgactgagatccatttggtttcattattgattttcaggtctaataagtataatcaaatatatttttgtaatttaatacatagatacaaatatttgttgaaaattagtttttttcgcgatatcgtcatatcctagtaataatattaataataataataatattattattaataataataataataataataataataataataataataataatatttcatgtatgcatgtatatataaatatttattgtgactatgggaatccttgaaagtgcagaatattaattactaaaaatgtagtaaatgaaacatatacaattggtaagtgtatgttgaaaatagtgaaaaaagagaattaactctctttttcttagcaaaaaaaacaaaaaaaaactaactaagtttaatcaaaaaataagtatgatttttctttttggaaactaaaatacatttaagtctaaaacctatgaaaaatactttttgttggggtaacagagataggcatattccgctgtaacaaataacggttttgccctcgatcatcttcttctttccttcttcatcgtttctttctcttcttaatattaccaggaattttggtttcaatttttttttttatcacaaacacccaataataacaatatatataccctaaagaatagtacaagaggaacccaaataaaataattaaacccaatgtatccaattaaattcgttttgatgagtgaaatctaaacccttatgagagtatagggaacccaaatgcttcaatcatagacacatatcgaatcaattatgaattttaattaataatttaaattattttgagaactttggatagggagttacttgtataaacttgatccatggagtagggtgtaaacgatgttgcaactagtggaataagtaaagaaataaaagggaaaataaaaatattttttgaaagctgtcaagggtgaaaccgtaaaattatataacgtaaaagtacctaaatttgtgagtactgtactgtgatgttcctatatcgacaaaagcacacactttaatgtgccgatctcgtaattgatccaactaaagtaggcttggtaaaaaaaaccaatgacggacaacacatgaaatattgctctctctcgctctctcttaattctttttaactctctcaatctctctcctcaaattggatatgagtttttcggtgagcgatctctttcttcctcatggatctggttaactttccagaacagatggtgaatccgtcggaaaatcttgcacaaaactaactgtatatcaaaaatgaggagtggagcccatattttcaatgtcaggatagctactggcttctatgcttttgatgaaaactttaatatcatccatgatgcagatattcatgaaagatggatgttagtgagaatgactgtcagaacccctgctattccgggtgttgcttttgcccaatacgatccaactaggttttaggtcacaatacatttacagctcagttcacgagcattctctcttgcttctttacaaattaagtaatagtaatgtttcatgtggttcatacaaccacggcgaataagatttgcacaacctaataattattgtagctttgttttttatattttcagagttcaaaattgaaccataatttaactagctacataaaaaacaatttcattacaataaaatgagcatatgaagttgtggtacaattgtaattaatagaggtttttcatatgcatttgcatatatctaaaggtcgaatatgacgatgtggagagctttttaatggtgattttttttacagaattctagaagatgacgaactaaacgaaatcatattcttggtgagtgcttctaaccttatagaaaatcttttaaatcttgtcttctaatgatatgcaaacttgtcatgttttctttgttgaggaaatgaatcaagccttgtaaattcattatcagttagtgacgatacaaagtggatgttgaaacttcatggctacagagatacttagttctcatatatcaaaaatttgcatatattcatatgttttcttccaacgattaaatgctttgagatacgactatattgtacatctttcagttattgttaattttcttaaaactagattcggaccgcatgttcgtgctggattatgtgtgtagatgtatttgtttggtatagtattcattaatccaaaccagggggaaaaacaatgctttataggagggtcaactgaccccataactttttaaaacttctatgttattagtagcctaaaacaatttttttgaccctaatacaaagattaatgttagaacatgaaacaaaaaaatagttcaaatacttgaaatttagtttcatagcatgcattaatgaaacaaagggaataataaattattaaacatgattaaggtgttcttagttttacacgtgggggttgtcaaagttgaccaaagcgttctcactgtttctttaatgagaaacaaatcaaataacatgggaacgtcagagtaaaactcgtgtcgttttgataatttaacaactaacgttgcgctgttttttagttacttagacacggtgagaaacacaaaaactatagacgacgaaacgattcctcaaacgcagaagtcttctccttctctcgacggattaagcttttacacagaagaggagagat

SEQ ID NO: 1799 - DNA, 3000 bp, Unknown
  misc_feature (1)..( 3000): cDNA_ID_2046755_gDNA_ID_1620449_Annot_ID_157416 3000 nt of promoter + ATG
tcaaatttatttataataaatgaaaataattttaaatacataacaaaagagttaagtataataaatgaataataataatattatatacaatatatgaagtatttatcactataatatttttaatttaaatattgtatttgaatgtaatacaaactttatgcatttataaagtatcgaaataggtaaaacaagcacaagataagagtattagatccaaaatatgcataaaaaaaaataagagtaaattattaaaatactgaaatcgagtgacaagattaaaatcaaaaccgagaatttatggaataacgaagataaagatacaaaatgatactaacatttccattatagataacaaaataaattgactaacacttttttatttatagatataaaagattatagtttagaaaagacagaaacattttaaaaggttacaattgagttttctgtagtagaaaaaacttcaaaatcattctagaaaaactcaatattatacactaaaagagaaaatgaataactatgtgtcatgttattctttagttgtacaacgaaacacaataatgtgcaatatgtgcaacatatcttacattaacgcgtaatcaatattaagatccaagcaaaaaatacgcttaaaaattcacaatttggtcaaaaattcagtagaattataacattttaagtttttgagaaaaaatgttggattacaacactatattgatatctaaaaaaagaaaaaacatgaacgctagatcacgatgaaaggattaaaatagcattgataatgttatgcatagacatgaacaataaggaccacattcttttggttggatgtatcaatatcgttgaataacatattaatttgtttttttatctaaacattatattaggtcatgaaatccttaaaacataaatataagatgctattatctgagatttttcatatattaacatagtataatattttattattacaatattttatattattacaatattacatataaattatttttaaatttaagtcatttaacattatcgcaactattatcatttttagcatttttattgtttcttaccactacaaatgtcaatactacgtttaaccacttcaattcatatatagtatttatatatataaaattacaaaatataatttaatagaattatttacttattcatttttaagggcacattgttcaataaataaaatctataaagtttagctttacattttttttaaactaattataattttaaaacttatgaagttttgaaaattataaattgaattttacaagaaatttaaatattataaatatataaaaaatatattaattcgagacgatatactacgggagaaattctagatataacaatcaaaaatttcacccgtcgtataagtttaaatattataaatatttaaacttattataaagaatcgagatgtattttaaaaaaattaaagttttaagtgtatttgttttgttaatattgttaattttttttagtatttaagattgtataattatattatgatttttaattttaagattttttccgtaatataccatcccatgttattatccacccaaacccgtctcacaatataatcccgtcccgtaaaattaaacataattttgtcattttcttataaatttcaaatatttataaaaattgaaactttaaaataaatttaatatcgatatgaatattgttttctggaatttttaaactattacaattaaacatataatttacataatattttttaaaataatctacagattctataatcaatatgtaaacgatattagactttacagatcttttagtaacttcaccttaattatgatagaccttacaaacaaataaacgtaacaaaaaatagacactaaaaagatctcaacaacaaatctaaacaataaataaataaataaatatatttatatatatatatatatctttaaattataaaaaatcacataaatatctttgggattcaaattttaataattatttgaacaatttttctaaactacatcaaaaccaaatatattgaagataaaaaatacaaacaggaaatatattaatttaaaagatacaaaatatttaacaagaaattgtgttattttttgttcaacgaattcgatataaaatcttcaaaatgatccgatattgattcttattaaattgaaattgtaaattgactctataaaaatattattaaaaagaaaaagaacagtttgatttttagttatcacgggacggatttatatggcgtgatgggtttagaggagacgagtttacatggtatgacgggtttggatgagacgagtttatatggtgctatgagtttagatgggacaaatttggataccacaggtgtactcctaaaattaacaatcaaattacaactatacaatactaaacaaaacaaacaataataacataacaaatacaatttcaattttaaatttttagttacaaaaaaatacataaaatcaacattatagtatctatactattaagagagaatgatgagcagtaaatttccaagccacataagccattttttaatttcacgttacaggaaaaaaaaaagacaattaagggtataagcgtcattaaccatgcgttttcgagccgacccgagccgcgtcctgattcgatccatttggcagacgcgcggatcctgattcaaaaataatgggcctcgattcggtttcttctttggcgtttttatcacagttggcccatttgcactcttaaaattcatttcttgctcaatattttgcctcctctccaagatattcactgcaaagtgaagatattctgcaaatcacaaccaattagggaagattcctatattctattgagatagtatatttagttatgatttcatatacctaaaaatctggtgtcgctctcgggtttcagaactaagtcctaaccgtataaatacacaagcaatctcatcaattctaaagcatcacataatca

SEQ ID NO: 1800 - DNA, 3000 bp, Unknown
  misc_feature (1)..( 3000): cDNA_ID_2990847_gDNA_ID_1620450_Annot_ID_157443 3000 nt of promoter + ATG
agaaaaaaaaaacatgaactcgatagcttaaaacaccgaaaaaaaacgagtgggcaacaaatttttggtaataaaaaaataatcgagtggcgtagaataacaaaccatccatatccctatccttctctctattacctaaacacaacgacacgtgtctgacttttggaacatctcagaggacaacacttttgtgctgactaggcaataaagtgcaaaacaaaagtgttgttttttttctcctctttcattttgagacagttgtaccaaacaatttctaatttggataaatggttttttttttcattgaagacttccagatatttattttacaatttttgtccttcacataaaatacctatttaattttgttttgaagttgacggctactgaaatttaaatatctctttcttctttttaaacaacgctcgtgtatgtttttatttagctactcgctttctttgccacatacttgggtcaaaagagagcactccaaaaatatatgatctgtcatttgaaacctaactattcctgataagtctaggttcatagtctaaagttcttggccctcatttaggtataaatagtctaaatttaaagtatttaagcaaaaacaatactgagaagaaaaaaaaaaaaaaaaaaaaaactacggtaaaatttctagaaatgtttaagaaaaatctaactaaaatcaaaagaatagcgtattaaaatactaattttattggattaacttaatttgatgaaaatgtctcttaatatttatggcgatatgtatgttggttggactttgaaattgtttttatagatttaataagatgaacattttgttcttgcttgagagtggctgggtacacaatttttttcactttgttcatgctaaaattcagttttgtcttcttatatttacatctaagtttatgtttgattatctgaaacccaaattatcaagtattttacgattttttgaaataaacgaaatctgtttatttccttattcaaattttataaaattttgtaagagtgatttgattgaaaatggacaacatttggagacattttcaaaaaaaaatgttataaaaggttattttaaaatgctttcaaaaatatcaatataataaagagcgtgattatattttaattcagaattatttaagtgatcgaaaatatcataaattttgtataattagagcatttgttctgatatgcgacatattttactataattttataggaaccatataaatttaattttttaactaattccagttgcacatttgtttagatgaaaatgatttgattgctgcatgatataatttatttacatttaagcatatattttattctattttgatgaattgtgtggtattttcgtacttaaattttgatatattgtatgtaattgtacaacatactcaatcatatgttattacttctaataatttgaatatggacatactcagaaaggtatcaagggctctttctctagctattgtttctcatataatcttttcaaaatcatatatcatcaccaactatactcatcattctcgggtactatgagctctaactagtggaatggtactagaactttgacacaccgtctagttgagattatagaaattaaagattatgttatatatagtagaaacaaagtaggccaaattcttatagaaaagaataaacaaaattaatataaaagataaatgaaaaaacggtcttgaattataaacaatttgctaggtgtgattcaacattgtctttattcaatacttgttgggtcataaacattcaaattgcatattattgttactctagtattcaaattgcatattatgttttatctaaactaacttatatatttattttgataaacatgtcatatgatattaaacttattttcaattgatcatcttctaagttgatgcattttagtattttatattcaaattttgagatcttagtatgtaatatattttcaggtttttactattcatcagtttgatgatgcaaatatacatagtacgaataaaatgagtgaaattgtttaattatatgatcaggaagaaaaaataatattccaaaatccaaattttagtgggtaattcttagcacaaaaacaaattttgtttccaaatatatcacatatttttcaatgttccacaaatagcattaattgttgaaatttgttatgaataagaatatgttctataacattatatgaattagaattatcaatagataaagtgtgtcaactcaaatcgctaaattgttgaaaacaatttaataatatattcatttaatatattctcatgtcaatatgatatgattagatctatttagtgagatcttatttaattgttaattctaataaaacaaaaatagtgattatattactaataaataatataattgtttaatcttattttatggaactgtatttctcaacttcaattaaatactgtacctaaacctaaaattaaatatgcaatcaacttgattaataaaaaacaacaaaatggggtaagaagtaaacaacgttgttaaacaagacacgcgctcaccagtcgcgagtttggcaataatcatgaaatgagcttctttaaaaaaactttctagtagataaattaaacaattaaaaatctccgacaagatttaacaaagaacagataatatcttctccgcaaagacaaaagtgaaagcgaagaagaaatcctccacgtgtcattagcatcttttaacctgagccacatgatactagtttctcgaaacccctctttacgctttttcacccaaatttttataaaaagaaaaacattatgcttacgtggcttatcttcttcttgctcttttaaagtaaccccttgactctgctcctttcataaacaacaactctctcaccaatctcaaaacaattctctctctctttattcttcttcttcagcttcagatttcagatcttaaatcttcaagtcttcttcttcttcttctgcaaccatg

SEQ ID NO: 1801 - DNA, 3000 bp, Unknown
  misc_feature (1)..( 3000): cDNA_ID_2143998_gDNA_ID_1620450_Annot_ID_157452 3000 nt of promoter + ATG
tgtggcattgatgaagccagtgagtatttctccatcctcttctcgaatggaatttcagtttccttccatcgaactgtgtatgtgaaatccacttggacttccttgtcctcagtcaagtccacaaggaaattctggtctgtcctcacgataatttcgataacacggtccttattatagaaaatctcaaactgcagatgattgaagagataatatttatactcagatgggtcagtctttccctccttgacaacttttccaaggaatccccaaatgggcaagtcatcataatacatctgaaagtaataatctttcgcaatcacatcacgaaacttagcaacgtcttctctactcaacctctttctacatgcaacttcagagttcttctcacccaaaaactcaagtttgtaaggtgcactgactaatcgatctccattaagaacttcccctagagcctccttcttctccttaacaggagctgtaaagaatatccctcagccacataaacttacaaaaaaatcacctatgaaactaagcaatttaaccatccatacatacctgatgaacagaacggaagatcaaagtatcgatatgtttcactgcaacacacaaaaaaaaaaaaacagttcgctcaaactaaaacatcagagttcgtaattctcgaaaatcggatttcttcacttaaatatccaatcatttgttcaattcatgcttcttgtttaaacaatttgaccatggatcaaagatgatctccataagaagcttaaaactacactaaccaccaatgacattcactaattagacctacaaatttgtcattccaattctcactatccaataattacgaatcagagctcgagaatgttattattaaggaaatcaaattcaaaattcgaatcagaaacacgaaaagcgaagagatctccatgcaattgaaatcaaaatcagaaaaaaaaaacgtgaaataactgaaaatcgaaagctcagatctgaatagataagcggacagacctgggattatgaaacggtccgactttgttagcgtaaagaggaacatcatcaccgaccttgtaacggtgatcggagccgtcggagataaccggagaaacgccgtagaggaagaggaacaccagaagaagcgacgtcatcgaaggaagaagtaccattagaaattagagagaaagagagagagagaggtttaagcggttgggtcgatgaagatgatgaagatcaaattcatgattatgagtgagtgatgagagactgatttttgttctccgcaatgcaagtcatgtcaattttactttttgttaacgaaaccactttttgtcactttttcattttcccaagttttatttatatattttgttttgaattatcaatagtaaatttttttttatttttttttggttaaattgatttatgtataatcgataatgatattttaactatctcacattaggtgttgggattagaggaaactaggagtaaagtacactgcaatctttttggtttttgtagacatgtaaattgcttcaaagagaagtgtaggaggaactgactggaggcagcggacaaagcggtataatttatctgcggtttagtccatctcatttttgggcggataataaaccgctgcggaccaaatttatttgtatgtaaaaaccgctgcggttttttctattttttttggtccggaccactgcggactataattgatgaatggtaaataaaaaacggtctgatccgttgacgttttgtccgccccaaccgccgtaaccattcaaaccctttgttaaacgattagttttttatcaaacgtttaaaggatttctgcaactccattttaagtctctttttattttgccgttttaaatttattatttattgcaaattctctgttttaagtctagtttagtttgtaatcaaataagagttttacatagagttctttttatgctcaactaaaaattggttatgaatttacaacaaaactaatatttcgttgttaacccgcttgtaaattatgttactccatagatgtcacgttatttttaccggttttataattcatctcaatttatgactaaacccattagtttgttttaacttttatcaaatgctagataatttacccgtgcgtattatatacatctcttgttgataatatttagtaggtattatacacttgtgtttgatttgatctagaagcaaaaaattaaacataattgaaatttttgtgtggatatcaaaatgagggaaaatggagaacatttttgaatgaatgttccaatttggcaagttggagatcgtatgtgcatatatttttctcctctagagacgtttggaacaacatttggcatgtcaaaccccttgtgtcatggtatcctttgggttggcacaaccgcacaaggctgcgattccaaaacactcttttcacgttggacagaaaagattgttccgagacgttgtccacataaaagacaatacataatgtgttttatttcataaattaagcggcaagtaagtaaacgatgtaaaagcaataagaggaaagtattatgcattagggttcttcgtagtcatgaattgtataagcatgtagaaaatcatttgtctcttggttattttttatttgaacaatccaaacttttgattttttttaaaacctttatggagtaatctctttcgtttgcttcatctcccaatttaataaaagtcattgggaaagcacaaagtttcgcgtggtttgatgttttgaatattcacgttcagttaaaataagattatacacgaaacctcttcgtattccctaccccatatatagtccataggcatattatgtaatggttatatcctcgagacttgtaactctaattatccatctacagggaagctcaaaagattaagtctttatgtaccactgggatttttgtggagtttgttttttatcctgcactcattttctctcatctttcgtgaattatttctccagaatctcta

SEQ ID NO: 1802 - DNA, 3000 bp, Unknown
  misc_feature (1)..( 3000): cDNA_ID_2144005_gDNA_ID_1620450_Annot_ID_157454 3000 nt of promoter + ATG
gcctaaaatccccaaaaatccttgatttttagattttgctcaaacccctaaaaagattctaaaatcctataattcaaacatgtcttcaactttgatttccaagacctaaaaccccctaaaagccttaaaatccttgatgacttcgattttgattatctgtttctactgacccttgatttttacctataatctctacgtgggctatttgccgaagattactcctcattctcccccatacgcaaaaccacaagtgggtttctatccacgttattaaagacctttcatttcttaccaaataacccactaatattgatgtgtgtgtgatgttccatgtcaatcttttatctttaaagatcacacgtttgctgtaagtggacaacgatcgcctgtagtattttaggatcgaactccacacagagagaaatagtttaaacgaatctgtaataagagagtaaagctagggaaaatcaataaaaaagggtttgctgttggtgtcacgattgcaaaataaagtaaatagcaagtaagacaagagttgggctttcaagggatcaagactcggacatgcgaaacactaatgatcgactaaccctaggctataggtgaaagtcggctaaaatccttatactccgttattcaactttcgtaggcaaagacgtatatatcaaacaaataagatcaagttcgattctacaacgaaacacataaaataatgtgtaatatgtgcaacatatcttatatcaacgcgtaatcattattacgatccaacagaaagacacgcctaaaaattcacaatttggtcaaatgcttttagtttaaaaagtcagaaaatcagcatatttaaagcattttaggtttttggagaaaaatattggattacaacactatattgatatctcaaagtaaaaaacatgagcgttagatctggattaaaatagcattataatgttatgcatggacatgaacaataaggatcaaattcttttggtattggatgtataatatcgtttagtaacattaattttttttatcaaaacattatattaggtcatgatactatcatctgatattttcatatattaagacaatataatatttatattattacaatattacataaaaattatttttaaattttagtcatttaacattatagccactattaacagttttaacatttttattatttcttaccaagacaaaagtcaatactacacttaactaattcaattcatatatagtattattgtagacaaaatttcaaaatataattcaataaaattatctacttattcatatttaagaacacattgttcaataaaataaaataactaaaatagtatatgataccaataaacccacataacttgtaggtcgatttctagtaactagtaattaaccggttcgaccacatatagtggatgtactaatgctttgcaaatcaaagtaccaaccaaatcatacattcaaacaaaagaaaagataaaccaaaatagaaaagagtaaaatatggtgatgaagtggccaggaagagatagttaagtctactcaatgcctcaagcaaacttgtaggctcctccacgagcaatctctacgttaatgatctgaccatcaaattcagcactattcagttccattacttagtcaagcatgttttcttcactaataaaggtcaaaaatgcgtaattgtatgagaggttactaactactttgacttgcacaataggaccgtagcagcggaagatattccccatatagacagcgtccatcatatcgagaacaagttgaatgtggattatctccaaactatataactgttgtagttaattatattgtactgaacttgcgccttcaaaatattcatgttgattttctgttgatttcttattatttacaattattattttactgcaaaatcatgatcataataattaggatagaacataattgtatgtttatttctataatataacacatctttttttttattactcacatgttttcagtacttgtgtaacttgtgtaactacacttaacacccttgattagttttaactaaatattatttttaattcatttttaattaaaaattaaataaaaaaacactgattatacatatcatcaatctatatcattaacataatccacgtcattactcatctgaaaccgcataacgttacggtttcatttcttttgccattttattgttcattagcggaaaaaaaaattgtcgctttctttctctatctctcttgacgaaacaactcgttaccctaactccttcgccgttttctcttttttcgtttgttccggccgaaattcttacgtcggagtcgcatttctggtatcgtgaagtcacatccctgtcgcagtcgcatttgaactgaacttctctaagttccggtgagtatatttccggtaagtaagaatccgacatctaagttcaatcgcaagtgattcgcgtcactgaaatagtttttcgatgcttaatgatggtttttaacgatgcttaaagctggtttttaacgtcgtcgttgattgacatatggtggccgatttgttagctctatttgatttgatggctgagttactttttgtttgccgactgatttatgatttatcaattcatctgtgtctgagtttgttatatgctgtgattgagttatggtttaaccttacatctgtggctgagtttctgttatatgatggctgagtttgtatgttatggctgagtttctgttatgatatggctgagtttggtttatgttttgactgagttgttgttatgttatggtttgactgagtttctgttacgatatgactgagttagatttatgttatggctgagttatgttatgtgtggctgagataggtttatgttatgactgagttatgttatctatggctgagttaggtttatgttttgcctgagttatgatgagtttgttttatgttatggctgagttattgaatgcttacggctgatttatggtttatcag

SEQ ID NO: 1803 - DNA, 3000 bp, Unknown
  misc_feature (1)..( 3000): cDNA_ID_2144020_gDNA_ID_1620450_Annot_ID_157459 3000 nt of promoter + ATG
cctaaacctcaaaaagtggtgagataggattgttgactgattttgtttgcatgatgaccaaaaaaagaggagtcatcgttcctttaattctgcagatttttttgtttttttagttccttattccactcgtaagagcgatacataatatcttttaaaaaagaattgaaagtaaacgatataaacgcagaaataaactttcctttagcttgttacatttttctgtcctcacttgtcaaagtttgatacttttctctcgaattacaaaattcaagaattgttattaaaactagattttaacccgcggtataccgcggaaacaatttattttttaaagttagtatatataaaagtttacaaattgtatctatttataaaatatttttattttataatttacaaatgttattaagtaacgtcctgtcaaacccgtcccgtaaaaaaaatccatttattttattaatgttgatcttatttatgatatatttatgaatcattgtctaaatattttgtaattttgtagtaattaaatgctatcaaattatatctctgcgctttgatgattataatcgaattgttatagtcatggagaaaaacaatatcaaaaatgataattttgtagtaattaaatgatattaaatattttggaagttttatttcagtaaataatcgtgtagttaatgtggagagattttaggaagatggttaaatgtcacaatttaattcgaagattttctttctaattatcaaaaacaaacattaaaatccagtggcagccattgtaaataagtctcaactacatgatttatttcacaaaatggtttcaaaaatgtatatacagataatggattttgggaaaaaagctatatgcatattaaagaaaaaagaaaaatctgaaacttttgaggaaattttttgaggaaatgcaatctcctcatttttttttgaggaaatacaaataaaattagttttcaaatacattagtttctcttaatctcctccaacctctaatctaaacagtctctctctacttgtaacatcctgtttatccaaaaatctaataagtcaaaatgtgtaatccttggaaatcctttttatttgtagtacatgatacatgttggtttaaatgtactgttttgattttttttaacacattatttgctacatgcttgatattacacttttataattgatctttttcttgatttttttttatttagatgtgtgtttctcacatattatgtatttttttgttggaattaacaaatctgtgttattctcagctaagaatgataaatgtaatagagcaaatccactctatgataaaaaaaactgaaaattacccggattgactcaaaactggataatagtaactaaaatgactctcattagtgatgaataactagactaacacaaattttgtgtaaaaagaccaattgaccctaaatgtcgatatttaatgttttagtggtaaatatggtaactgctctaataagtctgtcattacaatgaaaaaaaactgtcaccattgtaaatattgttatagcaaaaaaatatgcaaaaaaaaaccataactgatttttgaagttatataattttttatatatttgggttgactatgtatatttacgttatagtttttaggtgtaaggtttagtgtttaggatgtagaaattagttttgaatattaaatttagttatagatttgtggtatttttgaaaaataaaattcattatagtattttttttggaaaaactcattttagtggtatttaaaagaatttctaaaaataattgacaaaaaaatcaaatctgtcatataattttccaaataaaagaactgttacaatagttagtattattctattaagaaaatcgtggaaaaataaaactataaatcggtcaccataaggatttcaaattacaaatctgtcataacataaaatatttttaaaatcatttcagcaatttattttattctttattaaacctgctatcaaacgacagatttatggtaatataaatttatctgtcacaacataaaacaactttatcataacacaaaatattatatcttagaaaacaaatctgccatcaaacgacagatattgtgtaaaattacaagaatctgttataacataaaacaagtctgtcataacattaaaaaaattggttatcgttacacgtcattctagtaattaattatttgacaacaaatctgttacaatgtgacagatttttttaacaaaattataaatctgccatcacttaacgtaaaaaaacatccacaaaaaaataagtctgtcaaattatatgaaagtctgtggttgaataaactaaaaatctgtcaatcaaattaaatctgctataatttataaatctgttatcactatcttctaagaagtctgtcaaccaaaaaagtctgctataaaaaaactatcgcagttaaaaaagtctacggaataagaataaatctgcccataactaaacgatagacttttgtaaaattgttggaattttttttaaaagatatttttgtatttgttttatttttaacatataagaaaatgatattttagaaaagaaaagaatcaatttaactctaatattttataagttattctaataattaatcttattattttggttaatctagtttttttccctaaaaaaaattagccaaaaaaaaaaaacagaaacgaagaagattagtgatattatgatgattaagtttcttccaaaaaacttaacaaaaaaaaaagtttcttccaaaaaaattcacaaaaatcgaagaccagacaaatggcgcaagttcattgcacagagagacaaacaaaacacatatatggaaccaatgaaaaagacaaatctttaaccaaacgatgatgcctcaagaaacagcttcgactctactacattcattgtctaaaagatctttcggttgttcacgaattgtttctgagtttgcccaaacacaaacgaattgaggaaaactgaaagatg

SEQ ID NO: 1804 - DNA, 1219 bp, Unknown
  misc_feature (1)..( 1219): cDNA_ID_2144028_gDNA_ID_1620450_Annot_ID_157462 3000 nt of promoter + ATG
caatacaaattaaacttctccatagaatcctaatgtcagagattatagaagaaagaagctgtgcaagtagaggtctacactggtgttacactggtgttatcacaccatataaatgtggccatagtacactctgctgaggtcataaagattcctatcacaaagtttttggtcaattcggtcaaaaagtaaataataagagggtcatattaaaaatcttctaagataaatataaaagtttaagcccgcaatcgaaaaatctgaaacgcaactggtgtgagtgattctagcgttttctctcgtcgcatcttctcttttcatctttgaccctaaaactttgcaaatctcgagctttcaggtcttctcttgtttctcttcactttgcattagatatgattcctgattgattgattcactgattacagatttcgacattgtctctaggtttaatcgattttgatgttgttgctaatcccgtagaaatcaggtgcgtttcgagtcgaaatttttgagaggtttgtgagtttgtgagatttctagggtttttagatgaatctagaagtcgatttcgctatttacgcttagatgttggattgtttctacatatcttgggtttttcgaattttcggtggaaaaaaatctaaaccacacacattgtagccacttttaagctttgtttctgcatgcttctgagatttttcgaagattttagatagcttcatagagttaatttcttagtgacgcatgattgagagctgtttcttagctttgacaaggtttatctcctcaagctgctgattgtttcgcctctggtttgtggatttgcaattggagttaatgggtttttgttcttgtcgcataggcttgagtctggtgtctctgttttgcttggttgttttacatgttaatttctatgtgttggtggaagtcactatttgcaacggatttttggtagctaggctgcatgtgtgtagaatatgattgcagaaaaaccattgacattttgtgttacgtttttctgaactggctaagcggctagtagatgctttctcacatatgttaacacctccatatctaccttttttgttttagccagaaagtagccatccttgaagcaaaacatagcccagacgctggggattgctcaaattcggagaatttcgtcggcattgagactttggtcattagaaaaattgaatgataaggatacacgacaggcatg

SEQ ID NO: 1805 - DNA, 3000 bp, Unknown
  misc_feature (1)..( 3000): cDNA_ID_3064363_gDNA_ID_1620450_Annot_ID_157455 3000 nt of promoter + ATG
ccttcatgaatacagaatccgcgatttcatcctctacggatatctctcctcgctctataactttccgttggacctacccattgttacataattcattaataaacgttacagctttaaacctgacaaacttcaagtagtaaaaagttagacattacctcttccaaatagctatcaacattttcgtctgaaattgtcgggtcaactatgaagtcaaatagctctcgtattgtcataacagccacaccatgttttttgaaaaaatcctgcgtgtgattgtaaatccacacatcagacaccctattccagtcaaatattaagcattgttaaaacaggatactgttaacacttaccgagacatggtcacaatcttcccgtagaaagttgagtgcaagaggatggtccagatccacagattgagaaacatcaattatataaaggtgcccctgaaaaagtcaagataatatcattatatttgtttcgttttgctgccacgaaacgatcaaataagtgacccttgtagagataaatcaaaactcacttcaaaataaagtatgttatactcactgagatccccatgcactaatttgcacttctgatataatactcgcatttgaattatcaactgaaataagaagagattaatcgtgacatatcaggtctaagtaaagtattacaatgatacactcaggaccctctaaatgagaaaataagacatacctctaagtaacactcgcgcaacttgtccagagacaatgcggcatccttgagacgcggtgcagcccaaccatccctccctgcaaattataaatagataaaactatctttggtagctgaaaaatcgttacttcatcaatgaaatatgctaatgaatcagagtagagtgttgcgtggaaatgagtgattaaaacagaagataatgcataagagcgaacctataaactccatgactagaacatgaaggcgtagaagtataacagctggacacctaattcctgctgcatgaagcctggcaatgaaacatgtataatataaccaactaagaaattaccagaatcattgttacatatatgtgaccaaaagtgactacttctccggcttctgttttgaaaataacaagataaatcaaccctacaatacattaacaagattccatatgaaaattgtaggtattacctcttgagatttctctgttctttttcagcccatgtcttcaccatctttcgaggattgtgacgacagtagccatatctaaaacggtaatctccttgtacatatcgatctcgatccctgaaatcatcacagttataaaaatagggactaaaacaaaatcattaacaacctctattcatgtaatactaatagctcacttgaaaaccagaacagatgtcttgtacacttttattgcaagttccgaaccgtcagattttgtggcatgataaacatttgcctgaaagacaataattaaagagagtgctttcaacaaaaaagaataaaaacagataatctcaaatatgagagttgtgaaatgtatcatacttctttgcctgtcgagatacagccattaacatcgttaaacacacccctattaagcattctaaacaataccatacgcgtccttggatcaagagcctggaacaaagaacaaaacaacatcaacacaatgcttacatcagacccgaatctttgtgtgacagttagagcttacctgttcaacagttgcccggtccgctttatcagtattcctacttctcccaatttctgtatctctaagacttccacgaatcgcagttgtcacagaattcgacatcccaactttaactcttccttcccatccctgcatcatcaattaactcaaaatcacatttccagctacacaaaacctacctgaacctaaaccctataaactcaatgttcatttgagcagagactatgagcaattcagaagctatttcaaatgtaaagatcatatctttataagaaattcagaagcttttttcaaattctaaacaaaaattcgataagaaacggtacctccaaaggagaagcacgaacgtgactagtaagcttctgggccttatttgaaataggctgaagagcactagagttagggcgtgaaccatgtccaccgtgagcattaggacgacgagcatgaagagaaaagccaccaccaattagctcgtcatcgtctttaccgtctagccaatcaagagcttcagcgatatcggaatctgacgaaagcgagagatcatcgtcatcatcttcaagctcttcttcgtattccacaaagggagtaatcttcggtggtggctctgcaactaccactacttcctccatcacttgtttttcgtggaaacaactaccggcgacgagaatcagaagaagaattcaccagtcgaaaacccttttctttactcagacaaaacgacgtcgtttaggtttcggttttgaacagtttaactaaaccagaccggacaagaacaattcttggcggtgagtaggattggtttacccgacccgaagataaacaataaacaaaagacaaacacgtgatgctcacgtgggttcttcttcaactctctcgccgtttctagagctcttcggtgtcctctgcttcttgcctgagtttagtaaaatttcaagcattgtctcttttactcggtaagttttcttgtttgatacacatattcgcttctcacatcagaaattgatatcaaagtaagttccttttttcttattattctctcgagattgacgaaattgaactctgtttctcgatttctaggaacttatcttgagcactctgtcccactctgatttgacctttgaaagagctcttatataaattcttagtatagggattgtgtttggaaattttggatataagtttatgttttgtctagctgttaatgagcacaaagtttcatgctttttagcttgttttctctaataataggtttttgaacttcataggattgtttggagaaatttttggaggtgatg

SEQ ID NO: 1806 - DNA, 3000 bp, Unknown
  misc_feature (1)..( 3000): cDNA_ID_3064369_gDNA_ID_1620450_Annot_ID_157449 3000 nt of promoter + ATG
atcacaaatgatcagttccagtgtcattagacttgagcgttagggagtttttaagaggacaaaatctattctgtcttcccgaaaaccactatgaccgtgagggggaaacaacttcgggaagatggttaaagggacataccgttcatcggtggtctaatcgatctttttctcgcaggttattctcgagttctcgcacacataaaagtttttaatcgtatgaaagttcccgaaaatttgacaaaaacttaattttttacaattataaaatttcatttaaaaaaaaacttgtttataatttgctttcttcctattaatcctttgattcctagacttattttgctttcttgctcctaaattaattgagttgctctcttggttcgatttaaattgtttgatcgacatcgatctggagtgaatttggaggaagtgtagaccctaaaaggtcgtatctcaaactcgatgttggcatgtgatgcaagaatttgacttacaagtgggtgtagatcaagggttgatgttaatctactatccgatgtaattcgatacgttccattgatgtgaggaggggccaatgttcatgcttaagcctctagtgttatcaccgaactcaagacaattgaatgctgcaagattgtgtactaagagtatgcagactgattttacgtgtcaagactttccactgcgatttcaaccacagtgtacgtatgttttcagtgacaataatacggtattattaatacccgactctttcacaaactttggaaattagtttgagttcaattcaaaatcgcatttaaaaaaataataaaaaaattacatgaaacccacaatatttggtatgaaatttaatatggtagttagtaacctcgtaggtacaacattcatcttcttgctgccgacatcataattgttcataaatatttttgaacacgtacatataatgttcatggaccaaatctgatcagactcctaattagatgaattgtgtggtcgattttgagatgtactttttgaatcataattctttcaactactcgaaataaatttccctcaccatcccaagactactagaatagcatattcttaaatataaattattatataaccaaactattattctttttaagattatcactggatgttacgttgaagttataagacatgatatatatcactcaatttcagaaatgagtagagttcttagtgcatagtttttcttaaacctacaaggctacaatgaataaagcacgacaccatactgttctcaaaatatttgtatatagtggaactcggttgaaacatatatataccagtaaagttatttttgtttttgttaataaaagagtaactcgtgaacttgaaatcaaggagctaataaaaaattatttttgtttgaatttaactttttcaaaacctaacacgaaaatcagaaattctgaggggttagaatggttctcacttgtttacgtttctacgtccaaaatactcattgagttttcacattctcaagttttggaaaaattaacaatttcgtttataccactaacatgtttaaaactataattattctaaaactttaattatcaagttcatttcgtttagctaaaatttattctgttatatagttatttattggatataaaccctaaatttagtgttttgatgccacacgtaagctgattttcaaatcacaactttataaattccctcattaatttatcttctaatgcatctatcaacaataacgttatttatatatgttgtctatatctattaatctaaatttgttacaaacaatttaagtcagcacttatcggttttatgtctacatcatacattatgtaggttgtacgatgacgtgggttgtagctagttaggtataaaaatttacttttaaaagaaaaacataatctcctcatcaaaagcttttaattgaatttaatagccagggccaaatatgccaacaatatacaccaaaaaacatatttgtcgctagaacagtgctaattaagggactcacatactattagacattagtgcatgtcagccaataggcttattgtattttcaacatgttggcccatgtcagccaataggcttatagtatttgctaaaaataaaaatatatatatttgctcaagtgttggtgttgcatggttcaatatttatcaaaactcaaaagaattgttgactaactttacatattaacaagactaatcatttttctggtttgtccttaattttaaatatgtaaaccactcatttatgatttctccaatttagaaagagtgagatgtgaagtttctcccaaagaaagaaaaaaactacaggtaaataaagtgtatactgctttccaaaatatgtcgaattatcacaaaaataaaacgaatttataattaaacatctcgttatggattttgtatagaaatttattggcctacaactgttaatagacatattatttggcattgtacgtaatctagattagccaaactatatatagaacatcatgtttagctgatttttcaaaaaaaaaaaaaaaaaaatcatgcgtagacgaaatgcaagttttaatttaattttattgctttctctggttagctctagaggtctttaatccaccgatcttaaaaaaaaatccaactttctactttctctttctaaatgaaacaattccatatttttcatttcatttatacatcatacacttaattaatgatattctctttctagtaattagtacattaatttaaatttatcaagaaaatgctgttgaacatatataatcaattattatgaaatgaaatttataatgaaatgatttgtttgatagaaagaataaattataaactacttaagagaccgacgaagatagcaacgacaaaaccctaaccttataccaaccctcatttaataccaataaaaaaagagggacaaaaaaaatcaatgctatataatcgaagtatccactacaaaggttggagaatccttaaactgact

SEQ ID NO: 1807 - DNA, 3000 bp, Unknown
  misc_feature (1)..( 3000): cDNA_ID_2143994_gDNA_ID_1620450_Annot_ID_157451 3000 nt of promoter + ATG
ttggaccgtgatgccaagaagattctttctacaattgtaataccaaggaatggttatttcgtcaccacttaagcctttgaagcttctgaacaagttaccgatacaccccagaccatcatcatcatcaccatccctactagagatctgacatatatacccaagaggaagaacaagaaacatgcaaagaagatcaataaagccttcaccacattcagcgtaaataaccttcttgttgtcctccttactcaaatacactttgaaagacaatacttggcctaaaaccgaatcgcatggactcgatgccttatatgctctcttagaaggatatggcgaactatgaaaggggaagaatgttgctgtcaatggagtttctgatgtgaataaggatcgtagcaaagtcattgcctatacattgagattgcacaagtcaaaaagtttcattctattaaaccaaaaaaaaaactaagagaacaacacgataaaagtacctctcggaagccaacttctggttcaccctcccctaacttatcgaacacgttaacgcaacctaaatccttgacacgtttccggggaagatcccaagaaaaattctcgattgtcaaatcatcactcaacataaatgccatatttccatcaccatggacaaagactccatcatcatcacaactacctcccaatctgcttacagattcttctccttctggtgacgaactctctttgttcatcaagtttccacacctacatcttgaagtattgaagttactaaaaaactctctgcatgatgggctttgcaaagactttggacacataaagtacttggtttcttctgtgtcgtctatgttaatcttcagcattctgcattgacgttccttcacgctcttcgggtaaaccagcatctgcttacaagcttcgttcctgaaattatcgatgctcatgtctacaagacttttataaaggttgttgaaacaacctatgctgaccttttcttttaatcttccgtgatgctcaagcaatctcacaattgttcccaaaggcatggtaagaaaactatagaacaaatcaacgaagtcactaccagattgaatccagacaacgtttttcttgtccacatgatgtacaagaagaacactgatcattgttttccctgatccttgatccattagagattctggagaaataattcacgaaagatgagagaaaatgagtgcaggataaaaaacaaactccacaaaaatcccagtggtacataaagacttaatcttttgagcttccctgtagatggataattagagttacaagtctcgaggatataaccattacataatatgcctatggactatatatggggtagggaatacgaagaggtttcgtgtataatcttattttaactgaacgtgaatattcaaaacatcaaaccacgcgaaactttgtgctttcccaatgacttttattaaattgggagatgaagcaaacgaaagagattactccataaaggttttaaaaaaaatcaaaagtttggattgttcaaataaaaaataaccaagagacaaatgattttctacatgcttatacaattcatgactacgaagaaccctaatgcataatactttcctcttattgcttttacatcgtttacttacttgccgcttaatttatgaaataaaacacattatgtattgtcttttatgtggacaacgtctcggaacaatcttttctgtccaacgtgaaaagagtgttttggaatcgcagccttgtgcggttgtgccaacccaaaggataccatgacacaaggggtttgacatgccaaatgttgttccaaacgtctctagaggagaaaaatatatgcacatacgatctccaacttgccaaattggaacattcattcaaaaatgttctccattttccctcattttgatatccacacaaaaatttcaattatgtttaattttttgcttctagatcaaatcaaacacaagtgtataatacctactaaatattatcaacaagagatgtatataatacgcacgggtaaattatctagcatttgataaaagttaaaacaaactaatgggtttagtcataaattgagatgaattataaaaccggtaaaaataacgtgacatctatggagtaacataatttacaagcgggttaacaacgaaatattagttttgttgtaaattcataaccaatttttagttgagcataaaaagaactctatgtaaaactcttatttgattacaaactaaactagacttaaaacagagaatttgcaataaataataaatttaaaacggcaaaataaaaagagacttaaaatggagttgcagaaatcctttaaacgtttgataaaaaactaatcgtttaacaaagggtttgaatggttacggcggttggggcggacaaaacgtcaacggatcagaccgttttttatttaccattcatcaattatagtccgcagtggtccggaccaaaaaaaatagaaaaaaccgcagcggtttttacatacaaataaatttggtccgcagcggtttattatccgcccaaaaatgagatggactaaaccgcagataaattataccgctttgtccgctgcctccagtcagttcctcctacacttctctttgaagcaatttacatgtctacaaaaaccaaaaagattgcagtgtactttactcctagtttcctctaatcccaacacctaatgtgagatagttaaaatatcattatcgattatacataaatcaatttaaccaaaaaaaaataaaaaaaaatttactattgataattcaaaacaaaatatataaataaaacttgggaaaatgaaaaagtgacaaaaagtggtttcgttaacaaaaagtaaaattgacatgacttgcattgcggagaacaaaaatcagtctctcatcactcactcataatcatgaatttgatcttcatcatcttcatcgacccaaccgcttaaacctctctctctctctttctctctaatttctaatg

SEQ ID NO: 1808 - DNA, 3000 bp, Unknown
  misc_feature (1)..( 3000): cDNA_ID_2143790_gDNA_ID_1620451_Annot_ID_157475 3000 nt of promoter + ATG
ctaattagacgcagtttcactgtggttgtttgtcaacaggtttgcgacagagagggcatgagttattacctcggatcaaccactgagtgagacatggttcatgaaaacaatgagtgcagttaggcaactcgcagtaatcatcggatgtcgacaattcctccaaacagatggcacaagtcttcgattcttcttcttctccttggctcatctcttggtccaaatctgttgccaacggaggcacaacgacgtaaaccttgtgtgtcaatttgacagagacgattatgaataaaggtggttgttgtggcaagtaaacactttgacttgtttgccgttgttgggcttcgacaatcttacaagatatttgctcggacaagtcatgatcgtggagttgggtctggagatgttgatagacgtcgtttggtttgaaacttgggagtgtcagagagattagtgggtcgtgacaagtagaagaatcatccgggtaagatccgagactcgtgacacaattatccttgttgttaatgagaaattcctctacttctctgtattgactgattactaccgtacttaagaaccctaacgacggaggttgagacaaagcttttacatgaacatcgagtttgaaagattcagtttccattgtcgagcgagtgaaactagacaaaactcagagagacagagtgaaatattgttgagaaattagatgatgattcgtaaggaagagagaaaaacagagattgttgagaaaattgtaattgtggagaagtcacaagtgtaatgttgtgtttatataagcaaaaagaaaaaaactctgattataatttgttgtaacgtgttaacctaatttcctttttcctttctaatttcctttttttcttcaatatttccattttttttagggttaatttgtaaactagtcacttttttaaacttaattagaaaagtagtcactttactattcataatttgcaaaatagtcacttttcactgtttgattcgtacacttagattgtacaccacttttagtgtacaaatatatataaaaatacacagcgtacactttatatttgtacactaaaagtgatagtacaatccaagtgtacgaatcaaacagtgaaaagtgactattttgcaaattatgaatagtaaagtgactactttcctaattaagtttgaaaaagtgactattttgccaacatacccttttttttaacaccaaatcaatatttccatttttctttaacgttcattttttattgttgtatttcctttttttgtcttgtttgtataactataacatatctcattatatataccagagcttaagccaattcaatttcgaaccaaaccaaaccgaaagcaaatcgaattcggtttaacttggttttgcaaatcaaattattctctagtaagatgatgatgaagatgacgagagaattgagatgacgaggttgctctctaggacgttcccgtccgtgaagcttcgcgattccaatcctaaagctcccgaattcaaaaatttgaaaaattcacaaacccaagttccgattccatcgtcttcttctccgcaagagaactcaaagattcccaaatccaaatcctggtctgtttatctcattctctccacgaccgaacccatcaaaacatatgtcggaatcaccaccgatttttctcgccggttcgtcctcctctctttgaatcgagtttaggtagattctgatggaaaggcacgagctttcgattcatagttcttaaggaatgtataaagcaaagtgctttttgattaccatttaggtttctgtttcaaaaggcttgagcttttgattcttttggatttgaaggaatttgaaaagcaaagtgtttgttattggttgcagattaaagcagcacaatggtgaaatcagaggtggtgcaaaagcttcaagtgcaggaagaccatggctttgtgcttgcattatcactggattcacttgtttaagtcaaggtactatctctctttatctcctaagaattgaacattgcattgtgactgtatatatgcttatggatgatgattgatgagcttcccttgtttaatttccgcagcttcttcgtttgaatcaaaatggaagatctttacaagaaagttaccgcggagaaagaaagacgaagacatgagtcagagtgatgctttgctacaacaccgtaggagagctttaaacaaagtcgaggaatcattagactgtagttatcttgaaactgactggaaaatctaaccaggtaaccaaacgactgacttaattaatcaccggtgtgctctgcagccacacaagattacgtttttatgctgggacttgacgacaatagcgataagaatatagctagtatgtgggtttaacttgtcatatggcaatagtttgaaaaccacattgcacaacctcatgtgcattgatatttgtagctgttgtaacttttaagaatgataggcaaaagtcaaaactaatgtgttgtaagattttttaattcattttgtgtcttcagtttataaagaaaaaacaagtatagacaatcatttttaagatatattgagaactgttgagtcggcagaagaagtgaaatcatctgcagtagccaattttggttatgttaagcacgttcatgtaccctttagaatcatcactcgtagttcgacaccacttttccatttttgagggctcggctatgtgtttccaaacatattccttaaccagaatgccacaacaatacatataatacaaaatcataccaaattatatactatttattcaacataatcttaaaaatctgttggggttatatgagagcattaataatatgctcctgcttgtataaagaaaataagaaaatggtgcaacccacgtccatttcaggccggtggttttgtttattactccaaaacatgaactccattataacccaaaatcgaaaacccctttactaattcataatcaactatcaccattttcgaccaaaaaaacaaaa

SEQ ID NO: 1809 - DNA, 3000 bp, Unknown
  misc_feature (1)..( 3000): cDNA_ID_3064389_gDNA_ID_1620451_Annot_ID_157488 3000 nt of promoter + ATG
acttaatggtatattgtataaacaggtgaaagacgatcatcgagcaaaaaaagcagatagtgcagaaggtatgccataaggataaaattatgtaatttatgagtctctatgctaaagctactgatttggaaaaacaatattcccgtctcaggatttgactgatactaagcaaatctcaactcataaaatcgaaaatagtgtgtctcttggctattgatctttctgtttaaccaatatgtgagaatgtgaatcaggtagcaggcctttgctacagctcaacgaggagaaagctattgtcctttacgaggtcaattagaactgaaatggtttctataatttaaaggaccttttctcttatttttctctttggaacaaacaacttatatcatcttcttgcatttgaacagcctgattcccatccaaagcaagcaaatcggtctacctcatcagatgaaaactctaagtatacccctttgcgtgaattgttttttggttttcaatgtttttcaacaaagagagtagttaagtatctaattggtaatatgtggaattgtatcagagctcaagttatgaaagttctggagacacggaagataatgttgcagaaagaacaaggaatggcctttgcacgtgctgtggcagctggttttgaggctgatgatatgattcctcttatatctttcgccaaaacttttggagcctcacgtttgatgtgagaagattgtagtttacaccaatttcttctttgttttgcaaccaataatctcatatccattaaagtctttaagtttgaaagaaacttttcatagacttacttctcatgtttggtttcaacaatgttatagggatgcatgtgtgaaattcatggacttgtggaagaaaaagcacgaaactggccagtgggttgaaattgaagcaacagaagtaatggcaacacagccaaacatctctacaatgaacgactcagggattatgttcgcaaatgctgctaatatgcctgggacacctgaaaatagtggtaagatgattcttatgagtcatagtagctgagagttgaatatcttttcttgcattgtttggcattgcttttggcacaattgatattcatttcgagaaacttattgtatccagatgcgaagtctcctacagacaacaaacgaaatggaaatcaagaatatgtgcaagggcagcatcggcagccgatgtatgcaccctggccagttcactccccaccgggcacctttccagtatttcaaggatatacgatgcagggcatgccatactacccaggctatccaggagctagtccatatccatctccctatccgtctaccgatgattctagacgtggttctggccaaagaaaggctcggaaacatcattcatcttgtagcgaggactccgaatcagaagatcaggaaagagataatgaaaaatcaagtagaagaaggaaatcagggaaggtggtgattcggaatataaattacattaattcaaagaagcaagataattctggaacagaatctgatgctgatgacaatcatgaagaagtggcaagaggagaatgttacaatggtaaagagagggcaacaaaaggaacagaggctgacactggggattggcaggccttccagacttttttattgcaagatgctgacagagatgaacgttccattgaccatatgatggaaaaggagattagagggaagaagaggcaaggtacaggaaagtatgatcctttggcacatggtgaacgtgaatcaggaaaatatcaagaaagggatacagctgatattcggaatggaagtgtgactcgtagaatcaggggatctagtgactctcttatggttcaccagagagaaaatggttttgagaattcttctgatcctctcaacatgaatggatttgatactccaaggaatggtctggataagagaaacatggatgatgattcttatattgttactcgggtatcttcagcccgagatgaagctggaagaaataagagaaatgctatagacattggttcagagatctcttcgtgctatcaaactgatggaaatgaaagaaagcaggtcaattatgagcctcatgatctgagcctgatacccgaacgggaaacagagaagttatcagctgggtatgatcctgcattagagtttggatccaaagctttgaagaagaatagccaggcagctggaggtgctaagaagttagtaaaagatccaaaatcgagactttctaaagatgctgcagataagaggaaggctccggggccaatacggaaaggaagaccgacaaagatgagtcctttagatgaagcaagagcacgtgctgacaaacttagaaatttcaaagctgacctccagaaaatgaaaaaagagaaggtaaaatctcggcttaaacaatttgatgatagaattgctttttctactaatcatatagaaagcacaatcttaaaggatataaaccaacttgtggttgaaaattcttatcataaactcttattaccattctttcttgttttaggaagaggaagacaggaagcgcatcgaagctctgaaaatagaaaggcaaaagcggattgcttccaaaagcaactcagcggtagggcagtcacagttgcctgcacaacaaacaaaaaaacaaatactaaacaagttttctcccggttctagagcctctaagtttagcgactcagaaccaggttcattgtcacctcttcaacgtcttcctagaagaactacttctctagggtcaaatgactttcagaaattccccaaaaatggtaaactgagtaccgtaagtaagtcaacaggaaatatgctaacaaggtcgatatcaccgttacctccagctaagagagaaagcatagcaacaggaattaggttaaccaggtcgatttcaccattacctttgtctaagagggaaaccagagttagtctagatacgcagaacaagtcggtttcacagacaagacgattatcagaaccaaaaatg

SEQ ID NO: 1810 - DNA, 3000 bp, Unknown
  misc_feature (1)..( 3000): cDNA_ID_3064420_gDNA_ID_1620451_Annot_ID_157476 3000 nt of promoter + ATG
tggtggttctggaactggtagacctttaccggctcagattacggttcagccaccgaatcgtccttattgatgattctcaagaaatttgtatactttgtaaacgattcttctctcttgaactctctcactctctgtcttgtaagttgattatatatatatacacatagatgagaaacagatttgatagcttctgtgatattttttcttgtgttgggttgttttgttactgttcatagtcaaaatattcgaatttgtcattattggtggctcaaatctttagtattaactattaagaattaagatgatgggtttgatccaatgatacgaaaagttagcttcttcttgtatattgttgtaaatggactttgttggatgtgtttggttcatgtctagtactcaatatgtgaccatgagatgtttcaacagcctcttgttccaatggtatgaaattggttcatgtctacaacctcaaaacgttgtagaggaaggagtgttgtgtgtgaattttgtgaaaagctgcgaatagtaaagaggaaacggattagttataacaaattaaacagctacaattgtagtagatggtctctcaagtctcaagattagaaacatctcggagccaaaaaaaggcttcctacagccatatagaagtataatctcaaatcattatccacacttggaactatctctaaagctcatttgttatttgatggcatttctagttcgatatgccactccttaaatccgttgcgttcgtgaaggatcaatggggttcaattcaggtagctaggagatttgtaccaacttgtagctttctagaattccttgtacaatgtgatccaagtaaaagaaagaatcggttaaaattttcaatataaaactttaaaatagactactagtactagtttgagctagacagtgactcatgtagaaacaatctctacaacataaaaatctacgaaccataccgggttaccaaacgttcttctcaatctcaccaatcggtttaagctgaaaacccgaattagcaaaatcttcgttcgggctgttttggttaatccggtttacatgttttctcattgctcattttcattttcccgccgtgacagagcgcgtaaatctcaaaaccctaaaaatgtcgaacatatacaattcattaccttaatcagattttctcaacagaatcaaaatcaaaatccatggaggaagaagaaggatcaatccgaccagagtttccaatcggaagagtaaagaagataatgaaactggacaaagacatcaacaaaatcaactcagaagctcttcacgtcatcacttactccaccgaactcttcctccacttcctcgccgagaaatctgctgttgttacggcggagaagaagcgtaagactgttaatctcgatcatttaagaatcgccgtgaaaagacaccaacctactagtgatttcctcttagactcgcttccgttgccggctcagcctgtcaaacataccaaatcggtttccgacaagaagattccggcgccgccaattgggactcgtcgtatcgatgatttcttcagtaaagggaaagcaaagactgattcagcctaaagtaaaatttctcattttgttcacaattgcaaattttactctgttctcaaatcaaaatcttgttttgctaaaagtgtagtgagaatgtatggatcatgaggaacttttataggaattggtaattttaaagatgttgtgtctattagcatttctactaattggagaaactgattcttgtcctgtgactgtgagatacatctcattgtgttgcttagaaatctctgcattgctctaactttggtgtgtagagattgagagagagagagagagaggtttgggatgtgtattgttcttctaagctattcttatatgaatactacttttgagtgtttatgttcttctgaaagaacatggctatagaagttgtcgccgttacaatagtatgttatactttctttgattgtgagctaataagcgcggttgtgaccgagcaaaatgaaagcttttgcggaatgtatgtttcagttttctttagtttttcattctgacaagttttctagagtagaagtgaaccagtctgatgggtaaagtctgaaacttttaacaagaaagtgtgatatttctcaagatcactatccatggttacatttctcaataactcctctcaaacttcatcttatatcatctgctttgtagtgtggatttggtatatgttctttatttgcttttatggtttcagaccaagtctagtggtattcaatgatgacttgagtgtccaaaagctcttattatgttctcggaattgtgaaagaaaaaagtgattatgttgacatatcaaattgattgaatccaatggaacatccactttctttaatattccgtttagttattatgagaacttgaaccgttataattaaacaacataaaccaagcaattgtgttcttttcggaacttgtggtacatgaacccggcgaattggatttacttcgttatttgttgcctcttccattcccgaaacctttaattaaggcctttgaccatgtcttctctaaactgttccacttcctccacttaagctttatataaaacctcaagtcctatgaaaagaacacaattgcttggtttactctaacaaggtaaaatcttacgcagcatatatagatcatattgttgaatatttatgaaagtagtttttccaagaattgatgtgtttgtagtttcttctgtttctaagcactaggaaaccatttctttgatgccacgttagactatgttcttctgaggtttttgttcattgttagcctcgttacgtattttagcatgtatgatatatgaacagactccgctctgtttagcttttataaaattgttacctatttatacaaaatcaatgtagctatcgtctctaacatggctgtgtaaaaagtgacctttttcattgtatcagtgcagattttgtatcaagacatg

SEQ ID NO: 1811 - DNA, 3000 bp, Unknown
  misc_feature (1)..( 3000): cDNA_ID_2143807_gDNA_ID_1620451_Annot_ID_157484 3000 nt of promoter + ATG
atccttcttgtaaggatgttattcatacctcatattaatgtttccatctccaagtgaagaggcaaagaactctgtcggtgacatattgatcctagtagcattatttgtgcatcgctttgctgacaaatccaacttaaacgcacaagtagaatcataaaacttccatgaaccatcaatttgacatcttaatgtcgagatattacttccttagatgatttcctgttcaattgttttgtctgaactcaattagaccttcttccatgacaatttttcacttctaatgtgattataaatgtcaaggggtttctatagatttcttgaaagacttttaatttggttcttaattttcaaaataatcataaatttcatggatgacaattatagttttcatgttcgtcagaactactaggttctctccaatataaataatcgagattggtgaaaatcaaacttgatgaaaaacttcatggaatcatcaacatatatgttaattatttaattagtgaaacttataaaatttgaaaatcttttcttcatcaacaattcatttttttcaaaatttcatgtgtaatctaaagatagcatggtctttaatcatgttattttatctgacaacaagaaatttaagaaaataacatacctatacgttaatacaaaagacattttaattattattttttgtttggtgattcatttttttaaaaaaattattagagtttgggtatttactttaacaatggaaatagtaaaattattactccatatccttaaaaacccttcttgaatggatcaaaaaattctgatactctctacatatatataccgttaacattaactataaatgcaaactgcaaatttaaaaaaaaaaacaaaaactaaacggttgactttgttaaatgatttgagcagaaacttccattacaaccaattcctcaatcaaatcacacagacaacaacaacactaaagcccactaagtcaacccaaacctttttttgtccaccagctagtcacattatacttttgtctttacgtagcaagtcaaagcgacatagcaacaaaaggaaacttgattttatcaatatcatgggcctattccctatatcaatggcagagtttcgttcatttagcctgtgtaatatgaccgataagattttctgccaaatcatgtgccaaagactcaagggaatattgctaaatatcgcttttcgataacatattacgtattacattatagtagttcaggaaactttctacgtcatgagatatcatcaatttttttttaaatgataattcttaacatgtgattttcggaaatacgggtttatagcagatccatgtttcattattaggtagaaagaagacattttccctagaccacgaaaaaaaaatgtcagtttaccgcaaatgtttttacaaaataacatggttctcatccgcaaaacaatttggtcaaaatttggcaaagaaagtaaaacgatatttcaataaatttctgttattggttatttacgtatatatttacaactgtaaagttatttagctaatttaccctataaatttaaaacccttcttgaatgactgagacaacaagatagtacgtacgttaacgttaactatgactgagacaacaaaatattaaaacactaaacggttgactttgttaaatgataccaaaaataaaataaaaaaatctatttcaagcgtggtggttaagatccaaaaccaattcctcaatgactaaaagacaacaaaacctaaacccactaagtcaacccaaacggttttttgtccaccagctggtcacactatatttttgtctttatgttcgaaagtcaaagccacatagcaaccaaaaataactcgatattatcaatgttatggggcctaagatataagcttcaaagttatccacgacggttgattcatgaaatatatggacattactagaaacctatctaaagacaaaaaaaaagcaataatgataagatgaccctaaatttaatggtaatgttataggctgtcgcaagttcagtgcatacgaaatatgcattattgccttacatttctaagaaaaactatgtataacccacacatgtataatagtgctttgtgttagtattatcgatgtatatcagaaaaattcagtccaatttggagaatttatctcattttgttgtgatcatgatagttagccgatcataatgcatcttgacgtaaggtataagcataaaccaacttatcaaatcccagacattctcctcgtgtctatggaaaagaacgaccataatttgtttgatattcttatcatgtggacgatgtggtcttgaagagtagaacatacatcatgctcctagttttcaatcacggaatcctagctgtgactcactctctgaagttagaaaactttattttgccgcgtccaaaatttcgatgccaaatctaatgaggtaaattttttaattaggtataaataatagttctggatataataagtttttttaaagcaacaagttagaagctcaaaaaaaaaaatcatttatacatatatacatttcatatctaaactatttggattcctccaaaactatctctaaactagtgtaaatcgatacgtgtgaaaagatggtggacattccaaaaagtaaaaatcaatgataatagtgtttttatgtttattaacgattataataatgttgtgcaaaacaaaacttagagataaaagataaattgatataaattcaacacattaattaatgtagataatttattaaaaacaataatatggcatataactcaagtataacaaaactgaatccacatgactaattttggtattatatataactcgtgtagatcccctcctcaaaaaaagaaaagtaaatagaaattcaacacacgttactcttaaaagttaaaagaataaagaatccctctctccctctccccctctccccctcaccaccagctcgcataagttttcttgtccccatactcatatg

SEQ ID NO: 1812 - DNA, 3000 bp, Unknown
  misc_feature (1)..( 3000): cDNA_ID_3064547_gDNA_ID_1620452_Annot_ID_157499 3000 nt of promoter + ATG
atgtttcatttatggaactgtaatatttatgtacatttgtgtggttttcttgcaagttagaacggtgggaagccacctttgagttatcaatcatttctgaaggttgctggggagccctcatgtgctaaatctgaacttgtgatgtcttattcttcacttcctccaattggagatattggaaaccttggcatttcagaagtaccatctcttgaggaacttggctacaaagatgatgaacaagtaagaggtgatctgttttctttaggtcgtttaacaatttatccatctgagaatcttatgctcatgtaaatgtctgtaggctgattggactccttttagaggtggtgaatcagaagccttaaaaagattgactaaatcaatcagtgataaggtatggtcaagaacttggaagtttttctcttttagaaaaaaatggtaggaatctgctcgattgagtactttgtcggactgaaggaaacttactcctggagaacttgaattttatcactttaagattttagaattgatattcttacattgacttcatagatttatatcttctttatcaaagtcaagggctgaattcgttatgggttttatttgtagtgtaggcatgggtggcaaactttgagaaaccaaagggtgatccatctgctttcttgaagcctgctactacagttatgtcaccatatttgaaagtgagtttcatgacatagttttgcccacttaagcttcaccctcgattttcctaatatttccatctaattcctgacatttaagaagttcggatgcctttcttcgaggtacttttatcaatgccttcaaaatatttataaggatgttaaaaagcatacatcgccgccagtttctctcctggggcaggtcagtcattgacttacagagcgttttttatactgcctgactgcagaaagttgattgctttacttttttactttagttgttgtggcgagaatttttctataccactgcatttggaactcctaactttgacaaaatgaagggaaaccggatctgcaaacaggtaacaactgtagtatagtttcctgatgatgttccttcattttttagatgttcatgcttttttagaccaatatttttgttccatacgcaaactagattccatggaacgaggatcatgctatgttggctgcttggagggacggtaagacaggatacccttggattgatgccatcatggttcaggttagattttagtcaaactgaatgcctttagctttccttttaagcatcatttcttaatcattctctctctgaaatttatagcttctgaaatggggttggatgcaccatctagcgcgtcactgtgtagcctgttttcttactcgtggggatctggtaatgctgcctctacaattattggtttctatctccgaggatttcactgacatgcttagtttctggtgttagttcatacattgggaacaagggcgtgatgtgtttgagagacttctgatcgattcagactgggcaatcaacaatggaaattggatgtggttatcatgttcgtcgttcttttaccaggcactctctcctttctgtttctctttctaattatctttggctttgttagcttttttgttctgtatagttaaattgaagtaaagcaacttttgtgatgcttacacttgtgtcccaatgttttgttatggttttagttcaaccgcatctactctcctatatctttcggaaagaagtatgatcctgatgggaagtacattaggcattttctaccggtactgaaaggtaactgaagtttgtttccaccatcctggtaagtttgtttactgtgtattctttcattagctaataagttttctgattcagatatgccaaagcaatatatatatgagccatggacagcaccattgagcgttcaaactaaagcaaactgcatagtcgggaaggactacccaaagccaagttagtaataccgtctctatttacatatacatagtagaaagatacaaacattattgtgtctaaaattttgagaaatgatgtgatcaatatcatgaagctagttgttctagtgaatttgaggttgctgatagataaagtcttctttaagttgccatagttctaacttcgttgtttgcagtggtattgcacgattcagcaagcaaggagtgcaagaggaagatgggtgaagcatatgcattgaacaagaagatggatggtaaagtagatgaagaaaatttgagggatttgaggagaaagcttcagaaagatgaacatgaagagtccaaaatcaggaaccaacgaccaaaactcaaataggtagaggattaaaaaccttttctgaaattgatgaagtgtgtattgttacaataattctagctggtatgacttaatcatggttacatttctatttctatgtaaaaaaatctgttatgcatcaatgtgtcatgtaacacttctcttgaggcaaatataaattatttgaatttttggacagagatgtaattagtaaagtaacgaggcgaatttgtaaaaaaggaaacatatagtaatcaaaattgaagaagacaaagaaatagcttcccgaaatagaaatctctcagacatataacaatagcttccttcttcttcttacagttactttcttcttcgattagccacttttttttcttttgtaattttcctttcttttttttttcttttgaattttcgggaagcagcatttccactggagctgcaaaatcttcctatcaaaattatagatcgatccaagttttagattcgagaattattttctccaaattagatttatatatcaaaaggaatcgaaaatagacagcaatttttgttttgtcggatcgtattgaatcagctgtgaattttagcgccaatttaaccactgaatcgtttgattagaagctaagatttggtcttacgatcgatctaagtagggttcttcttcttaagtgtgtgttttgttaaaattagtaaagagagatg

SEQ ID NO: 1813 - DNA, 3000 bp, Unknown
  misc_feature (1)..( 3000): cDNA_ID_2046859_gDNA_ID_1620452_Annot_ID_157517 3000 nt of promoter + ATG
atgtgtcttcatgttttttggttccattttttaaagatgttttttggttccatttcccttaacttcgtttgattttcaaggaaatgtcaaatatctgcaattatataacataggtaaaaaaagagaggttataatcagctgtacattaaacacatagtgtatatgccgcgatttatatgatagtctccgtccactcaacaaaaacttaaatctacaaaataatctgaattgatattttgaatgcatattaaaaaggtgttatttgagatatcatttttgaatcctacttgagagaagtggtccacggatttgattacatgatactcgagtgtgacatgttcaatcctagcaaaaagatatcatgctaaatttgtcttcttttgacaaaagtttattggttttcagtcctagaaacttgtaaattatgtaagcgagtgacaaagtttattggttttcagacctagagagcagtgaatgacaaagtttattggtttgcagacctagaacttgtgaacgggcagcgaataaagtagctcatatcattacgctttcccgattctagttccttggttttatatgacgacggttatctgttgtgattgataaaccggatcgtataactaattagtaattcctttcaaacttttagtttgaagaagatgttgagccaaaaaacatttatataatctatccgaagaaacttgtgtttgcttcttaggccatcttcaacggtaaaattaggtggattatcttaaaatattgttttttaattattatcatataatattattatttacttaaataattattctgaaaataataatttaacctattaaaatgtaacctattatttacttttctctctctcctactttattattattttatattttttagttagtgaaaaaccatactagagactactgatggagatgttcttatcttttctgtctatttttgactttcatgattcgcttttagtttcttttcttcggcttcgcttttgggttttctattttagcttttttctttttgcttataagaaaaaaaaaaaaactaattatgtacttattgtagtttaattatagtaatattcttttgattttttttcttttttttcctactaaacagttaaagattcacgtactacttatcaaattcagttcagacagtcggacaatatcaataggtgcacctaaatttcattccaagttttaccctaccacaaaaaaaaaaaatcattccaagatacaggcctaaatacgtgtacagaatgttaaatcaccaggcccaattatggcccatattcaaatatcaatagcacctaaatttctagtttctacgtcccttcttcattttttccttgggtcaactaaaattcaaaagtcctattttctaaaataagctaatatagaagcaaaacaaaggaattgggttattttaagtccagatttttcagacaagtcaccggtgagcggtggctgcgtatcagaaaccttgccgtgagcattgctaaataataaacatagataggggaataagctccaaaataagctcccttgtatcctaccattgtgttacaatttagcattacgccgagttgccaatactgtcttaattttccctttgatccccatatatgagacacctctgatctgttcttcaccgcatttttatgattgacggttttgctgatggttagtacattagaacttattagataccagagaatgcaaatacattgtataatccccatgtggccacgttccgtttatgaggagtaatattttatacaactatcacattcttctttacccaaaaaaaacgaaaaaaaaaactacccaatcttatagcgaagatgtgtgagatccaatgatgaagcaattaaattattgctagtgaattcatgtcattatgcgaacacgtactacttgagaaaagtacaccatatagttttcttgtgatggacggtgaggattcagcttgggaaacgatgtcgtaacgtttggatgcagaacgtcgggcgcacgatttggatatctcttttttttttttgtctcccctatcctcaagtcagggattttattacaactttgaatatttatttcctttttttatgtcggccttcttaaaacttttcaagattttcaattagtcactaaactttccattttatctttttcactctattatataattttagatgtaacgtaaaatattactattaggatgtgagataacataatccaaccacaattatatcgttatctagtaacattaactatatattataagttataaattgaaaggaatctcttgagagtaactatttagggcctaattgtgaaactaaaaacgtgtagggctgaaactaataacaattcgtacgttgggtcactattaaatcatcaaagatctgtagaaaataatgaaaaagtggccccacacgctccaattaaattacagcagctccacaaagtagctcttaaagagcttccatcacggaccagatcccgaattcttcttctgaccaccgaacgattgagtttctccgatcagatctcagtttctgggaataattcgaagttagtatttctctacttcatctctatgaatctcattcattttatctttatgtttctctttacttgttttgcgattaaaactcgtttgatcatttaggtggttctttgttttgtgagataagtggaactcgctgacttttttttttttctttttggataatcaacgatcgggttcatttgctattgtcctctagtgttacactgatacgatctttagttttgagttagatcagtgactttagtttcactattcaactagtgttccttgtttttaggacaatactgcgaaaatttagctgctctaaaattttgataccagatctttgagattcgtagatctcgcttttctttttttttagttttttcagaaactaatattgtgttctggtcaattcttattgctaaaggtgaaaaa

SEQ ID NO: 1814 - DNA, 3000 bp, Unknown
  misc_feature (1)..( 3000): cDNA_ID_2046832_gDNA_ID_1620452_Annot_ID_157524 3000 nt of promoter + ATG
tgttcattggttctgcaattagtccatatgttatgttgaatagcttgggtgatgattcctttataacatagaaggataggctggaaatagaaaaaactgcactcatgactgatactaagtgaaatgaatactcttgttttctttttctctttgtaaaggtcttgtgggagctgtgacaagggttcaagaccgcgtaaagattttcctcgcagtgttcttttggatgtttctcttcttctgggttacagtcacagatgggacgggtaaaggcaaaggcaagaagggttcacgtttcaagtagtttccatatatgaagaggctttggtgattatctactactctatactgtatatatatcaagacttcaaagagatcaaattacctgtataaacttcaccaagtaagcatcttccttgtacatcacttattcagatgataataggaaacaataagatcgtgttatcttcttggttaatgctagtgatatatagtactcaattcctgattctttcccagtctccatctgatcatgcttaaaaaacggcgtcgttgagcaataggactcaagacatgaatgggcctaatttatgggctttaaagagtttaaaccacagtaacgttctgttttaccggactccaaagcaatactccattagagtttttttcccccaaaatggagaaaagtcgttaactatttggcacgtgtattgcatgagcaccaagtaagtctaaatctgcattaaatgcgaacatccgagtcgacttaacaccttttgatcaaggctttaacgtgtcgttgttaccatagaatatagatgatagagcgcattttatatcactggatatagacacgtggttaaacttaattgggttgttagttaagttgttgtgctacctccaagtgactttatcatatactctgtgtgtttctggtagtaaaaaaaggtctaaaaccatagtgttaagcaaaagagaaaaagaagagcagagcaaaatccctaaaattttaaactctgttttgctttccgacaatcaaaccctaggttgtctgttgcttcattcgtgtaaattgttaaattttttgtttttgttttcttggcattttgtggttgatctttctaatttgttttcaggggttgctaaagggaaaggagagagatgggtggtgaagaggaagttgtttctgttgagctaccagcaccttcttcatggaagaaattggtttgttttctttgtttcatacaaagacttagaatttgttgtatatgtgtagtgctgcaattaccaaatctttttctttgaagactctgaatatggtagcttttggtggcgaaatgttagtataagtgtaaataactttatgttgattaggtgattcaaaggttatagacttagaaaaagccacatttgattgtgtttgatctactatttctacttctttgttcttgacttaatgcctcattttgactatgtttgatttacttcttacttttcccgattcttatggattttaagccacttgtaaacattgtttaagctacattaaggtcttctttagaatttaatctttcagcgttttgaacctcaaattttcatattttcagaggtttacattaactgacttgtttttgcagttttaccccaacaaagtgggttcagtgaagaaaacagaggttgtgtttgtggctccaacgggtgaggagattagtaacagaaagcagctggagcagtatctcaaatcgcaccctggaaaccccgcgatcgcagagtttgattggacgactagtgggacacctaggagatctgcaagaatcagtgagaagactaaggctacgccgtcaccagataaagagccacccaagaagcgaggtagaaccaaatctccagtgtcaaagaaagatgcagaaggtgagaaatcagagggaggaggagaggaaaactctcatgtgaaagatactgaaatgaatcctccagagggaatcgccgagaatgaaaatgtgaccgataagaatggctccggtgaaactgagagggtgaatgatgcaaaagaaaacattgttgctgaggaaactccaaatgcggctccagttcaagaagagggtgagtcgatgaaggagaaagctctggattctgttgatgataagagtaaggagactgacaaagaaaaagatactggctcaatcgaaaagaactcggtagatgtagagaagaagaccgttgaagctagtgatgagaagaagaattctgaagctgagaccagaaaccatgaagaaaatggtctgaccacagaagctgaggggaaagagaaaacagcagaaggagaagctaccggatagccctgttctgctctgcttctgttagctcatgaaactgtaagtcagttgtttctatcaatctattgaagtatatggtttcctttttgcttcctactcggagcattatcgcggtgaaaggtgttgttaggctgagatatgtattatgagatatgtgcaagttctgtttggttgtaaggttatgtagaggatatattattgactcttctctaaaaccattgcaatcactaggtttgatgttttatctttctgctacaatctttagtcattttcgtatggatggacaatcaagttatgaacaagtcagattaaagatccacacatagattaatcttctagatttctttttatcattggttcaatcttcatttgaacgccataaaatgggaaacccaaataaaaaaatggaagaaagcagaagaagacaagaggaaaaaggtaaaagttttgctttgagagtaaagtaagaatctaatgcaaagaaagacttacaatgttagttttcttatttccttgattccatccttttgcatggtcccagggacgagggtttagaatctttctattaaggaacaacttcatagtataaactcttattgttcccattttaggattaaaaaaaaaacttgctctgttttcaaaaacatcattcgagacagtatctcaa

SEQ ID NO: 1815 - DNA, 3000 bp, Unknown
  misc_feature (1)..( 3000): cDNA_ID_3064500_gDNA_ID_1620452_Annot_ID_157526 3000 nt of promoter + ATG
gcgtctactttgcgtttgatctcagccacagtacatttcttcgtgtcgtatatgagacagcttcgttgcgagaagtctccatcgataatgtactcttctcctgttccgtcgtaaacttctacttccatcgtacaccgtccgattatcgacgatctacggacgctgaatatcggtttctgaccttccgatctctcgccgagaaaaccttcccatctttggtgtagagttggtctctgttcatcagaaaaataaacaacgagttgactcagtatcatctttagaactactatataacaaataaaggacactataaattgtgttagcaactgagtcgatgactcggaattaggcttatacaaaaagttgattaaaattttcagctcaaaacaatttcttcagatctcgtttctaacaatgatttttatcgattctagccaagtcattatttgtttaccaatacaaaaaacttatcaagattttcttgacaaaaaaaagaggttagcaaaagattcttgaattctgatggatgctcaccaatgaaattcattttttaaaccaaacccatctaatcaaattcagcacaagaagttgagcatcaaaatttattataatcacctagctagtcaccctcacgactagactcttactcatcccaacataattttaagaagaaaaaaaggatgaattaagtttacctttcgtttaacggtaaggagacacttcccggtcgcgtccatgaggacaatctcatcgttatctcttgtgtcaggtccataagaatcaaccctgaagatgatatcaccacggcagtcataggcggcgaagccatcgccggtgtagaagagagaagtcttgcagacggtgagtggtttgtcttcttggtaaagataagctttgtcgaccacaattctttctcccatctttttcccttcttttggaatggtctcttcaactaattccatttttatttttattttcttgtgtatgtgtgttttgtgtgtggaagttagattttgtggtttgattaacgaatgatttttaatctatgatatggacactcttctcttccttcctttgtctctctatttatatgtggttgatatatacgtacacacgcttgacgcgtatgtaatgaattaatatctttaagtctgcttcaaaaaagtcgtaacatatattattgttatttcctattggctaataataccaaagtcacatgcataaataattaaataacatgctataacttaaaaatgttagtttaatctgttttattaggctttattctaaactatttttagactgtttacacgccgcttttatatccaagttgcaaaagaagaaacaggtaggaagattgtttgaagtttttatggtattttaacattttaggtggtattattagtttgggatttaaataaagttttaatgacttaaaatattattgagaatatattgttatttaatcaaattttttaaaaagtttggtattattaatttaaattttttataaatttagaattattgaattcatacttttataaagtcattcaaagttttgtgttattcaactaaaacaaaaaaatctttgaatatttatgaattaaatttttgtgttattggtttataactttctacacgttttttacaaaataaaattataaaagtctcattaaaatagagagattgtttgagaaattttacaaaattgctaaaaactaattaataaaattatagaaaacactttagttataatttagaatcttttatttttttaccacctataattttatcaaaatcttcaaatttattgataaattagaaaccaatatatatcacttctttaatgtatttttatgtcgacaaatgttttatgttttatttatccacacggccactttatacttattgtaaatttataactttgtaaaagatgtctaactactaccctatacgtgattacgtgttacaagtttttttttttttttttaaattataataataagtatgaagaaaagaggaaataggaaattttgtacgtcgatttttttttttgtaaaagttgagtaaaagtgaactaaacatcaacgatgtcccaaatcatagccttgactagtagacaaacacgtctaattgggtgacgattagacagaccagtccaattatgtgaaaactaacaaaatcactacctcttgatttacatttacatttaaatgattacattcataccaccttttgagtgtgattgtatgaaatttacattctttggtacaactaaattcagatttctttctataatctcttaaatgtctactataaatttacaaataaaaaataaaatggttctaaatatatttaaaatctcaaaatatatgttggcatgcaaggaaattcaaaccaagataatcaagaaaacaggtatagcgtttcttctacgtcagatatcaaatccgtgatcgagtgaacaatgtcaatatgacaatattctacaaagaagaaattttgtttcattcatatttcttggtaatgtatcgattgatcattttgtttcttcctgtttttgtttctatattgtttaacactacaccaatgcttctgctgctttggatgacgagatagttttttttttactcgacacatcatacaagaccttcgtaagtatctgtaatacacgaatcattaatacataacacgaataatgcattactatagttttgagaatctcattctcatacttctgtctctcttgttgtcgaagaatatcacacttaacatataaaaagaacaacatgtcagtacacaaaggtaaagcccaccaaagagagaaaagaaaacaagacttaactataacaataaatttaatgtcgctctcaaaactcatttttttcatatgaattttctaacacaaacaattttccttggaaatctccgccttgtatctcttatataactcatctctctatactccgaacatgtccctctccgttaaccttaacggcc

SEQ ID NO: 1816 - DNA, 3000 bp, Unknown
  misc_feature (1)..( 3000): cDNA_ID_2046828_gDNA_ID_1620452_Annot_ID_157525 3000 nt of promoter + ATG
ctctgtgttgcatgtgatcgtgtctccaactcattcttcaccatgtgtcattttttattggcttttctaaagttaaaagcgatctatattaattaagtgttgtacaaacaaacaaaaaagcagttgttaaaaagaagatcacataactaaaacaaagagtttgtagtattaactatgttttcgtccactaactaatccgattaagaccattttatccactaactggtcttaatcttttatgaccattttaggattaatcttttgctaattttctctcactatacttaggatatttcattgcttgttaccattgacagcaaaattccagctggagaattaaataacacgggaaaataatctgaggtttgtttccatctctaccccacttttatttgactaaaatattaggatttatgaatgacgaagaaaaaaacaaattattaggtgaaaggaggcaataagaatttgaagataatcattaaatatatattttacctaaattaactcacacgacataccgtgtttagtgcggctaaaacagtgttaagatccggtgaagatgctaatacgcgattcaaagagcgcgtgaccacaaacccaagatcgaacggctcagatctcgcgggaatcatctgaagcgtgtactccacgcccatgaagaacagaagtccggcagcgaacatgcacggtatccaatggtatctcaccacgtagacgatatcacgcgccgtccacgtcgtgaacgacgctttgcttctccatcctcctcctccgacaccattggcgtagccgttgtcagttttcttagcagatatatccatgtgagtgtttgtatctccgacgcgacggttgttgttgtctagggttccgtcaatggcgacgccgttagtgtggtttccgttaagagagttagatctgcgacggagagagacgtcggtttcagctgcggcggctgacatggccgttaaggttaacggagagggacatgttcggagtatagagagatgagttatataagagatacaaggcggagatttccaaggaaaattgtttgtgttagaaaattcatatgaaaaaaatgagttttgagagcgacattaaatttattgttatagttaagtcttgttttcttttctctctttggtgggctttacctttgtgtactgacatgttgttctttttatatgttaagtgtgatattcttcgacaacaagagagacagaagtatgagaatgagattctcaaaactatagtaatgcattattcgtgttatgtattaatgattcgtgtattacagatacttacgaaggtcttgtatgatgtgtcgagtaaaaaaaaaactatctcgtcatccaaagcagcagaagcattggtgtagtgttaaacaatatagaaacaaaaacaggaagaaacaaaatgatcaatcgatacattaccaagaaatatgaatgaaacaaaatttcttctttgtagaatattgtcatattgacattgttcactcgatcacggatttgatatctgacgtagaagaaacgctatacctgttttcttgattatcttggtttgaatttccttgcatgccaacatatattttgagattttaaatatatttagaaccattttattttttatttgtaaatttatagtagacatttaagagattatagaaagaaatctgaatttagttgtaccaaagaatgtaaatttcatacaatcacactcaaaaggtggtatgaatgtaatcatttaaatgtaaatgtaaatcaagaggtagtgattttgttagttttcacataattggactggtctgtctaatcgtcacccaattagacgtgtttgtctactagtcaaggctatgatttgggacatcgttgatgtttagttcacttttactcaacttttacaaaaaaaaaaatcgacgtacaaaatttcctatttcctcttttcttcatacttattattataatttaaaaaaaaaaaaaaaaacttgtaacacgtaatcacgtatagggtagtagttagacatcttttacaaagttataaatttacaataagtataaagtggccgtgtggataaataaaacataaaacatttgtcgacataaaaatacattaaagaagtgatatatattggtttctaatttatcaataaatttgaagattttgataaaattataggtggtaaaaaaataaaagattctaaattataactaaagtgttttctataattttattaattagtttttagcaattttgtaaaatttctcaaacaatctctctattttaatgagacttttataattttattttgtaaaaaacgtgtagaaagttataaaccaataacacaaaaatttaattcataaatattcaaagatttttttgttttagttgaataacacaaaactttgaatgactttataaaagtatgaattcaataattctaaatttataaaaaatttaaattaataataccaaactttttaaaaaatttgattaaataacaatatattctcaataatattttaagtcattaaaactttatttaaatcccaaactaataataccacctaaaatgttaaaataccataaaaacttcaaacaatcttcctacctgtttcttcttttgcaacttggatataaaagcggcgtgtaaacagtctaaaaatagtttagaataaagcctaataaaacagattaaactaacatttttaagttatagcatgttatttaattatttatgcatgtgactttggtattattagccaataggaaataacaataatatatgttacgacttttttgaagcagacttaaagatattaattcattacatacgcgtcaagcgtgtgtacgtatatatcaaccacatataaatagagagacaaaggaaggaagagaagagtgtccatatcatagattaaaaatcattcgttaatcaaaccacaaaatctaacttccacacacaaaacacacatacacaagaaaataaaaataaaaatg

SEQ ID NO: 1817 - DNA, 150 bp, Unknown
  misc_feature (1)..( 150): cDNA_ID_2046800_gDNA_ID_1620452_Annot_ID_157532 3000 nt of promoter + ATG
ctgtctttccttttttggggtgtgaagaagatgttttcttttataaaaccctaattctctctttgtgtctttgtgtttgattagtggttcatgagtggtattgtgatcgatctgttactttcggagagcgagcaataagaagaggatatg

SEQ ID NO: 1818 - DNA, 3000 bp, Unknown
  misc_feature (1)..( 3000): cDNA_ID_2990274_gDNA_ID_1620452_Annot_ID_157528 3000 nt of promoter + ATG
tccggtccgtgttaggaacggctacactcgtgatccaaaacacctatctggacgctgagatgtgccctagatcgtcgtgtgctcacgaggcaaccccgaaaggaattgtgtttagaggccttgagtgggatttcaaaaccgtgtttcctaaactcaaaccagttgagtatctagaattgccgtggacaccttggccaaacagaacgtaaattttttgtcatcttttttttgcttccttttgtattgaatgtaattatagatattattcataatcagtttgtcacatacaatctcttgcacagatatatacctttaagtaaacacaaaaaagcagaacaaaatccttttttaaaaccttcatagcttcaatcgaaccgacagttttgactttaggcataaccatgtagttttttaagatcagtcgctggtgaatgccattctttgtttctgagcttccgatgggagcttgacatcagttgctaaaccgatggcttgaaggaacttaacgacgtaccaagtcatatcaagttgccaccattctaagccgtgtcgagctgagaactcaaaagcatggtgattgttgtgccatccttccccgaatgctagagctgctacccacctgcaaaattataattcagagtttcttttagtacaactatattatcttaagatggatcgagtgattaaggagtgatcgatgaagagttttaccagttgttcttagacaaatcgcctgtgttccatgcttgttttccccatacatgacaagctgagttcactagccaagttatatgatatacccatactattcttacaccctgcaaaacccaagaaaaaaaggattagagacgaaaatcaaatcagaaaccgtgactctatggaaatgttagagtagttataatcaagtttcttctgccttttttcttcttttcgttccgtttacaaatttgataaaaaaaaattcaatgtagtttcacttttagcatgcaaatgttgtttatatctaactaaatacaagcaactagaattaagtccattcacgagaagagcatgagccacaaatctttcttacaagaaagataagatatttacttgtggttctgttttgttcaacaaacacaacttgtgtgcctaaggtcaataatctaagttgcactaaattacaagaaaacgcaagagggaaatcaagtgaggagatttggcccagcaaattgatagctacacaaaaaaaactggtagaattatcttgttttggccgagctaaaacacatcataatcctatcagctagttatgaaaaattaacagtgaatagattcaaaatgcaagactagccacagaacataccattccccaaacgatgaatggaaagccacccattgcgtataaagcaaccgctagagccagcggatgcaaaatgtaggtggttcgaaggaatcgatagaatggctgcttctccaagtccccaacattattaggctctccacactttaaacatcatatacaaaacagagttttagaatacagttttcagaaaaatattaatatgaaaaaagagaagaagcaaatcgttaccctttgggtgattgtattggtatcaaacatccaattcatgtgactgaaccaaaacccatcaagtgggctatgagggtctctgtctgaatcacaaaactgatgatggtacctatgtgtactcacccaatcaattgggtttccctgaagaaaacaacacacaaacatcaatcacacaatttgtgacaaaattacacattcaacaaaaactacattatcatcaaatcaaatcacctgaagagcttgagctccacaataagcaaacaagtactcaagccatttaggtagcttgaaggctttatgagaaagattcctatggaaagacagagtaatccccagaagacctgtaacgatataaagcccaaaagcaaccgaaacagctctccaattgaattgaaacggagccaaaagactaagcaaatgcatagacaaaacgacagcaacagctccaaagtccatagctttccattctctctcccaccaaactactttttccttcttcttcaccaacacatcagataacattatccttctgtaatctccctccgtcgctgcagcagctgtggtgacatctctcttcaaacccttttcagagaatgcaacaacgagactaggaggcttgaaaggagcaagcttttggtgatgggtgaatgaaattctggtgaaattcaatgacggtgttgctgtgttcaaagttcttggagataacgatggtgaacagaggaaaacgggtttgggttttgttagaagagaagccattatcgatgtgatggctaagagaaagaaggaagagaagaggcttaaacccttaacttatatactagtagtataaatatgttaatatgtgtgcgtgtataaataagggtcggtcttttttgtatgcttcacaattagtagtactagttgtgatgacagagacgtgcaagatctcatcttttttgtggttcacgggactacattgcggctagatttggaaagagaggataagatggttttagggatttggattgccaatttggggcagttatctaaaacccggatcttctcttcaatttttcgagttgttttgctgaaaagcccgtgtttttcttggaaagttaacaaatcaccccaatatttgctttcaaacaattgggctcattgatctcttgaatgggcttattttggttttgagcccattctttcttattcattaaaggaaaaatcccaagagtgaaagggacatgttccatagaccttacatttcaaatttgatatttgtctctatgatacttaagtctttgtttgtatgtgtaagaaaaaaattctatagtagatatttgtatttgtggtgtgaaaaatccttatcttgaagccatatatcaattacttacatatttttctccttctttcatccccaaaaaaggtttctcattagatcggtatcgatg

SEQ ID NO: 1819 - DNA, 3000 bp, Unknown
  misc_feature (1)..( 3000): cDNA_ID_3064495_gDNA_ID_1620452_Annot_ID_157527 3000 nt of promoter + ATG
tctatattgtttaacactacaccaatgcttctgctgctttggatgacgagatagttttttttttactcgacacatcatacaagaccttcgtaagtatctgtaatacacgaatcattaatacataacacgaataatgcattactatagttttgagaatctcattctcatacttctgtctctcttgttgtcgaagaatatcacacttaacatataaaaagaacaacatgtcagtacacaaaggtaaagcccaccaaagagagaaaagaaaacaagacttaactataacaataaatttaatgtcgctctcaaaactcatttttttcatatgaattttctaacacaaacaattttccttggaaatctccgccttgtatctcttatataactcatctctctatactccgaacatgtccctctccgttaaccttaacggccatgtcagccgccgcagctgaaaccgacgtctctctccgtcgcagatctaactctcttaacggaaaccacactaacggcgtcgccattgacggaaccctagacaacaacaaccgtcgcgtcggagatacaaacactcacatggatatatctgctaagaaaactgacaacggctacgccaatggtgtcggaggaggaggatggagaagcaaagcgtcgttcacgacgtggacggcgcgtgatatcgtctacgtggtgagataccattggataccgtgcatgttcgctgccggacttctgttcttcatgggcgtggagtacacgcttcagatgattcccgcgagatctgagccgttcgatcttgggtttgtggtcacgcgctctttgaatcgcgtattagcatcttcaccggatcttaacactgttttagccgcactaaacacggtatgtcgtgtgagttaatttaggtaaaatatatatttaatgattatcttcaaattcttattgcctcctttcacctaataatttgtttttttcttcgtcattcataaatcctaatattttagtcaaataaaagtggggtagagatggaaacaaacctcagattattttcccgtgttatttaattctccagctggaattttgctgtcaatggtaacaagcaatgaaatatcctaagtatagtgagagaaaattagcaaaagattaatcctaaaatggtcataaaagattaagaccagttagtggataaaatggtcttaatcggattagttagtggacgaaaacatagttaatactacaaactctttgttttagttatgtgatcttctttttaacaactgcttttttgtttgtttgtacaacacttaattaatatagatcgcttttaactttagaaaagccaataaaaaatgacacatggtgaagaatgagttggagacacgatcacatgcaacacagagagattggttacttaaatctaagttttgtacttttaaactaatataattgggtggggacaggtgttcgtagggatgcaaacaacgtatattgtatggacatggttagtggaaggacgagcacgagccaccatcgcggctttattcatgttcacttgtcgcggcattctcggctactctactcagcttcctctccctcaggttccaatccacatatctctccctctttaaggataaaccaaatattattacattagtaacttcattttctttttataatattagtaatgatctaccagtatatatagatgtaacgtcctgtttactggttggtccatatcagcagaagtcgaacattttggacgtgtgatttcccttagccactaccgtatagaaaacagtttataaaggctccaaataatttgttaatctacaactctcattcaaagtatatttgattataatagtcttcaaatgattttatgttttctacctctaaaaaattttcatttaattttctataaaacgtacctctaagaaaactaattggctacgtatttctgttaaaattgactatagttttaacatagacaattagatattttctagttacagtttacattaaaactctaaagatattttaaaaaacaaaatcctctaaatgaccatatattagtgtgaagtgaaaggagtgatagattgtatatattttggtcgggagtgatagattgtgtctaacgcttttaagttttaacttgccgggtttaggttaattttcatcatcttagtgatttttcttcaattatcaggcatcactgttttccatctttcaaaatagttccacgatttgattgaatggacataaatatcagattgtcactcatatacattctacggtttctagtgactcatctatttactttctttctcgtgatgtagcatcggtacatggatttatgtgtcgttttcttatactattgacatgttcaagaaaaaaagtaatatcttaggttaattatctctagttcgtgatcaagataatttaatcccgggtattacataactcttttgcaggactttctaggatcaggggttgattttccggtgggaaatgtctctttcttcctcttcttctctggccatgtcgccggctcgatgatcgcatcattggacatgagaagaatgcagaggttgagacttgcaatggtctttgacatcctcaatgtattacagtcgatcagactgctcggtacaagaggacattacacaatcgaccttgcggttggagttggcgctgggattctcttcgactcattggccggaaagtacgaagagatgatgagcaagagacatttaggcactggttttagtttgatttcgaaagactctctagtcaattaaatttgttttctatcagaatgtttagttgagttgaatctagcgtaatgaatttttttgtttttctttgaaatggttctacttgactaccgttatttgaacctaactaagtgtgatcaatcttatgttaaggggtattacatagtctatttgaaattcataggatctacactatatattcatatatgttcccattagtatagtgaaaaaa

SEQ ID NO: 1820 - DNA, 3000 bp, Unknown
  misc_feature (1)..( 3000): cDNA_ID_2046855_gDNA_ID_1620452_Annot_ID_157519 3000 nt of promoter + ATG
ttggacacagtccaccatgatgacttccatcaacctaacttcactggtgctgctatcactaaaggtggtccaagggagccttggcatgacattcactcccgtcttgaaggtccaattgcttgggatgtcatgtacaacttcgagcagagatggagcaagcagggtggtaaagacattctggttaagttgagagatcttagtgatattattatcaccccttctcctgttatgttccaagaggaccacgatgtgtggaatgtccaattgtttaggtccattgatggaggagctgctgctgggtttcccgagtcgcctgaagctgctgcggaagccgggcttgtaagtgggaaagataacatcattgataggagtatccaagatgcttacattcatgcaatcagacgtgctaaggatttcatctacgttgaaaaccagtacttccttgggagttcttttgcttgggcagccgatggtattactcctgaggacatcaatgccctgcacttaatcccaaaagagttgtcgctgaagatagttagcaagattgagaaaggagagaagttcagggtctatgttgtggttccaatgtggccagaaggtctcccagagagtggatcagtgcaagctatattagactggcagaggaggaccatggagatgatgtacaaggatgtgattcaggctctcagggcccagggtcttgaggaagatccaagaaactatctgacattcttctgtcttggaaaccgtgaggtcaagaaagatggagagtatgagcctgctgagaaaccagaccccgacactgattacatgagggcgcaagaagcacgccgtttcatgatttacgtccacaccaaaatgatgatcggtaagttcacatttcaacggaaaaaaacttgagaagtatacataaatgttgtgcctgattcatttgatgaaatccattttgcagttgacgatgaatacattatcattgggtctgctaacatcaaccagaggtcaatggacggtgcaagagactctgagatagcaatgggaggttatcaaccacatcacttgtcccatagacaaccagctcgtggccagatccatgggtttcgtatgtcactctggtacgaacacctgggaatgctcgatgaaaccttcctcgatccatcaagcttggaatgcattgagaaagttaaccgcatttctgacaagtattgggacttttactcaagtgagtcactcgaacatgaccttcctggtcacttgctccgctacccgatcggtgtagccagcgaaggcgacatcactgagcttccaggatttgaattcttcccggacacaaaggcccgtatcctcggcaccaaatcagactacctgcctccaatccttacaacctaatctcactaagcatgtcaagtaatgatctctctctccctctctgctttgctgctgttgtagctttgaataaaacttgagtgtctacctttagaattaagaagtcaaatggttgttatgatgatgcacttctttacccctttggtttttatattcgtacaatgacgtggtgagagaatgtagctttgtgatcttgttttgttgttgttatgtacctttggacttatgaatcttatatctgatccttttctttttatttagtgtgtttcacatcaaagtttaaacaaaaatagcaatgaactaggtaaaacatacttcattagaaaagtgaaagtgacaatctagagataaagcatgaaactagggttcatatagcacaaaactaatacaaaaggggttttaaagttttaagccggaaacagggcacgacacaccggacaaatcccactgttcctaagccattcctctccacaagtacgatgaaacacatgcgaacacggcattcgacccgcttccacatctgacccaactcggatattatccatgcatatcacacaatagccttcattctcaacaacaagcgtctccaagtgcatctccaccgcctcatcgttcgctggagcaaccgcaagttgcacttgcacatctacgtgatcatcttcaccgggaaacctcgagacagtaacacctatctttacttgtaccctctccacgtctttcgcaccatctttcttcaaatccttaatctcatcagcaagagtgttaacaatagcagaataaggagggacttggagcgaatctagaatgtgatagacgatggctagtgaatgatcaccgtctccaccaaacaaccaatctcgatcaaactcgtgtgtttgctcaagggttagagtttgaagattgtcaaaatcgggaaaatcttcttcttcttcaacgtcatcatcttcttcttcggcacgagtgtaatgcactttgaaatcgaaaaacaatttttggctctttcgtagttctccgtcgtagtcgttgtagatccgcttgacatcgatcacgttgtctacgttatcgtttacatagaaagccatgattttgttggaagaagatgggtttgattatttgctgtgggtttagggttctaatatagagagattagagaaagatgaggcaattttgagttaacggcaaaaacctgaaaaaaggaaagtttgcttttgcttttatcttgctgagaggaagagagatcagatgatcaaagaaggagatcgctaaagtttcgtaacaaggctgagccaaacactcgtgttatatatcccactcctcaatttccgtttaacttgggaaattttccttttaataaaaaataccgaatattatttataatatgaaagtaaataaagtattaaccaataatattttttgaggatatttaataataactactttccttatttccctattttacaaaaatactcaggtggattccgaatcaaggtcccgatatctcagatctttttgtaaatatcatttcgtagaagttgtggccatcgacgatcctcattgttcttctttactctcgagatcttctttgctcaaaccttttatcgtggacgtctagaactg

SEQ ID NO: 1821 - DNA, 3000 bp, Unknown
  misc_feature (1)..( 3000): cDNA_ID_3064514_gDNA_ID_1620452_Annot_ID_157515 3000 nt of promoter + ATG
tgagattcatagagatgaagtagagaaatactaacttcgaattattcccagaaactgagatctgatcggagaaactcaatcgttcggtggtcagaagaagaattcgggatctggtccgtgatggaagctctttaagagctactttgtggagctgctgtaatttaattggagcgtgtggggccactttttcattattttctacagatctttgatgatttaatagtgacccaacgtacgaattgttattagtttcagccctacacgtttttagtttcacaattaggccctaaatagttactctcaagagattcctttcaatttataacttataatatatagttaatgttactagataacgatataattgtggttggattatgttatctcacatcctaatagtaatattttacgttacatctaaaattatataatagagtgaaaaagataaaatggaaagtttagtgactaattgaaaatcttgaaaagttttaagaaggccgacataaaaaaaggaaataaatattcaaagttgtaataaaatccctgacttgaggataggggagacaaaaaaaaaaaagagatatccaaatcgtgcgcccgacgttctgcatccaaacgttacgacatcgtttcccaagctgaatcctcaccgtccatcacaagaaaactatatggtgtacttttctcaagtagtacgtgttcgcataatgacatgaattcactagcaataatttaattgcttcatcattggatctcacacatcttcgctataagattgggtagttttttttttcgttttttttgggtaaagaagaatgtgatagttgtataaaatattactcctcataaacggaacgtggccacatggggattatacaatgtatttgcattctctggtatctaataagttctaatgtactaaccatcagcaaaaccgtcaatcataaaaatgcggtgaagaacagatcagaggtgtctcatatatggggatcaaagggaaaattaagacagtattggcaactcggcgtaatgctaaattgtaacacaatggtaggatacaagggagcttattttggagcttattcccctatctatgtttattatttagcaatgctcacggcaaggtttctgatacgcagccaccgctcaccggtgacttgtctgaaaaatctggacttaaaataacccaattcctttgttttgcttctatattagcttattttagaaaataggacttttgaattttagttgacccaaggaaaaaatgaagaagggacgtagaaactagaaatttaggtgctattgatatttgaatatgggccataattgggcctggtgatttaacattctgtacacgtatttaggcctgtatcttggaatgattttttttttttgtggtagggtaaaacttggaatgaaatttaggtgcacctattgatattgtccgactgtctgaactgaatttgataagtagtacgtgaatctttaactgtttagtaggaaaaaaaagaaaaaaaatcaaaagaatattactataattaaactacaataagtacataattagtttttttttttttcttataagcaaaaagaaaaaagctaaaatagaaaacccaaaagcgaagccgaagaaaagaaactaaaagcgaatcatgaaagtcaaaaatagacagaaaagataagaacatctccatcagtagtctctagtatggtttttcactaactaaaaaatataaaataataataaagtaggagagagagaaaagtaaataataggttacattttaataggttaaattattattttcagaataattatttaagtaaataataatattatatgataataattaaaaaacaatattttaagataatccacctaattttaccgttgaagatggcctaagaagcaaacacaagtttcttcggatagattatataaatgttttttggctcaacatcttcttcaaactaaaagtttgaaaggaattactaattagttatacgatccggtttatcaatcacaacagataaccgtcgtcatataaaaccaaggaactagaatcgggaaagcgtaatgatatgagctactttattcgctgcccgttcacaagttctaggtctgcaaaccaataaactttgtcattcactgctctctaggtctgaaaaccaataaactttgtcactcgcttacataatttacaagtttctaggactgaaaaccaataaacttttgtcaaaagaagacaaatttagcatgatatctttttgctaggattgaacatgtcacactcgagtatcatgtaatcaaatccgtggaccacttctctcaagtaggattcaaaaatgatatctcaaataacacctttttaatatgcattcaaaatatcaattcagattattttgtagatttaagtttttgttgagtggacggagactatcatataaatcgcggcatatacactatgtgtttaatgtacagctgattataacctctctttttttacctatgttatataattgcagatatttgacatttccttgaaaatcaaacgaagttaagggaaatggaaccaaaaaacatctttaaaaaatggaaccaaaaaacatgaagacacatttatttaatattgtaacagataatacaatgctacgtacttttaggagaacctttttttatttttaattaatacagtgcccactctgacgcctcatgggcactggtaataaatatgagatttgatagttactacatcattattttgttaagaaattgtatattcgtgtatccattttcttcacattgtcttcccctgtcccacaaatatccgctgaacatggtaaagtcctttagcatcttcttttctatgtacatatgtatcttatgtaagtagtataatatagtagctagtgtagtaaagccttcgcttcaacaacattttttctttagtcgtaaacatattcattcatgattttaacgctttttcttcaaaatatatg

SEQ ID NO: 1822 - DNA, 3000 bp, Unknown
  misc_feature (1)..( 3000): cDNA_ID_1394622_gDNA_ID_1620452_Annot_ID_157502 3000 nt of promoter + ATG
gagatccttgagactctcaagcaagaaccggatccggtttaccccggcgcgagacgaaccgggagagaacgcagatgggtctgactccatataatgcgggtcgataacaaaaaccggatacataaattcagaaccttttgaggcgtattcaagagccgggttgtcgtgaacccggagacctttccggaaccaaatcagtgaaccggatccagtagccattgatgttatgggattgagacgataacttgaaggtgaacagacgcagaatcgttgcatgaatatgtttgagatttctatagaagtttcttttgagaaattcgcgcctttgaaaagcgcgagagaaggtttcttaagacgaagatgtggttaatatacgcttcttcaactctgtgtttgctaatttgcgcggtaatcagcgtaagataaaagaagggaataggttattatcaacggttatatttaggccacgtcattactaaggagcaacatcatttgggcgatgtgttcaattatccaacatttagtgcttattagtatccatgattagtgaaattaagaaaatttacttcatatatttgagattgcaatcgtaattatatttgtatactaacattttaatctttatacgtgttgaacatatctaccgatccaacagttagcattaacaactgaggaaaaaaaaaaaaagcattaacaactgacaacaaataaaaagctaaactaactaatgatccaacggttcacaataaagcaacatcatacacgatccagaccgtacaaacagaaaacgacgccgcacaataaagcggttcttgagtatcatcgtaaacaaaaagttattcttcatcccataaaagagagacattttaagttcgacgaattattgattatttctggatccgtgacccgatccagttacttcttgacccgaacgtcagacgcgagtcgcgacgcgatcgcagaatggtacataacgtcgtggaatgtagaagcttcggcggttttcctccgcagctgcttagccttctcctccgtgagacaacatcgcagagacctcttttcagctttatccagatctgattccagattcacggttttgttgacgtaatcaggttccgatgacatgccaaaaagaggagcccaccatgaaaccgacgaaacaggtttcttacgggctggatccgattcggaagatgctcggatcgaggaaagagcggagcaggagatgattgtagccattgttaggtaaaatgtggttatctgagagaaagctcaaagctgtttttaggaagaagagaaagattaaggatttgtaaatttttggattaagaaaagaaaatggatatgtagatatttaggtggaatcagctgctatgcggtgtggttttttatagtgtggaatgttcgtttcactggtttttatcaacgtaagggtattttcggaaagagtgtgcaacggtaaatgcgttgtgcactacgataagtacggtggagatgagagcactggattataaaaaaatttaggagatggataagattgaaggcgtggagcagcgttgccaattgtcaaatgtcttcgtcttcacttttcgctttaattatttgttgattaggatatttttgtttggattttacattgcttgtgtgacttgtcgctttgacaatatccaaaatgacgtgtactcattggaaaatagagttcaactattatggaatattcttaaatcaggaataatcgtcggtgatatttgactatatctctttcaacgtatttcgaactcgtaacaaaatgtcagtcttcttttatcaaacggcaaaatgtaaaggtaaatgcatgtatatgatgtgatcatttgcatggaataggagtttttgttagatttacgaatgctgaacgcatataagtcttttaagactcatggtattatactattattgcatgtttcatcagccataaataatgtgcagagaaaaactaactaacaaaacattgattatatattttattgtatctaataagtaataactaaaataattagagctaagtgattgactgatttccttcgttattttgaattcaatttttgggctttttcctatttggcagattcgtatcacattagcaacactagggatttctgttttagttgcaagagaagataaaacgttataaagcccaaaagacccaattggtgaagcaagcccgcataagaaaaaacccaaatgttgaaccaaaaagatgaggatgcaaacttttcacgctagtgtcgtactaacggaaaacttcatatttggagacatcgagtagattttttttatctatgagaaaaataattcatctagaattttattgaggatatgagtataagataataatgaaagaaactattaattgtgtacgtctttatcgttcatatgttttgttcaatggacatatatatacattctacacacaaactactataccacgattttttttatgctaacattacctctagctacagacagaagtagaaagaaaaccaaaaccatcaggtattacatttgaagttttgaattgtggaattctcaacgaggttcgaggaacatgaatttggttgctaactaaagcaacttgcttgtgcctgtgtgcataactggactgaggaaaaaataatccttacatgtccatttcatcataatttcattttgtagtatatgcatcattgtatcattatttccacttgtatcactaattccacttgaaatgtcacacaatatagggtcccctgacacgtgtgtactatgtagtttcacacgtaccggttaatatcgagattccaagtaaaaaagtgaccaattctaaattaagaatctctctaatctcttcccaaagaagaatcatcactgaggaagaataaaacatttggggagtttcttcgctaatccttcaaggtgtgacctgagaatcacaacacaaaacaatctcactcgaaattcctttgactcatcatcatcacc

SEQ ID NO: 1823 - DNA, 3000 bp, Unknown
  misc_feature (1)..( 3000): cDNA_ID_3064537_gDNA_ID_1620452_Annot_ID_157506 3000 nt of promoter + ATG
aacaaagcacaaaaatgggcaatcttcgaaatatactaaaattttctattataattaacaaaataaaaaagagagggaaactgctaatatctggagtccattctcttggagaagagtaaagtgggcaaacaaaaaaaaaggaactgagctgattcgattctctttgggactcccatccatgcatcacctctttcatagtttcattttacttttatgtttattattttacaagattaagtaattagcttttttaactgcaagcataacaaataacaaaacctttattacggtctcaaacgctcaaaaatgtttttaaacatagtaaaaggtttcgttcaatacaatttgaaaaaggaaaaaacaaaaacaattttcttacaaatagatggccaccaacgattaattattaccgtcaaacttataattgggatgactcggtggttttgcgatggcgtttgttccaaaagagtgccatattgttcatttgttcttatatatgttttaatccataacacgttttggatcaatgttttcaagtaatcaaagtgaaagtagagaatatatcaattggtgaaaattttgaaatatcaatgtaattctttttaagtggatccattgatcaaggaggccactaaaatttgctcgaggcttggtagtgggttcatttgtgtttgataaatacactttttagtactcatcccctttttttgtctgacatcgtatatgtatattggttacatctaaatttgtcacacttgtgtagcagtgatagttgtctcagtgtgtctatagactatagttaaatgttaattagtagtatttatacaatactaattacatcatctaaatatttgcatatgattcacacaaggcaaatttccttggctaattgtcacactatttatgtgaaggtgagtagttaaagctaataacctcgaagttgcttggtttatatgagatcaagtttggctcttgtaagtgaagataataatttaaagagtattttaatcgtgataatctaaatgttagttgatagttaatacgtcacggaacatgtaccgaccgacggccgatttccatgatacaataaaaaaatgaaaattagcaatctcataacatgcgacgacgatacttatggtgttgccacgtagcaagcatcttcctcttaaccatgaggtgtcgcaacctcagaggacaacacggacaagaccgagaaaccgcatactaacgcttgcaacgtaaagcacaacacccctaaactcctatttttttaattttcttttaacctcaacacaccacgcagctatacacgtttcaatgtgctaatacgtgtcttcttctccgccgaccaagacacactacaaatgtcccgatggtttggggagacaaatcacagtttctactacaacaacaaatacttttacgaaaaaagcttttaaaacttatctagtttcgtttgatacacatttgaagaaagaaatggcatccaaccaacagagctacaaagctggtgagaccagaggcaaggcccaggtaataagaatatatttttgtgtatgtgtatacgtaaaaccacattatataagctctaagatgatttgtctgtgtaataccaggagaagactggacaagctatgggaacgatgagggacaaggctgaggagggccgggacaagacttctcaaacggcccaaacagcccaacagaaggcccatgagacagcccagtcagctaaagataagacatctcaaactgcccaagcggctcagcagaaggcccatgaaacggcccagtcagcaaaagagaagacatctcaaactgcccaaacggcacagcaaaaggcccatgagacgacgcaagcagcaaaagaaaagacatctcaagctggcgacaaagctcgcgaggccaaggacaaggccgggagctacttatcggagacaggcgaagccataaagaacaaggctcaagacgctgctcagtatacaaaggagacggctcaaggtgcggcacagtacacaaaggagacggctgaagccggtagagacaagacgggtggattcttgagccagactggtgagcatgttaagcaaatggcaatgggtgcagctgatgcagtgaagcatacttttgggatggctactgaggaagaagacaaagagcattatccaggaagtactactaccactactgcaactactcgaaccactgatccgactcatcagacttatcagaggaagtgatgagaaaacaaaattgagaacgatatgaaagtatctttgtgttagttggtcttttgagttttgtgtttgtgtttttgtaatttccgttgtgtctttctttatggttgtggttcagctgtgtttcttgttgtgacggtgatcctggagacttctaatttccagccaataagtttagatttgatcctgttacaacttatgtgttctcaaatttctatttttgttacaataaacagttattaatacacatcatggtccacttcgtatgttggtcatcaagcattagcattatacagatatagctgctaatccaaacgggttttactaatctttcaatttcttttatcaaaaatttcaataaaacatttgtgtctgcttttacgttttacgaatcgttcaatttcatagatctactaaaatgagagaagtaaaccaaaaaaattgaatagtaatttatctaaaccgagcaaaccaaataaatttatcaagacgtcaacggacgtatactttggtgaccatccgaaacgacatcgtataacatcttagggttatgagtaatgacacgacgtcgttctctgggtcggtcactggagatgaagagaagcggtcgcgacattgtaaagatctctagctccgtccttcttcctcgtagctaccctctctaatctttttttctcattcctgttcttgatagttttctagacagatttcgattaaacaaaaccgcggaacactttgaagaaatctgcgtgatttagagatg

SEQ ID NO: 1824 - DNA, 3000 bp, Unknown
  misc_feature (1)..( 3000): cDNA_ID_3064524_gDNA_ID_1620452_Annot_ID_157513 3000 nt of promoter + ATG
ttagtttcatttatctctttggttacatatattttagctagataggttacatatattatgcgagtaaaatttgtaatctaattgtttttataagtgtcaccacatccacatggattcaaactccgctatgttacaaacaggagaactattttctgaatggtttaattaaccaattatcaaagaaaaaaaatgaaacccttgtttttattctcaacagcctatttttttcaatgagattattttttcatttacttgattttcttaccatttataacaaaaccccaaaatttcacatatatcaaaatcaaatctattgctatttatagccataaatggtggtatttccgtaataaagatatagtcaaaggtttaaattcaaacatattcattaatatttaaaccggtttaactaacagtagtaaaccgacatttcgatatttaaaccgatttgcagaaacgctcgtgaatcaaatcaaatctgtgtttcattctcttctccactgaaacgcgtttgaaggagaagggtcaaagggatctgatcctatcactttcgctgggaaaaacacgaaatcgaaggaagaatcaatcatgggtttcatcggagaaactgtagattccatcaaatctatcaagatccgtcaagttctcactcaggctatcactctcggttcgtttcgatatcaattgattttactctcatttgcgttttagatttcgagaaattggtatctaaatctcaccaaatgtcacatcttgagaagcttaatatgtatataatgggtttggttttgtttttgggtttaggtatgatcgttacatctgcattgataatttggaaggcattgatatgtgtcactggcagtgaatcaccagtggttgttgttctctctgaaagtatggaacctggctttcagagagtaagtcacattatgttttactcattgcatttgattatgtggttgttggttattgattttgaggctaatgtgacacagggagatatattgttcttgcggatgactgatgagcctattcgagcaggcgagattgttgtgttcagtgttgatgttagtgtatctcttgtcctgttccatcaattcactatctttcttcgattctcgtggtttaatttgtcttgatgctttcgtttttcagggtcgtgaaattcccattgttcatcgagcaatcaaagtaatgtttctcgtactttttctcatctctggacatcagaggttcaggatacttacacttgattgcttactcgcttgtttgttgttttaacacatcacaggttcatgagagaggagatactaaagcagttgatgttctaacaaaaggtgctaagtttttgttggtatgaatgaataaccctttatagtaaccaattcctgacacaacttaacattttccaggtgacaacaatgacattgatgacattggtctctatgctgaaggacagctttggcttcacaggcatcatatcatgggcagagctgttgggtaaacactctaattcaacaagcttttgtgcccctgtgatctccttgaaactggtgcgaaatgttcaagagccgtaaattgttcccttttgatctcttttcagattcttgccttatgttggatgggttactattatcatgacagaaaagcctatcatcaaggtacaatcttctaacacggcctgcaatttatgtcatggtttttgacttgagatatatgtactcaccagaagatttttgttcatcttctcttcttttagtatatactcattggtgcattgggtttgctcgttataacatcgaaagactaagactacataacaagctggtcgttggtaaggaggtagcttctgcaacgctcgggtcatcatctttgtagccatcatctttgaaactgtagaatcatataaacctcaacttataattatagacacttttatctttaaatcagctacgttttgtgacaatttcttctttcgcagtgttgtttatgattttttcgaatagttttagggaagtgaaattcgtgaatggtctaagctctgaagggacatactaatttgttaaattctaaaagagcggctgaactttaaaaaaacgattgaaatatgacgcttttaatgaaaataaacaataacttgtgttaaaagattacagtttgaattcacagaagcagtcagggcaatgcagatcctctgccagtttcaaaatcattcttatgaacctcctaaagagcttactttctcttcagttctatgagcacttacctctgcaaatgcttttcttctcaagaacagagttttatacatccatttataccattctatcaaggcagcttttgtatttccatgcattcttgtgacatcttcatggtttagcaaatgaggcttagaaaacacaactttgtataaaccaatgtaaaacctcccatctccatcagacaatgttggttgttgttaactggaagttgatcatgagattgcatagtatgatactctaattttcaagactacatgtacactggttagtttgtgacattcagaccaatgatcgttatcttgaggaaaaaagttgaaaaactctactagctagagccatatactagattataaaacaagattctcatattttgcatttccccattaaatttgtatgcatcattgtatgtctatgacatgataaccataacacgagacaatcaacgaattattttggtttaataaagagaaatcagtatactaatgcatattattgtcaaagtagctggtcaattcatctaaatattaatcacacgatcgaataaaataggataaataaatcttgaggtcctccaacgactaacacttgaataaataaagaaaacacaacgtgcgggtcagtacaagccatggctaacacgatcttctatatacttatatggttataacttatatgttcattgagtgattacttctttgaattaaagaaaattagattgtaactaagtaactttgtaaggatg

SEQ ID NO: 1825 - DNA, 3000 bp, Unknown
  misc_feature (1)..( 3000): cDNA_ID_2024994_gDNA_ID_1620452_Annot_ID_157500 3000 nt of promoter + ATG
gatctgaaaatgcgtaaactatagcaacgatgaatcacctgaatcggagctgaaacgacgagggataacgaaagaagatgcggaaatggctgatcgattggcggcgagatagaaaccgacaggtctggtggtggcggctatcgatcgacgaggagaagcagcgacgacatcggcggctagggttttgagctgagaggagacgattcttctccacatggtgatgatgatgagtcaaaggaatttcgagtgagattgttttgtgttgtgattctcaggtcacaccttgaaggattagcgaagaaactccccaaatgttttattcttcctcagtgatgattcttctttgggaagagattagagagattcttaatttagaattggtcacttttttacttggaatctcgatattaaccggtacgtgtgaaactacatagtacacacgtgtcaggggaccctatattgtgtgacatttcaagtggaattagtgatacaagtggaaataatgatacaatgatgcatatactacaaaatgaaattatgatgaaatggacatgtaaggattattttttcctcagtccagttatgcacacaggcacaagcaagttgctttagttagcaaccaaattcatgttcctcgaacctcgttgagaattccacaattcaaaacttcaaatgtaatacctgatggttttggttttctttctacttctgtctgtagctagaggtaatgttagcataaaaaaaatcgtggtatagtagtttgtgtgtagaatgtatatatatgtccattgaacaaaacatatgaacgataaagacgtacacaattaatagtttctttcattattatcttatactcatatcctcaataaaattctagatgaattatttttctcatagataaaaaaaatctactcgatgtctccaaatatgaagttttccgttagtacgacactagcgtgaaaagtttgcatcctcatctttttggttcaacatttgggttttttcttatgcgggcttgcttcaccaattgggtcttttgggctttataacgttttatcttctcttgcaactaaaacagaaatccctagtgttgctaatgtgatacgaatctgccaaataggaaaaagcccaaaaattgaattcaaaataacgaaggaaatcagtcaatcacttagctctaattattttagttattacttattagatacaataaaatatataatcaatgttttgttagttagtttttctctgcacattatttatggctgatgaaacatgcaataatagtataataccatgagtcttaaaagacttatatgcgttcagcattcgtaaatctaacaaaaactcctattccatgcaaatgatcacatcatatacatgcatttacctttacattttgccgtttgataaaagaagactgacattttgttacgagttcgaaatacgttgaaagagatatagtcaaatatcaccgacgattattcctgatttaagaatattccataatagttgaactctattttccaatgagtacacgtcattttggatattgtcaaagcgacaagtcacacaagcaatgtaaaatccaaacaaaaatatcctaatcaacaaataattaaagcgaaaagtgaagacgaagacatttgacaattggcaacgctgctccacgccttcaatcttatccatctcctaaatttttttataatccagtgctctcatctccaccgtacttatcgtagtgcacaacgcatttaccgttgcacactctttccgaaaatacccttacgttgataaaaaccagtgaaacgaacattccacactataaaaaaccacaccgcatagcagctgattccacctaaatatctacatatccattttcttttcttaatccaaaaatttacaaatccttaatctttctcttcttcctaaaaacagctttgagctttctctcagataaccacattttacctaacaatggctacaatcatctcctgctccgctctttcctcgatccgagcatcttccgaatcggatccagcccgtaagaaacctgtttcgtcggtttcatggtgggctcctctttttggcatgtcatcggaacctgattacgtcaacaaaaccgtgaatctggaatcagatctggataaagctgaaaagaggtctctgcgatgttgtctcacggaggagaaggctaagcagctgcggaggaaaaccgccgaagcttctacattccacgacgttatgtaccattctgcgatcgcgtcgcgactcgcgtctgacgttcgggtcaagaagtaactggatcgggtcacggatccagaaataatcaataattcgtcgaacttaaaatgtctctcttttatgggatgaagaataactttttgtttacgatgatactcaagaaccgctttattgtgcggcgtcgttttctgtttgtacggtctggatcgtgtatgatgttgctttattgtgaaccgttggatcattagttagtttagctttttatttgttgtcagttgttaatgctttttttttttttcctcagttgttaatgctaactgttggatcggtagatatgttcaacacgtataaagattaaaatgttagtatacaaatataattacgattgcaatctcaaatatatgaagtaaattttcttaatttcactaatcatggatactaataagcactaaatgttggataattgaacacatcgcccaaatgatgttgctccttagtaatgacgtggcctaaatataaccgttgataataacctattcccttcttttatcttacgctgattaccgcgcaaattagcaaacacagagttgaagaagcgtatattaaccacatcttcgtcttaagaaaccttctctcgcgcttttcaaaggcgcgaatttctcaaaagaaacttctatagaaatctcaaacatattcatgcaacgattctgcgtctgttcaccttcaagttatcgtctcaatcccataacatcaatg

SEQ ID NO: 1826 - DNA, 3000 bp, Unknown
  misc_feature (1)..( 3000): cDNA_ID_2145511_gDNA_ID_1620453_Annot_ID_157555 3000 nt of promoter + ATG
aaacataacgattgaattttctgaaatattttgtctcttgttggtgttcttttaataccaaatcagggttggtggttctggaatggacatgagaagcaaagccagggtaatttttcattctctagataatcttgtgaaaaggtcaacttttgtctatctctatttttggtagtaattctggtttatatatgtagactctacctggaccagtgactgacccttcgcagctaccaaagtggaactatgatggttcaagcacaggccaagctcctggtgaagacagtgaagtcatcttatagttaataatctttctttcttgatcttaaatcagattcttctcattggtttttttttcgattcttgtttactaatcttttgtgttttgtacatctttgtttagccctcaagccatattcaaggatcctttccgtagaggaaacaacattcttgtgagtttcttttagttttgaccttttttgttgcagccatgctttattacatccatcttaacttaatggttttgatcaggtcatgtgcgatgcgtacactcccgcgggtgaaccaatcccgactaacaaaagacacgctgcggctaaggtctttagcaaccctgatgttgcagctgaagtgccatggtatggtattgagcaagaatacactttactccagaaagatgtgaagtggcctgttggttggcctattggtggttatcccggccctcaggtgaagaagatggatatataatcggttttgtatcttttccgttgtcggttattctaaaattttaggcgaaaatgtattgcagggaccgtactattgcggtattggagcagacaaatcttttggcagagatgttgttgattctcactacaaggcctgcttatacgctgggatcaacattagtggcatcaatggagaagtcatgccgggtcagtgggagttccaggtcggtccagctgttggtatctcggctgctgatgaaatttgggtcgctcgttacattttggaggtaagtttaacgttataacttcaatgtttgtttatgtagtttttgattagtaacacttagcttgttcttaaaacagaggatcacagagattgctggtgtagtggtatcttttgacccgaaaccgattcccggtgactggaacggtgctggtgctcactgcaactacaggtacatgtcaagaatctcttaaatgttttcttttatggtcttttcgctgattcataaaaccaaaatggtaattgtttcagtaccaagtcaatgagggaagaaggcggttacgagatcatcaagaaagcaatcgataaattgggactgagacacaaagaacacattgctgcttacggtgaaggcaatgagcgtcgtctcacaggacaccacgagactgctgacatcaacactttcctttgggtatactaacaaacatctttgcgggttttcgaatagtaaaaaagccgaattacgatacattttgtgattcttttgtgtgttggaatgttgtatgtagggtgttgcgaaccgtggagcatcgatccgagtaggacgtgatacggagaaagaagggaaaggatactttgaggacaggaggccagcttcgaacatggatccttacattgtcacttccatgattgcagagactacaatcctctggaatccttgatgatcatcagatcaagaaaaaatcttgaatgtcactcaaatttgtgtttcttgcaagattcaaagtttgtgttctctatcaagcaatgtcttaggataagtcaaagatttgctctgcttattctgctttttatttacttcacatcctattgaaaacatttctgtgtattatttatgaataaacattatcttaaaagggctgatttatttactaatgcatgcattcaccacttaagatccagaatttgtttttttttttttgcattttgattcatataagataacaactaaaatgaaaattaatctggtttgcggggcaggctaggtggatctaaatgtatattaatatttttttaatttttcaaaataaatatttcaaattatatataaagataactatacttttattattttatttatcttattttaaaatgttaaatttaaattcgttttcaagaatgctttttataatgtttttttctaatatttcatgtagtagtatataaatagatatcattttattctaaaaccgtttaaaatgtttaggttccgactaagcgttctaggcactaagcagaaggtcaccacccgtttagcacctagcgttttgttgaacactaattctaatgcataatttagaatcactgattgaacatttagcttggattaatatattttattaaagtttgaaaatatagttaaaatcaattttagttatttcggttcaggttaatttggaccaatgaagaaccgaaccaaatgatttgaaagtaatttcgtcgaacacctggtgagcaacttcactatactcgagggtttaaggattcttcgcgtctgacaaaacttgaggaagaaaaaaaaacaaatgtctctgcttcgaattttgtcgactctttacaaaggaactcatcggacttcacgttccttctcttcttcgcggaatctgatctgcaccactttcgctaatccactctccggtaactcttttagatcatttctcgaatcaatttctttcctttatcaaatcccattatgccattctttgtttctattcgaaattatgtatcttttaacgttgatttttgatttcttcacacaatgatagaatttgatttgtaacatttcagtggaactgaatcgaaatcttttaaattttttctctatatgtgaaattttgtatagtattcaatttgaactcagagtttgtgtaaccatttcaacctttttagatgattctcatgtaaaagataggttcttgattcttaacaaaaggacaaaaattgtttatatttgagtaagaatgttgagtttttatgtgagagattgtcaaaatg

SEQ ID NO: 1827 - DNA, 3000 bp, Unknown
  misc_feature (1)..( 3000): cDNA_ID_3064581_gDNA_ID_1620453_Annot_ID_157570 3000 nt of promoter + ATG
ctaatttggacagaatgttatgtaagcgaatgttgaatatatatagtgatgatgaactcatttgtaattatttattgttctactggttatgaccattacagcaagtttctattcatataaaaattaggtggttattttcttatctaataaatctttagatgtttacatatatcttttgattgttctggaaaaatgaaattttctagagaaacatcacggttgggaaaagatggcacatgatacatctactttaggttagactcctaacgttttgagaacaattgtttggagcggtgcacatttctattgtgtactaaaaaccattcggttagacttgtattcagaattcggtattgttaatatagggagtgagcaatttggtttatgattcgggttggttatttttacggtttgacagaaatataaatcatctaaaaccattcgtaattcggtttagtaagaaatttatgtaaatactgattatgattttcaatatataaaagattaaatataagattcaatgaatttttattttgttcgattcagtttagtttgattacaccaaaattggtttcagttcagttttggttacagaatatttcgaattttaagataacgaaacaaacgttttataagaaacgtccacgatgcatttgatgaaaccaatgttgcgttgatccagttatgtttctagtgttaatggtttattctcaactctaagctgcatagatacatagctatatctcacactgtctgtcacacgtatgacgtatctatggtcaaacttaattatatcaaaagagtatttttggtataagaaaatactatgaaaagagtaatttgattacttaataaaaacgtgtatggattcataagaagttggccaactgacgtcataagaagtcaaaatgtagttaggtttatattgtttgattaactcgttatttatttacaacttgctgtaagaaacctagattctttaaaataaagataaaacctaacgatagagtgattagactaattcccaaaaggaaaaaacaaagtagctaggtagtcccttgattggaatcttgccttgtgacttgtgagactaccactagcaacaaaaacagacctgatcaattgtagtcgagcctaattaaaaaaggttcaactgagctctaaaatatgcaagtgggggtgaacgagaaattttcataaattgaatctttcctaaacggcttactcgactcaatggtcagcaacaaataaagaaacgtgacacaacacaaagaggaaatagggttaggggagaaatcatggcaacgcctctagtcgaactgaccatacacaaccattgtttttattccaaattttcaaaattgcactattctcacggttcttattgcgagatcgactatctggttgggtaagacatgacatttacgtatctactaagtattacaatatgcctcttaccatattaaagaagaatccaataaagagtggcatgcattaagaatgtaaacgaagaggaaaacattcattacaagggagattttcgagaatgaaatgtgggctcgcttcagactcacaaattgtgaagattatacaaacttgaagtataaaggagtagtaccaacaagagtttcaaaggattaccaaataagggagtacaaaaataaggaaataccaactagagtttcaagtcctctagaataaatttggggatggaagcaaaatgcattggtcgtcacaactgtagtatggacccatgggctactgcacctctctccaccctatttgggccaggcctagttcttatcccttccaaatattttgatatcttaatcactaatatctatatgaaactttctttgtataaacatttcttggaacgagaagaatccattttaaccggttcctagtttaccaattttacattactagaactgaattttcattattcataaccaacaatgcaatttgtctacacatatcaatttgtcaattttactaatatcagtttatagtaataattatagacaaatcaacaaaacatatttacacaccttaagagtttttataactcattcagacaaaaacaattaattaaaatacccttaaaaatagttaaaaatattttcactttttaaaaaatcaatgggaggggatcaaagattttcacaatttacaagatttgtgtaaactaatactcttcatttttatttgatttttgtaggaaaaaaaatgttttttaaacattaattttttaggttttatatgcagtattattgatgtattttaaacttcaataaaaataattgaatattctttatgatcagatttaatatatattttaaatattttttttttagaaaattaattaaaaataacaaaaggagtaaataaataaaacggaataaagttgggcgtttttttattacaaaacatgggaaaatggacaagttcttcaattcttgctttttgggcttcttgcctgtctctgtctcgaaacacccagaaagagagataatctcgcttatctgtctttatacttagctggtttcttcttcttctttatcccttttggctcttattacaacttttttttttccatgtatttcctcaaattttaatattttttctttactgtatattcatcaaatctcaagttctctaatttcccattcgacctcgaaatttgaccaatttctcttgtctcaaatttcagattctcttcctctgaaaaaaatcaaaaaccaagtcttctaattccatctcctctctgtacccatctcctaaaaatctcaactttgagtcaaaattttgtcttctctcaaaccaattcatagttctaaaaatctcacctttatctcaaatttttaatctttcatctgatttctgaaacccaaattctctaatctcatctttgagccaaaaagtttcaatctttcctctgatttctgaaaccaaaaatctctaatttcaaaaaaaaaaaatctcacctttgggtcaaaa

SEQ ID NO: 1828 - DNA, 3000 bp, Unknown
  misc_feature (1)..( 3000): cDNA_ID_2145580_gDNA_ID_1620453_Annot_ID_157574 3000 nt of promoter + ATG
ggtaatacgagacaagttagttcggtgtacatatcaaattaattgaggtgcacgatatctataattaatgcaggatagttacagcgagtttacatctattttattatactactaaattttgaatattttgttcaaaaaggtgcgaaataaaaataattatgccaagttgataaaattatgattgctatgttctgaatgatgaaataagcattatgagaaattggtagaacgtgttactttacaatattacatgtgttttgctatagagactatagtaacatggtcttttttaaaatgtcaataaattcaacctgaaccaccgaatatggaaggctcgccggacgagaagagaaaaaaatattgtcggatactgccggagcccaacttgtaaggttgaatttactggaaacaaaaacgttgtagggtcgaggaaagctaagagagtgacgactataggtaggtatctattgtttgtagttttagacttttattaggattttacagatgactacacttcaaaattatgaatttaaatttcgatggtttacacaaaaagttatttatctgatccgagaaaaaaaaacagaacaaaatccttttttccagtaaatctaaaaagatgactactattttcagtattttagtgaaagaaatttatatcactttttttttttataaacgatattgactgatctgatcaactctgataaaaatgtattaaaatgattcagtctccccaaaaaatcaacataatccgtgtctcaagttttcaaatgtgttacgagtaatatcttggatcatcaaatcgcctattactaattaccaaatgaattgtttgcgtatttggtcgaaactcatacttttcatacaaatatgttttttttttgtttcttaggtggattgaacatgtattagttcctttcaacatttcttcaattctcaaccactagtagaccacaaatgtgtaggcactttttaaacttaaaattgatctatttttgttgagccttttgtacatatgggcatattttgacataaaaactagaatagaagtatattctacttggacttataagcttgggtactgtttggtccgcaaaatgacgatttcgccttcaaatttgttgatgataatccaattcgttttttccgtcatgagaccaacaaccctcaccgtctccatcgactgcaattctctccgtcgtgataatcaaatttgtttattaacaccgactctacattccatcaaaatcattattttcgactccatcaatatcgtttccttatgcttcgatgattcacacaacgtttatacgaccaacctttttcgatgaatccaatagaactaattaaacaagttttgatgtaagatatctaagctctaagagatgatgttatagaacccaaattctctaattatagatgcggatcgaatcatcttaaccgtaaaagataatgtctaaagaactcagaacaatcatgtatgcaataactgaaaagtatatgattgtgaatcatgagcaaatcttaagtcattttcgtcaaaattatatctcaagacccaattaaaattttaaagaagaaaaaataataaaggcaaattaatattttagaaaaaacaaaaatatccgtctttataatcactcgagaatatggctaaattcataatagaccatactttattatggtttttctataattaatcctaattttattagttgcatgaaattttggaaatcttataaaatacaataacttttggtccataatatattgtaatattgtgtatagttttttagtcaatgattgtttctaattatactgatttattaccaatttacactgccacttttggttagttgcatgaaaattttggaaggctagaaaaaataaattttcgcgcaacaaaatcatactcctttgtttatagttatggtgatggaaatcaaatacgtaccagacctttgtttatagttaaggaaaaaagaattaaagtcttcaaactctaatttgctggtcaaatccaaatttggcgtgacatgtgcccgtaattaaaaattaattgcgtaattaaatactaactttctaattagctgcatcatcgagacgaataattgagtgtattggtcaattgaatacgacaaaaattatttaaatagtcggtaaaatacccatagaaattgactaatccgtcacctcccccggataatacagttttaacatttggttttctaattcaaactaacatttaaattccctaaaaacctttacacgacctattgccatctaatccaaaactaaaagtactagttttttttttctcaactcaattataataaataagaggaaaaaacaccaaacaacaaaacaaaaacatatcatataaaaaatcataaatttttaagaggcaaagtaggtcagaattcttattaaaaaaaaaattaaccagctaatgaattaacataacactctctaaaaacgagtaagacaaatttggacaatacaatattttaaattaaaagaaaaagaaacaaatgattgtaagaatttgtaactttagaaaaatatagtacaacatcttcaacctccacaatttaataaaaaggatgaagcatatgatttagaaaaattattaaaattagttagaatctcttcggtttctcaacgtttgttttgtattttttgtgttcctctattattatttttgtattgttcacttaatttcttgttttccaataatctattttgttttacatgtctttttagaaatggtaaacaattaaagtaaaaaagagacagaggtggctcgaggcagaaaagtctacaatatatccatcctcggaaaaataaagaagataaaatcagttccgtatctatataagaaaatagacaaaagtcacaaaacctcatcagagctgtccgaattctccaagtctctcatcatcacacccactccaacaaactttctacgagagaaaaaaacaaaaagaaaaacaaaca

SEQ ID NO: 1829 - DNA, 3000 bp, Unknown
  misc_feature (1)..( 3000): cDNA_ID_3064556_gDNA_ID_1620453_Annot_ID_157572 3000 nt of promoter + ATG
agactgaatcattttaatacatttttatcagagttgatcagatcagtcaatatcgtttataaaaaaaaaaagtgatataaatttctttcactaaaatactgaaaatagtagtcatctttttagatttactggaaaaaaggattttgttctgtttttttttctcggatcagataaataactttttgtgtaaaccatcgaaatttaaattcataattttgaagtgtagtcatctgtaaaatcctaataaaagtctaaaactacaaacaatagatacctacctatagtcgtcactctcttagctttcctcgaccctacaacgtttttgtttccagtaaattcaaccttacaagttgggctccggcagtatccgacaatatttttttctcttctcgtccggcgagccttccatattcggtggttcaggttgaatttattgacattttaaaaaagaccatgttactatagtctctatagcaaaacacatgtaatattgtaaagtaacacgttctaccaatttctcataatgcttatttcatcattcagaacatagcaatcataattttatcaacttggcataattatttttatttcgcacctttttgaacaaaatattcaaaatttagtagtataataaaatagatgtaaactcgctgtaactatcctgcattaattatagatatcgtgcacctcaattaatttgatatgtacaccgaactaacttgtctcgtattaccggcttaccgttttccaaataaataattttctgtattaggttcgtactacatttcctgtgtcatatgtctcacctcacttttagttgtacttcacctaatgatgcattgaaattcccgactaaatcctccttgtgaggagtatattatattatagccattttctaaagagaaaatgaggctaaggaaccatagtgatttgcgtaatttccactcatgatttggctatacacctaattactccatatttatatataatagtgaaaccttgtagcttatggatcaccattatctaattaaagtgtagttgccattattgatatttgcatgggagaataaatatgctgaccaatttttcactaaagtctcaatgaccttagttgtagaaatatatataaaacaatgtttttatggtggaaaactttcagaaaagattccactcatctctctttctcaccatagttgatgcatccacatttgagccaacaagccaatagcattagattcataaagaaaaaaacttaaacgtacgtacaaatatgcaataaacaaattagtgatcattgatcaataaccatcatttttataacaaaaagtggtttttcacatatctatgaataaccccatcgataaataatttgtgctcttgatgtttcgggacttataatatgaatgtaattaaggatattatagattcttctcaatagagtttcaatatggatggaaactcctaacaattacctttcatggtctctttctatctctatatctcttcctttgtgctcttataaaacgaaagcaataagtatatgaaatccatgcttctttactgatgtatgcatagaagactaatatatatatatatatatatgaagatatataaagagtgatgaaaggggagaataaaaaattgttggtgagtgtgaatgttcttggaagtgttggccctataaggtttttggccaatgaagacgatgaagtttcaagtgttattaacacaaccttgaaagcctatgctcgtcaagggaggatcccggttctagggttcgaagtggataacctcaatttctattccattaacgccggattcagtagtattttccatccaccactatttagtttgttctcttagaatcacctaaattctagattaatcttgacccgcttataaaaaatcgcattagttgtttaacgttgtgtgtacaaattttggtataaaattctaaatcgaaagtaatttgatatttgtttatcatttttttggtgttagaattgaatacacacaagagaagataggatcaatggatgtaacgaattccttgttgtgcatgaaagagccaagaccattggaaaaagtccaaagaaaaatagagagtaaagcatcaatcttttggagggaccatgcatcaccactggatcaaacaacacttggttactatccatgatctttgcatataaataaggaagcctatcctcaaaggtaaggaaatatacaatataatatccatctttttcaagtagtttgaccctaaaaatgacattacatcctttttcaccactcttgttcaaaatttcaatgagtactgtatccatagtgatttgcattatttccacccatagtttggctatatacttttaattaatccacgtttatatatgttagtgaaacatagcttatatatgttttactattttctaaattctagttgctattattgatcttttgcatgggagaataaatatgttgacctattcgttcactaaagtctccattatgatttatgcacattagttgtaaataatataaaaaggttttagtggtggaatagtttcagaagagattccacacatctctccaccataggtgatatgcttagcttcttcatttgagccaacaagctctaatagcattagatcctccaaattttctatcgtacactaaacttactagtgaccaataaccattaatttattaacaaatttagacccgctttagtggttcttaacatatctatgattatcaataaccccacaaaactaaaattcgtagccttgatagaaaatctctctaacctattgtgtcgagacttatatatgcatgtaagcatatatattatagggttattctcatatagtctcaatggatggaactcctaacacttacctttcatgttgtcttctcttcctttaatttatgcatctataaaacggaagcagtaagcaagtaagtttcattcttctttaatggtctatacaaagaaaaaggatg

SEQ ID NO: 1830 - DNA, 3000 bp, Unknown
  misc_feature (1)..( 3000): cDNA_ID_3064613_gDNA_ID_1620453_Annot_ID_157556 3000 nt of promoter + ATG
accagaattacacaaaaaaagggtttaaaagtgatcactattcatagttcaactgctaaaccaaatcgttgacttgaatggttcaacaatctttctccagctatggtgaaaaatgatttcaaagtccaatgatgttgaaaaagaactctcatagaaccaccattgctcacactcaataaagcttggatcaaatcgtcatcaccaaataaatgtctcttcccaatggagaaagagttgctcttgtcagataatatgtacttcgcctcagcaccacacactgttttagagtgcaagcgctggtagtaagaagcagtgaataagcttgctttcttatcaatggaaaaggtggttgttgtgtcctcggtgatcaaactaagaactgtgtttgccttagtgattatccggttcacaagatccaaagttaactcaaatccaaatcgccaaaagtcatttccgaatacagcagaaaaactgagaattggatttgcaaacaaccccacaattgtactgattctggcccgttcggataacatgttcaactgagcatggttgtagtcatttcgattggacagggacacattgcaaagaatcaaggaggtaagcaaactctagatgtcattagaacccaacatcaatataaatataatattgcttactctctaaagatgtccaacttgtgcttactctctagggatgtctactacaaaaatataatataaatataaataaaattgggtgcacaaaaaaataatataaataaatatataataccacaaatatttagaatatatattaatccaatataaattaaaaattaaaaattaaattatgttattactttgggttctctatttttaatttctgatttatatatccatcgtttaaaaagtagttaattgttttctggtttattctcttaaatatttaataaattacatctttcccaaagcatagttaactaaaatcaaacgattttattatattttctaaattagtgagacatagagaagatataaaaaaaaaattatatagaagttctaaaattttcgtatcatttccgttttggagatcctatttacaatttagaagaaaatatattcaattaaactcttaatccacgctacattttttttcttttggttcctctctccttttagaaagaaaatatctgaatcatcttaattctctctcaatctccgaaccctaattctctcatcttaatcccctttcagtctccctcaaaatttagaatggagactgagatgagagaattatatctgactcttaggaacttcggtttcaaagaaaaattcgtatcaataatgacttcctggagaagataaaattcttggtcactctcctctgagccgaagagttttttgaatttcttgtttatgattagaactcttttgagacgtttaaccggaatcttgaatttatataagaagatagatatatcttgataattttgtcgaatcaatcgatgtctttggcttgaaccttctatcgaaagacattatcgaaagacattatgacttctctaaaactataagcttacaaatcccacatgtcagactttgtagtcatctaattggagctacgttgaattgatactacaaattttgttcaaatgaaaagttatcatataattgcaaagaatatattagatgtgtgttcaataaataattaaatatgatttgaaattaacttttaactgtcaaaaataattatatttttagaaaattaaaaaaaaagtcaacaattttagacttcaactcttacggttgtgggccgagtcaaccgatgcccgtcataaacgtcctcttacatgctcccaaaacaaagtcaactcaactatctaatcggaatatatatttgagtttcattatctttaataaagttgaatataaaccaaaaaaacaaaaacaaaaatctttggttttagatagtttacttgggtttgtatggctaagaatttagagtatctccggtttctttggtactcgttttcttgtcaagtaagaacaatattttgtgttgaaaagtcattgtggaaaaaaaccagaatagattcaagatgatcgaagattcgatagacaaaacaatgaccttgtgatattgatatgacaccgtgatattttcacaaaattcctcaaggaaagatttattttgattcttgtttatgattaatgaccttaaaccccataaaatgattggagagaaaccggagatgtgagacaaatggtttcgatctaatactaaatttaagtaagcgaatttcgtttaaaaataataatctaagtaagttgcattagaaaacaaatactaatttcaagatgattagagtgtttaattatggttccacctaatcaccgtttaaaacattattatactaaatctattgatatattttgcacaaataaaataatatatcaattatacttgtccgttttgttttatatatcatttaagattttttttacacatattaaaaaaaaatatattgttatatcatattatgtttgtatcaattaaaattaataatttaaaaatcaataacacagaaaatgtagtattaagaatattaatatttttcccaaattttattttagcatttacagaaagagatttttaccttaaataattacatttctttctctttttattccaatgacctcatacaaaattgtaacctggtgtgtctatatatgtaaactttaatattcctgaaaaatatgagattccattgggccgcgaaagaatctttataattttattcctgatatttagttgtattttttgtttctttccttgtggagagccaaaaagtctccaaagtcttcacgtcaccctcttcctcaatctctgcacccacccctcctccttctataagtactactcttcatatctctctctaccaaaatatcaaaacacgagacagatttgattccatttttattactgttactatcatccaaacccttggtatttgtagccatg

SEQ ID NO: 1831 - DNA, 3000 bp, Unknown
  misc_feature (1)..( 3000): cDNA_ID_3064608_gDNA_ID_1620453_Annot_ID_157558 3000 nt of promoter + ATG
tttttcgaattgacgctcttgtgagagtgtgtgagagttagatctgttttgtttctttcacctatttcaaaattttctatgagcgggaaaatatttgatattcttgttttgaaaattaaatgggaaaaatgtcaaacaaattacgaactttcaaatttgggacgatttaatcttgaactctacggaagacaaataaatcgtatagtttttgttgtttttcaaaataaatgacaaagtttttgttgagttgtcatttgagtcatgtcgttaagtaggttaacagaatttttttacggcgttaatgtctcgtttatctcctatgttagaacaaaacaacgttcttcattgcagctcgttttgtctgttgaaacaaatttaaaccctaaatccctaaatcgatttcattatctgcgattttgaggtcaatgtgggtctctgattttgagataatgaaatcaatttgggaaattagggtttatatttgtttcaaaagacaaaacaacgtcgtttcgtctctgcaataaacgacgttgttttgttctaacaaagtaaataaacaagacattaacgccgtaaaaaaattttttaacttatttaatgatatctcaaatggcaagtcaacaaaaacttgtcatttatttcgaaagtcaacaaaaacttgtcgatttatttgtcttctgtaaagttcaagattaaatcgtcccaaatttgaaagttcgtgatttttttgacatttttcccaaaattaaatcgattgaatagagtttttaattaaaaatatatatatagtacatatacataaattattttttctaggggaaatttgtaagaatatcacaaaaagaaatataaatagcaaaactaacacgtaacaaaaaaagactgatattctctatatattttgtattaataccaattctgcctttgtctctttctctatttcttgtttctgtgtatgactctacaatctctttcctctcacatcttctattcattctccctcttttgttaatgtaaaaactagattttattaattagttatgaaatacagattaattcataattgtttttggagatagttgtttcttaaatcagttaatgacaaatttcattgtagattttcgatactccaactgttattctcaataaccactatttgatgtgtatttaatttgataatttgggtttttcatattttttcaaagatataacgtattttgtatacgtttaattatattgtttgggttccatatattgtatcatttagggtatattttttttttttcactatgcgtttaacttgatcgtatgagtttcttatgttatgtctattagagtaagtgcaatggtagactctaagtgagtcccgtcaaaataaaataagaaacttaattgaaaaagtaagagggagaaggggaaagagagaattaggttcctaagaagagcgattaaattataatatttaaaaaattaatattatttgtaattaaaattatatatatatatataatcttatatatctatatttttctccttgtatcacgttccaagaaaaccctaatcaatatctggaactctattttctcaattatgtcttccacccaaactgatgaaaattaaaaatcaaacataagtatcatctatctttttattcattcatgagttctttgaatatttttcataacatcgtttttttaatgggaaaattccgtgaaaaaatctgacttatctaaaatatgatagaaaactacctaaacttttttttgtatgatcaaggaaatttttggtatgaaccaaaaagaaagaaccaattaatggtaatactaacagttgaagtaaacaacaaacataacttataacaattgtaaactatataatataaatatttgacaatattaatttttttggcgggacgaatttagcagaacgttacttcctaacaattgtaaataataaaatataaatattttattaacaaatagaatttataattttctatatactaatttaaaaaaaaacgtcttgccggtatacaagaattaaaatatagtatatattgaaaaaaataagcgactctcctacatcaccgtcgtagcatcacttgtttaagcctttcttaattagtatgtcgatggagactcaaaacccgaacaaggctgatctaccatgcatatattatacatagtttttattttttggtttaatgttaagattatcatatatagttgtttttgtctttctaagagattcaatttttcttacaaaatagagcattaaaattttaaacttcagaaacaaattttttgcccaataacgaaaagggtttaaaaagaaaaacggagcactgtttatcggacttcactaatggctttttttttggtttttgagtatttttggtctaaaaataacgaatattttcggtccgaatatttcattttgataatgaagtttatgatctatcggatatgttagaagttggaactttaattcggtttcggtaaacctatcagtttggcagttcacgttagttcaaaaaccatttcacgtggtgtcgggattaagttacacatactataattttagctatttaatgttctagttattatagcaagaagctaagaaccatttcacgtggtctacttgggattaatttacacatatattgtaggtaattaatgttagatgcatgttatatcaagaaccatttcatggggtgttactgttgggattaatttaccaaaaaaatttaagctaattggtgttagttgttaaagcaagaaccatttcacgtggtgctgggattaatttacacatataagttatatgatatataatttagctaattaatgcatgttagatgttatagcaagaaccatttcacgtggcttgtggccagactcacagctttgagaaatccgaaagaataaagaaaagaaaacaccattgtgaaaccattgcaaaagagagctgtgatttagattctggaaacaaatcaccatg

SEQ ID NO: 1832 - DNA, 3000 bp, Unknown
  misc_feature (1)..( 3000): cDNA_ID_3064643_gDNA_ID_1620454_Annot_ID_157584 3000 nt of promoter + ATG
taagaccaagactatgttcacttggttgcgttgttaataagatgttaaaacgaagtttatgtataaaaaaattgacagaacataactacatttcaaactccaaacttacgaaaacacacaagttttttctggaatctttcaagttttatttgatgtttcggaagaactaaattggggttttatctagtggtagacaaaaaggaaaaagatgagtacattttattgggcaatgtgttaactaataaagtttctagatataggcccatagaaaaaccaacttatataaactgtaagcccataaaggcccaaataaaccctaattttaaatccaccgacacatgtataaatgccaagccgtttcatatacgtctccactctgcaactcaggtaaaagactcttgctcctattatctcatgttccattgtttgttgatttcaatttgaaatattagtttctttcttcttcccttcattccttcaacttttataccattttcctgttatctattgatttgaaagttttaatttttaagaggcggtgatgacaaaaaacatttctcgatgctgaaacttactcgagagaccaaatcactcttgtaatctttcgtgatgcttgtttttatgcgtgtctgagcctaaaccaaaaaatctttcatttatgctttgattatcatagatcccaatttatgcgtttcttttattgcttttcaatttgtaatgcgagttttgctttattttgtccagccatggaagaagcagatcagttatgtttagctgctaaatccggcgacttgaaaaaggttcaaactttaatttactccggcgccgacgttactcactttgataacgacggtttaacgccgttaatgcacgccgctaaaatcggaaacgcagagatagtaacggcgttactcgaatccggagctccatggaacgcattatctccatcaaatctctcagcaggagatttcgccatggaagcaggacatcaagaaactttcgatcttcttctcaaaaccgggatccaatcagagctaatcttaggaacaatcgcaagaaaccaaacaaagaacgaatattctaatcaagaatatcttcaagacagagttagtttcagtgaagacaagttaatggatagtgaaagcaaaggtgtgatgatggcttgggaaaaaccattaatggaagctcacgctaaagctatttgtctcaacggtggtcacattcttaacgttggtttcggtatgggacttgtcgatacagcgattcaacgatacaatccggttaaacacacgatcattgaagctcatcctgaagtttataagcgtatgattgaatctggttggggagagaaagagaatgtgaagattgtttttggaagatggcaagatgttcttgataagcttgatgataattcttttgatgggatcttttttgatacttatggtgagtattatgaagatttaagagagtttcatcagcatcttccgaggctgttgaagcctgatggtgtttattcgtatttcaatgggttttgtggaagcaacgcgttttttcatgttgtgtattgcaatttggtgactttggagattgagaatttagggtttagcactcagttgattccattgccggttaaggattgtcttggggatgaagtttgggaaggtgtcaagcaaaagtattggcagcttgatacttattatctccctgtttgtcagtttagtgactgaagaagttttatgataccagcaattttgcgatattgtaatttttcttactcataaaaagtagattttttatccatttgaaaatagtcatagtcatccaataagaagaaaagaacagtaataagtgtataacataagatcccatagtcatgtgataggaaccaagagccagactaattctgttacaaatatcttaagaaacaaaagtactaattaaaacatgttatgcagaagcttcacgttttctacatggtctaaatatgtgaagactaagtgaccctgaaacgcttccattccttgtattgcaacgctcatcatcgtctttctctcaatattgaagtagtagacgtcgaaaggcactgtttgatagcacggcgacaacataatctcatttgtacgagtcactccaacaaagcgtaaattcagggttccaatcctatgctgccaccaagcgggtaatacgtacgtatgcttcgaccattccttcttttcagcatcttgtagaacccacaactcaatactcttactacgtccatcaacaaagcaatatctttcagaaacaagtgaagctaatttaccattgtagtttataagagttccatcatgcgctgctttaatgaactcttccatgactgtaataaatctaaacttctctgacctaacatcgaagcaaacgataatgtaatcccctgaagacaaattgatcgctggataatacaacacaccattgatgcatatctcagacattccaagaatgtgaggcatggaacattcgatgattctccatgacagttctccagttcctagtgtcagaacttgatgctcatcacttttatatgacaacaataccttgaactgtttctgaatcggttcatacacgaaaaatcttgacggcccaatactcgtcttcattggtttaggtaagcttaaggtatgtccagtgctgggattacatatcactgtcactgtttcgttcatttccttgcgtttaaaacagatcaagccattgacaggacgcgaaattttatagcataaggagaaattctttagagaaatggcggacgagttctcatatggattttgaagctgaggagacgagaagaagaacaagttaccatcttttttgcagcagaataagagttgcggtcgatgcaaagatcgggtcaagaacagctctgtgaaatcttgacggcaaattacggagatccagagtttcgacacgcaacgacatgtcgctatagattttgccggtaatctcaggagtatctcgatgatg

SEQ ID NO: 1833 - DNA, 3000 bp, Unknown
  misc_feature (1)..( 3000): cDNA_ID_2145422_gDNA_ID_1620454_Annot_ID_157601 3000 nt of promoter + ATG
aacattgcctgtgatgcacattctgggaactaaccgatctaagagagattttaaggcttgctggtgaacccttcttcaatgcttgaatggtagctgagatccaaccatctgcttcttgagtggcctctctctcctaagcaacacatatgatggtagagtgcgttgtcaaaggtaaatcagtcaactcaggatcgcaagtcaacatctctatatataaatgaaaagcttacaagtgcagatataatttcttcgactgttctccttgagaaacacctatcaataacatctaacctgcgcaacaaacggggagataaaaaataactgtcctctgcacttttataaattttcaattaaagatcagatgagaaatgagttctgtaaagagcgattgaaaacctgacagcaatacgaaattgaaattatagaaaaaatgtgttataatcatggtcaataaccgagaaaatgtaatcaggtaaaaccatactagtagaaagagtaaaagagataaaaatcatatagacttgcctgcggtaagcactctgctgtttcaggcgcggatgctgggtgtatgcatcgagaattgttgaggcaaaagttggatcatttgaattaattctgcaaagatctgcttctaatgcagtcaacctctgtggaaaggagtaaacctaactaagtagcaatccttggtgaagcagatagtgcttgacactagtagctatacaatatctgatgtgtaaagtcaattcagaatgtcttacgaaatagacgcacgcaaaggaagttcataccgttgaaggcacaaaatgagttgcaaggccacaagcaagcatttcagcaccatctaatctagctcctgtgaggccaacatactcccctgaacaaaaaagacaagaaagcattttcaaactttggtggctttaagaagatgcaaaaaaaggaaatatagcttctgttaccaaaaaaaccagggagccttgacaagaagtaggaggcgcctacatctggaaagagccccagagctgtctcaggcatggcaaaaaccttggagaaagtcgaaagatatgagcatattttggagcgacctatttgtcatccatggacatgtttaaggaaagattaccgtgttctcagttgcaatacgaaatcgaccatggacggatacaccagctccgcctcccatgacgataccattcaagattgaaacctatacgaattgatgagtttatccactcgggagtgattttacaaaaacaaaacgaaattatagcgagacctgagctttgctatatgtggccataacatagttgagcatgtattcagatgagaagtaattggcaccgagtctccagttacctagtcaacgaacgaagatagagaaagagtgtataaaagctgaaagtaagaaacagaaaagaatgggtggtaaaccttgattgatgtcacgaacaacagctgcaacatcgccaccagcacaaaaggctctcccatgaccctgtggcaaagttattcagtactaaatgtgtgtaagcggaagagataaggataatgattacctttaggatgacaagtttcacactagggtcctcctcaaatgcaaggaacagttgcagcaatcgagagatctacagaaaaaaatgagtctaagccaatacagtacgcatgtacaagaagggaaatattcgataccatgtggaaggacagagcattcagctgctttggtctgtttagtgtcaagattctaacactcgatttctcttccaccaaaacctgtgatcatattattaattcagagagcgaagaattgatcgtcgtagattcggattaaagacgcaagaaagagacctgagactgagaggccatctcgactgccatctttcttactggtcagattcgcctttgtatctccggagagaggagcagcaatgggatcagaaattaccactaatggctaacaaaatcttcacccgcttagtttaggaagttgatattgggccttatagtaatctgttggttttaataatgggctttattttgttaatagagcaaatggaactttgcttttcaaactcaatttcaaagccctcttgcaacatgcttgatgaatgagaagattatatgtttttatcgagtacgttagacatgtgttttttttgttaggaagctagttttccaactaaccaacacctccctctagcataaaatgacacgtgggcaccagatcaatcattaaaaaagtcttcaaaaattctcaacaaccacttctaaaagtcagacatgaaagccctcgcctctcgatatatagataatttgcatatacatgaaaactcaacaatctgacgcatatgcaacagagttgaaagatggaaagagcaaggatacgatggccgagtggaagaggaattaggctgaggcagaagacaaagagactgcgtgcgagagtgagaagctttttcaggcttctcaggagctggtgctgcagaaggcctccgctggtcagagaagacggtcttgattacacatctatacgtcgctctaactctttctacgccgatgcaattgcagactgcattgacttcatcaaccgctcctccgcttgacagcttctcattctcttccaataattctttcttccattttgtaaaatccaatgtttctgtatatgcaaccaattcgaattctttgtattattttatttttttgacgagtcgatgcatctttaagaagtgggcttataatgggcctgatgatactacatccttagaaaccacattagtttaaatcagatctgacaactgcagtggttcatacccttaaagattaaaggcccgttgaaaacccattaagtatttcacatcatattctgggccagatgaacaatctgacagctatacaagtccattcccttatccaaaggcccgttaaaagcccacgtaaaatgaatgtgtcagatccttccttgctcgattcaacgcgtccgagtctcagacactccccggcgag

SEQ ID NO: 1834 - DNA, 3000 bp, Unknown
  misc_feature (1)..( 3000): cDNA_ID_2145412_gDNA_ID_1620454_Annot_ID_157598 3000 nt of promoter + ATG
tcatcaagcatgttgcaagagggctttgaaattgagtttgaaaagcaaagttccatttgctctattaacaaaataaagcccattattaaaaccaacagattactataaggcccaatatcaacttcctaaactaagcgggtgaagattttgttagccattagtggtaatttctgatcccattgctgctcctctctccggagatacaaaggcgaatctgaccagtaagaaagatggcagtcgagatggcctctcagtctcaggtctctttcttgcgtctttaatccgaatctacgacgatcaattcttcgctctctgaattaataatatgatcacaggttttggtggaagagaaatcgagtgttagaatcttgacactaaacagaccaaagcagctgaatgctctgtccttccacatggtatcgaatatttcccttcttgtacatgcgtactgtattggcttagactcatttttttctgtagatctctcgattgctgcaactgttccttgcatttgaggaggaccctagtgtgaaacttgtcatcctaaaggtaatcattatccttatctcttccgcttacacacatttagtactgaataactttgccacagggtcatgggagagccttttgtgctggtggcgatgttgcagctgttgttcgtgacatcaatcaaggtttaccacccattcttttctgtttcttactttcagcttttatacactctttctctatcttcgttcgttgactaggtaactggagactcggtgccaattacttctcatctgaatacatgctcaactatgttatggccacatatagcaaagctcaggtctcgctataatttcgttttgtttttgtaaaatcactcccgagtggataaactcatcaattcgtataggtttcaatcttgaatggtatcgtcatgggaggcggagctggtgtatccgtccatggtcgatttcgtattgcaactgagaacacggtaatctttccttaaacatgtccatggatgacaaataggtcgctccaaaatatgctcatatctttcgactttctccaaggtttttgccatgcctgagacagctctggggctctttccagatgtaggcgcctcctacttcttgtcaaggctccctggtttttttggtaacagaagctatatttcctttttttgcatcttcttaaagccaccaaagtttgaaaatgctttcttgtcttttttgttcaggggagtatgttggcctcacaggagctagattagatggtgctgaaatgcttgcttgtggccttgcaactcattttgtgccttcaacggtatgaacttcctttgcgtgcgtctatttcgtaagacattctgaattgactttacacatcagatattgtatagctactagtgtcaagcactatctgcttcaccaaggattgctacttagttaggtttactcctttccacagaggttgactgcattagaagcagatctttgcagaattaattcaaatgatccaacttttgcctcaacaattctcgatgcatacacccagcatccgcgcctgaaacagcagagtgcttaccgcaggcaagtctatatgatttttatctcttttactctttctactagtatggttttacctgattacattttctcggttattgaccatgattataacacattttttctataatttcaatttcgtattgctgtcaggttttcaatcgctctttacagaactcatttctcatctgatctttaattgaaaatttataaaagtgcagaggacagttattttttatctccccgtttgttgcgcaggttagatgttattgataggtgtttctcaaggagaacagtcgaagaaattatatctgcacttgtaagcttttcatttatatatagagatgttgacttgcgatcctgagttgactgatttacctttgacaacgcactctaccatcatatgtgttgcttaggagagagaggccactcaagaagcagatggttggatctcagctaccattcaagcattgaagaagggttcaccagcaagccttaaaatctctcttagatcggttagttcccagaatgtgcatcacaggcaatgttgacaaagagctgactgtgagtatatatttcagataagggaagggcgattgcagggggtggggcagtgtcttatccgcgagtatagaatggtgtgtcatgtgatgaagggagaaatcagcaaagattttgtggaggttttgcaagctttttccatctgaaaccgtctttgttgtagaccgtagttacaacagcgtgtctttacttatgcaggggtgcagagccatattggtagacaaagataagaacccaaaggtttaacaagtctctccatttgttatttgtggttggtaatatgtgacattgttgataacaatatctgaaattatagtgggagccaaggcgactggaggacatgaaggatagcatggtggagcagtacttcgagagagtggaacgggaggatgatctaaagcttccgccaaggaataacttgcctgctttagggatcgcaaagctgtgaagtggagaaggtgatggagcactattgtttacgtctgtgggaaagaaaaaagaaaataaatgtaacaacacttgtgttgaataggacttgcatacattacataaatcattattgtatttgagaattgacaccaaagcagcagagcagaattgtgttaagatttgttaatggtgttggaggcacaaccatggcaaacggacgtggaagcacgtctatagtcattgttcatttatttgattgagattcctccttggtctcatcttctgaaaacgaaaaataattagaaaatcaggtgaatcgtgaagtattgaatgagaagaggcaattaaaaatctcccgtgactctcgtctccccatctctctctctccctctgcccaaatttctggggcaaatttgttcatcagatctactacaatctctctttttcttcgggtatg

SEQ ID NO: 1835 - DNA, 3000 bp, Unknown
  misc_feature (1)..( 3000): cDNA_ID_3072397_gDNA_ID_1620454_Annot_ID_157593 3000 nt of promoter + ATG
aattcatttacttttttgttctgttccgagatttcaaggttcactatcgattctgaaactcttggaacaatccagattcttggttagcaggtggggaagcattaatcatgtatttatgatacactgctccattattattacgagagagttgaaagtttcctttttgactcgtttttaaaggcaaggaagaagaaagactttgtttttaaaatgccaatgtttcagccttctaagaacggtgggtttgatgggcatatcttagatctacactcggcggttaaagacggtgttcttggcggcggagatgggaaatttctggtggttgttaccgatgagaagaagaaattggatttgaaggagatgatttctgagctggaattacctgaaataccctctgttttcatctgtcctatctctctagagccgatgcaagatccagtgaccttgtgtactggtcaaacctacgagaggtccaacattctcaaatggttcaatatagggcattgtacttgcccaacgacgatgcaagagctttgggatgatttggtcactcctaacaagactcttcaccaattgatctacacttggttttcacagaagtatgttttgatgaagaaacgatctgaagatgtgcaaggacgtgctattgagattctgggtacgttgagaaaggctaaagggaaagcaaaggttcatgctttaagcgagcttaagcaagttgtgatggctcacgctattgctaagaagactgttgttgatgaaggtggagtctttgtgatctcttctcttttaagtccttttacttctcacgctgttggatctgaggctatagctattcttgttaatcttgagcttgactctgattccaaagctggattgatgcaaccagctagggtctcgttgatggttgatatgttgaatgatggttcgattgaaactaagatcaattgtgctagattgattggaaggttggtggaggagaaaggttttagagcagagcttgtttctagtcatagtttgcttgttggattaatgagattggttaaagataggagacgaagaaacggcgtttcgcctgcgttaacgctgctcaaatcggtttctgttcataaacaagttaggaacttgttggttaggattggtgcagttcctcaattggttgatgttttgccatgtttggatgtggagtgtttagagtcagctcttttcgtgttggattcgttatgtttagaaagcgaaggcagaattgctttgaaagattcggttaacacgattccgcataccgttaggttactgatgaaggtatcagagaaatgcacaaactatgcgatatcgattctttggtcagtttgcaaattagcttctgaagaatgttcatctcttgctgttgaagttggtttggctgcaaagcttttgcttgtgatacaaagtggatgtgatccagctttgaagcaacgttcagctgagctattgaagttatgtagtctacattattcagactcaatgtttatctccaaatgtaaactcacaagaactatccaataaaagactgatcaagttttcacctttcgggtcaaaatcacacaacggatctgccccatcttgttgatgtatatagaaatgaagaagctcaaggagtatgagagtaagaaacgagtttcgatgtgttgaattctattttgcaatgttatttgaataataatagttaagtagaagtaaactgtataaatctttttgttgtggttggttcattattcagtagaagaatagattgaagaaaggaatcatttttttggcctcttgtaagttactagctgtttgtgagtcataataattggagaaattattgatctatgaatcgttttatttgacactcttataacccttagtgattcttgatagaacagtaggattagaaaacagatatgggtgggtttcagatttgtggaggggaataaaagtcttattttttgaacatgcattggtctgatttgtatgcactgtgtaaatgaatgaacaattgaaaagaaaggatgatttgacttatgaatcgtttcaacagttcactgtttgtttatctctgttttttatttaattggctatgagaatctgaacatatctcttggaaacattgtatcagtgagtgtgatgtcactgatgtgagagctcttgtctggaaataaaatctaaacacagttaccaaatctggaaaacaatttgtctcaagttagaaaaaataaaatataaataatttcccgaataggagctatcttaagatgggccttagttgaactatatgggctattatccaggtccagtaatattttgacagtcaatacaaaatgtcgtctttggctctaaattggattaagctattaagtaagataaagattacaatatttaaattagatattgatttagacggagatttcattatctatctctcaagtttgatttgcttctgctgtaacaaaaagatcacgatcgcaacttgtgtgtatgtgtgtgtgagagagagattcagatatggcttggttagctagatccatagcgaactcactcaagctcgatgaggaagatgaagatgatgataagcatctgaatcaacagccgtcggaatctgtatcggattcacagtctccacgaggcgttaaggaagacattagcgaacttaccaagaccttgagaacccaattttggggtgtagcttcgttcctctcgcaaccttcttcatctccggatcttcaggagagaaatcaaactcccgatcatccggaggaagatgaggatctaatcgctgggattaagaacgatttcgctgagattggtgggagattcaggactgggatttcgaaactatctgggaacttacctgtgtctgagttcacaaagatcgcttcgaatttcttacaattgagttcagaagatgtggatccgaaagattacgacgtaatcggagttacagaggaattagttgcgtttgtgaaggatcttgcgatg

SEQ ID NO: 1836 - DNA, 843 bp, Unknown
  misc_feature (1)..( 843): cDNA_ID_3064703_gDNA_ID_1620455_Annot_ID_157606 3000 nt of promoter + ATG
aagctttaagcacaacacatttgaaatggtggtggtgggtcaagacaatgtttcattgtctattctctgcaagtgtgttactaaacttttggtaaaaatttatgttttcttcgataccatacaaaatcttctgatgtgcctgtctttgtgcttatacatttgtggcaatttggtattcaatatttatatatctgaaatgtagttttaccacagtagtttctctccaaaatgtgtttgttttttatgcttgaaatgtagggtttggatttttgctctattctttagctttagatgtttggttggtaaaaattgtgaaataatcccaaagtaatacagagattttctatatcagtcagaaatttctatttggagaaataatcccaaacttttgttcctttgatagagaggttcaatattggctataatgcgatctctctggcattacccttgaaaattttctattacaaagtaaagtcatttcatgaataatgtgttttcttgattaccttttggtacaactgtcagcaaactaaagacaaagaaatgttacaaaccttttgtttgtttctcattggctcatagcttgaggtctatgtgtgattttggtatccaatgttttcttgttatagcttaagagaatgttttcaaacttttttcaacagatacaatcttagtaatcacacttgagtatttttcttaactggttttgtttcttggcatcttcatttcagggtctatatttctctgaggaattggattcttatagaagttaaaccgcagagcttcttctatccaatagtcctctgagaatcgtcgatatagtttgctgatatagttgttatg

SEQ ID NO: 1837 - DNA, 3000 bp, Unknown
  misc_feature (1)..( 3000): cDNA_ID_2145786_gDNA_ID_1620455_Annot_ID_157624 3000 nt of promoter + ATG
agtcctctatttattgtttccagaaacttttgacccaatatcatcttcctaatccaactctatgtgatgcaacttttttctacatattaaaggatcagaaaaagcttcaaggacagctcatagcagaacaagaggcactttacgggtccaaacccagcccatctaaaccccttggtggtaaaaaggctccaagaatgtcgaccggtggtgcatctaacagaagactttccttaggagcagcaatgcatcagactcctaagcctaacaagaaagcagatcaccgacataatgatggagctttatcaaatggtaactaagtctcttaatcaaatgtaaatcattggttatcatcatagtatgaatagatttcctaattgcattggcaaatgaatcttattcctgcaggaagaagagggcttgacattgcaggactaccctcaaggaaacaatcaatgaatccttctgaaatgttgcaatccccattagttcgcaaaccgttttcccccatatcgaccacggtggttgcatcaaaggccaacatagcaacaacaacaacacaacaacttccgaaaaacaacgcagtgaatgagatctcatcatttgcaactcctatcaagaacaacaacattctcaggaacttggaagaagagaagatgatgactatgatgatgcaaacaccgaaaaatgttgctgcaatgattccaatcccgtcgacaccagcaacagtctctgtcccaatgcacaccgcaccaacaccattcaccaacaatgcaagattgatgtctgaaaagcctgaagttgttgagtactcgtttgaggaacgaagactcgccttcatgctacagtctgaatgtcgtttggtttgatcatcaatccgttggattcaacttaagttcttttatttgtaaaactcaaattgaatgtggtttggtttgtaaaaggtcaattatatgattggcttttttttttttttttgagtaatcatttttacacgtatggtttattctgagactgacaagaaaaaaaaaaacatttcgtgaagtgtagctcagtagctgtagtgggaaactagtcaacctaatctgtattgaccacttcacattattattcgaaaattccgcaacatattattacctgacttgtcataacttgtttctggctatattcgtgtattcaaaaaattatttgcttgtgagttgaggtcaatatttcacaattttctattttaatttactggtggattgaccactttttcgtctccatgtatgacttcaaaatagcttggggttactaatgattttaccactttggataatcaacttccatcgatttgtatccatcatgaattaatttcagagatctatgaggtcttatttgacgacatatgcaacataataaaatagaaaggggtcggtcaaatgtagatatagttagaaatcttaagaaatattttatagagtatagaaaatattttatagatataatgtaaatattttaaatttaggaaatatataattctttaggttttatagagtaagaaatcttttttaaaaagttttctataggttataatagatttatctcttgaaaattttctgatgttacaagtcaaaattactagtcggaaaggagatttgtacgggacgaagagtgttgtttgaaatttgaatattataggctcacaagtcacaattcacaaatgggagattttgaaacctaatatgttgtttgtaaaattaatcttttgcttctagaatggaaatcagaactctctaaatagatacattccctaaccagagtttttaaattgatattatgtatagtcgtgtgatctagaagacccactataacttactttagacaatgataaaacaactgaactattttgtgcgatttgtatgtttttggtatcaagtttaaaaaaaaaaacttaatcaccccaacaacaatcgtgatatataggtccatcctgaagatctataacctaatccaccctaaaaacaaacttgtagactttatttgcgggaattagacatcctaatgaaaaaatttggataactttggtacggagtcattaccaccactcctaatgtcagggattagggacaaagaagattttgtacttggtctttgggaggctaaattggtcaacgttttggttatagtcaacgtggatagactgaaaaagaaaagagtgataatattaggtgacagaaatatcttaaatctttttcttatttttcattttgaatagtgtggaacatctcaaaaatcaagtccaactgcatataattaaaaatttgcctctacttattttattaaattacttaaaaactttagctgtatcccaaactccaagacttttgttaggaaaggagtgtaaatttttgaattttctaattaagccattattacaatattttagaattacacttttctcgtttctctctcctttttttttttgattttttccttttaataaaacaaccttttattttatttctataaaatcaaattgtaataatgtaataaaatccgctcctttgattttttttatattttctatatttatttattttctctttcccattctcctcaaaaccctaatttctcacatctgtaaagaaaaattctccctaaacttaaccctcctgtagaaaaaaaaaaaaaccctggtaattatgagtgttttaggagaaattcttctgaaattaagattccgccatggaagcttttgatctttctcttcactagttttacttaattttcaacacacaataacaaaaacaaaaaaatctctttgccccttttctctgaatcttacgtcctctggatctttcttctctctctctctctcttgtctatactttaagtgtctgtctgaagaagcttgaatctgtcgtgatcatcaagattcaagttctgtctttttgagtctttttcttctacttctattgagtttctcttccttaattgtcggaatcagaatcttttcagatg

SEQ ID NO: 1838 - DNA, 3000 bp, Unknown
  misc_feature (1)..( 3000): cDNA_ID_2145812_gDNA_ID_1620455_Annot_ID_157631 3000 nt of promoter + ATG
aagaagcagagaagcgaagatgacgaaagaagttaatccaccaatagcaaatgcaattgaagaaacttttcgaggaaacaacaacacagtcgtctttgaatttgaaactcgtggagaagccaaagtcatgatttttctgcacaaaacctataaaaaaaaacagagcaatcattcattgatggattacatatctaactgggttccgctaaatcacaataaagtttcgatttttacaatttgtttactaatctctattaggtgaaaaaaggaatcaataagagaaaaacttacatttagaattgaaaacgagacaaggacgatcgaagaagcttttgctttggagaggaataaataaatcgacaagatctgggagtttgagagagaagcgtggaaggaagaacaatgttatgaattgttaaagtcaaacttattttagtcaaaaaaaaaaaaaactaaacaatttaggagttttttatttttcttcttttgaagttatttttgatttggttattgtgtatgatattataattcatataattattacggttatatttcataattagtttaatcgtgtatgttcaacttttttaattgaactagattattagttaaactaaatcgaattacgattggttagactgttagatttttattaaatcaaatttaacttgaaaataaatcaaaatcttcactcttcattttgattaaactaaacaaaaaataaactaaacaatttaggagttttttcttttttcttttttgaagttttttattgatttggtcattttgcatgatattataattattacggttatatttcataattagtttaatcgtgtatgtccaacttttttaattgaactagattattagttaaactaaaccgaactacatttggttagactattagatttttattatatcaaacttaacttgaaaataaatcaaaatcctcactctcgattaacaataaacgttttccctttcttccccttcttgcgcttgttcttttcaagcttcttctccttcatcaacttttcaataaactcatcgttctttttctcaaactctctcagaagtttcttaagttgctgcttgtcgtttgccagtttccttaaatctgcagtagttagtttgattttacttccaaacttgattcacagagaaataagcttccttatgtcattctccacgtcatcctcctcctcctctttcttcttgtccttcttcttctccttgagatcccagataatgccaacttcttcttcaaggatttttgtatcaaagtagtcattttcgttaccaggtgcagaaacagtccacttggagtagttgataaggtcacgttcaaggttaaagtgatgaatggcatatgtgtatgcaacagacacagatccatccttttcccatgagacatgagcctcttctttctccttctccacaagaaccttttcaactccctcttctttcccttgagcttcaagtccctctttcctctcctgaaccacacgttgaactcctttggccactaaaggatgccaaaaatcctcgaaaaggaatcgaggctttggagcctaagagagtatctctttgtgaatagttttaacaagcacagtgtaaaaattttcttccttgacattttttcttctggtaatgagaaataagataaaaatttggagaaaaagaggatgaagcagaagaagaagtatgtaaaaagagtagttataggtggttaaacttaaagctatcattgttgtcgtcttgtatgggggaggaacactcaaaatcgtttcacagagacttgcaggaggtttcttattttatgaggacaagaggtgagaagtagaggaagcccaaagttggttattttccttttcaagatttttcaacaattaataagaaatattatatgaacgtatctttaaatcaattaattattagcatttgttttcataaaccttataaggcatccccttgttctccaaaacaattactgtcatcctctttctaagtgaaaattatatttttttttatcgtctctaagttgtttaaggggttaaaatactaattacaaaaacacaatctaaaacataaataataaatacgtttatctcttacatatttttgctgagatttttttattagaagtataaagatttttggggaaatttgatactaaggatcttttttagaactaaaaaggaaaacaaaaatattttacaaaatgatatatttcgatatataaagttttaatgcagtaatgaaactcaaaatgattgataacactttctaatacttttatgttgcaaaaacaaaatcatggtgcaaaatccactacttttatgttgtagtatatttctagaagaaatttggtttcatggtatatattgggtattaaataaagattggactatcttccctttggctttggtgtgtcatagatagtgataagaaatacctctttttttgggcattatttgttgacaaacgatatagaaaattataaacaaaataaagatcattggaaaaacatcatttgaccaaagatgtgtatatgtgtcccaatcagaaagttcataacaagttcctctcttctcttctcaattcttatgcatccacatcatcattgatttaatgcttttaaaaacagaacattacatttatttttttaaaaatgtattactttttggacaatacaagtttgatacatataacggatttcgcaaaatatttcatgttctttttgcaaacaaataatccccaaaaaaaactaaaggaaaagaaattcgtaaagaccaaactcgtaataaagagtatatactgtttccccttaaaaaaaaaaaccaacctaaaattaaaacccgtgggtttaaggatttgatcttttaatgttcacaaaatcgagaccctaaattgctctcacactcacttcccaatcttcttagttcaatttcaatttttagaattagaatctctgaatcccagattccggtagagaag

SEQ ID NO: 1839 - DNA, 3000 bp, Unknown
  misc_feature (1)..( 3000): cDNA_ID_3064666_gDNA_ID_1620455_Annot_ID_157628 3000 nt of promoter + ATG
atcatcatgaacggaaacaatcggaatctgtagcgttgaatcggagagagagtgggtgatatagccggaagcacagttctcgacgccggtaggccaatgcatcatcttataggccgcgaaactcatcttctctaccggaatctgggattcagagattctaattctaaaaattgaaattgaactaagaagattgggaagtgagtgtgagagcaatttagggtctcgattttgtgaacattaaaagatcaaatccttaaacccacgggttttaattttaggttggtttttttttttaaggggaaacagtatatactctttattacgagtttggtctttacgaatttcttttcctttagttttttttggggattatttgtttgcaaaaagaacatgaaatattttgcgaaatccgttatatgtatcaaacttgtattgtccaaaaagtaatacatttttaaaaaaataaatgtaatgttctgtttttaaaagcattaaatcaatgatgatgtggatgcataagaattgagaagagaagagaggaacttgttatgaactttctgattgggacacatatacacatctttggtcaaatgatgtttttccaatgatctttattttgtttataattttctatatcgtttgtcaacaaataatgcccaaaaaaagaggtatttcttatcactatctatgacacaccaaagccaaagggaagatagtccaatctttatttaatacccaatatataccatgaaaccaaatttcttctagaaatatactacaacataaaagtagtggattttgcaccatgattttgtttttgcaacataaaagtattagaaagtgttatcaatcattttgagtttcattactgcattaaaactttatatatcgaaatatatcattttgtaaaatatttttgttttcctttttagttctaaaaaagatccttagtatcaaatttccccaaaaatctttatacttctaataaaaaaatctcagcaaaaatatgtaagagataaacgtatttattatttatgttttagattgtgtttttgtaattagtattttaaccccttaaacaacttagagacgataaaaaaaaatataattttcacttagaaagaggatgacagtaattgttttggagaacaaggggatgccttataaggtttatgaaaacaaatgctaataattaattgatttaaagatacgttcatataatatttcttattaattgttgaaaaatcttgaaaaggaaaataaccaactttgggcttcctctacttctcacctcttgtcctcataaaataagaaacctcctgcaagtctctgtgaaacgattttgagtgttcctcccccatacaagacgacaacaatgatagctttaagtttaaccacctataactactctttttacatacttcttcttctgcttcatcctctttttctccaaatttttatcttatttctcattaccagaagaaaaaatgtcaaggaagaaaatttttacactgtgcttgttaaaactattcacaaagagatactctcttaggctccaaagcctcgattccttttcgaggatttttggcatcctttagtggccaaaggagttcaacgtgtggttcaggagaggaaagagggacttgaagctcaagggaaagaagagggagttgaaaaggttcttgtggagaaggagaaagaagaggctcatgtctcatgggaaaaggatggatctgtgtctgttgcatacacatatgccattcatcactttaaccttgaacgtgaccttatcaactactccaagtggactgtttctgcacctggtaacgaaaatgactactttgatacaaaaatccttgaagaagaagttggcattatctgggatctcaaggagaagaagaaggacaagaagaaagaggaggaggaggatgacgtggagaatgacataaggaagcttatttctctgtgaatcaagtttggaagtaaaatcaaactaactactgcagatttaaggaaactggcaaacgacaagcagcaacttaagaaacttctgagagagtttgagaaaaagaacgatgagtttattgaaaagttgatgaaggagaagaagcttgaaaagaacaagcgcaagaaggggaagaaagggaaaacgtttattgttaatcgagagtgaggattttgatttattttcaagttaagtttgatataataaaaatctaatagtctaaccaaatgtagttcggtttagtttaactaataatctagttcaattaaaaaagttggacatacacgattaaactaattatgaaatataaccgtaataattataatatcatgcaaaatgaccaaatcaataaaaaacttcaaaaaagaaaaaagaaaaaactcctaaattgtttagtttattttttgtttagtttaatcaaaatgaagagtgaagattttgatttattttcaagttaaatttgatttaataaaaatctaacagtctaaccaatcgtaattcgatttagtttaactaataatctagttcaattaaaaaagttgaacatacacgattaaactaattatgaaatataaccgtaataattatatgaattataatatcatacacaataaccaaatcaaaaataacttcaaaagaagaaaaataaaaaactcctaaattgtttagttttttttttttttgactaaaataagtttgactttaacaattcataacattgttcttccttccacgcttctctctcaaactcccagatcttgtcgatttatttattcctctccaaagcaaaagcttcttcgatcgtccttgtctcgttttcaattctaaatgtaagtttttctcttattgattccttttttcacctaatagagattagtaaacaaattgtaaaaatcgaaactttattgtgatttagcggaacccagttagatatgtaatccatcaatgaatgattgctctgtttttttttataggttttgtgcagaaaaatcatg

SEQ ID NO: 1840 - DNA, 3000 bp, Unknown
  misc_feature (1)..( 3000): cDNA_ID_3064683_gDNA_ID_1620455_Annot_ID_157616 3000 nt of promoter + ATG
catgaagaccattcattcttacaaccgattatccgaaaaagttagagaagcaaatagagaatttagaagttgaaagaccttattgttttttttcttctttgaccgtgacttcttctcctcctcgagtaaaagataagctgctgctatatctgacttggcgttggattccatattcacaatttcattctagataataagatacatactaacatataagaaacaattcaaaggccaaatcagatggtaaacaaaagctctctatatataaccgaagtttcagaccaaccagtaagaaaggtttcagcagtcgaaggatataagtgcggttgtcaaaagcagaaagcctggtgaggttggttagcaaagtaatccttgaattatcaatcagcaaaatcttagaatcgattagtagaacctgcgagtcatatagatatttttagatgggctattctatgttattatgttgtaatgaatattaacatcaaacaaaccttgtgggtgaccactgatttcaggtggtgtatggacttcaacgctatatcatcgccgagacttttacgctgacgtataagattcatgcaatcttctgaatcgaggaaatcaaatgtcggatgcgatgctccttggagaacatctcgtactgcccacaagaaaaaatttgcagtgatggaattttcggagactctctcttcacagctatcgcatagaagagatgcatatttattccactgatcttccagaagattctttctcctttcatcttcactcatacacaagttctcaacgacagtaagagctgcatcataatctaagaccagatatttctttgcatatttttttcccaaaaacgaaaatgtgaactgaacagctttcagaacagccacccagataccaaaattgtgttccctgataggtctgggaaagatcgtatctactgaattgtagtcagttaaccaggatatgatatcatctccctgagctggtgccttggcgtagtgagcattgggatcaaaaacattgattgtcccttcatcatcgaatggaacatctttgcattttagcagtcttttatccagaagcagaaatgaaaactgagggtcaaagtcgatcttttctttgactcgagtatgatccaagaaactgttcactgctctgcaaaccagatctgtaccatcattccttttacacttgatggtttttagaaagtctaggatttgattgagttcatgactttcaagaaaacagatactctgaggtgttcccactaggtgagaatcaataagactctgttcggaaacatcaagttttgcaagatgttgaaccggaaaacgcatcagccactctcgaatgctagaaggaagaattttatggtcacaaagtgacacaaggagcaatttgatttccttgagtaacttactgcgatcttcatctgcagctaaaggccactcttcggaccatccattcttaggtgcaaacgctttcacatctgcgagccgattcttgatcatttcaacggcagctactgtatccactggttcccaagctccaaccgatatcttacgagcccagtcctttcctatcctctggaccatatcctttttcgaagcatttttaaaatctgcatcatgttgttgttcaaaatgattcttacattcttcagcactagaaagcttcttcaaacatttacttctacacatccaaaacgtccattttctatctgccttagcagaagtgagaactttctcaaaaacatctcgtccctctctgttatgtactccctcgacaaaacttttaagctttgcaatgcttactttcataaagtctcttttgatcttaatatccaatcccatccaataagacctcaattcttgaatctcgtcgtcaacaaggtctgaacttttctttggctcccaaactttagactcagagcttaaaggggaagtcttggctccagcgatcatgcgctctgcatctctgattaaagtattgaattctttgttcatatctttttttagctcttgcaacattgatcgagcaacaggactcgtgttttctgggtaagtaactgataaatcttgttttgatttcttcacgcattgcttgtaatacgatactgacccaagctgtttggccaaattgtagaatcccattgcacaaagtcgtgataatatcacatcttgagaatagcattgtacagaagccaccaagtatgcgaaacccacgtctggattctctgttatgtcctctagtttcacgaacattgtaccttgtttgatatgaagaaaccatgagtccttgtctttcttgtggtcaaaaatcaaatcttcaagtatctccaaggccttgcagtgatttcctttaacgaattcttctctagatttcgtgatgagttttatgacctcaacatcttccaggaaagatggcttcatcatagtaacgactctcaagattcttgcgttttcttgctctccaaggtttcctttgcttcggagagaaatttgtcagaatgtagaaaacaacagcaacagtgagctggcttttctcacgtgagagccacgtgaaaagggttgatacaaaaaaaaaaccaattatgagcactgaggaattctgtcgaaccccttgtaagcaatatccgtttgggattttcacggagtagcaaaccaaaacaaatcccaaaaattgtgtgaatcttcgattttgggttaagacccaaatgtagaacgatcttcatgttggtgttacacaaaattcgtggaaatgtttggacttgaaaatcaacaatctcaatcttcttcgtcggatctctaataagtgttttgagttttactgttaaagaagacacattagctattctactgttattaagttctcgtttcaaacgccatgccgtttgttatatttaaaaacggcagcgcatcgctctatcccctactaaaccctgagcatttttaagttaaactcagaggtcctctgtcacaagccgcaagaagaagcagagca

SEQ ID NO: 1841 - DNA, 3000 bp, Unknown
  misc_feature (1)..( 3000): cDNA_ID_2145738_gDNA_ID_1620455_Annot_ID_157607 3000 nt of promoter + ATG
actccaatgttgggatgtgttgagccatttgaccggttgcaatgcattctatgaatttggctttaggccaaagtcttggaactataccttcccatgatttattgttgcattcattttctatgagatcagccaattcaggattaggctctccaagaatctttgaaacggagtctctacaactaatatcagtgatccactcactaagatgaccaaaacggatattagtgcaaatttccttccaagaattctcaagaagatttattgctcggaccaaaatagtaacaaaggcggcaccaaccttcacaacatcgtctctttgaacaagaccgcatagaagatgacagtacaaagtctgcttggtgtctgaacacaatatgacttcgtcagggcttgtgtaagaccaatgccaatacgatggtcggttcttgaaataatcactcttgaagaagctcgtcgatgcagctgatgatggcaaaccagaaggagttgtgttctctgatgtacaaaagttaaataccattccctttccatgttcaagaccatctatatgcctatcatgacaccaaaagagactttcatcaataatctacaaatataaaaatgttttattaaaagaatatgttgtgttatcatcattacttgcttataacgagcgatcggtaataaaagatgaattttatgttttccaagtacttgttgttacgaggaaacatcttctgttttcctccggatgttccagaactacagtgaaaaaccattagagcacattatctctagagtttctaacatcactcacattgattgtataataaccaatgataaagttgctctaatacaatttttgaaaagaagaaaaaagccaggaaatgaaaagtatataccttagaaggaatccggtaatggggttgccagagataatatcagagggctctccattcgtgacacgatcgataaaaggcttcacatcctcgtaggtcaccacagggacgttcttcttgaaaagctctttactagagctcccatggagaaaacgtcgaagatactctgtgttagcattaagtgtgagtatctcctccaatacgttgtcttgtatttgcttcacattggacgtcaagtcctctaaaatctcctcgtctaatttctcagtgagatcagagcataaactcatatttggttgtcttttacttcatctgaaatcaggaattggacacttggctctttttatatagcaataatggggtcatgccatgaatattcaaatattgctagtttatgtatattaaagacaaacgagccttctctatatatgtaatctttataatctttagattcacgggtcacttgagatatttttacagtaaaaaattaaaggctcccatgcaccaatgacatacctttacgtaaagcgcacggttgaacaaaagcacgcttctccaactcacaatatttcacaattcacatgtaagaatctgagacctatatatatccaatttttcatgttagaattcttgaaaaatgaagctaaacatcgttaatccgacttaaatatataataattatgtactgtcagaatatctttatgatttacaaagtaaatctccgttttctactgaattatactttgggatattcaagatttgatatgggggttcgaattttgcagattttattcaaaaatttgtaaacgcatatgtaatataatcatgcttattcaaaccaagtatggcttgaaattaatttatgcacatattttccatggcactatttggcaattccacaactgcatgcagttgcaaaccgttgataaaaatcaacattgttaatgttcatttcaagatggatgaagatttgtggggttgattggtggagacgatagaggatttgatttttaccaatataacacttttaacatctttttaaatctcttaattgttttcctagctcatcttgttctatttattctcgtcacattcactttttcaaagtcaacaatgataaattaatttttttaaaacaattgtgactttgtgagtatgtagaaaaaccttaatttccaaatcttttctaagcaaattggaaagcatcaaggagtccaaaaaaactccttaaatttttatggtggatgcctttccaatagcttatgagtggcagagcaaacttagcttgacaaagtctaacgaaagacactttatgtcctacatattgtaatcaagtggaggtgggtgaactttgatttttcaatgttatttatccgcgtcaggtttggactatgttaccactcatgtagagtttgcttgatgcttcattcacaatcgaaattggaagagttgctcgagctacaagcgcaaattaattatatatggtttctttgcaaaaattggtgagttgaagaatttgttttgcacaaaaccctttatcaaaacccatccattttgaaaacattttgtggaaagttcttttggtaggaaacggcaacaagaaaaatgtaactaaaagaaaaaatacaagttcattatgtaggcctgaattaaacaatgtttcagagtcaacaaacctaaccaagattcataatagagataagcgtaataaagttcactcaatctaacaaactcatagacatgaatgaaaaaaggggattgttattacatttgaccacacaagaaaacgttatatacaatatgaagaaaataacaagtaaaccattaccttaattctgattcttccactaatgataccggtattgggaagtagtcaaatacgttgttctccataagaggacttgatacatttcaagagtcaattacgcattttccacaaagaaaaaaaggagtatccgcgtaaccttatctttattacaaaagaaaaatcattgaaattatcatcgcaacgtgattacgtgagttcatttctctacatatattcatgaattcacatttcaaaaactcatccttttaaaactacgtaccggaaaaaaaaaaacgaccatactataaaaaaatg

SEQ ID NO: 1842 - DNA, 3000 bp, Unknown
  misc_feature (1)..( 3000): cDNA_ID_3064692_gDNA_ID_1620455_Annot_ID_157611 3000 nt of promoter + ATG
atcctgcctcgcctgccactcaaaggtcaagccaatgtaataaccgcacaaggtcgtactgatctatttcagaacacagggatctctattcataactcaataatcatacccgctcctgacttaaaaccggtggtccgtagtgttaagacatatatgggtcgaccctggatgatgtactcccgcaccgtggttcttaagacgtacatcgatagtgttgtgagtcctgtcgggtggtctccgtggactaaaggttcgacgtatggtctcgacacgctgttctatgcggaatataagaatatcggaccggcttcatccacgaggtggcgtgtccgttggaaagggtttcatgtgttgagtaaagcttccgatgcatctgctttctctgttggaaaattcatcgctggtactgcgtggctcccaggctctggcatacccttcacttcagaactctaaggccatctttgattttccatgctttaactaaaacgatgtcaaagtttataacatataattcatttttacaaatcatttcctattgacgtagcaaaaataaataaataataataattaaaaaaattcctatttcactctcatttgactaaaagaggagaggcgtgaaaaaaaaagttatagcatagtttgacgtgaacgtggctaagatcaattctcataaaaattatataagtgtatttgcatgtgtcaagagtgagggaaatattttcgataagatttggagatagtctcttttgatcctgcagaaaccaaattttagcatgtgtatacgaatcttaagtagtaatttacacttccatatataagaccataaccgtctacttcaatcacctatataagtcaactcatgttgaccatcccatctccgatcgaaaatttacatgaaccttggaaaaatggggtagtaaaagaaacggtttatatgaaattttatcctaatgaaattagaaaaataaaagagacatcaatttttaatgtgaaaatgaatacaaatgaaaaggtgtgtcttgtcttagctcgagttagccgaaatattaggagcaaacaaaacaagagttgagtttccgtctatattagtgatcaagagtctgatcgatggaacatgaatccatgcggtggaagagtctggttcctagctagaggaacaaaataaggtttctagtctttgggtctaagttagggacgtatgtatttcgtggaatatatgttgaaaattggttagtgtcgacctaaaagatgtcttcgtatcaaataatcataattaagcaagatcatattgtaagagcgtagatacgtagccaaatctcaagttgtgtgtgcgtttcttatatttgtttttacagtgattggagtgtgtgcatggacactcaaaggattttcaactgctcttttatttgctgaaaacacaattcacacaagtgcatcttttagttctcacgaatccaaaatgtcgacactcaaggaatcacatgggtcacttttatattatttgcgagtattaattagagaagaagactaacatgccatctttctcgacaagttgaatgttcacagtcaattaaattagagaaggctaacatgccactcaagtttatgttttcaatagataagcattactccccaaaccagtttcaactccggttaagatgtgaatggtatcacacattctcaactgatagttaattaaacaaagaaaaatgttcacaggttttgcattaattaatgtaaatttgaatgtaattgttaattatgttattggttgacgatataaatagcatgtgaagtgaaggattcacagcaggagagaagaaaaatgatgtatagaagcgtttgtttatttctaggattctagataggatgttaataatcatatttaataccttcaagtgacgatatttaattgttgtcggattgttttaattagttttatttttcagtgtttaattaagaatcaagatctctcgtacacagcgttcttctaggaaaataattgttcaagaactagtattttcgtttagtgttacaataggttttttaaaaaaaaccaagttttccgatgatatatatattttttttaatttaaaccagaaacagatggcaatatgttaaaatttatattctattttagattcttttgaacttctaatgtgaaacataacatatatagtatctcgattgatgagtcttattagtctatcttgaaccgataaatcgtagctaattagaccaatgaattagattttgatatcatattaaatttcatgaatttctaattcaatattttcctacttttaatgtggaatatttctcacattagtatatagtgaagtaattgctttgaaaactagttcttgttgcttttattaccagtactactaacgaatatgaattcttattttataaatttgtgtttaaagaatagctaaaataaataaaaaatggtcgaactttttgttagtattcctcctgaaaatctccctaaaagaaaatctttagtagaaaaaggtgataggaatcgttcacgcaataagaaaacagcagcattcgagctaccaaaggtagatctcactcataacctcacaatataaattttgtttgcttgtgttgctttaaatgtcaataccaccacaccatatatttttagatttaagatatagattgaagatcatgttcccactctctagtctctagcattgtactttgagttacattcaactccaccttctcaaaccaaaacaacatcaagttaacaaaagaagcaacatgaatatgatgatgcaaaaactctctattctatttctacatttaatattactagtactactctgcgtccatcctctcaccaccgtagccgaccgcaattccaccgattggtgcgacaaaactccataccctgatccatgcaaatgctacttcaagaaccacaacggatttcaacagccgacacaattatccgagttccgagtaatgctggtggaagcagccatg

SEQ ID NO: 1843 - DNA, 3000 bp, Unknown
  misc_feature (1)..( 3000): cDNA_ID_2145740_gDNA_ID_1620455_Annot_ID_157608 3000 nt of promoter + ATG
ggttaaagtagaagaagaagatgtagaagaaaagtggttaacgttaatatatattacaaatatgcaagttagaggtttattgttacttttcggctttatacaaaaactaccgttgagatttaacttaacggtatcggaggagagatcacatgatggcttaaaacatgccggagatactttttccgaccaatctctttatcttctacaactgtaaattcctccatctccggattaattcaagacatttttgtttaaaattttatgtgaagtaataactttttaatagaacaaaatgcaacataacgttcacattcttctcaatcaaaattgagcaaagctaaatttgcagagaggaaaaaataagatggaatattttgattgtttattgcttattgtatttgtttgctttatgttgagttggtttagtcctaatttcataaaaaaaaaaccatagaacctattgataacatattacagtttgggacaagcttaagctgcacgatactgaatccaaagaaatgtctattataaatagttgttgctagggcactagggttttgtacatcgttttggcgagcctggtatatttgatgagcctggtctattgggtggccctcttccatgtgcatgcggtgaacaacttccacctacctcagccttgatctctgtgatcaccttttgatcccaaaccccttctcctattaatgaaacaaacagcactttcaatagttagagtaaaaaacatttttctatattttagttaaatcaatccaaatcaaacaaacattgtattaaaaaccagttaacatatctagtgggagaaaaattataaggatttcagtttttttctcttttcttcatatgctaagaaattgtaatattaaactgcaaaaaggaaattaaatggtttaaactttattttctttgagttttctattatttgagagatattttgctaaagatggaatctgaaaccaaaatcgagatcaaagtaaatatggagtaacaatggacccccattcatttttaaatccaaaaactgaaccaaacttaaactgggcatatataaaaacttactggcttcgtatggtactcgagcctctgctgtgtttgatagtccagtgagcaacagaaaactcaaagtcagtaagcaaaccacaacgttatacatttttttatagtatggtcgtttttttttttccggtacgtagttttaaaaggatgagtttttgaaatgtgaattcatgaatatatgtagagaaatgaactcacgtaatcacgttgcgatgataatttcaatgatttttcttttgtaataaagataaggttacgcggatactcctttttttctttgtggaaaatgcgtaattgactcttgaaatgtatcaagtcctcttatggagaacaacgtatttgactacttcccaataccggtatcattagtggaagaatcagaattaaggtaatggtttacttgttattttcttcatattgtatataacgttttcttgtgtggtcaaatgtaataacaatccccttttttcattcatgtctatgagtttgttagattgagtgaactttattacgcttatctctattatgaatcttggttaggtttgttgactctgaaacattgtttaattcaggcctacataatgaacttgtattttttcttttagttacatttttcttgttgccgtttcctaccaaaagaactttccacaaaatgttttcaaaatggatgggttttgataaagggttttgtgcaaaacaaattcttcaactcaccaatttttgcaaagaaaccatatataattaatttgcgcttgtagctcgagcaactcttccaatttcgattgtgaatgaagcatcaagcaaactctacatgagtggtaacatagtccaaacctgacgcggataaataacattgaaaaatcaaagttcacccacctccacttgattacaatatgtaggacataaagtgtctttcgttagactttgtcaagctaagtttgctctgccactcataagctattggaaaggcatccaccataaaaatttaaggagtttttttggactccttgatgctttccaatttgcttagaaaagatttggaaattaaggtttttctacatactcacaaagtcacaattgttttaaaaaaattaatttatcattgttgactttgaaaaagtgaatgtgacgagaataaatagaacaagatgagctaggaaaacaattaagagatttaaaaagatgttaaaagtgttatattggtaaaaatcaaatcctctatcgtctccaccaatcaaccccacaaatcttcatccatcttgaaatgaacattaacaatgttgatttttatcaacggtttgcaactgcatgcagttgtggaattgccaaatagtgccatggaaaatatgtgcataaattaatttcaagccatacttggtttgaataagcatgattatattacatatgcgtttacaaatttttgaataaaatctgcaaaattcgaacccccatatcaaatcttgaatatcccaaagtataattcagtagaaaacggagatttactttgtaaatcataaagatattctgacagtacataattattatatatttaagtcggattaacgatgtttagcttcatttttcaagaattctaacatgaaaaattggatatatataggtctcagattcttacatgtgaattgtgaaatattgtgagttggagaagcgtgcttttgttcaaccgtgcgctttacgtaaaggtatgtcattggtgcatgggagcctttaattttttactgtaaaaatatctcaagtgacccgtgaatctaaagattataaagattacatatatagagaaggctcgtttgtctttaatatacataaactagcaatatttgaatattcatggcatgaccccattattgctatataaaaagagccaagtgtccaattcctgatttcagatgaagtaaaagacaaccaaat

SEQ ID NO: 1844 - DNA, 3000 bp, Unknown
  misc_feature (1)..( 3000): cDNA_ID_2145634_gDNA_ID_1620456_Annot_ID_157641 3000 nt of promoter + ATG
tgagaccacctccattggagggtccttaagagtttctagtactgaatccttacaaaaagaagccaaaattaaatcagaaaaatgaaattaatcaaggtacgcaccttagcttaggtattttgtgatgttttaggtgcgtatacgtggtggtttcccattgggtaaggtaagagacaaaacaattttttttctttcctctgtttgcgaaatcattgtctctcttctcttgttttctccggatgaattctctctcgatcagcttcatgcggcgtccacatcatcaaattggagaagataaccgaagaaaatcgtcccccttccgccgtgatcatcatctcaaccgacggtctcaacatctgtgacttcgaacataatcggcgattttgatgaaccaaatcggagagagaagattaataagatagttttgaggaagaaatcacaattagagcttaaagcaagaataaatcacaatcacaagatgggaatttttcggacaacgtagtgataatcagtcaatcggagaaagaaggtgacccgagtgttataaccatcaattgtcctgacaaaacgggtctaggttgtgatctttttcgtatcctcctcttcttcggcctcaacattgtctgaggaggtaacaattccatctcatcattacactttgtgtggttttcaaaaatttcttatttttgatatctgctgtggtttgtgacttgaatgtgttcgatgaaattcctctgaaaagatgtatcaactaatggaaaatggtgttacttggtcttctaggtgattgggaaaccaaacacgagatggaatctgttgaaggtgagacttgttgaggcaagtgcttctttttcttaggcctttggtatctcaagatgttacctttctcatcttttcaacattcaggtttgtgcaagtctttaatgtggttgtgagaatgccgtgtggtagggtcatcatcttagagggtctattgcagggcttcactctccttcgcaactattcctaatagatccttcaaaagagaaaccgtcatggaggatcctgaatgtcccagggaaaccacccaagttagcttggggacatagcacatgcgttgttggaggaactagagtattggtccttggtggtcacaatggtgaggaatggatactcaatgaattacatgaactctgcttggctagctggcaagactcggatctgtaaagactctttccttattcatttggtttgtggttatgtatctgtcacattccaaactcttatgacagaagcgtgtgtacatagtaaattagtgattgttgtacgctttagatattaatgtaatgatgttaatgggtttgctgtatgagatccttctataatatacttactccttgttacatgaccatgtagcatttgattttgacgtaccaaaaggcttctctgaagcatgcgaacacataacatccaaaagagaagccactgagttatgacatatgtcaacaaacccaaaagtagaaataatcacacacacctcaagtaaatagaatgaagaaaccgaacaagtaaagtacacaaactccaatacaaagctaaaacctatttaatttcatcaaaatactagttcatccaaaatggcaagttcttcatccaaaatgactggttttttttaaaaaaaaaattcacttaaggattctaccactggacagtaaaaaatgtaaagactctacaaaaactctaaactttaaaattttcaaaatttattattatacaaatgtaaggattcctttataaggacttaccaatggtcttgctctgagttgctttatttaatttcttgtttcttcattagttttatggtgatttgtttactgtcttcttactatggttcgtgttctctgaccatttaggagaagaaagtttatttggataaagctgctcaactaaaggcagaatataaacaagtcatataaagtgaagatatggctagtccttggacgaattcaaatgcagcaaagccgaggaagagagtccaagtggaaaatagcagcaacacctctacgactacattacgtcacgctaaagatgatagtatatggtgagaaggaaacatgagacgtcatggtgaggctccaacacgaccctctaaactcattggatttatcgataagagtgttcatggttgaccaagcacaatgacattgttgagattacatgattatgaaggcggcttacgctactggtttcacatccatatccactaatcttattttacaagttgttatattatctaaaattttcaaagtcttacaaatctttacattcatagaaaaaagaatgtcatatggtgactatcaaacatctagttgagaagatttaagtaagaaaaaacgaatatctatttttagtatttgatttgtttcataaatttacagatatacgattttttctaaatcaaatcgagtcgaatagtagatggaagcgaatccaacaaatattttgcccaacagtaaatcaaatcaaagaggcatttttgtcctataaaaaaacaaatgttattttaacaaaggacaataaaataaaataacagaatggtaagaaaaaggtaaaaaatttactccttttttccaaagtctccatttttactttctttttcttctccccagcagagagaggggaagtctctaaacccttgcttgtcatcaaatcgattcctcgagtgaggaaacatttctcttttcgtggatcttacgagaccgagaagagagtaagatatgtccggcgcatcgtctgaggatagcagtattttcgctcgctggtgatttcttcttcttcgttgaaaacttttttgaaatcggatttgtgtttctaattttgttcgaattagggttttgttacaaagatttagcgattgggatttctagggcttctcacaagtttttgttttttttttgttgttgaaaattcagtgaagacgtagactgtaacaagaaaatacctgtagagcttgtaaggatg

SEQ ID NO: 1845 - DNA, 3000 bp, Unknown
  misc_feature (1)..( 3000): cDNA_ID_3064730_gDNA_ID_1620456_Annot_ID_157645 3000 nt of promoter + ATG
aaaatttccatcgtttggaaatagtagacactatcacactaatgatccggtagtaaaccatgtgcatgagccatgaggttaatttgcattctttcatttgattttcactccataatctttcgtttttatttggtcagtcaaaactcaaaataataacacatctaattttagtggcttatccggtggactgaccatcttcaactatacattttgaaaattatttgtattttagatcaaaattatttattattaacaaaaataaaataaaatacaacttatatccaatgatatatataaacatatatatcaatggtcaaaatttttataatttttaaaattgtaaagcaaaatattaaggtcgtaatagtaaaatgttaattatatcttcccactgaaaaaagaaaaaagaaaacgaatcagttttattccacttgcacaaatcttcttcacacacatttttttttcttcactcggactgatatgagtagccaaatcgctttgtcaccggccatcgccgccgccattcgccgtccgtcctctcacgactgtctatccgcttccgccactactgctaccgccacccccatggctctcaaatcttgcatcgtcgcacctctctcgctattcacctctcaatctcaaatcaaacactcaagctcaagaaaaacttctcgaaccacgattcgatgcgatgtagcgataaaatccgcagattcgataaacgcagacgccaatccttcgtcctcaccgtcatcagaggaagaaatcgaagcggaagcgaaggcgaagataggatctagggttagagtaactgcaccgttgaaggtttatcatgtaaatcgagttccagaggttgatttagaaggtatggaaggtaaactcaaagattacgttgctgtttggaaagggaaacgaatctcagctaatcttccttataagattgagttcttcaaagaaattgaaggtcgtggtcttgttaaatttgtttcacatcttaaggaagatgagttcgagttcattgatcagtgatgaaacaagaaagacaatttttgttttcctttctcagtgtttgtttttgtttgttgtgtttactggaacctgggaatggagaatgatttgtatgtagtgtgatgtgtattcaacctttagcaatcatatacataagggtttcttcactctctatttatgttgatttgattcattggcttgatcttgttattggtttcttagtgttcgatagattggaagaaacgaaaagttggatctagatgtggtttcttgatgattaataagggcaattttaggctgcggttgtttcaaatgattccattagcaagatcaagatccaatttgggataacacctagtttactatgtttgctgtttaagactagtatcattgaagtatcttgaattgaaagggtggatcttggtcatgatggtaagggtgattagggagtggagctcagactctctactagattgagttagcacttgagatgttacatagtgtggatcgtacttgaggagtcttagagaaacagttccttaggtattcagatgattttcctatatgcaaatctgtgttgtctctgtttggttcatgtgtctttagcttataaaatatgtttgattttgaatcaaaggtaaactattgtcattctcctcttctgtcttttctagtatttgtgaattcagcagcttcgtggctgtggtattggtgatgatctttatgctcgtggtcgcatttcgtcctagtgagatagaggagaaggcaatctagatttgtagtcgtcatcaatcgcattttgatctaggagatgattgagctacgattgttagtctttgaaaccttgtgaatttcaagcttttgttgttgatagagtatataagcttaaagtctctaaaggaaagtgctccaaaatatgtcatccttatgtttagttggtgggtcagattaggcccgtttttcgttcgtgggtcagattctaggcccgtatcggtttagctattcctattctcataaactttaaaacaagatattttaggtagagagaagcgagtcgtcttagtcaaatacatatgccctaaggtagacaggttcatcatcatagatatcacgagtctgtcattattctcagaagaaaactaaaaaaaaaatcttagtaatatgtttagattttgtgaggaatattattatggttgtttgatcaactctaacgtactaacacgtccatgtatcacgtcttccaaagttcaacgttttataaagattggagtattaaaattggagtggatggagattcgagcttgcatatgaataatacaataattggattacaaaactcagatttggtgacagcacatctaggccaaggccaggccagaccatggtggcaatgattgatttagctttttaattagctaatgcattgtgcgctttcaaaagcaagcagccaaagtatatgtaatgagggacaaagtaatttaaactctaaaaagtcaaaacgcttatatatgtccgtaattttaggtttctatttcaaaattttgtagttactgtaatcttgtctttaaaagttgttacaatcatcttccacataaaaactttatcttaccgaatgtttatttaattaacatctatccataaagttgttttcttgatgttacgtaattgatttctaccacctaatgaatttcttctttaacaagagaatataaaaaacatgattttaaaataggtgttcctgatattttaatgtaatgtgaaatgtcaattctacttaaataacattgcaccaataaatcaagtccctaattctaaaaattcgacgacggataaatgattaaattaaccattcaaaataattatgaatttttggttaaagtcaagattcaagaagcattgcaacattgaaatcatggtttcacaaaaaaaaactctttattaaataaaaaaatcttttgtttttggagttagagtttgtgtacttgtaaaatg

SEQ ID NO: 1846 - DNA, 3000 bp, Unknown
  misc_feature (1)..( 3000): cDNA_ID_3064722_gDNA_ID_1620456_Annot_ID_157647 3000 nt of promoter + ATG
catcttcccatctaccaacttcttccactattaaaccttctctaatcatccttttaagattataaggttattacttaagctaaaccatcatcaactaacatagcataatcgttttctgaaagctaaattattaaatctggctatggaaatattgacagctaagctaaaccattttaagaaattttttgtttgttatattcagaatattcggcatctatagtgagaaaatatggtaaactacaaatagtagtagtagtttgtgaccaataaatatatcatatctaaatttggtgtaacggtggttgactttcttatcaattttgaaattatttatttgaaaaaatagtcgtttcttttgtcaagattcaagaacataagtaaattaacaatcatatattaaatttctttgaatgtgaaagtcggtgatttttctttaaatagaattaggttatatcatggcaatttccaatttatgttttttttgtagtttctataatatgtcagaaatcacttagcattatggtttacgtcaccagtcacttagatacatataatatatggtatatcatttcaacatcatgtttttgtatttgaaagtgttttcattttttcttttctttttgaatatctaaaagttcaaacatgaaaactttactttccctaaatttagaattcacatctagttaaattcatatttttggaaaaaaaattcatcccaatagaaatataatccagaacttctacctgtgagatttatcaatgggccaactccgtattgataaaatgttttcatttatctacaacttcttctaattttgattataagtaaaattgtcatcgtttttctatgtaaatatttaaatccacgtatttgatgttccttcttttctatatataatatataatataaataaaatgatttattgttatttaaagattaaaaaataattatagtgtttgatgttgtatctaattgaaaataatatcaaatatctcattataaatttaaacaattaaatttttaaaatatagatatatatttggtttatgatactacgagcgttaaaaactcaactcaactcattacccaataagtttatagctaaatgagtatatgagttgacccaaccaatttgtttaaatggattaacctatgcaattaataactgtttaaataattaataaaaaaactatttataatgattatatgaacgtaatttgtatcgattaacgagagtaatggaatgcaattaatgcactgtaacatttttaagtcaataaaacttcacattattataacaattcacgattacaagaatgtctaaaacataaccaaagctatccactaccatttgaaaacatcattcatattttttttccctagaagctggatctctaagatctgatcgaataacattctagatcaacttactatacaagaagaatgaaccaaaagaagaaaataaaattgcaaatcaccaattgcaaaacggaaaaggaataacaaatgaaacaaagaactcgtctccaacaaaaacgatagaagaagaattaacgaaaaagctctgataccatattaaactccgatgatcggagaagagatgataacgaaaacttaacaaactttcattacacacataagtgtttgttacaaagcttaattaatctgatcatgaaaataagcttatatagtatatacttctctcccaagtcatctacaattcataacaaataaatatataaaaaatcatttaacaatagaagaagatgagacatgaaatcatatcaatgatattgtatcacacttttatcgtcaatcacaaaaccatataaccaggaacaagtacacaatatagtttggacattgttaggaaaactttgatttatgatttatcgccttgttatatatgaaattttttaaaacatttccagaaaatatatatgtatcaaaattagagtttatatgatttatcttagatggatattatactttgataaataaaatttgttacttattaagttttttgaaatataaataacatttttactgaattttaataacattgttttgtttcattttataatcaaggaaacaaattcaaatctaattactaaaaaaattctatgagaattcaaatttacctactaaatatataaatataaagttaggactaaaaacttatattaaaaatgaggggttttaaaaaaaatatcttgcgaataaagcaattgcaagaataaaatatttcgaaaaataaagtacaaaataattttaaaacatagccattaaagtaacaaatactactataatatcataaataaaatagattaaaattttggaaaaaagaagtccaaaaaaaggttctgtagtggaaataaatccgaaaggagggggccataggtttctgctgtcgagtcgaatccaatcgaaatcgaatcgaaattgagtcgagtcatcatctcctccgccattatcgtcttctctctctctctctccgccacctctcttcaattctgacgcttctcagatcctccgatccggcggcgttacttttgctgatacacttctctccatttcttctttttgttcgccgagaagctaaggtaagacgaataaatagctaaaagcaagctctgacgacgatttcgttttcagattcgtttatcatttgcttccgattcctcatgatctgttgtatagtgttcttattttgattgaatttccatcaaatgctggttataaatcgatccatggacatgaattttgttacaggagaattcttcctgaaaacgcgttgatggatctgatgtatagctacggattagaattgtgtaattctctctaaaatctgttcgttgaccagctcgaacgaggtttgattgggtttctctgtttatgctcatcaggggttttgttttgtgtatgccttccgatcactgtttgtcgtctgtttcgtccgcggaactcaagagcagagagattgttagtgtacggatatg

SEQ ID NO: 1847 - DNA, 3000 bp, Unknown
  misc_feature (1)..( 3000): cDNA_ID_3064726_gDNA_ID_1620456_Annot_ID_157646 3000 nt of promoter + ATG
aatggtctgcttactcgaagcaatccgaaagaaggagtttctatcccaattggaatagtacctgctggttctgataactcgttagtttggactgtccttggtgtaagagatcctatttctgcagcactctctattgtgaaggtaaccccgcctaaaatcctattggtccctgctttgttttatccagccgccaacattaattagcttctacttaattaatattttctcagtgaaagatttttttttttttggtttagggtggcctaacagctactgatgtctttgctgttgaatggattcataccggtattatacactttggaatgactgtttcctactatggttttgttagcgatggtaagtgaggatacctgtgtgctttgtcttgtatgattttctaatgataaacagtttctcaagtgtagttaggtttgaatctgtattcctagcttctttgtttcattcaccgtgtctgcaactgtttagatctttcatgcattttagaggagagtttttaaatcttccttactgtaatttttcagtttatcttctaaatattttaactggcacagtgtgaacactatgctgactcccaagacacataatttcatagaatattgcagaatgtgcactcttctgatgatgagttagaagcagaaaatcgcctagttattcaaacgtatcatggataaactcaaatacattgaacttgtgcaaaaggctgtaaatctctctccatttctttaacagctccggtgtgtgtttgatgtattagtttgagctattggacgctgtctcgtgtttgacgtcaggattattgcacatataattaccttcatgaatactgtataatgtttgtggcattcacctgctataactaaatttcatggtttttcttgtcattatctatttgcagttttggagctctctgaaaaataccaaaaacggtttggtcctttgcgttactttgttgctggattcctcaagttcatgtgtttgccgaagtatagctatgaagtggaatatcttccggcacaaaaagaggatgcagaaggcaaaattcgacttgaaaaggaagctgtggatatgcaagatctctacacggatgtaatgaggagatcaagcagagaaggatttcctagagcctccagtttatcaagtattgactccataatgaccccaagcgtaggcgaattagacacttgtagcagcacacatgccagcactgagccgtctgaatatgtccgtggaatagatcctaaaatgaaacgcttgtcctctggaagaagagatgttacggctgagccagaggttattcatcctcaagcacagtcaacaacccctaattggccaaggacaagatcaaagtcaagaatggataaaggatggatggggttaacatccgtgcaggatcctccaactcgatgttcatgggggaataccggtggtcaagacagggaagatatatcatctactgtatctgatccaggtccaatctgggatgcaggacccaaatgggacactgaaccgtctgcttgggatgtagaaaattcgatcgagctgcctggtcctcctgaggatatagagacaggactgaggaaacagagcatcactccaatatttgaggataaatgggtttcgagaaagggacatttcctcggcatcatggtctgtaaccatgcttgtcggactgtgcaaagttcccaagtcgtggctcccaattcagaacatgatgatggtacaatggatatgctcttggttcatgggtgtggaagactgaggttactgaggttttttatacttttgcaaacaggtcgacacctttctcttccgtatgttgagtgtgtaaaggtaaattatctttcctattttcttacattacgaaacctgcaactcgctatgtgctaggaaatgctaatcaaacggtcaaactcaatgcaaatattataagtctagaatagaatgtagttgatcaaatgcatgacaattgcaggtgaaatcagtgaagataaaggcggggaaaaatacgcatgacagttgcgggatagacggggaactgtttgcattgcatggagaagtgatatcgacaatgctacctgaacaatgcagactgatcggtaacgctcctggacgacattcatagttaattaatctcatctaaattgtgaggatggtgagagagtttggatgtttatatatctggaattcatttttattgttttttgttttttgtcggcgtcaagtttacggtaagtaccatctatgtgataagagaagcaaacatgagagagtataccaagtacatccttttgtgccataacttccctataactctaaaaccctttgtatattcttttgcccttttttgtgtgttttgaattatatatgtactgtgtacgtgttttctacaacgatttgtgtgtttccatttctttgtttggattagtcgatcaataacgaaatagatgatttgaagtaacgaggtttttggactaggttaactaggtgaacttctaaagtgatattatttgtggattaagaagattttattcgaagatatttaactgatagagattctttctgtctgactcggaactttgaagcatcagagtctcacagatgaatatagtagaagccgcacgttcctcatcccgtgaaaaaggacacacgtctgacttctttatattgctgggtcttcttctccctttcctttttacttcttaaagtttaaacctttgttattatccatttcattcacatgtttttttttctgtctgcttatcatttacacgtttcttgatttgtttcattcgaaaaaaaatcatattaaattgcatccatataaatttgtagatgaagattttgacatattaaaaaaatgtaaatgcatattttagcatcaattcttccaactaataatgataaaaaatttccatcgtttggaaatagtagacactatcacactaatgatccggtagtaaaccatgtgcatgagccatg

SEQ ID NO: 1848 - DNA, 953 bp, Unknown
  misc_feature (1)..( 953): cDNA_ID_2145696_gDNA_ID_1620457_Annot_ID_157657 3000 nt of promoter + ATG
agcagcattaggaaataaatatctcttcttcagagcttctcattaaagtccgtataactaactaaacactcttagtagaatttacttttgacattttccaacgtaaaaaagatttatgacccaaaaaaaaaaaaaagagtttgaccttgtaatcacttaacttgtgtcgtcgttcaagtacaacgcatgtgtgaggaaaaaaagaataatgtgtttttataataataatgaaaagccaaaacagaccgatcaggtcaaaagaaagccgtaaagaaaatccaacttaaaataaaaataaaatctcttttaccaaacagatatacagagagacttcaatcagaggaaataaataaatttcattatttctctttctgaattaataaaaaggtttcttgttgaattgaatttgtagctgtgtttaacgtagtagcacttgggttttagatagacaacgtaaccaaaactgtttcatgttctgtctgtattctctcttttgcttttttgggtttcctccttctttctcatctttgctgcggtgcatttttttctcgggaaaatcctttctgggctttccgggaaagttttcttgtcagattcggaaaggtaccaaaaaaaataaattaataaaaacttaccaaacagattttgtgtttatctctctctctatagattcttttgatcacaaatccttttcgtttttgatcatattttgattgagaacaaaacaatcttcaaagtctcaacctttaagtttgattgatctttttttggtaagtaaatcttctgtcgtagattcgatattttctgatcttctcttttcgaattcttcaatcttcaacgatcccaatcttcttcttctggaaatctattttgcttcttcttcaaattttctggggaaaaaatcaaattcttgagttaattagactccgattttgttgaatcgagaaacgatg

SEQ ID NO: 1849 - DNA, 3000 bp, Unknown
  misc_feature (1)..( 3000): cDNA_ID_1009146_gDNA_ID_1620457_Annot_ID_157664 3000 nt of promoter + ATG
cagcatggaagctttcacaagcaagtaagcttccaaacctgcaagttacatcacatgaagattcattttactaacagctacatttaggagggagaacaatcttaatcataatattgaatttcaaagatcttaccacacattaagcgcggtaataaggctgttttcgggactggaaacaagtgatcttatagagtccagatcagtcagaggaactccatatagcctctccattgtaagtacccgccggctgctgcagtacttatatactcttggagcagtagcttgccctgtcaaccccatggtttcaagatatctcttaaatgactcaatgttttgagcctccttattgaaatctacttcttcaagcattgactcacgaatatctttgacaattccaacctatccataggataatattgtttagagagtatcttaagagcgactgcaaatcaaatacagaggagattaccagtgaagtacggctaaactcaggactaaggaactcaaatatacgggaaacaacgtagataaagttcaaatctgccactaagaaatcttctatcccaggcttcaagactttaatcacaacatcctcttgggagcctcgaagccttgcaccatggacctggtcatgatgattcccttaagcagaagaagagtacatgaacaaaatgaattttgatcattgaagtacaagtagaagaacacacttgtgctattgaggctgatgcaattggcgtagggtcaacatattcgtatacactttcaatgggtctcccaagctcctcttgcaagattttacgaatttcttcaaatggcacaggaggagctttgtcaaagcagttctgaaattctttgacatattctggtgggaacaaagttggcgcagatgctataaactacaaattcaaagatacattacaagtattgttaaatggatagaataggaaatatatagagaagcaacaaaatatgataactaagcttactttagacatacacagttcacatggttctagatatttacatgatatcatcagaggatacaatatgctctacatttagcaacatgatttacctggcccagcttaatgtaagtagctcccatgcgttcaaagagtttcctcaaatatagaggagacagtagaccaagctgcaattcacttggtaatccaccagacgcgcttgtagactgcagcgagtgagagagtagttagcaatcaaagatagtttgacatcataagcaaaaagataatttcagccaccttagataaatcatttagccactctcctccaacccctacaaaggcttgaacaccttggacaaggcgtgtcacacctcgtggacctgtgtttatcgatgtctgaactatatcctcaaccaatttgggcaatttctctatctggcctgcatcaaaagccatgtaaacaagtaaatggatcaataaactgtcatccaatatgtagatttttacaaaataaatccaataagcaacaaagaataccctaacgagatacaattcagaatcatagatgtatacaatgagattgagtttacaagaagaaggaaatttctgtactttgaagacgagaagtgaaaaggtcctgagtttgcgaatactgggctgtaagaacaaaacccttgaaattcctggctccgatcatcttcttagacgttcctgacacagttctcgcgacgggaaactgaaaaatgaagctatcgagattgagcagcgagtaaaggacctttgcaaattttggtagctaagccataaagagcagatcaaggaaacgactttactgaaggaaagagaagagaaaacaagtaaacctgagaatggtgaaataacggtaaccgcgtgccacggaaagctgagaccgccatcgttcgccggcgattgaagcagcagagacaagacactccggtcaagctttattactcacaaaacgcacagaaaagcgacaccgttttgtatattttgaaaattgaaaatatcctgaggcggagtgaaggggaatatgccacgtggaaacgtgtaagtggttgttttcctcctcacaagtcacaacatattcgtgaaaaactctcggtacgattcgatttccggttaacctcttttaaatcccattaaaccgaaccgtttttgcgacgctggaggagaagttgagataacgcggttttacataaatacccttataaaaattgagaaataacaaaaccattcaaaccctaaccactttcacggaacctcttcatcttcgtctctctgtcttttttcttctctcaacgccgttgattcgccatcgtcgctaccggtgagattttccttcgattgtctttcttttattccatcaattcgctctctttccatctgggtttgtgcttgtagcttaaaaaaattgattatagagtcagaattgtttatcacttaagataatgagttctgagttataatgattcctgaactgatatgtagaaacttcaacttttatttgtttctacgattcatccttgtttgctttagggttcttctattctttgtaggataagatttgtttctttggcttgtttatgtttgcttcttatcctctttattcatcctgagcttgttatactggggaaacttgttgtattatactaaggtttctgtttctcttctggataatgaataaggatatttgctcaattacacaacttggaattttgtttttatggattaatggtgtctacaaagtcatcttctttagttctgtatctatctagcaaacgagtaaacttggtgtcacttgatgtgattcagtgacttgctcgattctgacaagatgcaggaaattctgaatgtatttgtaccagcttagttatagctatgtataatgtatatcgaaatacatgtcttatgatatctgtagtctttcacagttactaatatatccttgttttattgctgcagattgtcttgaggtttacgacttttggactaatctcctctgtggagagca

SEQ ID NO: 1850 - DNA, 1612 bp, Unknown
  misc_feature (1)..( 1612): cDNA_ID_2145723_gDNA_ID_1620457_Annot_ID_157663 3000 nt of promoter + ATG
cttctgtgaagccaatctttccttctctatcttctccttcagtaaatcgagagtcgtcaaagcagacttctctgggtccaacttatctctcttcgccttctttaggttgtcatttgtttttttcttggctctagctttttgagccttgctaagacctggataccatttcctttctgtctcatcaggtaagtagaatctagcaggcgtgagctctatcaacttatcgaaaaattcagtatgctgatgagtcttgaaatccatttcagaaacatgtttaccctttttctttgtcatctacaacaataaccaaaaccaatcacaatcagaaaaaagcccttttggagaaatgacaaataataaactaaggactcatagtccaagtttcataaaaactatagaatcaagacttacaatggcagattaacaaaatattagatgataaaaagttaacagtggaaatcaaaacttacatcagtcccacgagttttagtcattgctctccacagaggagattagtccaaaagtcgtaaacctcaagacaatctgcagcaataaaacaaggatatattagtaactgtgaaagactacagatatcataagacatgtatttcgatatacattatacatagctataactaagctggtacaaatacattcagaatttcctgcatcttgtcagaatcgagcaagtcactgaatcacatcaagtgacaccaagtttactcgtttgctagatagatacagaactaaagaagatgactttgtagacaccattaatccataaaaacaaaattccaagttgtgtaattgagcaaatatccttattcattatccagaagagaaacagaaaccttagtataatacaacaagtttccccagtataacaagctcaggatgaataaagaggataagaagcaaacataaacaagccaaagaaacaaatcttatcctacaaagaatagaagaaccctaaagcaaacaaggatgaatcgtagaaacaaataaaagttgaagtttctacatatcagttcaggaatcattataactcagaactcattatcttaagtgataaacaattctgactctataatcaatttttttaagctacaagcacaaacccagatggaaagagagcgaattgatggaataaaagaaagacaatcgaaggaaaatctcaccggtagcgacgatggcgaatcaacggcgttgagagaagaaaaaagacagagagacgaagatgaagaggttccgtgaaagtggttagggtttgaatggttttgttatttctcaatttttataagggtatttatgtaaaaccgcgttatctcaacttctcctccagcgtcgcaaaaacggttcggtttaatgggatttaaaagaggttaaccggaaatcgaatcgtaccgagagtttttcacgaatatgttgtgacttgtgaggaggaaaacaaccacttacacgtttccacgtggcatattccccttcactccgcctcaggatattttcaattttcaaaatatacaaaacggtgtcgcttttctgtgcgttttgtgagtaataaagcttgaccggagtgtcttgtctctgctgcttcaatcgccggcgaacgatg

SEQ ID NO: 1851 - DNA, 3000 bp, Unknown
  misc_feature (1)..( 3000): cDNA_ID_2145707_gDNA_ID_1620457_Annot_ID_157660 3000 nt of promoter + ATG
tacttcaatctccagttctttaaccacagctttcagttcctcaacagtgttcttggcatttcctgattcagacacaagctctgtctgcttatagaccagctggttaagttgctcctccatttgctgaatttggatgtctcttgatctcatctctgcttttagattgtctacttcagcacatactccgtctttctctgccattaacatgtcgtacctcagcttgtgcttgtcgaaatctttgtttaatgcttcaatatgctcaccacgtgtggccaagtctgtcttcaatgcactgatttcagcttgcaactcaacctctttcctctgcatctccattttctctgcctcagaatgctttatctgatctaccagttttgttttctcaatagagaaattttgctgacaatcacacaacatttcccttagcttagagatttcagaaaatgacacatctaaacagtccctactcacctcatgctcattcactagatgctcaaatttgaaacttaagtctgaaagctcagtttccaaatcaaccacctgtctttgcacctcgagaactcgctttctctcagtctcaatagctatgtccctaatcgcaatttctccttgtgcgatttctcgctcaccacgtagatactcgccaaacagaacaaccgattcttttttctcggtctcctttagtttctcaatctcttgctcaaattcttgaagtttcaaactcgtagtcctaagctcttcttcacactggacatatttcttcatcaattcttcataactcatttgtttctccggggataagtcatggctatccattgaccctggtgatacgaggtgatggttaaaagatgagtaaaaggcctccgtgtccgaatctaaatcggaataagaagagttagaatcatgattgccagaaacatcagaacttccttggtcaaagttggaagctactgtatcagactttggagttacaggaggtgaagatccattgtgatctgaaacttgacaattgatatgtctaataagatttctacgtttgaacggaaacgcacacaaccaaaataagacatgaatgaattatacggttatacctgttgagatgtccacaaaggaattcgaattatgtggccactcatctgggacctcaactgttgtaaaatccattacacttaaacaacaaaaagcgaatcaacttaaaaatgatcaagcaaaaaaaaatcaaagaaacgtaaacatagaatgatgtaacagaaaaaccctaaaaatacagaagatatacgagatataaaaactggtaagatttttatttactttttttttttttatactcctaagatttagctataactaaacgtatttatattttttgaccaaaaaaaaaaaaaacgtatttatatttatctctacaataatttcgattaaaaatatctaacaaaaaaaaaagttgtgataataatcagtggaaaactatcatgaagagacaagctaatgttctttaattgaaatcttagaaaataaaaaaactagggttgcgtaaattttaagactttcttatgtcacagaactgaacttttttcactacatgtaaacagaaattataactcatttgcaacggtgaagaaacatagacaaagaccctccataaatctcagaaaaacagagcaagtaactcagatcataagatctacaaaacacatcaacggaacaaacaaatatcaaaccctgaaatctgattcacataggaccaaataaacatgagatttcactgaccttgaaaattgatatgatcgagggaacaaaagagcagatttacaggaaaagtgaaggagaaacaaaggaaggtttaagtagaggattgctagggtacgagagttacgaagcagaaggtggaaaggtttaaagggacgacaaagaggagggaagatttgtcggatagcgaagagaaagtggcgctctttgggattcaaatgtttgccattttcttcttttgtctatctgacagtctgttctttgctgcactagtggccacacatctccacatgcaccaccagttatcaaagtttgacctattaattattgggttcggttcgattcaattttctctcgtaaataacgtaaaccgaacatataccaattttgtctgcaaagtccaacaaacccattttctcgattctgttgggcttgatgatactagagttggacctttattttttcagcccgctggttttagcctattttgatatactagtaagtaaagcatcactatcaatatattttgatttattcattggactaatccgttgattaattaatattttgaagttttatttttgtcggcaaatactttttaagttttatctgtaagaaagttagtgacgatgaatatcctttaccccactacttgtgatttgttgtgttcttcacacttctattttagttatatcactatcaaatatcaattactattttgatttagtcactaattcgatgataatatatttctaaggatattttaaaggtttatcggccgttttttcactttttttacagccactgtaaaactgtaactagaaaaaaatcgactgtggaagttgtcggtggtggtggtggttgttgcttggttggattatgatttgtgacaaatatattaatattttaaaaatctggaagagtgacgagtagaggagacaaatagcttgctctttgcatcttcttagccatcccaagattctcctcttcgtcttccttataaactatctctctgtagagaagaaagcttggatccagattgagagagattcagagagtcacatcaccacactccatcttcagatctcatggtaaagcttttaactcttcttacactcatgatccattctcagatttgacttcctttactcggatctcctcagatctaatcgtagtttctgtttttgataattccgatcagatttgaactattccgacgtttcggtgttggaagcaactaagtgacaaatg

SEQ ID NO: 1852 - DNA, 3000 bp, Unknown
  misc_feature (1)..( 3000): cDNA_ID_2145829_gDNA_ID_1620458_Annot_ID_157667 3000 nt of promoter + ATG
aataatgttacttttcttgattggtgataaagtgtgtttttcgaagaaaaaaaacggtctactacatttatcagtctaaaaattatcggtttttttttttttttttttaaacgcaaaatattgttatttttcttgattggtgataaagtgcatttttcaattaaaaaaaattcagttccgccaactaaaagctatcaatcaagaccagaatatagtcacgtaaaaaatgctaagtagaaaagtagaatcgattatttggtgtgccaaagtcaaacaagacaatttaattaggtggttgatttgaaaataaacaattctttggtgtgccaaagtcaaacaagaaaatttcattaaggagatatttactttctcccacactttctcaacttcctcttcactattccatactttcatctttcaacaagatattttcttatgttattacctaaacaccctcaactaatgtttgtcataataaaggatctctctctctctctctctctctctctctctctctctctctctctctctctctctctctctctctctctctctctctctctctccatgatttttaccgccttcctctctccatctctccagcacttattggatcaattcctcttctcgatgatagcggtggctcaccagaaatcggtggtatcgattcagcaaacggatgggagaagcttcttaaactattcgatctggattctttcaagaattcatttcataagctttgtaagctacttcaatggagttgttctcataagatctggattctctcatctctaaccaaagtctcgttttaaacacaaccctaattgaaaaagagcgtgtggctttgcatattatggatttgcatacgaacgtgtcgcgcaaattatgttgataaccatactatccatgacattgtgaacaattgttcgtttcaacaagttcataccgtccatgtactagtctactggattcaaaaacatataatctttgatggacaccttacttgtcatgttcttctcttttatttgaatcaaatcagatgagaactcttgaattaagaaatctgcaattttgttttttcaagctttgcattcaccttctctcacctgtttggatgatcaatagttataaatattggtatagtatatttgtttaagtaccttttaatatctatttaataataaacaaatgttcaatcataaaaggataatagatagggaattggacttgtttaggcacttctacaaacttttattctttttgaggcacttctcacgtacaaggcacttttccttgtttttgaaaaataaatggacaattatatccccactcatctaaaccaaaaatttacttaaccggttagaaatgtttgttttgatttggtttccttctaataaatcgacagttgatatttacagatgagaaaaggaagttaccttcgccgagtgaaattatctcaatgtcgatggttgttaattctcacagtgataaatatatcacagtgataattgattgtaacactgatagctaaaggctatatcgaaaatcaaatctgacggagccgcgcaggacccgacggcggagatggatttaagatgcgatgaaacgattctcctccacataatggtctcgattcttcggggaaaattaggaaaattagcatcaagagaagaaatcgcagataaatcatgaaaatgagattacttacaggaaaattagatccggacacgcggtgaagattactgagagattagagctctcagaggagattctccgatctacgatagcagagagtgataaagagtgtgacagagagaaagagagatttgttggagaggcctatttgcgtcgattaggaatctccccctgaattagtatcggcctgcaatagccatttttttacagactttgaaaatcttaatatgatggaagttgtagttatctgaaaggtttagaataactagagtggagggtaccaacagcgatactgatatccacgtagtctctgtaaatgatatcatctccatcgataactgcatttactacaggttggtgctggaggtttgacttgagcaccattaaacaagaaactcgtatggaaaaaatttaagaaattgtttcggcaaaaaaactagtatccaacatatcaagtccaaaaaaagataaactgcaaaatattaatgtccacttctgtatgtccaactattttatcatatttgttcactgataattgtccagtatcgtcgaatgtttaaactgttatattgattatgtttgatgtaaagggatgtaaattatatctttcatgtttttgaccttagttccttcttggacttttttagacaaacccaaaaaatataaaaaagaaaaccatgatttatattggttagtgatgtatctgtttttgttgtagggaaaagaggattcctaataatttggtcttctatcatattgatgcttctcccaaaatgttcagctctacttgagtgtatacatgcaaaaaatgaattgaagattttatttgattatttaaaatttttcccacaatgttttatgtgttttggtttgatttagtttttgtttgctgatttttaactttccattatactgattgtgttctatatatccacaatattatgtccacaatataatgtccaataaatccaaaaaaaaaatgtaaaattgatgagtgtttcatacttgtgtattgttgagtgtccaatatgatcaatcaattagttaaccggttatcttgctaaggtttgtagcggtatctaaaaaaaacgtatccagtcagtgcataaagagacggttgagatcttcacacaaagaaaggagttacttgacgattacagacggttgtaatgcagtcattatttcgatgtcgacaaaggtacaatgaaaaaatatccttaaaagtcgtaacacgtttacgatactcaattacgctattaggtaattaacgtgaatgctctgttttgttttggttagggattgatg

SEQ ID NO: 1853 - DNA, 3000 bp, Unknown
  misc_feature (1)..( 3000): cDNA_ID_2145892_gDNA_ID_1620458_Annot_ID_157684 3000 nt of promoter + ATG
tgatttgaagagcttcgcgcacagtcgcgtcattggcccagtaggtagttagcaaataccgataaatctacaaaagtatataaattccgtttctccaaattgtttaacggctaatagaggacatttagatatatagattacttacatagcaatctggagtttcagtttcgcacaacggatctagtataagttgttggaatattctgtttgtgcactaaaaataaataaccacaaaaaaaaagtgtctgaatttagtgatcatgaatctttaataaccacaaaataaataaggcgcttgagtgtgtaaaccttattaaattcttcaacgaatttcaagcattgtgtgttacgtggatgaacatttgtatattctcctttacaggttttcttcaacgactgcgaaccaaatggtatttttttaaaaaaaccggtttccttgtaaggacaagaaacaaaagcaaaatctaatattgtttctaacctcgtagagttcatcagatatcagtgccattccatgggcaaatggaatgcggctgttactaccagttgtatagtctgttaacgggttaccgagcacatagccctgaagatttattggaggattgcagcattcataatttcctgcatcaccatgcatgattcttttgttagaattattagggatattgtcccacatcggaagttgagtaggatcttaagtggtatatataagatatgggcctctccacctattgtcaattggttttgagttggaagcccataatctaataataataattaattgagaaaaaggcttgtgggattgatattgtaaaactatgtagtgtatataccttttgagatttcttgaacggtagcgggaacaaccaaaccggaataagaatctccggcaacatagaaagggttggaggaaaacacttgatgctttcctagccactacaccacaacaacaacaagaaaaatagaaaaaggatcctaactaatttgtccatgcacaaagaaacgttgcatcaagatttgccatttactttttgaagaaactcatggatccgtttggcttctcctgaatcactaggtttattaaattgttgagttcttgaataggaaaagccagttccaacaggctgatccaagaatattatgcttgaagtctgaggaaaatgatgatcaagaatatattgattattgggttttgctgatcggcatatatatcaagaatacacacttttttttgtattacctttgtccaagaatatgtagtagagaccaaagaagggagagttccattgtaaacgtcaagcttcatagttagaggccctgcttatatacatatatagaattgactaatcaaagacgcagaagaaggagtttatcaatgttttcgatttcaccattttcaaaaagaaggccagagatggcagagcagccaggtcctccagttagccagagaataagagggtcttcttttgggttcctctcagacttgatgaagtagtagaatagttgcacttcctcttcctcaccaacaccaatataccttcattcacaagaaacagtaacatacttttaggttatctgcaaacacagaacacggatttaaccaagtaaaaacatggaaaacaaacccggtttcaagctcaaagggaagttgaccttcaaaaccaggaagagacttgacgattgaggcagagtcaacatgttgcttactcaagaatacaaggtgaagaagcacaagcagcgacttcagaacagaggaaacgtacttgtttgccatttcgtatttcagattctgattagcaatgtctttaaggctcaactctatataactattagaaacggactacaaaattactaaataatcgtcatcgcattttgcgatcatagaaaaataattatatactattaatcttttgctctataattgtatttgattcaaaacgcaaccagagtatcttcaatgatctggatcaatttttaaagcagcaaaaaacaaaaaagtccacacaaaaaaagaccaactaaccaatccaataatttgatttgttttggactcgtatggtttcaagagatttgcttaattattttatctaaattatatcagattgactcaaaacctaacaagaataactcaaataactctcaatcaaactgtaaaactagagtaacccaaatcttgtgtaaaaaaacatattaaattttaatctaattttaataaaaaaatccttaaagaaaaaattcaaaaaaaattccgacaatatttttccgccaaaaacaatttcgtcaaaatttttccaccaaaaaaaagaaattcaagaaaggttttacaaaatttaggaatgattttaagcaattcaggaaggtttcacgaaatttagaatttttttttgtctgtaatccttcctgaatttcatgaaacccttccctgaaatttgtagatttttttttatgaattttggcgaatcattcaaataatcattttctgaaatttaggaaggatttcactaaattcaggaagggtttcacgtaattttttttccgaaattcttcctgaattctgtcaaatcattctcgaattttgtaaaaatttgatgtatattttttggtgaaaaaatatttatgaatatttttggtgggttttgaccaaaaaaaaaaaagaatatttttgatgggaaatgttttggtggaaacttttttaaaaaagttttgacgaaaaatattttttttgtttatttaattaaattaattatttatatttagtatttaataaaaacttgtagtactatttgtggaattttttaaaagatatactactttttgaaaaattatttttttcattactatcttcgtcaatctcttttctttaatccattaaaaacccaatttttaaatatattccacaatttaacttttatacttaaaactgatgacgtggctgctagctttgtatggataacttggcaaaggtcagaaatctgaagaaaagctttgagcagaaacatg

SEQ ID NO: 1854 - DNA, 3000 bp, Unknown
  misc_feature (1)..( 3000): cDNA_ID_2145889_gDNA_ID_1620458_Annot_ID_157683 3000 nt of promoter + ATG
gtcaatctcttttctttaatccattaaaaacccaatttttaaatatattccacaatttaacttttatacttaaaactgatgacgtggctgctagctttgtatggataacttggcaaaggtcagaaatctgaagaaaagctttgagcagaaacatgtccatggagctcaccgttctcggacccctcgccggtcggagtttcgcaatcgccggaaaacctaaacttctgcttcttcgaccaacaaacctccctcttctccgtctctcactcccgctttctcttcccaatttctcttcgtcctctcgttttaattcgcccagtaagttcttctctccctctcgctccaacttcaattttagatttcaaatttgtgtaaaccaatttcttccgaatttcgtttcagtagtattcgctgcacaggagagtaacttgagtgtatccaacgaaaacgaaaccagtgagtggctgatgcaaggtaccttcttatcaccattgatctatcaacatatttcccagtgaatctgaattcttagggttttgatttcttttgtttcattggtgattagatttttatacattgagaaaagatgtagaaatagcatcagctcgtgttgaagagattagagcttctgctaatttacaacaactagaacaagagattacaaatctggaatcaaaagctactgatacatcgttttgggatgatcgtactaaagctcaagaaactttatcgtctttaaatgatcttaaagatcgtatgcggttactctctgagttcaaaacgatggtattgttacatatctaaggtttatatgtttatgatgttgaggctttgagataatgtgttgttgcttgaggtataggttgaagatgccgaaacgattgttaaactaacagaagagatggactctactgatgttagtttacttgaagaagccatgggaatcattaaagagttgaataaatctttagataaatttgagcttactcagcttttatcaggaccttatgacaaagaaggtgctgttgtttacattacagctggagctggaggaacagatgcacaggttattattatactctcttagaggtttgtgtgtgtttgtgatgtgaattgaggttcttttaaaacaatgataactttcagtgcaggattgggctgatatgttgcttaggatgtatatgagatggggagagaagcagcggtacaagacgaaagttgttgaaatgtctaatggagaagaggcagggattaagtcagcgactcttgaaattgaagggcgttatgcatatggttacatttcaggggagaaaggaactcataggattgtccgacaatcgcctttcaattcgaaaggtcttcgccaggtaaaaataaggtctatgagctcaaaaagcatatgtggttgtgtgctatggatttatattggtattgcatgcagacaagcttttctggtgtggaagtgatgccgcttttgcctgaggaagcggtgggaatcgaaataccagaagaggaccttgacattagtttcacgagggcaggtgggaaaggaggacagaatgttaacaaggttgaaactgctgtacggattactcatatccctactggtgttgctgttcgttgcacaggtttgtatttcctccccactaatgttacaacctgaatgtcccgtaagatcgtgttatcaatgcatcagaactgactatggtagttgattaagatcgcgttggatgttgcagaggagagaagtcaactggcgaacaagacgagagctctgatcagactaaaagcgaaactgatggtgattgcggaggagcaacgtgctactgaaatcaaggaaataagaggagatgcagtgaaagctgaatggggacagcagatcaggaactacgtgtttcatccgtacaaactcgttaaggatgtccgaacaggtcatgaaacttctgatatcacatctgtaatggatggtgacttggaccctttcatcaaagcttaccttaagcataagtacaccttagccatggcttctgctgtaaccaattagaatgctgaggataggcttgttcctttatatttctctacttagatagaaatcatctcctactagactgttcaattttatagcataatcttgaattccaacagtcaatgtgggattgtgagtcaagtctgtttgtatctaaataaaaccgcattttgttttaaacaaaacgaaacataaaactaaccataagccctaccaaaccatattaaaaaccattgagggtaataaaacttcgatatcttccgtaacaatgggtacttgattttcatcgaagttgtgcttcatggagacttatactttagtgaacaaataattcaatagctccaaatgaccaaatctattcttcaaaaccatcgagtccgtactattagagctcacactctttatcttttgcttttgttgagctgatcatgtcttggttttgtcttcatttgctggtgaccgttggagctgtgggctaaatggatttgcttctttgttgggccttatacttcagtttggcccattctcattttgtcacatgggatgacatcgttttgagaagctttggatcttcttcttcttgtctgatttggatcttctcttctctcttctctattctcctttgtaatgttccaagagggagctgtcactctaatactattatgaaacgatttatgcgtaaccctaactttttaaaaaaaattatatttatgtagaattgtagatagtgttgcatacttgcatgtagtcaaaaataaaataaaaaagagaaaaaaacaaagataccctaaactccaaaatcagtgagtaagacatatcttaaattaaatgacaaaatttggcgttttctctcataccaaaataaatgaaatagtttaccaacgacaaccacaccagtcccattcacaaaccattcataaccaaaatcgtcggtgtcacattttgtcacgtctcttcttaaaaaaaaaaaaatg

SEQ ID NO: 1855 - DNA, 3000 bp, Unknown
  misc_feature (1)..( 3000): cDNA_ID_3064774_gDNA_ID_1620458_Annot_ID_157675 3000 nt of promoter + ATG
gtattgtgctttcccacattaaaacgtaactcaacttctttgactttcccataacacagtgttcacagaaacccagctctttgatatccttcttttcaatcaaacctttctcagtcagaatcttcatgttattcacactcatgtgaccaagtctgcaatgccacaaacttgtcctttttgttgacccttcagcattacagctttcattcagaactgtgtgaccatcaaggacatacagtccattaaccaaatttccacgcaaagctgttttgttttctttgtaaaacctgatcttaccgtctccaccttcatgcttaaagcccaacttatccaaagtacctgtagagatcaagttccttctcagatttagaacgaatctgacattctttaacattcttatggttccaccatgagtgttgatcttaactatgccagaacctcttgattcaacagtgtgatcatcacccaacaagattagtgttgactcattttcattgaaatctgtgaaccagtccattcttgaagttatatggtaggtacatccagagtcaataacccacttctctttagcttcttggtcatgcatgctaagtgcctctgagtacaccaacttctcagtaatcacacctgcctcaccttgttcttcattttcgaacttcttcttcctagcaaaacaatccttctttacgtgtccctctttcttgcagaaccagcaggttacacgagatttggaattcgacctgcttttgccttttccttgatttttaccttggttattaccttgattgttgccttgactaccattttgatttcgggtttgtggtctgcctctttctgcagtgtatagagttgtattcaccaccttagtgttttctttaagctcagccatttctctttcaagagactttgaagaagatactacatctttcacagacaaggtcttatttccatacttcaaggtgtgcttcaactgatcataggtaacaggcaaagaattcaagattaggatcgcttgaacctcttctgcaaccttgatatcaagacttcctaattctgcaactatcctcagaaaatcatcaacgttttgatcaatcgtctttgaagtcatcattctaaacgagtagaatttcaattgtgcatagatccggttaggtaacaacgtctccatatacaattcattcaacaattcccacaatgtagctgcagtcttacagtgatttacttttctcaagactgtgtcacttatgtgattgatgataatgttcatcgcttgttctgatttttcaatcttgatcggatctggaacttctttagtcaacacagcacttgaatccgatgattcatctccagaagctacttgcttctcctcactctttgttaatgtctcagtctttgtcaaagcaaagtcagttagagttcctttcaaaccaagaactccgagctgtgccattatcctgatcttccataacgagaaattgttatcgccgtcgaaggctttgatctccactctcgtcgtcgttgccatcgaccgatgcgatgtgaacgaaacacccaaagcctgggctctgataccaatctgttacgttttatgctcgattcacaacgcaataacttcacaaactttcgaaaactcagtaatcgaaactttgaatcagctcaagaacagaaacgaattgaagaacgaaagaaacaacacaagagatttgattacccagttcaacaagatcggtatgatcaagtctacgtctggggccgaatcagttcggcaatccactagaacagaatgagaattacagagtacaagcagagctcaacaatggagtctcaagcttttctttttgtttgttacagatgaaaacacgaataatgaagaagaagaaataaaggccttttatactaagtccgaaatagaaacagaagaccctctctcgtgaaaagaaggtttcctttagcctcttcaatccggtttaaaacactccatctaaccggtcctcaattcttcttaaccacagcacctaaaccggtcacttaaagttgaatcagaattaagatccacaacatcatcaatggacaactatgtttttgatttgttgcgagtgcgttttactgtttagtaaagttatcacccttttttatggttacgatatatttatatgctttcatggagagaattgttctacgtagagattatttgggagaatgaagtagatggagcagatttatacaataactttgtgtagaatggatatggctcagtaaaaaggtttttgtatggcacatatgaatggactcgttattatgtacaccgaattttttttttggtttttgtttaaatttgcagagatctctaccttcaagacaatatattgatattacgagaatagaccatatgcatcagatctcgtcgtcttgacaacacacaatttcgcttatgtgaatcatgttttcacaaaataaagaaataaacaaaattgtgttcgttaaatagaggttacgaacctacacaaaatcgaaatctagagaggcttctccgtaaagtaaatacagaaggtacactatcttcacaaactccatcattgctctcatcacacactcagcacttacaaatcttcaactcgccatttgatttttggatttgttttagagagagtgatagaaaaaacatggttccttgtagagaagaagagagatgttattatctgatctagataacaagagaatgattttttttttatttcatcttagccatagattttaaaatatatttttttaatccaacggtctatactaaaaagaacataactagactgagtttttcgtaaatatcttccttgttgaacgacaataaaaaacgaaggttagttattttgcgtcaaaatctcaggggtaattttatccattttctcaccaaaagtaagtaaaaatacttcatctctgaaaaatgcttcataaggaataagattctctgaaaatgcctaactagtatacgcgttaagaatg

SEQ ID NO: 1856 - DNA, 3000 bp, Unknown
  misc_feature (1)..( 3000): cDNA_ID_3064759_gDNA_ID_1620458_Annot_ID_157679 3000 nt of promoter + ATG
tatacacacacaaaatacatctagtcaataatttgcacaaagacttcaagtaaatctctataataaaacgaaaaatattatatgtacaagattgatgtctatgacacaggcacagctaataggtgacgtttgcatgttatattttattaatctaatttttttttatgtatttgttttttttttttgtcttcactggagatacattattggaactaaaacagaaactgtgcaaagccggcaaagattgagactttcttccagagacaaatcaggcaaaggtttaaatcctttggagaacaaagtcaaagagtttgcataggtttaaatacattattacttagtctgccgattactaaaatagataaaattcagaattttccttcgattctctggtatatttaaattagaaatctcaaaatgataagatttttgacaatttggatccacgtggaatccttcggaaggtgaacctcaaacatggagcctgcatggagcttggcacaagtagatgttatctaggagcctcatgatactactgcactatctctcgagaggagtgacttcaaaagttatcgttgatttattgatggttcatgaaaagaacatccgaagcacaagttgatcttctgaaattttgtttaaacatttgctgaaattttccaaagttttttgatcttcttctctatctccgaagcacaagttgtaaaaccatatatatttttcttttaaatataatttgatattacattaaaaaaaaagaaaaaaaaaagaacatcatccttattcaggtttaggatggtattgtgcgaacatcaacaatgaggcacaacccatggtagcttataatctttgctggaggctctctcgtttacatatcaaattaaaagcattagtgtgaacgataagatatcgatgcttaattgctgaacttgagactgaagttgctttcatcacggacagctctgatccggtgaacattgcatctataccaatagagtggccggcatttatgacgtacgcaataagaagagaagtgtaagaaaacattctcgtatttttcttttgcttctcgtaatgctaatataaaaacggatacgttagcaaataatgtccgtgtctaccagtattatatttgttcccccataatgacttatgaagcctctcaattaatataaagttgttgacgggagaataagatttacttaaaccaaaagtccaataaacgagaaaaatgactgtccgagactccgagcaaatgtgatacaaaaaccaaattttcaaagcacagaaaaaaataaaagggagaaatccctaacccggaaaacataacaaaactactaatattattagtttgcttctttgttctttatttgtccgggtgtttttcatggtcatggtcaaaaattggtttagcatctatgggaaacagatgccatcaaatccgaacgtcaggtcttttattcgcttattttttggagacttgaaaattcgagattttaagcaatttgaaaacggcaagaaagaatcttagtagaagaggttgaaatcgccaaatgtggtgtgaactgatgatggagatattaaatcagactaggtccggtttgaaagagtcgagacacatcatatctcggccagatatgtatggttttttagtggaggaagcttaaaaaataccctaattactatggtaccaacagtaaaaacgattatgggtagcagtggatctatcggttgaaggcagaaaaaatcattggtgagcctcgaacaaattcatattcgaaaacgaaacatagaagaaaatgagatcaaaacgcatgaagcacaccattaatcgaagagccctctcacggtgccgataaagattgctagacagtctcatgttaatagacagcagagaggagatattcaaatcgttttatttttttctctttttggcggtaagggtttttcctaatattttttatttttttcttatttttggtaaggatttgtttacgtatcttgaataatagctatttaaagaattagacctgttattgtcgcttttcttatataaaatatctataaaagtttaaatattatataagaaaagtctggtgattcttttgaaagatatctactataaaatttaaaatattatgtaataagaacaatcattagtgtatatatatgggtacatgtgtgttacatttctttcataattccagaagacaacctcatacttacagaagctttctagtccaagctcaagccagcagggtaagagatctggagtttgattgtttttaaacttgtatttgtagtcaacagaagctctcttatcatcattttttattattatattaaactctagtgttattaagacatgaactatttataattttatttattaaaaataattgcagaatataaaaattttgaataccaaatattctctacgagtttataattttttacaaccgaataaaataaaaacagaatctaggaaaataaaattttcccaagtgtaataacagtatttaccactagaatagaaaaatttactaaaggttaaaaataattatttttctaagctttatcattatctataaacaagtttccaaaaatattttttactgttcaatcaaccaaacactagttataatagtttcttaaaaacaattcaacacaagttaatgtaataaaatcattcttttaaaaatcattgagagttctttgtaaattcttaaatcaatatgcgttaagttatcatcttaaaagtaaaaataaaactaattgtacatctaaagatatactgaatttaagaatatttttatggaaaacagtttgttcatttaactattatggatatggatcactttcacaatgaagtatttttaacaatcaaatttctctccccgtgtgtggtagggaatataacctggtatacataagtgcaaggaaatagacattattaacacaaaatatgtttgttctttctaggagagttattacaaaatg

SEQ ID NO: 1857 - DNA, 3000 bp, Unknown
  misc_feature (1)..( 3000): cDNA_ID_3064770_gDNA_ID_1620458_Annot_ID_157676 3000 nt of promoter + ATG
gggacttatcagtggtagcagagtggtcaaggagtttcggaggagagtgtgaatcgtttggtggacttgaaaattggataaaacatagtttatctctctgattacttgttattgtgtgtcgttgtcttacacaaaacacatctctttggctttgaagagagctcatctcatcgctaggagtgtaacaaaggaggatcaccgccaattatattagcaaccggatttcttttgttggttgaaacaactgtttgaggataataatagtattcccgaggcgtagtactcatatgggttgaactagattgattgtcttttatcccccgacccccaaatttatagtatataaaacttaacacaatttaaccaatattaagacaaactgttaaataaaaatattcaaaaatataaaacaattaagaaattttgtattaaaacgtgagaacatcacttactatgaaacaaaaaaaaaattctaaaacatcaaatatgttgaagcagaaaaagtatattaataaacgtctatattcatatcaaattttacaaaattcattcacatatacatccgtgaattaacatatacattcttatgttaaaacactgctcataaccaaaacaaattactggaagaattgtcaacaatctgtgatctcacttgtgtcaaattacaaccaagcatttgcttcaaagctctcatggaaccattgttgatttaccttatctatctttttgtggtattggggaatgccctgttttgttatgttttaaactctgggatttctgaatctctctcttattgtacttatttcttttgtccaaaaaaaacaaaaaaaacaaaccaaaacaaattacttagcgtgtaaaagtctacataaacttctatttcaccagaatcgtaaatttttgctgtgctttacagtttacctcacgcagttaaaaattcgatcgtggcgaaatttcctaatgtccttgacctgcactccctgatgtactgcctcttacttcaatcttgatccctctaatcacctttttatcccaaacttgtcctatttcagttaccaacaacaaaaaccattgatatagctaaattttttaagtttttgaaagaaataaaaaaagagactaaagacggtttcgagtatcataaatggaaacgaattcttatcgttgagaacaatagaagatgatttacaatttacttatgggatcaataaccttttgcatggtagttcaaacaagatgttgttcatacattttatttaatcgagttgagagactaataaattatttctcataattagatcttacttgtttttggagattcatatgggagtcgagccaggactgtatttgatgatgcagataacaagagaagaagcaaagttatcaaccaaaccatgtacattttgttttcttggtttactattacgagttttgaaacatgtaacatggtgtatttatatgtaagcgaaaatgcattcaggtcaagtggaatataggtcgttaattttgaagctagaaaagtattcattcttaacgcgtatactagttaggcattttcagagaatcttattccttatgaagcatttttcagagatgaagtatttttacttacttttggtgagaaaatggataaaattacccctgagattttgacgcaaaataactaaccttcgttttttattgtcgttcaacaaggaagatatttacgaaaaactcagtctagttatgttctttttagtatagaccgttggattaaaaaaatatattttaaaatctatggctaagatgaaataaaaaaaaaatcattctcttgttatctagatcagataataacatctctcttcttctctacaaggaaccatgttttttctatcactctctctaaaacaaatccaaaaatcaaatggcgagttgaagatttgtaagtgctgagtgtgtgatgagagcaatgatggagtttgtgaagatagtgtaccttctgtatttactttacggagaagcctctctagatttcgattttgtgtaggttcgtaacctctatttaacgaacacaattttgtttatttctttattttgtgaaaacatgattcacataagcgaaattgtgtgttgtcaagacgacgagatctgatgcatatggtctattctcgtaatatcaatatattgtcttgaaggtagagatctctgcaaatttaaacaaaaaccaaaaaaaaaattcggtgtacataataacgagtccattcatatgtgccatacaaaaacctttttactgagccatatccattctacacaaagttattgtataaatctgctccatctacttcattctcccaaataatctctacgtagaacaattctctccatgaaagcatataaatatatcgtaaccataaaaaagggtgataactttactaaacagtaaaacgcactcgcaacaaatcaaaaacatagttgtccattgatgatgttgtggatcttaattctgattcaactttaagtgaccggtttaggtgctgtggttaagaagaattgaggaccggttagatggagtgttttaaaccggattgaagaggctaaaggaaaccttcttttcacgagagagggtcttctgtttctatttcggacttagtataaaaggcctttatttcttcttcttcattattcgtgttttcatctgtaacaaacaaaaagaaaagcttgagactccattgttgagctctgcttgtactctgtaattctcattctgttctagtggattgccgaactgattcggccccagacgtagacttgatcataccgatcttgttgaactgggtaatcaaatctcttgtgttgtttctttcgttcttcaattcgtttctgttcttgagctgattcaaagtttcgattactgagttttcgaaagtttgtgaagttattgcgttgtgaatcgagcataaaacgtaacagattggtatcagagcccaggctttgggtgtttcgttcacatcgcatcggtcg

SEQ ID NO: 1858 - DNA, 3000 bp, Unknown
  misc_feature (1)..( 3000): cDNA_ID_2991486_gDNA_ID_1620459_Annot_ID_157691 3000 nt of promoter + ATG
attattttgaattatttaccgtttaaagaatcaatgtttgaactcgaaaaaattgtatgatttgtcaagtttttgtctgatattaactacgtacaacggtacaagtatcctttctttaccttttcttatttatttaccagtctcatctctgtaaatgaaaggttccgagattcttacatcactagaagaagcaatctcattcccagctgatgttgtttgttgctctctgtaagatgcccaagtaaccatataaagcccgcaaatgatgaggattccacccaaaacgctgcggagagaacaaaaaccaaggtgtttatatgatccaatacaagaagacagaaaggtttgtatgtgtctggatgaatcaaagatacaaagaagagtgcataaaatttaaaaaccttccaagatagatcgggctgccgaggaaaattgtcgataaaaaggccgatgttgcaggctgaagaggattgtatagggaaaccaaagcagctccaagaattttattggaccaagtcaagagtccatagtttagagctgaggcaaacactccctgaggaataaaaaccgaaaagaaaacaattaaacacaaactagtaagatgaatccgtatgtacagaatcgagttccaatctttttgagttcaagttcaaatgatttgagctcaagctccaaaacacaaacacacccaaataaacatattacatctcggttgtgaaaacttactgcgaatataacagcaagaacctcagattgtgttaagctccaatctttaggctctctaacaaacaagatagctgttgtgatcattattgatgcaccgaagaagtatgaatacgcagcaaccgaaaggtaggcaggatacttcttcaaaaccggtgcttggacagcgagaaaagcagccatacacatacagtttccaatcaaacataaaactccaatgtgccattgatcaaacccaagaccaagaaaactagagactaaccacccattaagctctggttgacttctatcaataattacacttttcactgaatctgctgcatctttacctccaaacaaggctggaccacgaaacaaagccatcgctatagcacccgaaacacaaacaagagtacctccaactttcgtttggccctcgactttcaacaagttcactttttctgtactgtatacaaagaagaagaccatcaaaagattgaaactttatattacaaattttcacattttacagtaatgttgaggaaactcatactcaccccatcaagacagccaagagaaatgtaaagacagggattgatggttgtatagcagcagcataagttggattcgtgtaagataaacccataagaaatagtaactggttcccaaatatcctatcaagattgagattgaatgttgttattagaatctttcattagcatgattcaaaagataaagagatacaagctgattactttaccctgctaaaccaagaaagaagagtgaaaagaagatgcttctattcataggaggtctgatcgttctacaagaaattaaaagagcaaatctttatcaaaagacaaatccaagtcacacaaaattgcaatccatcattaaacaatagaaccagaattaacaaagaaaaacaaccctaattccaattccagagagatcaaactatttgtctgattttgccgcatataaactcatcaaaacaatcagaaacagagacttcagagactttagcaattcaagcaaaaggataaagaaacagagagattttgagaagaagataaaaagggacctttcacggaaaaaagcgagaggtgcgagaatggagagagcaagaagatcgcgaaagacacaaaaaacgagctgatttacaccaacgttaagagctactttcgtaaccacatggtatcctccatttatgacctgaaccaatgtcattgcagagtgagccattcgtgtttctctctccgtcgcatcgccgccgtttaggatcgccggagctgccatttttcttctctacctccgaatcgaggaagaagagaaggaacacctgttgactaaagaaattgagatcctttgatttgctctgtaaattgtaattctaacttctctgttttttcgttccaaaaaaaaaaaaaacttctctggtcattgtagtcgttggtcttcttcaatttgttaactatgattttttgttaagttgaggcaaaaaaaaatttgccagattattttcttaaatcttatacacattgaagcctaacagattaacacatttgttaaatatgctcatatatcctacttaaaaaatatgaaaattttccacaaaaaatggtgtaatataaaaattcggtttactcgggttaaacggttcggtttgttcggttttccgggtttttcggttttcaaaaattctgccgaattgaaccgaacaaaaattcggttcggttcggttcggtactcggttttttcggttcggttactaggatttataattcgccgaaattaaaccgaattttttttaatcggttaacctaatcagtttagatcacaatattaggcatagtgggctgtttttaaagcccatatcggcttttgacatttaaaaacccaaaactttttttttgagggacaagtaaagtcaaaaagcccatgacggtttttaacttttcaaaacccaaattctttttttccagggacaagaaaagcccatcacacccatctagggttttgttttgttttattttttggaaatgacggccgtcaaagaaaaacaagggtgagatgaagaagaagaacattgaaaacagagaaaatagatttgtattgtgcggtggtgagaaaagatgtagagaaccatgaaatcattgccagagaagatcgatgtcgcggtggcttaatagaatatttctgcgaacctaaaaggtggagaagaagaacgaagacaaggagaagaaggaggaataaggaagaattagaaggttaaaagataaaaatgggttagagatg

SEQ ID NO: 1859 - DNA, 3000 bp, Unknown
  misc_feature (1)..( 3000): cDNA_ID_2145953_gDNA_ID_1620459_Annot_ID_157707 3000 nt of promoter + ATG
tcaggaaattgaaggtggaggagtatgatgaatgctacaagaatacacagtctcatgaagtgcccaacacgagtactaagaaaacaccatttcttaaaaggattcttaacaggattctcagggtgagggagttgaagacagagaagtctcatgaagttctcgacaagagtaccagcaaaataccaggtcaggaagtgcccgacaagagtgccaagacaataccatgtcataaagtgctcgacacgagtttcatgtatcgccggtggtctgagtatgtacatgcacacaacctgatcgaatactgcctaggtttaaaaccgaagcgaatccaccataccaagggtttcatacacatcgcctttgacaaggttatcaacatactttacattggccccgcattcacaaaacttggaagtgtcattgaatcctgttttagagtcacaaaacagagaattcatcagactttcaagtggattgacggtaaagtaagtcgtttatgcaagaaatacccgaagttgaatgaagagtacattaggtttagcttcttctgcatattttacattcctagtctacctggacgctggataaaaagttttatggagttctttggcatccgagctcagctagatgaggtgatctacacatctagtgatcgtctcaccctggatatgtgggaacacatattcggagaggttaaagccaaatcccgtttcgctgacgactctgaaagcgccatgagggtatcttcagcaagaggtgactggacactgcgcgacatacaaggtgacccagaaacagaaaaaaaacgtgagaaacttctacgctatgtgatggaaatggattacgatcagagccttcttgtatggcatatagccactgagctcttataccagacaaaaaaaggcactaaagcgaatcatagcgcccgtgagttcagtaaaatcctgtcagactacatgatgtatctcctaatgatgcaacccactctgatgtcagctgttgtgggtattggaaagataagattcagagacacgtgcgaggaggctcagaggttcttcgataggaggcatatcatggggatatccgcaaagaaggcccctgatgcaaaggaagccagcgtggcaattttatcagtggcagttccagcaaaagctgagcccattgacgtgaaaggagatagaagcaaatccgtcctgtttgatggggccatgctggcgaaagagcttaagggtttaagaaagaataaggaggacgactcagagatgtggaaaataatgagccaagtgtgggttgagttgctttcgtatgcagcgacaaagtgtggcgctatagaacacgcagctcagctaagcaaaggaggagaactcataagctttgtttggctattgatggctcattttggactaggagaccaattccaaatcaaccaaggagatgccagagccaaactgattataggcaagtgatcatcatccaataagcaacgaaagtagcagcaattgattagtttccctcatttgcttccattgtgttttttttgttttgtttcaaagagtagtcttcaactgtttgccagcaaaacaatctgttcttgaatcatctgcattgttgtaactcatgtccttcttctgtccctgataaattcatttatgtgagcttgattgatttctctgatactctctatacaaccaaaaaagacaactctctctgtaaacaaggacttcaaattccaattagaagcactagaacaagaatataacctctttgaatccaccattatgaagcagcaatagtgaacatcatccgaccagagaaaaacttcagaatctcagaagtgatgcaaccaagaatctcgatttagtcctgaactctgaaataaaattgttggcaacggtaaaaactttttccatctgtacaaaaaagtaaatacagtaaataattcttaagtatgtttaaaataaaataactccaattttagactaataattactgagatgtgaactcttcatgtaacaaaattattagttggacctaattcaagttattggttgaagagataatatttcaaaactcaattttatttacagatattcattaaatgaacctcaagttcaaattatttatttagtagacaagtatatatacatatagaggtataaagaagtaaattctgccagctatagaagtatttttgaatcttcattatttctttaggtcaatgcctcaatagtcactaaataatgaatgactaacttcagaaaaagactaacccgggacagtctttaaaataatataagttataactatggttatacagttatacttaataatattattatataaccatcccaaacataatagtctaaccattcaaatctgagtttagtggatcattttatatttactaaaacgacgcgagctcaactaatgacacttgaactttaatactactaactattattcaacatacatatatttattactatcaaatatgaatagaaaaaagaccaatagctaagtcgtctcttcacgtcaaaaaaaaagaaaaagaaaaagctaggtcgaaaatgactcattgattgactaaaacaaaagaaataaaagaatatttttatggtgtccataccagcagtaaatttttaataaacaaattgcaagaataataataattgacgaaaatgcaaaatacaaaaactattattttgcaaaaaataaaaaattatacctgagttgcagagtcgtctttcttctcgctccagtgagagcttctggtaaaaaaagaaaagaaaagaaaaagaacaacatcaatggcgtcccaaaaacattccacaaaccccaaacttttcaagtaaatctgaggaaaaaaaaacatctcaataaccagaagagagagagagagaaaaaaaaagaaagaaactcaaatttctcaagtaaatccaagagagagaaagagagaaggaaaaagatctatcttttttcctctgagagagagcaaaaatg

SEQ ID NO: 1860 - DNA, 3000 bp, Unknown
  misc_feature (1)..( 3000): cDNA_ID_1022586_gDNA_ID_1620459_Annot_ID_157720 3000 nt of promoter + ATG
gcgaccaatccagttatgaaactggcgagttcctctggtggcattttcgatggcagtatctatggacaaaatgtgaacggtctggtgaaagaaactgtgtatcttacccttggtataatggattctcttgggacgtattcccaaacagaagccaatcaagttgtaagcatgaacatactcagaccatctgcgaaacataaagtttctgttgagcacttgatgtccatcctgggaacatttggatcttttccacctcagcgtcttgaaatcgaggatccagttgagaactctgtctgtcaaggtgtctttctcttccaggtcctcctttagtttcctcagtctagcgatggtccagtcagatacacagaacatgagaagagcaatggaatcaagagctattccacatatgagcaatgcgtaagtaaggacgacatcgaatccatcatattgatctttcttattcatcttgaagaggcagagagatgcaacaaggcaccccaaagctataaaccggaacacagctccagtccagttatgcagaatctctgctttggtgaacagacaatcatagatgagtccgagctcgacttcgatgatacgtaaagcttcttctgcagtcagcttgtcaaagaatttcctgctctcgtcgcgctcttgattggtgaagattagatcaacaataagacctttgaagatgttaaagtatttgtaagcatactgaataacttgtagtgcggtcaattcattgtcgggcctaactggagtattgccttcccgtcctttctctggatccttcaccactattacatcagttggcatattcatcttcttcctagcttcatattcctccatgagtttcgcgtaattagcaccagggtcaggatcgtcgagcatagagtccttgaacttgtcaagactcgctgagaacaacgcagctgttctctcgacatacttgatcactcctcccacaaacatgattaatgttggagtcagaagcctatttggtatagacaacaagatcacatacacagtggctaccgcttgacagacaagactaaacaagtgtctgtcccaaagctcattatcctccaaggcaagtgctgtaatggtatctggacctccaaggtgcaagagaagaaacggtgaccaaaatgctagcagctcacggttcttggatggtttgtttgattcagcttcttcttcttgactgtctgagatttgcccaaccgcgtaatcagctgcccaatcagcaagaagataagctgaccatatgaggacaaggaagagcttctttgcggtgcgtcttcggctaggtgcaaagaaaataaggattgtttggaggaaaagactgagtattatgactccacgtatgttccatttgtcccaaagtttcctcagatgtggtggaatcatgtcagtcatcttgtcttcttcttcgttggaccgcaaaactgcacttggtttactgtggatgttcacagtagtgtcaaaggttagtgaacgtttctttcacataaagtttaagtttttgtctatgggtttctttgcttccattgttttgagacttgaaatagaaacacaaaccatcaagtgttattgttacactataagtaactttataccttgcttataaacaaataatatcttaatctcttttgctttttgtttttattcctagtctttgttcttttcttatgaccataagtaaactactaaaaaaagacaaaagcaatcgaatgtagatttatcacatggtattaaacgtatgtacatttaaatgtattacctcatagcttctctaaagttaaaagttaaaatattctacttgaagcttgtcttcactttcactgttttttgtttctaacactaatagctttctggataagtgacaaggtctctatattcgttgtctgagtattgtgtgaagttaaaacttggaaagttgataggtaaaaaacacattgggaaaaaagttgcatactcatttcctacattattacacactcttcaacataaactctctacaccacgtcaatccaagatggaaacacttgctaattgggacatatcttgctggtactttcgtatgtctttcttacctttggacttaaagggcttgattggttcttctgatattaaccgcaaacgcttgctagtatttaaacctaatcatagagacaatttcaaactgctccaaaatactctaaaccatttgtaatagctgaattttaaaaggtccttgcggtggcaagttaaaaaagaattcacataaacaacaaaaaaataaaattatcaaaccctttatatattaacgttaattctcaaaatcctaatttgatttcatgttgtcaatccaaactggagaaagtcaaatattgtaataatattatcaatttggaagatttaagaattcaaactcacttttagtagtttgtcaattatttgatgcaatttttggtgatgagctaaaatgaagtaataaacatttcactattaaatttctttgtctttgaataattatgtaacattttatttacaaattttattattagttatgttttgatgttttttctattttatcacaatagtagaaatttttgatatatctaataaccaccggctttgaaatttgtcctaagttctataaaaacatttcagacagaaagcaactgttttttttttctttgtatttttgcttgcccatgaagacaaattccagtttttcactattgtgtgtgtagtcaagtcacttgaattttccagctaataattgattatttaagaaacttaaggtaaaataccaaacattctgaaagttaaggggttttttaaaaatatgacagctaataagaagagagagttagagagaaagagaatcaacgagtctttcgtcttcatcatataaatactctctcactttttcccgtctttcagagactctctttctcatttccacctgaggaaaaaagctttttcgaatctcgcttgctttttgtcgcc

SEQ ID NO: 1861 - DNA, 3000 bp, Unknown
  misc_feature (1)..( 3000): cDNA_ID_3064810_gDNA_ID_1620459_Annot_ID_157715 3000 nt of promoter + ATG
ataaataactaaaagacggtgatctagtggcaatacaaggggttaattctatatgtctggatttaacttttcttggatataattttaaaaaaatagaaatagagtaaataataactctggatactaaaagagattatagaccaaaaattcagaattttctcagtttaaccaaacataaataaaaaataatgagataaggaaattaatcatgtcttacttacaacgttatattaattgtattgtagactgtactataatttttataattataataaaattatgatatttgatcaatttgtggagatatttataaaaaaaaatatattgtttgatttgcagaaattgtttgattaataagaaaaattataaaaaaaatattggttatatattggtttaaaaaaatattttttattaatcagaaaatattgtttgattaataaaaattttataaaaataataaattttgtggagatattaattgatcaaaaataaatcagaaaattgattttttaatatattattagtttatagaaatattgaatcaaacaattaaatgtgtagaagtttgattatatatcattacgcacatgcgaatcctacaccgttcacattatagagttactcttattatattttaagtacaattggcacataattcaaaactaacaacatgatttctagctgtttaatttgcaagttttgctgtcaatatatactattgcaagagttttgactgaagttaataaaagaccaactcggtttacatcatttataagtcatttgccaactgtaacaaataataatgacaagttgacaacaaaggataaaataatctttgtaagcgtattaaattttacactggtgaagctgtattgtctagttttagtgtcattgattaagatggtactgcatactttttcctcgatcagatacgtgcaacagcatcttcatgtgttgtctgtcatctttttgaaaacttggaatggtgatgttgttgaaatgaatttcgagcactaattatccttaacaaacttcttaatgtgtatattaattaagttgagccatatatttcgataatattgggccaccatattgggccatacatatttgaattcggaccgtaactttcgctatacatctataatctattttgattaacaatatattttaataaatgatttttacaataaagaatagtaatagtttgaagttcgttcttatatagtttcataaacttattaaaaaaataaattaataatattagtactaatccaaaatataattttaaacaaaacaaaaacagtgacaaataaaagaaaacaaaaacaccaatccaagctaaatggagactgtctagattcttttgattatttttctaactcattataatttttatttccttcacattatttcaaaaatatttagatgtttttgcataaaaatttgagcttacaagcaaaaagaaagtgttgtaaataaaatttcatggggaattgtccaaaatccttgattcaccgtgattcacattgccttccaaaatctctaactccactctaagattcgatttctccttcctaatctcattaagcgtcaaattaggccgtgtatcatttgtcaaccaaagcctagaactttaacacaacttctcctcatctctaacctagctttccatccgatcacattttctcattctgattctcgcatcagttttatttcaaaagataaatcatttttttttttaccaaaaaacgttataaatcgtactctactgacaagtaagtagtgttcaaacaatagctgaaggagtggatccgctactagaaatttgtaggatcatagcttgggttttcccaagtgggttaatctataaatgtgatccgaacaaaacgctcaaagtaaaataccatgtgtgtttattcatagagaaaaaaaaaaaaattgataagaaatagggtatcagcgaggacagtttacagtgttctcagtttatgttatcttaaatcatgaacgtatctgcataaatatatgttaactcaatacatgtcagaaacgatgatgtccaacttgatcatgcactcgttcacattgccccactaaaacttaatccaattttatcatataatttaagtttttgttgttgcaagtttatatataattttataaaaagtcaaaaatgtaaatcaaactcatgaagttatattattttttattttattttgaaattgaagttatattaatttacaatataacttgttgacactattgctaagtttattaaattattattttaaatttttaaaatgaagcatttacataaggccggctcaacattactaatttactatggtctctaggattttttttttgagccctaattattatttttaattgtttttgttatgaaaactatttttttgtgtaatttgacaacaaataattgttaaaaaaacaaaaaaatacagataaattcttctaaattcttttgaacatttttcaatatcatatataaaattttttaaaatatttttgaatattaaaatagtatgaaacttcgatatacacgcttataatgaatagtccaattgtcattttaagaattagacactttaatatgtgactgtaaaaactctttaaatatgtatattattggttagatttaattacatgagtttgatatatatatatatatatatttgcaaattgaaaataaatttaaagaaaattgttatttagaattttaatttcttacgagaaaaatcctataatttaattttagcgcctggctcaccccgtctggctaggaaaagaaatataaatacgcatgtgattattagaagaaatgatgttaaaagagagagaaagatacgagagaaaatggagagaaagtgagagagagagagagagataaagcagaggttgacttcgctttgctgagaaggcaaagagctcgaaagagagaagactaactctcatcagcgacgaatgtctgatccgttgaag

SEQ ID NO: 1862 - DNA, 3000 bp, Unknown
  misc_feature (1)..( 3000): cDNA_ID_2145912_gDNA_ID_1620459_Annot_ID_157694 3000 nt of promoter + ATG
atcaaaggatctcaatttctttagtcaacaggtgttccttctcttcttcctcgattcggaggtagagaagaaaaatggcagctccggcgatcctaaacggcggcgatgcgacggagagagaaacacgaatggctcactctgcaatgacattggttcaggtcataaatggaggataccatgtggttacgaaagtagctcttaacgttggtgtaaatcagctcgttttttgtgtctttcgcgatcttcttgctctctccattctcgcacctctcgcttttttccgtgaaaggtccctttttatcttcttctcaaaatctctctgtttctttatccttttgcttgaattgctaaagtctctgaagtctctgtttctgattgttttgatgagtttatatgcggcaaaatcagacaaatagtttgatctctctggaattggaattagggttgtttttctttgttaattctggttctattgtttaatgatggattgcaattttgtgtgacttggatttgtcttttgataaagatttgctcttttaatttcttgtagaacgatcagacctcctatgaatagaagcatcttcttttcactcttctttcttggtttagcagggtaaagtaatcagcttgtatctctttatcttttgaatcatgctaatgaaagattctaataacaacattcaatctcaatcttgataggatatttgggaaccagttactatttcttatgggtttatcttacacgaatccaacttatgctgctgctatacaaccatcaatccctgtctttacatttctcttggctgtcttgatggggtgagtatgagtttcctcaacattactgtaaaatgtgaaaatttgtaatataaagtttcaatcttttgatggtcttcttctttgtatacagtacagaaaaagtgaacttgttgaaagtcgagggccaaacgaaagttggaggtactcttgtttgtgtttcgggtgctatagcgatggctttgtttcgtggtccagccttgtttggaggtaaagatgcagcagattcagtgaaaagtgtaattattgatagaagtcaaccagagcttaatgggtggttagtctctagttttcttggtcttgggtttgatcaatggcacattggagttttatgtttgattggaaactgtatgtgtatggctgcttttctcgctgtccaagcaccggttttgaagaagtatcctgcctacctttcggttgctgcgtattcatacttcttcggtgcatcaataatgatcacaacagctatcttgtttgttagagagcctaaagattggagcttaacacaatctgaggttcttgctgttatattcgcagtaagttttcacaaccgagatgtaatatgtttatttgggtgtgtttgtgttttggagcttgagctcaaatcatttgaacttgaactcaaaaagattggaactcgattctgtacatacggattcatcttactagtttgtgtttaattgttttcttttcggtttttattcctcagggagtgtttgcctcagctctaaactatggactcttgacttggtccaataaaattcttggagctgctttggtttccctatacaatcctcttcagcctgcaacatcggcctttttatcgacaattttcctcggcagcccgatctatcttggaaggtttttaaattttatgcactcttctttgtatctttgattcatccagacacatacaaacctttctgtcttcttgtattggatcatataaacaccttggtttttgttctctccgcagcgttttgggtggaatcctcatcatttgcgggctttatatggttacttgggcatcttacagagagcaacaaacaacatcagctgggaatgagattgcttcttctagtgatgtaagaatctcggaacctttcatttacagagatgagactggtaaataaataagaaaaggtaaagaaaggatacttgtaccgttgtacgtagttaatatcagacaaaaacttgacaaatcatacaattttttcgagttcaaacattgattctttaaacggtaaataattcaaaataattacttcgcctcttttttggtaatgcaagttcaactatggaaacaaatctctatttttattttaagaattggttgtttcaatacgttttttagttgggtgacaaagaagcgtatattttaaattcaatcttagataaaaggaatcaagaacacttaaaaagtcattgtacctaaagacaagcacgattaacaaaaaggaaaacattatatatgtcaacggacatgttacatacttacatgtcagtgtgatataagctgggaagaagacaacaaaagttttagcaacatattatcttgaatttgtgaagatagtgtctattccataattccaacagagtggtatgtctttgcgacatacacacatagacgagctcatgagaatcaagaatcaatatatattatctatatctaacatattccacgcatttcgagtaaccaagatagatgttttagtagttattgccaaactatgtgtgtgcataaagtattaacaagtaggtactgacctagtaaaaaaatgaaaggtataacttataagtttcttacgagtacttagatcactcatgacatcattgtccaagtggaaaccattaatagcaaataaacaaaaatcattgacttattgaagtacgaaattattgactttctcccatttcatcatcaataatggtaacaatttctaatttgtgtggatagtatcttatacgtcatgacaactcttgggaatggtaatttaaccatagaagagattcaatttctttttctaagtttattagattcctttgtttgctaaatcaagattctttcaagttgaagattctttctaatagtatatacaagagggaagaatctttcaactatcactccctacaaattccatgagaaaattcacttttccaatcaaaacgtaaagaagaagaggaaga

SEQ ID NO: 1863 - DNA, 3000 bp, Unknown
  misc_feature (1)..( 3000): cDNA_ID_2145935_gDNA_ID_1620459_Annot_ID_157701 3000 nt of promoter + ATG
gcattttccggcggattatcgctcttcgtcgaacctttagatcgcttattcaccgatttcctcctggattcacgttcgttatccgtggatgactcatcgtgaatctgttctggctccaagatctgaccataaccgacgcgaatcttacctccggtgagcgagctaggagcgaaaggaccgacgaggaaagagagggaaagccataatagtagcgatttggcaggttcagattcgaagtagaagaaggagagagataatatgatgagggagattgagacggagattgaaatgaaaagcttgttagggattctagcttcttcttcttcctccgccgtgtgagaagaagaaggacgagattggaaaacgaatctaggcctgtcttcgtcgaaaaaatccattgttgctctgttgcactgtagaagaagctgaaacaataaataaaacttagaaaaaaaaatctcagaaataagtgtttttgggcttttgaaagtccatatacgaagatttttgggtattgtaaagcccatatatattaaaatttagcatatgacaaaattggttatacgaattttaattagttaattttagagtaagcaaacccttaattaattaaattttagtggaaagcgtgtacactcgagatcgcagatagagatagtaggactcagagaagattgtgccactaatcatgctcttgagcctttctgttcaacaacgaagcaattgcagagaaatcacacgtttgtgtacgacattttttttttttaacgtcgatttattggttagttttatattgcaactatattataaaatgaaaatattgttgacggaaaaatggaaattttaggagccagaaaaaagggaaggaaacaataattcactattacgaaaatatataaacttgtacgaaaagtcaaggaaaccatttatcacctgttacaacttggaatggaaagcggagaatatattaggcaaaggctagagaagttaaataaaggataaaagcttacggttcagattggagatgacggcatttatgaaatatcgacggtttatctgtggataattactgtaggttgagatgcaggagattcgagcttagcaccaacagacactaccataataaatagcttaataatatattcctttttagctgagatattataaagtagggtttaatttgttattatcacgagaaccacacaaatacgcggcaaagagagagaaagatagagagagagagagagagagagagagaaagcggtggagtcgtgataagggagaagctctggatacagtctcttcccgtcgtcggagacggagtttatgcctattggctcctgaggtaaaatcgagatcgcctttttttattttgtttctcgtgttttgactgatgcgcttttgattctctcttcgtttgtttgctttgagtatatttttattattggagtcgcgtttctgagaactttggatttgaacgtatacggattggtttttttattgaattttagggttacgcttttttgtgggtttttttttttttttatgttatcgtttcggtttgtgaatttcttcgttcattcagatctgagataaattgagtctatggttggttggtttttatggtaaaacttcagcagagttgaaattaggtactagaattttagatatgatgatagtttctcagagattatgaattgggatctttctgtacctctttgcagtttggtttcttagggttttgaccttcgccagtattggatttggatttcattgttaatatgcctttgtgtaagacatgttctagataacattatttgtacgataccttgaattgcctgttttcgttgcatttctaatgtctttatatactgcttttgtgctcattatcaggttagattaagcttcgtatttagtggattttcttcttttgagatatggaacaagattacatctgctcagggtgctaccagtatcgagttttttcattgcaagaagcactcgattggcggtttcttgtgcactcagatttccttatcggctctttcgtgaactgcacctagtggtcagaccttctgcgatctttacggaaggtgtgatgcaaatttctgattcaggtatgggtttctgaataaatctgttgacacttgcatcgtagctttcacaagatactttgaatagatgatattcctcagtgtaagaattgttattttggtttctgacatattttggtttctgtgtggtaaaggtagaatttattttcagtatctaaataagcaaatattggatttatcaattttctctaagcctttttagagtatgaacgcaatatgcaaatttagaaaaaaggaaaaaagtgctatcaagaataggaaaattcgaaaaggaatattagatgataagttttggaaaaacacgtcaaatactccatacttatagatggcttatatgactatagttcttctttgaaattggaacatgattgttcgtatggtatctttgttttctgcagggctgatgtttgcaagttatcctaccttcacacagtcctagagtgtcatctaaatctgttccctgcactcaaaaactagttggtccttcttccatatcctgttcttatgagagcttgttgaagaaggatgaatcagttttttttcaagttatgacttttcttagctgtgtcttttcctcgagtctctgaaccccttgagtgaaatgttgtgagcataagtttcgtccagctacccagaacattactttttgttagtgcgtcttccaattctcagtatgttttgtctttttctcttagcgtctttcttttgccttgttggtcaacccattgatgttcaaacttcaaagtaaataagggtcagtctacccagcgggagaatcattgatcttgctgccatacgaacaactggaagattaaagtgatagacatatttcagaagttctttacagagaaatacttaaggggatactttgcttcacctagaggcg

SEQ ID NO: 1864 - DNA, 3000 bp, Unknown
  misc_feature (1)..( 3000): cDNA_ID_2146011_gDNA_ID_1620460_Annot_ID_157731 3000 nt of promoter + ATG
tttcgagttggtgtttatacaacgccgttaatgtaaaaagatataaaaagagtttctgagtttggtttttattttgtgtgtgttctcaagtcataatcattttttacatactcttatggttgatttgcttcccaagttatctccaaggtaacataacgaccaacagtttcactcggacaaatgatcttcacgacttcccgatccgataggatccttggaagctaacaaaacccacaaactaaacaaattatcaccaagaacaatgtttctgtctaaaaaaaacaaaccctttcactgtgtatctctcgagtaaagttttcttctcaatagtggaaagacccaatgggccttatgcgcatgggctatattgaaggcctaatgagctagttggacacatatcttcagttaatgttttgacatcgtccacactgttcttgttaaagaactattttgtcttcttcttctcctctttaatcccctgattccccaaactttagggttttacgttttccttatcaacaaaaaccaaaacaaatctcccttgaatccgaaaaatgatcactacattactccgtcgctctctccttgacgcatcaaagcaagcgacatccattaatggaattctatttcaccaacttgctccagcgaaatattttagggttccggcagtgggaggtctgagagatttcagcaagatgacatttgaaaagaagaaaacatcggaagaagaggaaggatccggtgacggcgtcaaggttaatgatcaaggtaacaaaggggaacaattaatagttagttattggggcgtgaagccaatgaaaatcaccaaagaagatggaactgaatggaaatggagttgctttcgggtacatagcatatttttactacatgttttggtgtcttgttacttactcttggtcgatttataagtattttttgtgtttttgtcgaataatggtagccatgggagacttataaagctgatctaacgatagatttgaagaagcatcatgttccttcaactttaccggacaaaatagcttattggatggttaaatctcttcgatggcctaccgatcttttcttccaggtacactcttaggtttctattgttccaaccgctaactaagtctttaactagtgaaaactgttttagaagatttggtagctagctatcatttttagaagattttagtatggactaattcttggcaatgacttaacgcagaggaggtatggttgccgagcgattatgctagagacggttgcagcggttccaggaatggttggagggatgcttatgcacttcaaatctctcaggcgtttcgaacaaagtgggggttggatcaaagcccttctcgaagaagcagagaatgagagaatgcacttaatgacattcatggaagtagcgaaacccaaatggtacgaacgagctcttgtgatctctgttcaaggggttttcttcaacgcttatttaatcggatacataatctctcccaagtttgctcatcgtatggttggataccttgaggaagaagcaatacattcttacactgagtttctcaaagaactcgataacggtaacatcgaaaatgttcctgcaccggctatcgctgttgattactggaggcttgaagctgatgcaacgcttcgtgatgttgtcatggtggttcgtgctgatgaggcgcatcaccgtgacgttaaccactatgcatccgtaagtgtatactctaaatgaatggaaattatataagttaaagatcgatgcttaattcttataatatgtttgtataaattgcaggatattcactaccaaggtcatgagctgaaagaagctccagctcctataggatatcactgaatcagaagagcttctagttttgttttgtcgctcttaagctaacacggtccagatttcttttgttgaagtactcatgactcctttttaattggatggtacggtggagatgagccaccaccacattatttagtttcctttctacttttgttttggaaaatcttagtttctctacattacgtaaccaaaatcccactatatagttcacgtttgctcaatggtttttcattcgaagctctcctccgtgaaagtggctctgttttgctctgttttaaggttcaaattactctgttttttcagttcctaaacatgttttaaattagctaaactgtctcaaactcttgttattatttttcttttttgttgattaattaatttaacattcaaaaaaaaaaatcccactacagtatatatgaaatataaaagtagtaagttaaaagaaaattccaatacagtaacttcaacatgtaacataatctgtgtaaatttttaagtattatttattttgctaaatgtttttttgtcatcattgttttgctaagtgtttattattaactttttatggaccaggtttctatttttaaagtatcatatattcttaccaatagggttttgtcatcctctcattggttcacccagatttgttttttaattttttaatttttttgacagcaatttgttttttaaatttaaattgtagagtttgtaaatatattatattatactaaatttaatcattattaaaaatttaactcttattttagtcatttattagctttttcaactcaacatttaattattattatatatatatatattttttctgtttcttattaattgatttttttttttataaatatttatgtattatttattagtcattattgatgaattttaaagtttaaaacaaataattgaatattattggtttagaattataaaaaatataactcataaaagttactacatttataatatatttttttaatctctgtgtttataatatagttggcaattagatttatggtcaacatcaaactctcgaatcaaagtcagcttcttcgagaatgaaattggaattttaaagtccaacttttaaaatttatctttctgctttcacagagacgacgagagaaacaatg

SEQ ID NO: 1865 - DNA, 3000 bp, Unknown
  misc_feature (1)..( 3000): cDNA_ID_3064839_gDNA_ID_1620460_Annot_ID_157752 3000 nt of promoter + ATG
gattttttttagtgtctttaaaaacacgagttcaagtttagataatagagaacattttgatagagtatttatactagaattttcacacatatgaaaacgaatataattttggaaattttaaattttctcttttcaaaaacaaattaacagaagatgttagtttgtaatatgttggtaattgtgattttcaaagttttaaattctggaattttcaattacaattttctacttggtgtacataaagcttgtagtaaatttgttaattcggaagttaatggattttttgtaacaagaaaataaaaatgattagtacttgagagttgacattagccagtagggaagtgcatataacgcgcttaagagggaagtaattaagaaaagagtcgtttccacttaattaaatcgtagccacaaataatggggtttcttaaaaatggcttaagtgtacttaaacttttgtatgatacgccaaattatgtgccctttcaaatatggaaactatttagttatgctttaacgagtaggttttcaatcactcataacccttgctataaaatctaaaatatatcatttttattttattttgcaaatatgaaaatctaatggtcttattagctccatagatcattcacctcctcaaagataacatagttattattattttttaaagttacttatcaaataaaagtgcaccaattcagatgtttggtatacgggtccggtaccatggacttggcccttgggtctacccatattcgactcgtacccaaacgtttattttgttcttttcaattgaactaacaaactaagcatcttaagtataaaaaaatcgttaattgtaatgtaaaagccaaaaaccaacagacaaatattgatttttgcgtttgtgcttaacataattatttaatgaaaaaattatatgttttaattttataactcaaaacctatttcttaaactgatgttgaattgtcgaaaaactaaattaataatgttggcagatatatatggtcacgtcaaagtctatctaatcaggacttttgtttttaatcttgataaacgcatgttatcgcattaaaaatgaaaagagatgggatgtggcaacaaaagcaagtatttgctacttgaagtgtgaaggaccatacatttgattaattttggatgtgtttttggttaggaattagtcacttttcactttaagataatggatttcgaatttggttgggattagagtgagataactttttagagtgtcaagatcgtcgcgtctccatcttaatttgtactttctttgtcatgttcttaatttgtttactaatagagtataataagttcagttacctacaattaattaagttaatttggcgtcattatttattactataaagtagtaaactaatgtacttttatcgatttctttatgagacatgccctactacaaaagcatataaagatcattgagttgttgaagtacatagcaaatttattctaccaatttaattaccatccaatctttttttcgtcaactatgacttgaatatatggacaatatggttgactaaagaaacgacaaggagtctcatgccgaaaacttagtacgtcgaggcttgtgtgtggtaacgatggaagaaatagattgagaaaaaaaagtgaaacggcaagcagtctgtttatgaagtctttggatctcttaaaccgggctttgtccaaaattagaatggaaaaaaaaaaagaaggatcccttaaaccggtaagcaacccgattaaattcaatatgtgtacagaaacttaatttgatttttttataaaatttaaatcaagactaatatggagacttacaaaagttaattatatgaattgtatgttacagattgagtgcgaaaggatgttccacgttcaatccactagcgaaacaaaaaaatcatttatttaactgattgtcttcgtaagtttacttagtaatatcatgttgaaacattaaatctgatatatgtgccactatgtaaatcatttagttaacttataattgaaacaagaaatgttatgtgtgccactatgtaacttttattagtacatatataaaggaaatagcgtttaataaatcgactgctaatctaaaactaacaagataattaattatgatcactaagcttcattctaacaaatcagtttatagaggacaagaaagcttataattactccaccttcttttgtctttttgtttgtgaaagagaaatatctgatggtaaaaaagcccaagaagacctcctctctacacctttaaagtttatgcaaatttagaaacaaacaaaacggaccactatagctaattatcttatatagataagatatgtagaaggagggatatacatatgtataataacaatcttgatatataacttccatcatccatggttaagattgtaacaccatgagttggtgcgaggataattcatatatacaaaccaaaaatcacgcgtatgtatgttattgcatgcatgtcttgcatcatccatgcatgaatgcatcaaagagtctccagtctttaatatacatatctacatggatggatgaaagtcatgaaaccatgttattaaaaccctttttcaaaacaaataataatgaaaccatgttgttataattggttaggtttgaagagatatacatagatagtccccatgcatgtgttattagtagtgtttaggatgaaaataacccctaatacataaattaattttatgattaattaacactctaagattaaggtaaaacataattaattaagactttagattaattaagggttagtaatcacgcggtgaatttagtctctataaaagcagtacctcaccttccacaaccttcaatatcaactcacccacatctttctctcttattctctcactcttttttttttatattcctctctctctaaatctataaaatatatttaaaaacttgatcgtatataataaagtaaataaagaataataacaaaaaaa

SEQ ID NO: 1866 - DNA, 3000 bp, Unknown
  misc_feature (1)..( 3000): cDNA_ID_2146061_gDNA_ID_1620460_Annot_ID_157749 3000 nt of promoter + ATG
tttaaaaaggggttttaaagtatttacctatgtttttaaagactttataaagattttaagaggttttaaaatgatttacaagggtttttagcaactaccaaagcttttaaaaaactttacaaggttttttaaaagagtttataaaaaatttacaaggatttttaaaagcatttttttggctgggaaaaaacatttacgagaaaaaattttggcggaaatttttttttgggcgggaactttttttttggcgggaaaaaaagtttggcggaatttttttttggcgggaaaaataaattttagcgccaaaaatttggcgggaaactttcagtttccaattacatgttcttaatagatgagggtaatttggtcattctgttcaagggaatggatatttttaaaaatgaacaatataaaagggtattgttgcaaaaaggtagtaaaaaaaggtagttttgtaaatctccccattttaaatgattctctatgcaataaaatttaaatattcttgttctagataatgccaaatttatattcaaaatcatagttttgtaacattgaattttgaacatcggttaaagcatggttacaaatattagatccaaaaaaccatatttaatacataatttagaatcaattattatctaacaatgaattaggttattgaataacactatgtcactgaaaaatcatagaagctcattgtccaacttacaaattctttatttcactactcattcacaacaagttggatgctctctcactgacccaataaacattagatgtgttcgtatgaagagaatcattatattcaatagttagccgagcattgcatttttttcttctaatagatgtgatacatcgaaaagctattttgttgcactatagctagcaacatcatatcccatttgctaaactaaaacatgtcgtagttggtcaccttacatttaacagctaaagtgactccaccaaaccactcaacacacatttgatcactagacctcggtaaatctttctaaattttaatacacaaaacacaaacaccattcaaaaagacattacatctaagatttgctctctcttattgttttttaagaaagactgtttcaacaccttaaaaccattatatgctcactaaaggagaattgagcctataatcacctcttgacctaagatgactcttatattacccatgtggtattttcttattctgaccatttgaaaaagtattctccttttctacaccagaggcctcgcccttgtagaacatccttcacatacgggcggactgtgcaacaccgatgcaacaatacaaaagcctaattaacaataaagaaggggataaacgtgaaaaagttctctcctttgaaaaaaaaatacggtggaaaagatctctgatggccactgacatgatgaattttggtaacgaggttacaaattccaactagttaaaaactgttattaaaagagttgaaccaatgtaatttggtagcgagtttgtttttggtataaaactgcacgggttcaaatcatatcatcgttattgttatggtatttactattacctataaggcttacaaaattgatttttctatctaatactgttatttggtttctaaggtgtacttccatgcttgaatttttaaagtagagtaatttcaaatttatctacatgtcttgagtttcttgtattgaaaaaattgacttttatttttggaaacctatggaattctttagatattcttaaatttttattaaaaaatattttccacctgaaagaattattgttttgcaatatctttcaaccgtttttccaaatacttcaagataattgagtcattactcttttaacattcaatatcatcacattaaatattcttttatttttggaaatgtcaaatttattaatcaacaaaaaaatatattttcaagtggaagggaataaaaatcaaaaccatagcggcataccctaaagataccctcaaacttgtgaagatattttgtaactcaattttttttttctactacacaaatcacatatattatttagataaagggttttgtggaacataaaattcatctatggaatttttatttctaatagacgatatgttgaatatcattttaaattgttaaagttggaaatatatgatatttttttcttctcaacatacattaattaattaaaattttcaaaaaaccaaaccaaatttatagagaaatgatatttatttttaaatactttaattttttttaaagtaactacctattgctaaaaagtgaagatataaattaaactaaatgtgtagtatcattaatttatatatatacttttcatcatcttagatttcttggtcaatgttttagagttggaccttgtgggaccaactaatttgtggaccctatgctgatacgaaccattagattgacattgcaacaccaaaaagataatcacacggctagtagaaattataatgcttacatgttttacacttgtcacaaatatgcccgagaattttccgcaacaatacaaactaccttataacgacttcatgattattacatgacaaattttagtgaccaatttacccttggactatcattttgtttttaaagtaactttttaactcacccaagttatcaaaggttagatctttgccaactcatcgctcttcacagttgttcttgtttataaagtcttaatattttacccttacctttacttctccctgtttttcctcttccttaaattcatcttcaagcttgaatttcatttcactaatcaattactttcctcgttatccttttttgcagtcaagttaaattgctctctttcaagacttgtgttctttaaaccaaaaaaaaaaaaaaagtatctgtgttcatcaccaactcattcttctttcagatctagggtttcatgcttcactcaatttttttttgtttaggtagttccatcttctaaacgttgtatttttttttttttgccatcataatcatatg

SEQ ID NO: 1867 - DNA, 3000 bp, Unknown
  misc_feature (1)..( 3000): cDNA_ID_2109192_gDNA_ID_1620460_Annot_ID_157747 3000 nt of promoter + ATG
ttgatatgcagcctcacacatatgaaataccatcaaaagaaaccattaggggcatcactccttctccatgcactgaagctttcgaggcatgttttcatggcacatccaacgaccatgttttttttggcatggcctataccaccccaccaactattgaacccaacgtttcacatgtctcacatgacaatactatgtgggaaaacgatcaaaaccaaggattcatctttggaaccgagtcaaccctcaatcaagccatggcggactctaatcaattcaatatgccaaaaccactcttgagcgcaaacgaagacaccatcatgaatcgacgtcaaaataaccaggtaatgatcaagaccgagcagatcaagaagaagaacaagagatttcagatgaggaggatatgtaaacccacaaaaaaagctagcatcatcaaaggacaatggactcctgaagaagacaagtaaattcaacatctaattttttggaattctcataaataattttcttaatctagtatgatattgtttttaatattaatattttctaatgattctacctatatttaggttattggtgcagctagtggaccttcacggaactaaaaaatggtctcagattgctaagatgcttcaaggacgagttggaaaacagtgcagagaaaggtggcataaccatctccgtcccgatatcaaggtctcttattttattttattttcattttcttattttcataggagaaacaaaaacaaaatatcatcttcgatactttcaaattcattacatgatacattgagaatcttctaagagaatattaacaaacttttttcacacttgtcaacatgtatacggttttatttcatgcatgaatactttaaacttttgtttgtatatacatatatgtctatgacaattctttaaggcattttgtcttcttgttgcggacaaaacttcacaattggtaagacatttaaactaaagtcattgtcacttggattctctcatataattcaacaaacataaaagagaaaaaaacatataaaaaataaaaatatttgtttaatattgtatgtattatttacatataaagcatattttatgtggtatgttacagaaagatggatggactgaagaagaggatataatactgataaaagcccataaggagattgggaacagatgggctgagatagctcgaaaactcccgggacgcactgaaaatacgatcaagaaccattggaacgcgactaaacgtcgacaacactcgaggaggactaaaggaaaagatgaaatttccctttcacttggtagcaacactcttcagaactacattaggtctgttacctacaatgatgatcctttcatgaccgcaaatgcaaacgcaaacattggtccaagaaacatgagaggtaaaggtaagaatgtaatggttgcggtctcggagtatgatgagggtgaatgtaagtatattgtggatggtgtgaataacttgggtttagaagatggaaggatcaagatgccgtcattggcggctatgtcggcctccggatcagcgtctacttctggttctgcgtctggttctggaagtggtgtgaccatggagattgatgagccgatgactgatagctggatggtgatgcatggatgtgatgaagttatgatgaacgagattgctttgctggagatgattgctcatggtcgtctttagaccgtgcaatataaacaagtcgaacttgattatatctacctatataattatgctatttatgaaattatgtttgtgcttttaattgaagaattggacatgtaatatatattgtggtttaattgaaggtttcttttggactaaacaaaaattgaaggttttcttgctttatcagattttttttttgttattctctaatttcattttaattaagaatctatatatattgttaaattttctgttatactatatgaatggtaattgcgtttgcggttaggagaagacgaccattaggtccacaacaagtacatttagtcactaaagaataattttatatcgactatgctaaagaaaaaaagtactagttgtttacaaaatatctggttagtatgatgtaatatgggataatatgtgtatggtccgttgtattgtaattttctggaatttgttaccttaccgtcataatgactatatggtccgtcgtattgtaataccagaaattttaggcaaaacacaaacaaaaaaaaacgtaatgagagttttgtatacattatattttggttttccatttgttttgtatatcaccattcgaaaagtcatacataactaaaagaaaaatacataaaacttttgggatctatattcattaatgatattttgactaactacatagaaaattgagatcttaaccaaatacaataaaccattacttcttattctttttgtgcaattcctccaacaaaaaaagaaaaaaaacttaacaattttagtcttaactacaaatagttaaaaataataatgggcttgtagatatctttccatttatatgagatttgtgatttaggcctatttaagtaaaatacacacgaaaccaaatcgacgtcgtttggcaactaagcgttggacaaacggagaaggtcccacctgtccttgtctccactctgtgttctccgattccagtgggcctctgacaccgccattggattgttcttcagatttatacatatctcatatctcatcaccttccaagtttcaatttgacttctccatcacacacaacaacaagaacaaggacaagcttctacatttctcttaacataacgtaagtatcaagaatcaaagctacttaatcttaacactaatatctctatatgtaaatcaattaagctacttttaactcctctgcagagacagtttttgatctgggttttcaagtccggtgttgatcccattgagtttcggatctaaaagatccgaatattcagacggatcaacaagagaacaagaaaaaaaaaatg

SEQ ID NO: 1868 - DNA, 3000 bp, Unknown
  misc_feature (1)..( 3000): cDNA_ID_2146030_gDNA_ID_1620460_Annot_ID_157737 3000 nt of promoter + ATG
aaaattcttatcttatgcaattgagaaagaaaaatctatagtttattttttctcacacattattcttacaattaaacttttgtatattcaagaagtggacttgtgaccatataataatcaagagaaactattgtactagtgtccccatgtatagaaaacctactgttttagtacttgctatttgagcaaatagacataactttttacaggttaaatccaagtttgaaatcaatctcatcgttaaaaaggtgaagatcacacaaagaaaacgtcaaatggatcatactgggcccattttgcagaccaagagaaagtgagagagagttgtcctctcgttatcaagtaacagtagaccaccactaaaccgcccaatagcttataatcaaaatagaaaggtctaataacagaaacaaatgaaaaagccttgttccatggactgcctacccgaattgattgattcgactagtttttcttcttctttgattaagacctccgtaagaaaaatggtactactaaagccactcgctaccaaaactaaaccattccagactgtaactggaccaatatttctaaactgtaaccagactctaaacatataaactaattaagaactataaccattaaccgtaaaaataaatttactacagtaaaaaattatactaatttcagctatgatggaatttcagctcttaagagttgtggaaatcaagtaaaattaaaatcataataatattcttcatccttatttttgtttcacatgcatgctgtccaatctgttattagcatttgaaagcctaaaattctatatacagtacaataaatctaattaattttcattactaataaaatgcttcatatatactcttgtatttataaatcatccgttatcgttactatacctttatacatcatcctacattcatacctaagctagcaaagcaaactactaaaagggtcgtcaacgacaagttatttgctagttggtgcatactacacacggctacggcaacattaagtaacacattaagaggtgttttcttaatgtagtatggtaattatatttatttcgaaacttggattagatataaaggtacagttagtgaaaatatttggttagcgggttgaattaaccggatataggagtcatatatacaactgtgaaaaaaggataaatacaaaaagggaagatgtttttccgacacacaagctaattaagtgcatcgagaggagagcaattgtaaaatgaatgttttgtttgtttttgtacggtggagagaagaacgaaaagatgatcaggtaaaaaatgaaacttggaaatcatgcaaagccacacctctcccttcaacacattcttacgtgtcgtcttctcttcactccatatctcctttttattaccaacaaatatatttcaatcccatttatatgtacgttctcgtagacttatctctatataccccctttaatttgtttgctcttagcctttactttatagttttatatcatatcaatcgacatggcgaatgtggatcgtgatcggcgtgtgcatgtagaccgtactgacaaacgtgttcatcagccaaactacgaagatgatgtcggttttggtggctatggcggttatggtgctggttctgattataagagtcgcggcccctccactaaccaagtatttttgtggtctctttagtttttcttgtgttttcctatgatcacgctctccaaactatttgaagattttctgtaaattcattttaaacagaaagataaataaaatagtgaagaaccataggaatcgtacgttacgttaattatttccttttagttcttaagtcctaattaggattcctttaaaagatgcaacaatctaattgttcacaaaatgagtaaagtttgaaacagatttttatacaccacttgcatatgtttatcatggtgatgcatgcatggatcatatctagagatttatggttggatatatatttaacattttgatattagcttttaaaaaggtctgaataaacaacacttgttagataaactcgatataatcaatacatgcagatcttggcacttatagcaggagttcccattggtggcacactgctaaccctagctggactcactctagccggttcggtgatcggcttgctagtctccatacccctcttcctcctcttcagtccggtgatagtcccggcggctctcactattgggcttgctgtgacgggaatcttggcttctggtttgtttgggttgacgggtctgagctcggtctcgtgggtcctcaactacctccgtgggacgagtgatacagtgccagagcaattggactacgctaaacggcgtatggctgatgcggtaggctatgctggtatgaagggaaaagagatgggtcagtatgtgcaagataaggctcatgaggctcgtgagactgagttcatgactgagacccatgagccgggtaaggccaggagaggctcataagctaatataaattgcgggagtcagttggaaacgcgataaatgtagttttacttttatgtcccagtttctttcctcttttaagaatatctttgtctatatatgtgttcgttcgttttgtcttgtccaaataaaaatccttgttagtgaaataagaaatgaaataaatatgttttcttttttgagataaccagaaatctcatactattttctattgtaacgagttttcttgtattaaatttagaagaatatacaaaactaaataattaaatcgaatcaaaataaatcacaatcttagactcctagtacggacttgaattaataattttgattctctgagttcttgaattaataattttgggtcggttcggtttctctattatcttattgggccaaatcggacggcccattatctagctccggcttatcggacttcctcttccccggcgctgtaaattccaagtccctccgttcacgtctccaaactagccgttgccttctctctctccagccaaagcg

SEQ ID NO: 1869 - DNA, 3000 bp, Unknown
  misc_feature (1)..( 3000): cDNA_ID_3064835_gDNA_ID_1620460_Annot_ID_157739 3000 nt of promoter + ATG
tgacgctaatgcaaggctaagctcacagcaaattgcgcaaagcgagagagataaagcaccaatgcttgtgaaagtgatgcattacatttgtgtagccttcagagatcatttgcctcttgagaaacagcttagacttgcttctatggacatgtcttaattccttaaaacctattgtatagtttttatatttaggagtattttgttgtatttttaatttttagcgggaatttcattgcccacactgttgtatttttgaaagatatataagaaagtgaatatgaaggttgaatacaaatttcaaatgaggtacatcgacatagtagccaactttatcataattaaagatgtctatgattgctgattaggagaaaactaattgaagaagttaatgagtatgaaagcaataactcgtgttttcccgtatcttattatgtatctaaacaatgtactatttccagatggggtttcagaagtgttgtctttcatttaaaaccatggctttcgaataataacttaaaagttgttaagaaaaatgaatgctgcctttttttcattggtcaacaacatagcgaataagagcttcatattttcgtattttttttttatcatttaagatgtgagtttttttgttctgattatttttgttgatgctattattatgaaattttcatatatgtcttttcggaaagaattcatcaaaccaaattatgatatcattttcttatatatttatatgaaccagaataatatttttatttatcatgggtggcattggcaatcgcaattcccaagcaaagccaataataaccaataagaatcgtaagaccatccttattgatgagttcttagtagaattcttaacattttggatagacaaaataatatttaaatattaaatagttcttaataagaagagaaagtgtatcaataatctcttatttaagagccaattttatttttctaaaaacccttttctattttttatttgtattttattttatataatattttaagagtttttctaaagtttttaagaacctattgataatgatgctctaaaaacatctttaatggaaggttttaagatgaatggattcttaaacaaagtaataaaaaaataaaaatttgaatgaaagaagaaaaagaatgaagaaaggcttttagctaaaagcatcaagaagaatttttgatactcaactaaacccatttaaatgacttgtctctcatacattggttcactttttttctaaaattaaaattttagttatataataaaattacaataaaataattatttttgttgttgttaagagtctcttagaaatgcttattgtcgaggatggtctaaaatagagttggattaaaacactaccgtcttgctcgctgacatgcccatattccacagccacaaaatcttcaactgacacgtggcataactaaagcctctacatatctcaggcacgtgaatctactttgtgaaaacactgaatccaatgtttccagtgtgtgcatagagttttatttttagatgtcaagatgtttaacttggttggtataagatatccttctgtattagttcttactaatagcaaatatgagatcttacaagtaaagatatcttaaatagtcttattaggtatacataaatctatcagaaatggattaaaaagaaaaaaggataaaatcaagtaacatttgtggaaaatcaaagataataaaaatagaatttaaaaatagaatttctttttgataatatcttatatatatataattaatttaacaaatagtttttgttacattttgttgatgatgcttacccatataaatgttttatttataaataataatacaacttttttattctctaatagctcgttaaattttttaatttatccaatcatatactttattcatatcaaccgacttttttaagccaccttctttctttaaatagattccatcttctctcgctctccaatcccaatcagctccattatcataagcagtatattgtttaaatgcggtaaaattttgataatgtctatagtttggtctttgtttcaaagtacacatgaaacgagtcgtaccccaaatgttagcgcgaaaactattcacgtaatcatatcccactggtattatttttggacctattacatcatttttggaataacacctcatccataagtttttatgagatttgagttcgttcacgattctaattccggtgccggatacatgaccaaaaatgtaaatactaaaaacaaatagaaaaactgaaaggattttcatttattttttttttgtttagggtagatgtttagatgttttgttttgttaccttgatttttgtgtttctctggtactatatatacaaacacatatctgtattactattatttgcacgatatatctttctttattagttctaagttataacaaatatgatatcttacatataaagatatcttataataaacgtactagagtactaggtatacataaatctatcggaattgaattttgaagaaaaaaagataaacattacgttggcttactttatatgaaattcaatgaaaatcacttagccaaagaaagatagaaaaaaatcttatgatatactctttgtgtacgtaatataactttgtttataattatttatcaacgcaatagcaagcattgccactaaaccaataagagagtgatcatgagcatgttgggaacaacactatccacttgttcgcttacgtggacatttttcactgccacgagatcttccactcccacgctgcataaccacaatctctacatatcttctacacgtgaatctagtttgtggaaatctaaaaccaaccaatctacactcgctgacgtgtctatatgttaatcttcccacaaaatggagtaatgaacactttactatataaacggcgtctccaattcaacaacatctcattctcacttacttcttttctttttttgtgttcttgtttagaagaagca

SEQ ID NO: 1870 - DNA, 3000 bp, Unknown
  misc_feature (1)..( 3000): cDNA_ID_2146040_gDNA_ID_1620460_Annot_ID_157740 3000 nt of promoter + ATG
agttgattcctaactattcctccaaaaagcaaataaattgttctatctttgaaaatagaaaaagataattaattttaacaagtataaacaactaggtgacactaacaacaaatatttataattcaacacactgaaatttatgagcgatatatagactaaaataaaggtaaatgaaaataaaacttccaaatggcaatattataatgaaaaacaaattttcaaactttttaaaaatttttttaacactatagccatagtaacatcaaaattctctacaatcaatcgtttatagtaaaaatctttgagaatattacattatagggaacttttataaaacatattacacgtttaggaactttctaaaaagtaggcactttgtataaataaatttagctatttaccctttaactatttctctttccttataatctttgtctctctcctagtttctcttctctctctctttctctcccttttcgacaaacacaaaatcactctctcctcatttctcttctctctctctttctctctctttgtcgacgaatacaaaatcaagcggaagataatggattcgctacaatcacgacttgggttaaggatctgtaccatagattttttgctttgtatgtgtttacttacgtaatttaagatcatgggttctgcccaaacttcactcattattcaattttatgagttttgtagctctgaaaccttaattgaagcttttatttttcttccaattctttacttgctagatcttagaatttcagaaacttaaaataaatagaacaaataaccatatgagtcaaacaatgaccatatggattgcaccgctcggacaaacatctatggacaatattatctttgtttactactaatgtgttttatcactagataaaatattctatgtatagtatggatccattttataatgatggttgtgtccatacacaagcaaatattggtcaaagaaaaatggacggtgtacttttaactgatgattatcgtgtgtattgatatgaattgattatgttaattactagatgaccatttggacttgacttcttggacacttgtcaatggacaactatgtctttgatttgctgcgagtgcgttttattgtttagtaaagttatcaccccttttttttatgattacgatatatttatatggtttcagggagagaatcgttctacgtagagattatttgggtgaatgaagtagaaggagcagatttatacaaaaatttggtatagaatggatatgactcagtaaaaaaagtttctctatggacacatatgaatggacttgttattatgtacactgaaaatttattttttgatttttgtttaaatttgcagagatctttaccttcaagacagtagattgaggctacgagaatagatcatatgcatcagatctcgtcgtcttcacaacacacaatttcgctaatgtgaatcatattttcacaaaataaaaaaagaaaacaaaattgtgttcattaaataaaggtaacaaacctacacaaaatcgaaatctagagaggcttctccgtaaagtaaatacataaggtacactatcttcacaaactccatcgttgctctcagcacacacactcagcacttacaaatcttcaactcgccatttaaattttggatttatttagagagagtgatagaaaagacatggttctttgtagagaagaagagagagatgttcttatcagatttagataaccagagaataatttatttttatttcatcttagccatagatctgaaaatatatatttttaattcaacggtctatattaaaaagaacataatcagccacaataaaaaaggaaggttagttaatttacgtcaaaatcgcaggggtaattttgtccattttttcaccaaaagtaaagtaaagtgcctaaactcttggaagtgcctaaaacgtcaaaacattttccaaaagtgcctaatagtgtcacattcccaaaatctttatcaatcagcaccataatcataaaggtatgaatggttgtgacggttatagccgctttttatttactattcataaactataatctataacaatctagattagaaaaaattgaacaaatccacgaaatactaactttgaaccgcttttacataactttaaacagagtggtttactttgctaacagtttagtccgctttgttcaaagccggacgagttttaaatttttataatttcataataaattacgaatacgaaagaaatattggggcaatttgtaaacttaaataaatattgggtcaatttgtaaaattaaagaatttttggggtagaaaataaaacattttccagtctagtttctgtcttcctcgcctttccttgtgttacttgcaataacaaataagcccctctttctctctctaccctctctctctctttctcagctattccacagctccatcaaaccctaacgacgagaccagtcgctatcggcgacgttgattctcctactaattccgaaacctcgacggcgcggccaaaaatctccgccgtggattcaatcttcattgacgattcctccaattttgtccaatttcttccccaaatgttccatccattgttttttatttaggttttcgtcgtcgtcggagccgaaaccgattttgtttgtctgtgaagaggagcgaacagagtcactgattattccaagagaacctgtaagatttatttcctttttttttttgaagatttctgaaagctctctaggttcgtataaaccctaagttcttatgctgcttgtagttagaattctggagttagtcttaattgattagtgttttcgagttgttgtgggaattatgaacttaatcgatagtatatacgttaggatttgagtattgattgctttaggatttcgttttggtattatactctttgatctgatggatgcgaaattgtatcagagttttgtatgagagacaagaagctctgcaatattgaagtggtttcatg

SEQ ID NO: 1871 - DNA, 3000 bp, Unknown
  misc_feature (1)..( 3000): cDNA_ID_2105617_gDNA_ID_1620460_Annot_ID_157745 3000 nt of promoter + ATG
aaaaacttctggttcggaagcactaaagtcatatgttcatctcttccagattatatatcaggtagacagattcctttggttattatgatgtatagtttgcaactttcagatttcttgtttcattagtgtatatatgatcactgatacttgtgtgttttggtttgttgaaaaacagatgggtgctggagcagctgtgcttacagacagtatatattggaccgtgattttcccgtttctgtctttacaggactatgagatgagtttcgtaagttttcgcgccatttaccgtatattagttaaagcttgtacactgctgatggcactttctacgttgcacttgaccctcttgaacttagtctcaacttctctagtgtcaaaattctgtgttttcagatgactgtgaatttgcacacaagcaacctcgttttgctgcttattgacacgtttctaaaccgtctggtaaaacaattctttcctctgcatttacgacgagttttcgttttcattaatgtgttgaacctgaggtctttttgtgatgttgctttgcagaaatttccattgttcaggttctcttacttcatcttatggacaggatgtttcgttcttttccagtggattctccacatgtttatctccgttgggtaaaactcttctctgtcatcttttgtatgttacacttaccgtcttgattaatcttacacttgtattcctcgattgacttaggtggccatatccatttctcaacctgtcattagacatggctccagtgtggtaagccttgaaaacatttacatactagacactagtcaggattggtttatatcataatgtttcattccttagaatgattacgcctatccttaatattttaattcatgcatctgcaggtatttgttggtggcactcctgcatcttccttcttatggcctctttgcattaatcgtcaaaatcaaatacaaactcatttcttgaagtcatttcgaatccaagagtttctgccccgtaagagtcagtgctcaagggttacaacaatcaaagaaacaattttttaccccatatgtctaaaatcttcaaaacagatcattgtaaacgccacaacatttcaatgcataaactatttacttccgatccaattcgcatatcgcaatgaaccatttcgtaaatttttcgctacccgaattgatttcagctcgaaccaaatcgaaagaactaaccatagcaacagaatatagtgcaatctttgccaaaagtgtatgaacttaatcaaaaaccgaaccaaaccaaaccgaaaacccgaaaattcaaggttttagaattgaagatttgagtgagacttgagaagccaagtctggctctcctagtctcaagagacccttactcaaaacctcagcgacatactcatcagcctcccatgactcagacccccaaccactttccctcatcaaggtataaaccctaaccaccgactctctcctctcagctccaaccacagccctaatcaacttagctaaagccttatcatcacttctttgatcaattccatcaatttcaccaataagacgatctatctcatcgaactctttattcctcgtaagagcattaacaatgtctgcgtatagaacaaggtcaagaggaggatactctgtacggagagtggagagtacatggacagcgagtgtgcaatagtcttgacggagaagctcacggaggacggagatgagatcggattttatgagacggcggagaggacggagggtaagggagagggagacaccggttcgatgagctcgtttgagagattggattgattggattgcttcggtgcttaggattcggcctttgagaagtggtccgcggttgtctcgtggaccgcatcggatcgaaacgaacgttctcttaggaacgatgacgctaagggtatggctatggctaaggcttggtggtcgagtctggctgagagaaagcgccattattaatcacaccaatctttacgagtgtggttgtgtgagtgagagagatggtctttcattgggcaagcccatattaatttataaaaggcccatatgtgacacaaaattaattaatttatactttctaattatgcgtcgtttatatttctgttcccgctaatttctctacacgagtctatcattacacttgcaagagcgactctatcttcttcttttttttcaaattcttgtttcgttaaaaagttaaattttataccaatttgacgactttatcttcttctttttttttcagattgtttttttttttgttaaaaagttaaattttataccaattttaatttttaacataattacaaagattacaaaatacatataaaaataatctacagaaaaataaatacaacattactactaaaaaaggtttggatcgcttctaagcaaagaaagccaagttacaaagagaaccaccgaattcgatcttgtaaaacttaagaattcgcgtgattttaccatatgacctaagtactggaatcttcatatttgttgccacaattctaactgaaatcagtcttcaaaaaatcaagatagaatgctagcaacattctatcttaaatcttatatttctttaactcgtttaattactaatatcctaaaacatttttaccttattaaaatataaatatatgatttttttacttttatttaaccttatatttattctatttcgaatttatataaaatctatttatatatataattatttaaatattaaatttagacatatattcgatactttattctatttttataataaacaaaactatgattttcatccctttttatttagcaacaaaactatgattatgtgaccaaatttactagagaaaaaagtcaacaaaagtcaaagcaagatactgtaataataacaacgaattaatttcaaaaaaagagctatcgacccaccaaccctaaaaaaccttgacgccgttttcttcttcgatcttcttcttcctccagagaaaacaacatg

SEQ ID NO: 1872 - DNA, 3000 bp, Unknown
  misc_feature (1)..( 3000): cDNA_ID_3064844_gDNA_ID_1620460_Annot_ID_157744 3000 nt of promoter + ATG
ctaatgacaaacccacaaattggtaatactggtgtcaatcctggtaagtggcagtttcgaaactttcgtatacactaggaacttatgttctcaatgtttcttattacatttgtaaatgtttgttgtagatgatgaagaatctgggcaatgctttcttactggtttggtgataagaaacctaagcattaggtaagcattttccttgatgtgtctttccattatcctccattttaatgtccctgacttcttgaattgtgaaatgttcagtacctcaaactggagatgcacgaagacacttgctgattatctaaccgaaagggacatcatgggagtttgtaagttccttgtattcaacatactatttagattgtgcatgagataaagttgcatttgaaaacatctctgattactctattttgggatgtttttgtaaacactatcagatgatcttgacactcgagcaataacccgtcggttaagagaagatggtagtcttatcggggtgttgagcacagaacagtccaaaacagatgatgaacttctgcaaatgtctcgttcatgggatatcgtaggtcagatttctcctgccatttcctgtttttggcaattataatataacacttggaatattgaactccttctgtctgcttttttgaatctttgaatctttgtaggtattgatctaataagtgatgtttcatgtaaatctccctatgaatgggttgacaaaacaaacgctgaatgggatttcaacacgaattcacgagatgggaaatcctacaaagtgagtattacttctctacttttgctcttatcgatgctttttactctctctttctatacttttcttactctctctttctatactttgtctcttgaattcaaaggttattgcttacgattttggaatcaagcaaaacatcctaagacgcctttcatcttacggatgtcaaatcactgttgttccgtccacatttccagctgccgaggcgctgaaaatgaatccagatgggattttgttcagcaacggtcctggagacccttctgctgtgccatatgctgttgagacagttaaagagcttctcggtaaagtccctgtttacggaatctgtatgggccatcagttgcttggtcaagctttggggggtaaaaccttcaagatgaagtttggtcatcatggaggaaaccacccagttcgtaacaacagaactggtcaggtggagatcagtgctcaggtaccaatacccaacctcaaaatgttccatttaattccaagcatactaccaactaaggatttgaacttccacattcaaagttcggataattatctgataaaacgactgtgctaggaacattgttacaagcttgacaaaatctaaatatggtgtatcattgtctttttttctgtaattcttggcagaatcacaactatgcggttgatccagcttcacttcccggaggcgtagaagtaacacatgtcaatctcaatgatggaagctgtgcgggtctatctttcccggaaatgaatgttatgtcactccagtaccaccctgaagcctcccctggacctcacgactctgataacggtaactgtcctctttattccagtcacttggtgaaagacacttatgcttcagtcgtactgaaaaaccagaagattaatgtgattatttttttgcttatgaatgcagcatttagagagttcatagagcttatgaagagatcgaaacaaagctcctgatcaatgagaagtactctttgtttttgtacgttgctgtttttaatcatggcacttaaattaaaaccaactgttttgttagtgataatggattggcattattgtttctttgctttgactgtattgagcaaccatccaacctataaaataagtaagattttgtaaaagtaataaagagataaagagatgtgagagtttgtgtcttttgatataagaaagctgggaaactcttgtgacttggggtcaattcttggaacatttcatgatcctccatcctagtaccctcgataaccccattggccagaatgaggttcaaatggctcaacgtaacagatgataggaactgattaacacatagcaaacaattggtgtttctaactctggctctctgaccttggagccttagagaacaaccttgccgttcttcctccaatggtccactagttgaaactaaagttgtatcaatcatttatcagtgaattaggatttactttgaatgcagttatttagaaatgaaagttatgaaaaacaaaagaatctgaagcaaaaaccggattaaaacagatctaaatttttttatcattctgtaatttgcaaagtattggctaccgccaaaaaacttgttcccttttgttttgtattacatgaccaaaagtgcgtggcgttttttgtttttgggatttttaaattttcggagagatccaaactgcgtgacgttttgtgtttcgggatctttagttttgaaatagatcaaaactgcgtgatgttttcttatatgggacgcagcgttttcggccattaactagtaattttagcttgctcttcttcacaacaacggcccttgaatttgaattccgctctctcacttgtatcttcatctctctaagagatcgttgctcttcaagtttggtctcgcgcaagcttttcatggtgatttaacggtgagatttttgtttctctgttcaattttgcttgattcgtgatcggttttaatggagtactttgtgagttccgacttgttcaatgttccgtaacttcctcacacgtttctctgaaatttcgctagcgtaatatctttctcagtttaaacttggcgaaattgagatttcaattggtgatcggagcagatgtcggattggatttatgttaatgatgtttctgatgtacggatagatttatgaagtgattgctatcggagatttaggattctgattttcacgctattggaatctgtagaaatcctcaaattagcattggtcatg

SEQ ID NO: 1873 - DNA, 3000 bp, Unknown
  misc_feature (1)..( 3000): cDNA_ID_3064832_gDNA_ID_1620460_Annot_ID_157735 3000 nt of promoter + ATG
taaatccgaaatactttaatctaacatccatataataaattagaccgtttacatacaaaacatgttaaaggaaaatattacataggtcataacaatgaagtataaaggtcatccaaacatgtcagaaaatttacacaaataatttatttgttccattgctattttcttaattgctcttctaaattttatcattggttgcaaatactatgatcttaaaaaacatgaaataattagttgaattattagcaaaataaaataaaatatagttgacacttgacaataagagtggacatcactaaaactaatcgtatatattgggttcgatgtatatgtataatgtaataagaaaataggtgtttaacaaaaataaagtaagaaagggtgtgtgtgtttttttggtgaaatgaaaggaggtgtgtagccaaaaacaaaagaagagaagaggtgcattatttctaaataaattttgatcaaataattgtgcttatgtaatgattgttgaggacatatcacacttgacttgcaatcattccgtcgacatttttctgtattatacatttcgtcaacaaccaatccacaaaaccccaacctatgataactaaatcacaaaagtacatttggttttatgggttgatacaaacttgagatcaagctaggtataaattaatctcaaaagtaatcgcaattaataggattcattcgttagttaatcgatcatatcctgtataaattttgttgtaacaaccatgcaattttctctaggatttaagctattgtcaaatttcctttcaaaataattatcgaaaatttttagttcgaaaaatttaacgtataacatcacttttaattttcattattcgtatacgctatacttacatttaaaccatttatttatttatttataaagtttatatatgtatatagagaacttaccaggttttgttatcccaattgtccaattgataattaaagtataccgacttctagttataggacttctaggtgcatgcatgatacatacatgatgcattatgcatatacatgaattcttctaaaatggatacataattaattagcacacacactatcttggcttcttcgtttcttggacgtcttggctttttttggtcgacccacattagcttattttatatacacgataagagacatacattttcattcgccaggcctgatcttatatatttatgtatagccgtatagggatatttgtatgcatgcgtattcaagtgcttcttcttttccgatctgaattggtccttctcttttcatattttcttcactttttctttcaattttctattatttttatactttctttgtacacatactatatgaagcatatctgtatacactgaaatctaatcaggaaatacgtaaagtatcgttacaagaaatacgtaaaataatgcttgccaatgattgattatcttatctaatcattggtataatctatatacgcacttgctaccaaatattgcacttatatggaatatgaagcatatatatgtttatggaaacaataatgccttggtatcatcatcacttatatatatcattttaattttgtaagtgcacttggattagaaaggatatataattatatatcaactactttgtttggtatatcttttaggtcttaatttcgttggatgattaaagttgtagctgaccaatactatgctaagtcgctaaatattttaattataggaaatataagatctataatacaaccacaagagttatccaacaaacaacaaccttttttgtgaatggtatctatattcgttgaaaatgacggtataattttaaatagaaattgattacagttttttcttttctttgttatgcactatagaaacttttttttttttttggattcaagcatgtggctcaaccatcagggtatgtcaaattttttgaatgaacacatcaactaattaaaagaacgtaaaagttaataactatttttcagaaatgtaaacagtaaaatcaagacgttaacagttaaattcaatcaagcaaaatgacagtacacatgtcggatttgctcagatcctcaatagttctgatgttcttgtaagtttgtatcccaaaactttctgaaatttagtttaaacaatatatttaagtggtccaaagacttcacaaacattttttttttacggaataataaaacgtggaaaggtcaaaggtaaataaataatactaatagcttactaattaaggtttatcattagttttaaataaataatactaatagcttactaattaaggtttatcattagtttctttataaaatggttcggactcctgagggtatatggctgtaccttaatttaaatacatgaaagtattggtttactatcatttgattttctttcattgttaaattatctcatatattcttaagttacataataaaagagtattttttcatgacaaattatcgcttttatattttacatacttactgaaccgtatcatatcacatatataaacaatattatatactaatggctcgtttaatttttttctttttaataaattagttgacaaaaattataaattagttttttaaaatttaatagaaaatacgttatgctgtcaaaattaaaaataagatagaaaatatgttgtatatttagttatttactaaaagcaattgaatggagtaaaatttgccacggtcagagttattctttcttaagttcactattttaggtcctcaattaattgaggccaatttgtctttttgtaatctcattatattcatcttctttctctttctcatcgcaccaaaaatgccttttgcccctctctctctatatccaacccatgtctcctctttatctctctaactttccccttagagagattcctctttctctcaaactagggtttcctctctgaaaacaacaaaaatatcccaataattgcaaaatctacttgaagatttttcattctcctttcttataatta

SEQ ID NO: 1874 - DNA, 3000 bp, Unknown
  misc_feature (1)..( 3000): cDNA_ID_3064860_gDNA_ID_1620460_Annot_ID_157734 3000 nt of promoter + ATG
acgtcacggtgatgcgcctcatcagcacgaaccaccatgacaacatcacgaagcgttgcatcagcttcaagcctccagtaatcaacagcgatagccggtgcaggaacattttcgatgttaccgttatcgagttctttgagaaactcagtgtaagaatgtattgcttcttcctcaaggtatccaaccatacgatgagcaaacttgggagagattatgtatccgattaaataagcgttgaagaaaaccccttgaacagagatcacaagagctcgttcgtaccatttgggtttcgctacttccatgaatgtcattaagtgcattctctcattctctgcttcttcgagaagggctttgatccaacccccactttgttcgaaacgcctgagagatttgaagtgcataagcatccctccaaccattcctggaaccgctgcaaccgtctctagcataatcgctcggcaaccatacctcctctgcgttaagtcattgccaagaattagtccatactaaaatcttctaaaaatgatagctagctaccaaatcttctaaaacagttttcactagttaaagacttagttagcggttggaacaatagaaacctaagagtgtacctggaagaaaagatcggtaggccatcgaagagatttaaccatccaataagctattttgtccggtaaagttgaaggaacatgatgcttcttcaaatctatcgttagatcagctttataagtctcccatggctaccattattcgacaaaaacacaaaaaatacttataaatcgaccaagagtaagtaacaagacaccaaaacatgtagtaaaaatatgctatgtacccgaaagcaactccatttccattcagttccatcttctttggtgattttcattggcttcacgccccaataactaactattaattgttcccctttgttaccttgatcattaaccttgacgccgtcaccggatccttcctcttcttccgatgttttcttcttttcaaatgtcatcttgctgaaatctctcagacctcccactgccggaaccctaaaatatttcgctggagcaagttggtgaaatagaattccattaatggatgtcgcttgctttgatgcgtcaaggagagagcgacggagtaatgtagtgatcatttttcggattcaagggagatttgttttggtttttgttgataaggaaaacgtaaaaccctaaagtttggggaatcaggggattaaagaggagaagaagaagacaaaatagttctttaacaagaacagtgtggacgatgtcaaaacattaactgaagatatgtgtccaactagctcattaggccttcaatatagcccatgcgcataaggcccattgggtctttccactattgagaagaaaactttactcgagagatacacagtgaaagggtttgttttttttagacagaaacattgttcttggtgataatttgtttagtttgtgggttttgttagcttccaaggatcctatcggatcgggaagtcgtgaagatcatttgtccgagtgaaactgttggtcgttatgttaccttggagataacttgggaagcaaatcaaccataagagtatgtaaaaaatgattatgacttgagaacacacacaaaataaaaaccaaactcagaaactctttttatatctttttacattaacggcgttgtataaacaccaactcgaaatctgaaggaggcacaaagtactctatacgaatattgttctgacatttcaacaccggtgggcgtttccttggagccgccggacactccggagtctttgctcctctcgccgtgggagtgatacaaattccatcttctgattctctctcaggcttaatgagtttcgtcttcaccggctttagtgaagcccgaatcgatgttttggcgaagataaacttttttccatcggtgtctaattctctgctaacttgagattttttcgaaattcccatttaaaacagttggagattgagactagtacaatgttttgaagatgaggaaacaagaaaaagaaaaacaaagaaggaagaagggataagtgtaaagtaggtgaaagagtttcttcttcttaaaggaaagagttttgccttttcaatttggttgcttccccaggaattaaaagagaatgaagctttcagaggaagattattaggtgcaagtagaggaaagggtacaattggaaatgataataatgttcagcccgggaaagctacgggtagtcaataatctttctttttaatatttggcgccatggttttgagactattttaataacagtggttcctaattttttatttttttttggttaatcagtgttcggttttaaaaatactaccgaaattaaattacctgaaaaagtatttggtttgatttgatttagttatcggttcgttttagttatcgattttagaagaattttggtatttttttcataaattttgatataatcaggtttattttgataaattctataaaaatgacatcaaattttgttttaatgataaaaattagttcaattaacataataaacttaaaaaataaatgggaaaaatgttaaaaaaaaatcacgaatttttaaatttggaacgatttaattttgaattttccggaagacaaatagatcgtaaacgttttgttgactttcgaaataaatgacatgtaaagtcatttatttaatacatgatctccaaaccaaatgggccatcatatatgggccttacaataacttaaaatgtatctttgaagatgaacttaaatgagtctttctctattcctctcagcataagaggtcaaacaaaaacattttcgattttggggaaaaattaattttcccgcgtcaaatgagagaccacaccgcccaaaaaatccagtatcccgccggattcaggtaataaactttttctccaccggcaaatatcaaaccataaactcatatctctccgccgcttctctctttacctcgattgcttcagagactctccg

SEQ ID NO: 1875 - DNA, 3000 bp, Unknown
  misc_feature (1)..( 3000): cDNA_ID_3064889_gDNA_ID_1620461_Annot_ID_157761 3000 nt of promoter + ATG
atgataatgagagcacaatgagcagtaaaattcagcagcaacaggatcatcacaacatgataaaggatgatcatgaaacggaaaggtgactacttcgacatcagtagaagacatttttttctaataaaaattataagaacaaaaagagagaaagcagttgagtttcagtttcattggaactcatttaatggtaattggcgcatactgccagctaatcgaaaataaaaaataaacaaaccaactaatagtaataacaataagatatgacctcagtccccagtcatttaaatacgatctagacagagttgtaatgtgccaaagtcgtcgcattcttaagaattcttcttctttatttttatttattgtcgacatcgtgcctacaacttcagattaccaaagtcgtcgcctcttgttcagaattttaaaaaaaaaaataaaaaaataccaaactgaaatattttttttttctttttttttaaattttaaatttccattaaaagagaaatatacaatgccaaatggctaaaaaggctcgcaggcctgaacattacacggcaaaagcccaacacaggttcgtaggccccaaaagaaacagaggaagagaagaaggagaaaaggaaacagagacttacccgaacaacctaaaccaggttgagagaactgaagatcccggtctggctaaccgctgggctctagcgatcggatctaggcgagctttcaagataaccaaattgaaataatttaattatctggtttaatttatagctgatgatggcgatctgtcgacattttggtagatctatctacgaatctcccttgcaaacattctgatttttgagtagggaagatttgactttcaaatatttttgagtagggaagatttaactcttatcgattttcaaaaaaattatacgtgtttttgccactgtccacaaacacaccgttaacgaacggttgtggttagatacgatatgcaccaatcataaataatcgttacatctcatttcataaatgtttataacacattgaaattattaaaatgaactcatgacttcacaagttcaattaaattttgttcaaacttatcaatataaccatctgaaaaaccagagtcagtcaaaacacatctccacttgtcatgattcttcctcactttctcaccgatctcactaccttcctccatcacactcttcacagcattctccaagctttgccgcgagaaccaccctttcttttccctctccacttcaaccgccacctccatctcctccgtcatcagccttgcgttcaaaatctgttctccgtgctgcggaaccaaaacgatctgacaatcactcatcaacgactcccacatcgacccaaacccgcaatggctaacaaaacaacccactgaaggatggttcaacaccaacggttgctgaatccaacctccaaacacaacgccacgtccttgaaccctctctttgaatccttccggtaaggcttcctcgacggttgatacacccgaaggaggcttaatggcaaccagaaacggaaaaccagttgattctagacctaaacagagttcttgaaactgatctatcttgtttacaacgggttggctaccgaaagcgcagaacacaaccgaaccgtggttgaatttggctagccactccgcccattgaggatctaaggagggctgattaggttgggatccagggagaaccggtcctgttaggtaaaccggtttactgtactgcctacttatgtaatcgcagaatttgccttctgtctcacggcaagtccttatagcgattgcgtcgcagtttctcatcgcggtaactttcccatcaaagaaagagccaatcgcctcgtgcttcctccacacgaaactcagggattttgcttcgtgcggacgtaagactactttcgaagatgggtaacctagaggcgtcttagctaactcctcccctgacatttccttgccatcaatgacctctctctccgcagaagggacaagagacagtgcgattgacgcagcgctaacgatgttgaagcaaacggttttagcaccgatcggtttagcaatttccggtatccaatgggcagaatcatagaaaaccaagtccggtttgattgtacggaaaatggtctcgacctctggccgggtttggtccattgcaactgcaagcaaatgtgtcaagaagaaagggacgtcggagtttgtctccgcacccggagggagccctttgacctgagggatagagatggtgtggaaagtgatgagatttgggtagagattaagaggttcaagctggtttagtgctttcttgggaagcaagaaaacaatcttgtgacctttctctgcgagcttgttggataggtgaagaaaaggagtcatgtgaccaaaggctaaccacggatacatcacaatactcatgcttgacgattcattcgatccaaaaacacccattttcttggactctcttgtatttcactttaactaccggaagatccttattagactttttttgttctcttttgttaatttctaagttgtgtgttggatgtgtataaatacataaacctttaacggatcagattggtgagtgtcctgatgaatggtgtgtggttattgggtaaccaaatgaccgggcaagtgtaacctcctggtaagtgcaaacacgtgatggtatcgtaacatcaacaaaagcaaaaccagacttcacgtggtaattgatgggcctgaaatattcggccccctttttaagcaaattaatagactctatttaaaagtcgttatttgttcgttacgcttaataatcccacagtcaacgttttatgtcttaattcaaaggttgtttacgaacgattgtcaaagtggtaactctcgtaattaatataacgtttctttacatattacccctataaattgtttgtttattttgataccaaaagcatcacaattaaacagtcgactaatcttcatagaaaacaaaagaaaagatcactagagtcact

SEQ ID NO: 1876 - DNA, 3000 bp, Unknown
  misc_feature (1)..( 3000): cDNA_ID_2146145_gDNA_ID_1620461_Annot_ID_157768 3000 nt of promoter + ATG
cgatgatgcatttttgggtgtttattgtgcagtttgatgagcaaaaggatcaagtagcagtggagcaggttcttcgggtcatttttattgatgcggaccgcccaagtgctgtaagctattcatgctgataagaccacatacagtctaaattctatagtttgaacatttcataaggagaattacgatgtaatgaatcaggcattggagaaactgaaacgtcaattggatgaagctgaagctgcagttgaagcaagaaagaagcctcccccagagacagggcctcgagttgtcggggagggtcttgtcatagacgaatgggtaacatataattataagatctttggtccgtttattgttgttccttctttctcccatatattcaccaaagtttgtgtcatctatcagaaggagagaagagagaagtaccttgctcggcaacaagtcgaatccgtagattctttgtcctaaacgcagagagcaatgtggacttgttctgcagatcatgtacataatttattatccctcgattatgtatttatctctagacgattactttgtggttcttgtatgtctctgtttgttgtgtgattcatgccggttttttctccttcatcaaattttgtttcggtcgtttttagttgatctagaatcgaaccagagtttgttcagtatttagttacaaatgaaaaatcctgttataccattcgttaaacgtttcttagaaatgagtcattaaggttagaataagaatgatggttttgtggacaattataaagtttccccaaccatgatcaatttgattggaacatttcacaaaccaaagtacaaatttgttttggatgataggctaccattttctgatatgtcaattgtcaccatgtttatttttagttttaaagtggtttttttattttgatcagactctaaactaaaggtccacaagagtgacctataaaagactgatacccactaatacaaaaaaaagacttatacccaagtactgagattgatgtgttgctacttttgctccttgcattcagaaactacgatattctctactggcccaaataattagtggacttacgtaactgagtactttgaggacacaattatagaaaacgttattgcatttagtttcagctggttaagctagtctgtcatataatctttcttcttactgtaatgaaaacaataataataactttactaattttctactaataattatgagattaactgaataagaatagccgccaaagagaacgagaaataattaagaatattttggtcttaaaactttgaaaacacgtaactcttaaccattttttcgtctttgtacgctgaaatctaagtcagaagattcaatgtaagtatatttaactagcattcgaaatatgatcatatttgtttgtaaatggtatactttatagacaatcaaatcacttgtatgaaatgagaatatgagatataagtaagattcacgtggtatataaaatttggaacaaattatgcttaattagaagcacacaaaaatctaaagttagatatgttttatttcgttattagaatatttttattcggaaaaaaggggaaataaaatcgactcgtggagattatgaaggaacaaagacaactagaggtgtcttttgatttccatgtcgctttatgaaagctttcggccaaattgcacaatcaacaaattcgacaatccttatctctctctctctcttttttaacctcaaatttagtcttatcaaaggacataagaatatatttttgtatcaaacttgaaaacatcacttaaaataaaacaaaataaattattaaaatatcactaaaatgaagaagagagataacttatatatacttttaccaaatatatatctaatgtaagattctgaaattgagtcatttttatctcagcaaaatcatttcataacccgggcgaataaagtgtgtgtttagtattacgtgcttgaaacgtaactagatcattaagctaagacttgtagaacacgtacatgcatcataattcataaatgattagtttaagaataatcaacatatggttaataaattggtaaaacaatattagaaaaaagagaaaaactaccgtttaaggtagttttccattatttgcaaagcatatatacaatatatcatttcatttcattatggaacataagtgttcaatactcgtcttaacacaatttaagaagaagaaaaaaagactaacaaatgaaaagcttagtgactgtgtcactgtctcttaacccgtcactaatctgttgcaacttctttaatcctataacaaagaaactgtttttaatccgaaaacttcaactatataaaccggcacaaaaaaaccgtcatcaatcaaaacaaattacttaaacaaagatctcgacaacaacgtctacaacgcataattatgtccatgcattgttttttccttttcacaaaaagataacaataaactaaaataaaaactttactattacaacaaatcgtatctcaatttcatgaagagatggccgaaaggaataaaaacatggacccacccgcccatcgaatcgtgcgttacgcgaaagcaaaatattcattaccattaaaaacaatatttatcaacccctttttaaaaatgtaacgaacaaattcaggaaataaaatatttatattcctaatacaaagtgcttcaccaccataaacacacattcactacatgcacaagcacgtatatatataaatgttcatgaaggaagaagctttaacagagagaacaactaaaatagcctaagcctcaaatttaatcgctatttagtttctaattttgggttaaaagaaattcgggtttcaattaattcgaaagagcggtcacgacgtttcttagagaatcgtcttcttcatcttcttcgtgaactttttgttttctcctttttttgattttcaccgccggagatttttgtatttttccgattattcgccggcggtttagagata

SEQ ID NO: 1877 - DNA, 3000 bp, Unknown
  misc_feature (1)..( 3000): cDNA_ID_2146123_gDNA_ID_1620461_Annot_ID_157763 3000 nt of promoter + ATG
acataagcttttatcatgggagttcatctcaagtttggatattgaggtttgtttataaggatcttgttttagctaccaacagattctcagcccagaggaagcttggtgaaggagggtttggggcagtttatagatggtacttgaacgaaatagatatgatggttgctgtgaagaaattgtctggtggttccaagcagtgaaagaaagagtttgtaaccgaagttaagatcattagcaaactgcgtcatcgaaacctggtgcagcccattgtgttggtgtaatgaaaaagatgagtatttgcttatataggagttcatgccgaatggtagcttggacactcacctctttgagaaaagaccccttatctcacctaggacacacagatcttcacggagagggagatcggtgtgtgttgcatagggacatcaaggcaagcaatatcatgttggacatcaatttcaatgtaaaagtaggtgactttgggctggctcgattgatggaccatgaactaggctcacatacaatagcgctagcaggaaattacataattgtcaaagacttttgtctgtgtgtggacatgtgtagggcaagtgaaccacgttttattgaaattcaaattcaagataatccaatcaagtttgacaaaagagaaacaaaaagatagggcaaaaaaagccagcacttaactaggatatgaaatccaaaacataaatagtcaaaaacagaaaagaagataggtgcaagcgagctacactggaatcattaatggaagtactgaatactgaaaattcaaaacaacgaacttgttgtccaagtgactccagtagagtttcagaacatcgccttctgagagatctaacgaatgcttcatagtactccaaccagtaccgaaataatatttaggtttatcgatacctgatactttgagcgtaactgtgtataagtcgtcttccattatgtcgtcgacttgcacttcaacaccgtttagcaaatcttggtcgttaacattcatcctcgtgaggacagacatcacttctgctttcggtaataccacattaccaacgatatcactctttgatagcacttttgttatgatcatagccggttccaatggatcgttgtaattcatcttgcttaattttttttatatttcttacgttctctattcaaacatatatataggagatttagcctaagaaaaaaggtaaaatacaaaagagaaaaaatcagaactctttttgaaacaaattagaaaattgtctaaatatctagatttctcttaatatggaattggaaagtaaactttttgcaaaatattagatttagataactttcacttggtaaattgagaataaagttttgtgcaaattattgatttagatcatttccatttctattctcaatctctttttgagcgttccaaccaattacattgctgccccgaaccaatataatatttacaatagtatcatagccggctccaatggatcgttgtaatccattatggaccgcccaacttcagcccacaaaagaaattgtccacacgaaaacgctcaataatctataaacggaccatttgacatatttaagtgttttgcaagcccaaagtaatcatattcactcaacaaaaagtataaaaaatctgaaatttaatttaggtcgttgctaagcttgttgtagggtacgtacgtttgggagcattttaattagaataagattagaaatttagaatagttttaatcctccgaaactttttgtagtacggacttttgggagcatttttatgagtcgtgccaatcttgcaaaaggacccatgcagagcaacaaatttggttgtggcatgtcggttaggtagcccaaaagcttcattttatattagttataaactttgctgttatatagttagtaaagtttagtcagtaaagtagactgttacttcttttagtactttgaatacatcttatttactacaatgttaacagtcaacatggtataaattctattccatgttttgtttcaaaggttgacataacggacgaattttaaaatgtaactattgtaataaacagtaatgagtattaacttgagttactctatacaattgtttgtttcttgtgataaccaaagccatcacaatcaaacatttcactcttaaaacaaggaaacagtaagtgcaatggaaggtaggatccaagtgcttctctcgcaacgattgtttggttgattctcgtaaaaatgtgagtatatgaaagaggaagttagaccgatgcaatggttgcaatgtgagcatagtcgaatttcacctgccatggtgtttcttcctttttcatcttcccaccggattcactcaaggctcgtcgtttaatccattatcgcctatgtaaccgtcgcttcttcacctgcggccacaaccaatgcaaccgctataacaagtttgtttttgatctctttatcgaccattaagtctctttatatattccttaaaactctatattgcattttgattttctagtgcgtataacattgacgttacagtaaaaatttctagttttaatattcacaagcatggctgctatttcaattcaatataagttttatcatcgtctacaataatatatgaattttatcatcatatagaagaataacagagctctgatcacagactcacagccctgtaactctagctaacaaaattatcttttaactctcttctttattaaaaaaaaagcacttgcatagtagcattttaactgatgtatatgctttccctaagcgacacttgtcctcatgcatgaaatcaaattcaatggacgaccgattcatcttgaccgaccacaaagatccaacggctagctggagatatacaggtgttaataaattgttatattccaaaaaaatgggttataatgtggcagctttttgatagtaacactgatgtatttcttacaataaacgaccaaaaagttaatacaagaaatagaaacggtgtaggaagctact

SEQ ID NO: 1878 - DNA, 3000 bp, Unknown
  misc_feature (1)..( 3000): cDNA_ID_2146129_gDNA_ID_1620461_Annot_ID_157765 3000 nt of promoter + ATG
aagtcctctcaccaggtctttttttaagctttacgatttcgtaaatacattctgtgaaatttgaacggatttgacttcagattttgtataggaagcttacgattgatttcgttttgttttgtagctaccaaatcaataaaccttcgccgtcaaaatccttcacttccaggcttctccaccaatcctcctccgccggtactcctccgcaacaacttttcggcgcccgtagcttctcatctcccagcagtgatttcaacaggtattttagttttcgttaaacgcattttgaaatttcgatttgacttcagatttttttagtagaaaccttatggatttgatcggttaggcttaaacggatcttcgctgaaattatttttttgtagctaccacattaatccgccgtctaactggggaatccgaatcgtgccggagaggaaagcttgtgtgattgagcggtttggtaaattccacacgactttgccggcggggattcacttccttgttccgtttgtggatcgtatcgcttatgttcattctctaaaggaagaagcgattcctattggtaatcagactgcgattacaaaggataacgttagcatccacatcgatggtgttctctacgttaaggttattatcttcgtttcagattccagttttgtatacagtttcctgtttgcttttgttgatatgtcattgtcttgaaatttttttgcagattgtggatcctaagttggcttcttatggcgttgagaatccgatctatgctgttatgcagttggctcagactacaatgcgtagtgagctcggtaaaattactcttgacaagacttttgaggaacgggacactctcaatgagaagattgtggtatgttctctctctctatggcttgagtttcgtttcattttgaaaactgggattctttgatgttcatggtcagtgatgttaatgtgaaatttgtagttcagattgtttaattgtgttgttcatttcacgatagctggctatataagttttgttagataagagtattgtagtgtatgtgttgtggaatgtattatgcttttgtagtgtatgtgttggatattggaagtatctgaacattttgaaatggacatgttcttgcaggaagccatcaatgttgctgcaaaagattggggtcttcagtgccttcgttatgagatcagtgagttatttttctgttgactctttgctggtgttagctagatacccttttggccttgtatctaatacatgtatatccaggggatatcatgcctcctaatggagtgagagttgctatggaaatgcaagctgaagctgaacgtaaaaagagagcccagattcttgagtctgaaggtaaaattgcttgaaagtatatgttctgggattgaactatgtgcttgctacagctcatttcgttcagattcttggctcaatttgattctcataatctgctgtactgactttaacaggagaacgtcaagcccatatcaatagagctgatggtaagaaaagttctgtaatcttggaatcagaagctgcaatgatggaccaagtcaatcgtgcacaaggttagtatttagtaagcatttaagattgaaaaacatgaaatcatcataataagatgtggagccattcgtctgttaacctcatatcataactgactcagtatgtttcaccataacatttttatgtatttgttctgttgctatccaggtgaggctgaagcaatattagctagagcacaagcaacagccaagggactggccatggtatctcaatccctcaaggaagctggtggagaggaggtgatttcctgaattatgagatcaatgaattaactattacttaggcgttaatactgttttatcaaatttggatgtgttagtgctacttaacccttcacatgtgaatgcaatgaatgattccctctagatgctgcataaagatttgagttgtttattggaattgcaaatgttgactctttaagtttatttgtttttgctttccaaaagagaacctcatatgcttaatggtggtgtgatatgcaggctgcgagtttgagagttgcggagcaatacattcaagcttttggcaaaattgctaaggaggtaaacacatcatttacttgatcccatttacttttctaatctcgtccttccttgggatttatctaatagagttgtatttttttgttcttgttagggtacaacaatgctgcttccgagtaatgtcgacaatcctgctagcatgatcgctcaagctttaggaatgtacaaagggttgtcaacaaaggtcccaacagtggtttcagggaaacttctggagtagaatcctctactaacgtggttgttgccaaacttgaatagaagctataatgtagctgaacctagggaacaactattcttttgatttgtccaggctttttagccattttcagtttgtttatttcttcatatgagaaacagttatcttaccatataaccattttgcaaactagaaaacagatctaatctcaaatttctgacagagtttttgcaccagatttggtcttctaagtgttggctcttgttatctttatatcaatatccaaattttgttatgtttgcttttgctattttgttgctattgtcttgaatcgaattggcacagaaagagtatctggctaaaaccaaaaacgcaagagcggttgagaataaggtttggttgttctcctgatgaataggtcgttgacagagaagagccttaaagaacctaaggtgacatgaaatttttagcccttttcctgaaatagctttgtgttgtgttgtgttggtacgaaccactatatatatctcttttgtgtcttcacctacatttgctcagcctctaataaggagaaaaaagaaacaaacagttttggcttcttgaaaggaatcagaatcttttagctccacagttcttcccattgtgtaaatttgttttcgtttcaaaccgatttctttctattaaacaccatg

SEQ ID NO: 1879 - DNA, 3000 bp, Unknown
  misc_feature (1)..( 3000): cDNA_ID_3064934_gDNA_ID_1620462_Annot_ID_157777 3000 nt of promoter + ATG
gatcgaagttcatatcctttaaccgcgtcgatggcgcgtttgagagagacgagtgtagggttaggaaggtcaaatgaaagcggagaagatgaaattgagagtgacgagagctttgaggatgataagagagaagaaagagaagaaaagaagaatttgaaagagaagagagaagcagataaaggaggaaataagagaagcttctcggcggcggagatcacgacggctaggtattgctccgaattgggtttgatcagaagcggattaagatctatcaaaagcacaaaacgctgcgttttggcgtataacaaatctccagccattgaaatgaagcagagagagagaagattcgattttggttttgaggttgaagaagagaggagggagtgagctacgaggttatgtttttggcgggaaacatattgccacgtcattagattgtcaatttattgggtcttgcttactactacatcataaggccattaatggcccaacaagagttttaatttggtgacgtggcaaaattgaagatagaacaaagattacgaaaacttcctccgcttcagatttttcctttctgcaagaattttcctgggaaaatcaggaattttctcggagaaaattctcgtaatcatgaactgtgtttctgcatttgaatttgttccttcaagtgctctatttccatgtgcacaatcatcaatccctgcgaaatttcttcacattttgagctcaaaagcctcgatttctcccagatgtcgtagtttcgcttcttcttcttcttccacaattcggaggaagcctctaactctagtatcttcaaaatcttcagacgcggaggaggtgtcagatacggaggacgaatggctgaagaagctaccagagaagaacaagccactgtattcgcatagcttaccttgtatcgaagcgtggctgaggaaattagggttttaccaaagtaaagacgatagagctgtttggttgattcagaaacctgattggcatgctcaactatctcttgatgtcactgatctctgcattaggtatgaagctgattgcttttgtagtttcattgagttcctgaagttctcagctctgagatgttgttgataaattcctgtttttagtatcctaaatgaatgatttcttaactagtttaagtgtttgtgattgtgtagttaaagctagttgtgttaacaatgaggatattgatgttgagaagaagagtttgtttttagcttggataagtataaaagtatagcatagtgtgatgaattaacctcttgaagatgattgtgaagtgaatcctagttcagtatttgtagtgcggaaccgattgttatgcggttggttgcatccgctgttggtgctatctaatcttgatgttttagtccaaggagttgagaattagaagctaatttaatgtctctgtgtatcaatccaacagaccaaataagttgatgcattgccatgttctctgatcatttcctttggagtttctctatgtgtaatcccgccaagttggactaactagattgcttgttatgtaggtacatgaaaagtgggccgggaaatctagagagagacatggaaagaaggtttagctatgcgttgagtagagaagataccgagaatgccatacttggaggaccttaaagaataaaaagagtttgtttgagtatctttgttcttaaactttgctttttcagtagtttctcgttatatgatgcatttgcttgtttgatccgaaaaccatttttatcacaattctttagcaggtacggtctttcaaaacttgaacaatgaatgtgaaaattatacgcatttggaaccagtaggtagataatcttactgcatcccacatgaagaacctatgcattatctaagctattactaatatgtgaaatttggtgtgtaggcatcggtgactttatttactgatgcataactttcacatcttctgtttcaaacctttagcaagactacatttacgttagtcaactcaaagtaatgagagaaaattaatacatcaaacttaaacatgagttacatattgaacacagaattaaaagtgatatgttactcttgatttatcaaataaagccttgtttcctgatactataaattctaagtttcttccgatatccaaaaccatcccaagcatctaagtctaacataaaaccaaaaagaaagaaagaaatacgtagaaaaaggattaacaagaaagatggcaaccaaaacttttctctcaatctctttaatggtttccctttgtgctgccatttttgtctctcaaggagtagctcatatgcaaacaccaccaacggttccaggacttctcctacctggcttacctattgatcttgtaaaatgttggtcgtctctcttcaatgttgaaggatgtgtgctcgagatcgccaaatcaattttctctggaaaattcgaaaatgtcgaagccgcatgttgcaaggcgttttcaaccttagatgctaactgttggccccatatgtttccgttgaatccatttttccctcctctcctcaaggacaactgcgctcgcattgtccccaactcccctacacacaactaagaacaagaattattgctggtctacgcttttaaattagtcattagctccaaagtctaataagtttcaatgtttattttgttagcaaaatgtgaactatatcttggaagagttctctttttatagtttttctcaatgacataaaatttcaatattttccttttatataataactcttataaatgtgttttgttggttgcacaaaagaaaaacattggaaccgaccaaaaaaaaaaaacattggaaccgaccaaaaaaaaaaacattggaaaatcgtacctcaaaatgcaataaccaaacaaaccttctcatatggatcctatagtatggttatttccggtttagttggttcggttctgtaccgaaattatatcgagcgttttaacgttatccagaacgaagcagagtaacgaagagtc

SEQ ID NO: 1880 - DNA, 3000 bp, Unknown
  misc_feature (1)..( 3000): cDNA_ID_3064922_gDNA_ID_1620462_Annot_ID_157784 3000 nt of promoter + ATG
attcaatcaaaatcatttaaaatgaatatattagccgaaaactaattcacttaacgatacgctgcattatgtaaacattttgtaagaatgagatttctctaaatcaaaaatttttaaattgttcaatgagataccttaaccgatcggttcaataaaatcttcgtaatttctgtacgaaaagttgtacaaatcaaacaatcaaacgtccaccatttttaaaaattacattgtttcactgctaatttgggtctttgcccctactagtttgcctaatacaaccaaaacatcctaaagattttaaaaagagggacaaaggttaaagtgcaaatattttaagaagcaatatttttggggaggaacaaaaagaattaaagagaaggtttagttaaggagattaagacaaaagatgagagattaagataataaggaggacagggtcgcacgtgcaacaccgaaatcttcgaccagagaaacgttatgaatcaaaagatgctgcgcacgtgcctcctcggtcaaagatatagagatatcagataccattgctaataccccttggattcaattttctactgatggtaatttctgatttgtaaaacttgaaattctggtactagattatgatatttctgtgtttacatttatgtagtttagaagtacaatgtttcttcagtttagatcttattcaaaatagacaaatctaattaagcattgcttgccttatttttgatgacgagatttaattcaagttaacgaataatgtttactgaatatttgcttcatatacgagcaggacccatcaagagaactagtttaattttctcaaaggtgcatggggtgtttaatttttgtttgtgtgtacttgtaatattaattaaccagcaaatctgtgtttttttcttcttcttatatatgaactagtttaattttttttccttccccctcagatgcaatggaagaagactagagtgtgtgtgtgtttgccaatcatggagagacggttttgctagccaaagctttgaacagttcagcgaccatctcaagtctagagatcatatataatgaaagtaatcatatcattgatgacttgctctcttgcttgtattatatcatcaatataatgtacatttctcactgggcctaaactacactactaagactagttaagtagtagtgtagtactaatcatgatcattttcaaatcataagttgacgaagactttttttatctacattggcattcatatcaaaagctcttttgtgtaatccgatcgtatattttttgtggttaaccgttaacctcgcctgatcattttgagagtggtagttagaaactttcagacgagtcaagttatcaacaaaaacaaaacagtagtagaaagcaaaggccattggaaaagtgaagataatttcattgggctattaatgggccggatcagtagcccattatccacgaccggtgggaggaattcgaactctagttgccgtcttctctgttcatctagttattaaaaaaaagaatggtactctggcaattacataaaaaagttcccagctttacagatttcgaaacaaaaaaaaagcttgattggttcttgaagtaagatcccaagaaagagagaagcttttgtatttgcatagttgtcatgatgaccttttatactaaactatgcctttcttcctcaccaattcaacactttacttacagaggtacttcagttttgttatccttttcttcttctatataaattttcaaattgtttaaacactgacccagctgcttgatttgtctctgttataatatactgaatcttctttgattttcactgtttgattggggtaaaaagtttagaatttagaatgagtgatgggtgatttgttttttcagcaatggaatgatatagttctcaagttgtttgtaataatgactcaaagaagaagtctttttgttacaacaacaaaagaaaattcaggatttcttatgtaaaattacaacaaaaatgtaaaggtgttagttaatgtcgatagtgaaatggaatgattgaatttacatggtccactttgaatatctctaatcatttctgtggtttcaatttctttcatatccaaatcatcgatcacttcataacagcttgatgaagagtatttatgtcgttgatacagtttttacccaaatgggaaagataaaaactcttttcatattgctgtgtaaccttttaccttttgagtttaaaaagtttccttttttatgttttcaattcaaaactataacattagtggtaatttgattatgtatttctcagtaataaagattggattttactttaaaacctagttaagttattgtttgtttgatggcttttgttgacaattattagtttgatcttgttctcagtaacaaacaatgggtagaaaaatgaattggagataaacaaaaatgaagcgattattggaatgaaaaagtaagagcaagtggggacgtgttaaggggcctttgtgttaacataaaaccaggagaagcatacatttcttgctttatctacctgtaaggatgatgatctcttacatgattctttcaatgtgtttttacatgtgtgtcagatctttcttttattcaccaaactttattcctctctgccatttccatctggaaaaataaaaagctcatgtaactcccactcaacaatataacatgctataccacatgtactttgcagttttcttgtgcttagacttgcaatttcactcaacctttttttaatgcttgcttaagatctcaggcatcctctgttttttttttttttttttggtaccatcttgaaccattttggcttttgccttggatgttttgctgattctttgctttctatttcactttgatttttggttttcctatcagatggatgatagtaggcaaaacgcttcttgagattcagatttagtcatctctgctaagattgattgtgttgttgccctttgtttttttttgtaagagcaaccacc

SEQ ID NO: 1881 - DNA, 3000 bp, Unknown
  misc_feature (1)..( 3000): cDNA_ID_3064916_gDNA_ID_1620462_Annot_ID_157789 3000 nt of promoter + ATG
taatgtgtgtccaaatcaacagctgccctttgttcaggggtctttgctttcagaaaacgtatcgcaatggaaagcgatttccggtcaagctgaagcacataaaaacaacagtgcatggtactcagaattttgtatccaagtgaaacatcaccttgtgacaaatcatgacaaataagaaaacaatagtttgtcttcatgataagaaaccaaccgatatacacgtatgaacaagtcattgctaccaaagaaagaagattcaacaacaacgccacgtatatcattcaagtaccttagggaagcattcaaaacctccacctgtaacattaagcaacgccaaagaaagaacccgttcaggcgccattgcagctaacttgcaagctatcattgctcctgttaatcaaaaagccaagagagactaaataatttggctcagaaaaacaatcaatagtcacttgagtgatcaaacatattacccatagaatgaccaattatgtgagctttcttccaacccaaatgatccaacaaactaattgaatcatttgccattatcgttgttctgtaccaaaacaaaacccaaattgagtgaagaagctaacaaaaccaatttcacaggaaattgttaaaaccgagattaagaacacaaagcagagaattttaagttcttcagtaatgaaattggctcacgtgtactcagatttgtgggtaggcacagagcttcgacccataccacgattatcgaaagcgcaaacctcgatgccggaatcatcggaaacaattcctccgtcgtcgtcatcatcgtcgttgggtttatccgttcccgtcaatcccatgatttgaggaccccatgactcatgggttccggctaaacctgaacaaaattagaaaaacccaattgaaatcaagctcggaattgctaaggaaactaatcaaatgggaaagatggagattacaacagacctatgatgagaagagctttgataggaccatgaccgtacgttctgtagaagattttgattgcggcattgttaagcgtcgtctctgggccgacatcttctttcacgacctcgcaaaacggcatcgctttttttgttctcaaactctgatatctgggtgggatcagattttgaataaccggagaggagaagaggagaagaaaggaaaggacttttctatcggaagagagagagattgggtctgtggtgtggttcggttcggttttttgggtggaggttaggactgccacgtaggattggtcggctggattttattggcgggtaatatctaacaaaggtcaacggtcaaattttttacacgagaaaactatgttgtatagaaatatagcacgtgaaaaacgctagaagtagaagtagtactacgtcaatggaattcatatgcatcatatataagagaagcgataatgggtctgaacacaagtggagcattaacctaaaacaatagcaacttagaccatttgttgaagtagtcactacactattttaatctccggttcaatttgttgaactttataatgttttgctattttgatccgcgttgctttatattatattggtgtggtttcaggagaagacagatcgagacacaaaacaaggcaagatcgttactgacattttatgctggacactagataattgttcaccaggacatgtgataataaaacctccatgacttcgtggctgctttttcattatatatagtttaggtcaccatcttgtcgtagcacaacctgaaaacgcaataccttctcctgaaacggaaaatatttgttgggaagacctatcatttggaaagtacttatgcccgtcaaggctcacaatttagacgaaacgatccaccaacaacttaagctttgagtctttgaccataagtgcgagacgattttcttgtattgttaatttgttattgcttgtttttgtgaactgatccttagttttttttttcatcaaaagtgatcatttagttaaagacttaaagtgcaatgagagtttggtttctttatttttaaactcttgaaaaattaattttgtcaatgaagcaatacaaattaaattgctgaaaagggatagtaaatcgttttttgtccttacggattggtgatgaaaatggtattcaacggatgcaatacttagatgcaccaaatgatttttaccatatgctaaactttaacactaaaccaattatactttacctggtaaatattaaaaggattttttgttttccaaaaacagttttagtatatgtacttaattacataataccgcggttaataaatagttaaaaattaaattagaaaaaaacacatacgtgtctacagttttagtctcgtacataacacgaaaaatcatctaattggttacgtattaatcatatcatttttacctattagaaaaaaattatttatacatttttagtatctactaatacgttacgtgagcacaaaaattcatcttcatcagtgctaataactatgcgaaaatctgatgacgattcatttgtctaacaatttatttagcttaatacgagtttttaaagatgaagcatacccaaatttcccaagagaccaaaacgacaacgtttgggagtagctaatatcgtagttagcgcacgccactaacatcacccattgcacggtctctctctactctcaaacttcaaaaagctttggctttttagattcacaggaaagaaccctcaaaacacacaaaaagctggtgatttttgcattgcaccgattcgcctccatcgattttggacattcttgaattctccctccaagtattcctgtgaaattgaccggaaagttccttcctttttcaatttccggtaaaaaggaaagtaattgggtactgtagacttccttctagggcttgtgaactttctaatccttcagaaaaccctcgaattcgaaaaatttgctgcgagattgataaatgactagttaaagatttgaactttgatttctgggtttgcgattttattcaa

SEQ ID NO: 1882 - DNA, 3000 bp, Unknown
  misc_feature (1)..( 3000): cDNA_ID_2146182_gDNA_ID_1620462_Annot_ID_157790 3000 nt of promoter + ATG
agaggaggaggattacggtggagttagacctggtggagggagagttgtgactagattagtggtttctaggatgcatgttggttgtttgttgggtaaaggtgggaagattattgagcagatgaggattgaaactaagactcatattcggattcttccaagagaaagtaacttacctcgttgtgtttcactctctgaagagattgttcaggtctgaaaaattgctattttgagaacatatttgaaatggtgaatcttgttgagattttgatatgaaatgtagtcagtttattgaaatgctagataatttaaatgtgtgattgtgaggttgaggttgttgacaagagttgaatcactcttatgtagttagcttggtcattatttgttatgtttaagctttctttggtgttttctacctatgggaaatgcatttataatgttggttctttcagattgtaggtgaactaaatgcagtgaaaaacgctttagccattgtatcatctcgtctaagggagagtcagcatcgtgatcggagtaatttccaagggcgttcacattcaccagaacggtcgtttgcagctgcgggggatgattacatgccacagctaagaagacaatcatccgataggtttcctcgtggtaattttagaaataacaacttcagttctcgccagtccaactatgcagaagaagctccagcagttccagttggtgagaatgtctactccgaagagcttgtgttccagattctctgcccagctgacaagattgttcgggttgttggggaatcgcaaggaataattgatttgcttcagaacgagatcggcgtggacgttagagtatctgacccagttgctggatctgatgaacagataatcaccatttcttcggaagaggtactctaaataccctcagatcttcttcaatattatctgttacatttacaattgtgaacttgaagttttgtattcttactttgcttaggcacctgatgatccatttttccctgctcaagaagccttgttgcacattcaaactcagatcatagatcttattccggataaagataatttaataacaacaagattacttgtcccatctagagactctatatgtttggaagggaaagcaggatcagtatctgagatatcacgattaactggaacaagcgtacaaattctagctagggaagaaattccccgatgtgcttctatcaatgatgttgttatacaggtatgtttgtctatttttgaggagtcgagcattttctaaacaacttctggtctcaaaagagaattcttatgtgaatgtcgatgtagattactggcgagatcagagctgctcgggaagcacttgttgaattaacattactattgaggagtcatatgttcaaggagctctctcaaaaggagacaccaccagcttccacatccacaactggccctctcgaaggtgttgcaggagtaatggaggtagcttcatcaaataacacaattcaatctcgtgaaggtcctactagttcgaatctgaacttgcagcaagttagcacaatcttgccacagtttaaggtttttgttctcatcaacaatcttttcaatataaaggcatctgtaatcagttagggtcagacttatttttgccatcgaaacaatgtaatattactatcaggctatgcataattacctgaatacttggaaagtagtctatggttcttgtccattcgtgcaatgtccctatatttacatatatttttctcttggtttttataggaaggtttcggatcagttgcaaaggcgggtgaaagtgaacaccgggaagaggttcctgtcacgacaagcaggtagagaaactcccaaatttgatatattttcccaaaaccgtacaagtgcttgtttcacacctttccttcctgctttttgtttttttctctagaatggcggtaccacttgttactagaagcactcttgaagttgtcttaccagaggcggttgttcctaagctcgttacgaaatcaagaaacaagcttgcacaaatcagtgaggtagaactctttttaactggaactagattggtgcaaatcatgactctaatcaaaatctttgacgctttgtcttatctctttcccacttgatcacagtggtctggagctagtgtaaccatagttgaagacagaccagaagaaacacagaatatcattcgaatttcgggtacacccgagcaagcagagagagctcagagtttgcttcaaggcttcattttgagcagtaagtttctctctttccaaacttttatatccgtattgtactgatctataagtctgatttccgttccttgtttggtgcagtacaagaggatggaccgtgaacttggaccagatcatcagtcaacacagagatgaagatcaagaaactgagaaatgtggagttatgtatgacttgttgaatattaggatttcagtaagcagtagtttagatgaacattccacattttgaccatcactctttggtttctatgttgtctattagtcttctttgtttacattgttctgtaacttatttaaaaaagtcattaaagtttaatccgaatgactaatcattaaagactcatctttaattcacaccacccctatgtatattggaagaacttaaacgctgcgtttcacttgagttaacatcattgagattggggtgtttttgccctagataaagtttagggtgaaaacatagataaatcttaagtcgtattttacaaaaatagccactgctaaaacctcacctgcggcttcacctttcttcgagttcgtgaaaaagagacgtcgcatcgcaccgccgtcgccatttccaccgtcgtagcattgccgcttcactggtgattgattcttccttaacttctctttttgttttctctgttctcttatatccgtcgttttctagggttttctcactccttgttgtggaatctctctttgtagactgtcgcactgaatattgttgaatcgagaaa

SEQ ID NO: 1883 - DNA, 3000 bp, Unknown
  misc_feature (1)..( 3000): cDNA_ID_2146163_gDNA_ID_1620462_Annot_ID_157785 3000 nt of promoter + ATG
tttacttatatataggggaccagtggtcatatttaaactcctgaaatcttagttaatagctcaatcagattattgaactatcgaaatttcggtttggtgttggttagcagcttgattagaaatccccatccttatataaaggaccacatgagtattataaagagaatgcaaggtaaggatgcttaaattggatgtgtctatctcttttggaagttgatagtaaaaagtagcttttggaagttgatagtaaaaaagtagcttttggaagtgatagtaaaaagcatttctatgtgtttttgctttgcctctttgtggaagcttcaaacattcaatccacaatgttttgtagttgccgtcttgagttatctcctccaattaaaatataatgtcataccaaaagaggaaagagattgttatttgtatatcataaattcataatacttagaaagtttgttttttctttataatcaattagaaattattttaagtaatatcatatccataataagtatatgttatgttaatatttttatattgtttgtataatatagattcttaggatttagcatacgattagattttatgggttttgtttgtacagttattgctagctttttagtgagcacgagtaggcgggctcgcccgctagagtcaaatttatctcaatttttcattgtgtcgggtttggcttcttcttgtagacttttcaaaagtcacttttgaatgtagggtgacgttcctataaggtaaataacatggtgacgttcttaaggcaaacaatatggtcaagatggtcttcgagaaaaaaaaaaatgaggattgtacttgataaaaattttacgatcaaatagggatttagtttaacttggatctaaattataaaggtgatttggtgtttagatgaacttaaaatgtggtttcatagatatatagatgaagtcttcttctgaagaaactagaggtctccaagaggtgatagggttgggaggattggatttctaaccagaagttttgatgaaatcaacaaaagagaagtggtatcttgaaataagatcatagaaccttttagtgcataactttctaatttaatttatcaaaaaaaaaaaagcaaaatgaatttaagaaaatgttgaaaatttgagaaatatttttctccacaaatacaaatttcattctaacacttcacgtttcgtaagcgcaatatcgaattgctttatgataaaaactaaaaggcagacaagtgccaaaaataagaggccttcgttatggttatctttataactccccctttaaattcttcttttatttcttgatggatggcatataattttcacattttatatattaagtactatcttatactatcaaacgtgaaagaagaaagtaacatttcactaatgtcagtggtctctcaattcgaataacctaacatgttaaattcaaaagcactcctcaattctcatcttacgaacgtgacttactttttttaaaatacttttctgatattaattaactaattagaataagatttaaccataacatataagtaacacatttttttatatggctttctattcaaaattttgacatataccaaagcttaagtatataatccgtgtgcaaataaaaccccaaatgcgaaaaaggaaattccactaaacaatgagactcctatcattttcactttacggattcatatacatatatagaaattgtagggcttgtaatcatgattgtaatatgaattggactgcctgtaatcaatccagagtcattctacttgactgtgatagttataataatgagcaaccaacttataatcatcataaatttccaagttagctgattaattttaaagtactagatggtaggaagaaaaatggaactatcaatcttttacttagttagtgtaaaattcgttgtcatttgcggtaaaaatttatgactcagtataactttgtaaaaaagatatttcaaaacttgcggtgtacgtggagagagatttcatacggttaaaagcactttttgcttcgtttattttcttgaaatatttgttgttgtttgacctaaatcctaatgaataatcaatgtaatataaacaaagtaagtgatctttgggatatattccaacaatacatgcagtttcaacatgttacatatatacagataaactatacttaatagtagtatacaacaaagtatcgcatgattattctcctaatcttcgcatttcgtttctacacaaaagtcgccgcaacataactcatgcaacgacaaagcgggatcgagggatagagagagcacacaacacaaagagctgcctttgactttttcaaaccctaaaccaaattgaccgtaacgtccatcaacaacacgtcccctcaacgtccatcgtgattacctttattatttcttaccaacaatatttttctgtttttttctttttacaaacactaattctatacattatcttacaagatttacactgcctaaaacaaactaacaaaacatgtgtcttctaagtgataacaatgaaattttctcacgtgtaacgtttcatactatagtttacgtacaaaaacaactgaaattggcataacaaattgattagatatttattggatctatcattcatccacgaatttttgatagtgaaggtacttaattaacaagtcgttttcaataataaacaaacaaaatgccatagctcgtgaacaaagaagcacaaaagaagagcgtacgtttcatttattttattaaattcaaaattttcaattcaattcattaatttattatcttttcttctccttcatgtcttctctaacctctcctcccactatacatcgtccttaacttttcctttttctcgttcaaatgaatccaattcctataaagctttctttaatttttctctcctatttaacccaaacccatttcatataacgtcaaaaaaaacattattaggtcttcattaactcatctccaagaaaacgaaaaaaa

SEQ ID NO: 1884 - DNA, 3000 bp, Unknown
  misc_feature (1)..( 3000): cDNA_ID_3064926_gDNA_ID_1620462_Annot_ID_157783 3000 nt of promoter + ATG
ttcaagttgtctctggctagaagcaagctcaaggaatgtcttcttttgcctccacagctcagaagaatgttcttgcacatctctctcttgtgtttcccttaaatcttgaacttccttttctgctttcactagcctttcctctaacaattcgcatttacgcttctcttcttctattgccttatctttagattccaataaaccttccttttcctttaatctttcttgcaattccagtaagctatgtctcttcctcttctctatattccttagttccttcatcagagcttcaatctgcagccttaatccatacctctcccttaaccaattctgtttctgagacgcgattatgctaactaccttctcgttagcttttgcatcatcatttctcactttcttcaactctgtaatttcacaattggcatcctcaagcctctgaagaagcttaccactctcctcatcaaagattctcctaatcagtaaaccaaatagcatcatttcgtttctcatctcacactgtttctcatctcttatggacatggtggttgctcttacaaaaaaaaacaaagggcaacaacacaatcaatcttagcagagatgactaaatctgaatctcaagaagcgttttgcctactatcatccatctgataggaaaaccaaaaatcaaagtgaaatagaaagcaaagaatcagcaaaacatccaaggcaaaagccaaaatggttcaagatggtaccaaaaaaaaaaaaaaaaaacagaggatgcctgagatcttaagcaagcattaaaaaaaggttgagtgaaattgcaagtctaagcacaagaaaactgcaaagtacatgtggtatagcatgttatattgttgagtgggagttacatgagctttttatttttccagatggaaatggcagagaggaataaagtttggtgaataaaagaaagatctgacacacatgtaaaaacacattgaaagaatcatgtaagagatcatcatccttacaggtagataaagcaagaaatgtatgcttctcctggttttatgttaacacaaaggccccttaacacgtccccacttgctcttactttttcattccaataatcgcttcatttttgtttatctccaattcatttttctacccattgtttgttactgagaacaagatcaaactaataattgtcaacaaaagccatcaaacaaacaataacttaactaggttttaaagtaaaatccaatctttattactgagaaatacataatcaaattaccactaatgttatagttttgaattgaaaacataaaaaaggaaactttttaaactcaaaaggtaaaaggttacacagcaatatgaaaagagtttttatctttcccatttgggtaaaaactgtatcaacgacataaatactcttcatcaagctgttatgaagtgatcgatgatttggatatgaaagaaattgaaaccacagaaatgattagagatattcaaagtggaccatgtaaattcaatcattccatttcactatcgacattaactaacacctttacatttttgttgtaattttacataagaaatcctgaattttcttttgttgttgtaacaaaaagacttcttctttgagtcattattacaaacaacttgagaactatatcattccattgctgaaaaaacaaatcacccatcactcattctaaattctaaactttttaccccaatcaaacagtgaaaatcaaagaagattcagtatattataacagagacaaatcaagcagctgggtcagtgtttaaacaatttgaaaatttatatagaagaagaaaaggataacaaaactgaagtacctctgtaagtaaagtgttgaattggtgaggaagaaaggcatagtttagtataaaaggtcatcatgacaactatgcaaatacaaaagcttctctctttcttgggatcttacttcaagaaccaatcaagctttttttttgtttcgaaatctgtaaagctgggaacttttttatgtaattgccagagtaccattcttttttttaataactagatgaacagagaagacggcaactagagttcgaattcctcccaccggtcgtggataatgggctactgatccggcccattaatagcccaatgaaattatcttcacttttccaatggcctttgctttctactactgttttgtttttgttgataacttgactcgtctgaaagtttctaactaccactctcaaaatgatcaggcgaggttaacggttaaccacaaaaaatatacgatcggattacacaaaagagcttttgatatgaatgccaatgtagataaaaaaagtcttcgtcaacttatgatttgaaaatgatcatgattagtactacactactacttaactagtcttagtagtgtagtttaggcccagtgagaaatgtacattatattgatgatataatacaagcaagagagcaagtcatcaatgatatgattactttcattatatatgatctctagacttgagatggtcgctgaactgttcaaagctttggctagcaaaaccgtctctccatgattggcaaacacacacacactctagtcttcttccattgcatctgagggggaaggaaaaaaaattaaactagttcatatataagaagaagaaaaaaacacagatttgctggttaattaatattacaagtacacacaaacaaaaattaaacaccccatgcacctttgagaaaattaaactagttctcttgatgggtcctgctcgtatatgaagcaaatattcagtaaacattattcgttaacttgaattaaatctcgtcatcaaaaataaggcaagcaatgcttaattagatttgtctattttgaataagatctaaactgaagaaacattgtacttctaaactacataaatgtaaacacagaaatatcataatctagtaccagaatttcaagttttacaaatcagaaattaccatcagtagaaaattgaatccaaggggtattagcaatg

SEQ ID NO: 1885 - DNA, 3000 bp, Unknown
  misc_feature (1)..( 3000): cDNA_ID_3065013_gDNA_ID_1620463_Annot_ID_157805 3000 nt of promoter + ATG
agatcaaaacaatcaacattgatttacttttcttaaattactgttactgtaaattacatgaaaagaaatgaaatccaaaagacgaaacaaacaaacaattattacaagagaaaagagagtagctagctacctttggagattgaagacaacacaagacaagactggtgttgggtttggtgatcatttaaaagttgagagacgaggaagtttgtccctcagatagtaaagtcttgctcttctcactttcctgtgacttaccacttttatctcctttatgttgggagagtatctgttaaattcaaaacacacatcacatcagatacatattctaaaccaagatcaaaacatattacttgattgtgtagattagtatctgttcaagatcaaaacatatcagttacatattacttcattgtagaatcagccaatagtactggaaagttcatagggactagtatgttatgataacggctagactctagagtgattaagattaaaggttggtgcgcgtttctgtagtaaataagcacaaagcttggtgacctataatgctaagacttccagcatttatgtactagttcctatagtatcatacttggagtagcaattatttccttttttcgtgaagaaagctaatacatatgatcagatatagaattgtaaatctcttaagttctcaagaagcgaagactatgactgttcacgataaaagaagctaattccggtttgttttagagttcctaaaatctctctcaaagccaaaagactccttaacaaggtcaaagacccttaactctgactatctaatactatttacatttatacttatcaatatacccgagtaagtgtgtgataataggatagttaaggaagaataaacttacatgggaaagacgatttcaacaccaatgcctgcaataatcctccggatacggatagtagtgtggatgcctgcattttgtctagacatcacaatacctttgtagatagatagcctacgtttgttctcaggaacttcctgtaaaatcaaacccaccatgtcgtatcaaaatcttgcagttaaatgcataaattgcataagattatacggggacaatgagttttaccagtttgatttctacaatatccccagtcctaagtccaggaaccggtcttacagtctctgcaacctcaatagctttcttgttcagtagctacagaaacaaaaagcaaatcaacatttcatttctccaatgcctaaaagataactgatgatttaagaacaggagccaaaacaactacagtatcagacatgtataatcagattcagagccaaaacaaaacactagacaatctcatagaatcacattggataatgaactaacccccatgatatctccgagcttgactctcgtcttccacggaggtttagcttcctccgccgcaacagtggcttctccttctccttccgcttcagtttcaacagcattctccacaacagcctcagtttcaccttcagtactctcttcagctttagcgataaactcttttctcttcttggaatcgatggcgaaaccaaaattggagctcgaatgattgagaaaaaccctagaaactgatagtcttgagttcactgatgatgctcgtggtagaattgaagaaacccctaaattcttcgacgagaaagaaggggttctcggtatcatatgcaatgcctggttccataaatggtagataaatacagaattcaaagaagcataagtatgaaaatgtgattgagcgtgagagagtgaagaagaagaacctgaggaagaagatgagagctcgtcgccatgtttgcacaacccaaactcgaaaccagagtaaagaagagccttatcgcttatccgctccgtgtatttcaatttatgggccatttactaattttatgggcctagacatttaggcccatattcaattgatataacaagaaacccattaccaaagctggttctaccagtctaccaccacgaaccaaggcttgtccaagtacactaatgtagaaccaaaaatggtttaaataaagagtttctgttacaaacaaatgtatgtttatgtgtccttaaattgatagctctaaataatctactttgggccttttaaaagttatgattgacgaataaatttctgctggagttgaaatattattctatgtgactatgttgtatattcaagtcgtctacatgttcacgttacattgacttacaccgcaagcgatgaaaagctattatatgttagtttaatcagaataccaaaaagataataatcaaaatattccatcttctttctttgtgaaacgaatatatattctcttacaggtggtttaattaaaagcttgacaacagtacgtaatattagcatacatataaaaagttacattaattggatacgaaattttaatctcctaaagatagttattctccgattgtatagaatcaaaaaagaaaagaacaaaaatcgacaaagaagaagaaaaaagattgattgattcttttgtcctccacgcatctctctgagttggctcggccacgtcagcattcaaacatcaaaaccaaaacgcatttaaatgtcgaaaagagtgggtccctttttttcttttttcttaaccgtgtcattgacaaaaagagcacttaataagccaaagccacatagaagaaaaaaaaaagaacattcacgtctctctcgtttttttggccgacgacgatcgctgaattgactgccggagattcctttaatcgtcagattctcgttgagggataatgaatcctgaatagtaagaaacttgtcttctcgttgtttcatgtatctattgtttcggatcgatccgcgttttttattttttgatgtgtttggtgatttggtttttgttcgattttgctttggatctttgttggttgttaggtttgtgaattgaatctacctaattttgctcgtttaaggtattttgtattagaattttgtatagatttggattttcgttcc

SEQ ID NO: 1886 - DNA, 3000 bp, Unknown
  misc_feature (1)..( 3000): cDNA_ID_3064989_gDNA_ID_1620463_Annot_ID_157821 3000 nt of promoter + ATG
tgtgtattcttgctatataagacgtgcaaagtgactacttatttttgttttatatagcatgaacaagatgatgtatttggtttgatctgattcttgttttttttttggtaatggaatccagagaaattggaaatggagtaataaattcaatgttcttgccacttacacaacaagcagaaatagcatgtgagaatgtgaaggaaatgaaagagttgagtcaaggatacaacattgttggaagatctcaggttcttgatacactttcttgaaaaccctaaaataggttttttgatcactataacacgtttcagtttcatggatgtttgatgaatgatggaacaggggaacctagtggctcgaggcttgatcgagttctgcgacggtggacctcctgttttcaactatatatccttagctggtcctcatgctggcatttcttctcttcctaggggtctttgtggtgtaagctttttttatttttcctcaaattatctaaaacttttatctgtaatttaattttaatcaatcaaggtaacaacaacgattgttttgttttgtttcttttcttttaagttaacgtccgatccagcatgtaagaaatttaatgagttgatcaagggagctctctatagcgagaccattcaagtatatatatctctttctctatatatatcatgattaaagactcaattagaaaataataaaaaatcttcaatgactctgcaggatcatcttgctcctagtggttactacaaaatccctaatgtaagtccattcaccatttgtttataagaaaacttgcaaaatcaacaaataagtgattgatgatcaaaacaacaacataaagttttaacaaaatctttgtttttcttttatttattctcaggatatgaaacagtacttggaaagatctaagtatctacctaagcttaacaacgagataccaaaccaaagaaaccaaacttacaaagaccgtttcaccagtttacacaacctggttcttgtcaaggtttggtctcatcaaaaccatctagacttttcaactatcttctcattcctttcttgatgactctgttttttttttttacagtttcaggacgatgaggttattactccaaatgattcaacttggtttgggttttatccggatggtgagttcgaaactcttctctctgctaaccagacaaagctctatacagaggattggatcggtctgaaaacattggatgatgctggaaaagtgaagtttgtgagtgtacccggtggacatgtcagaatggcagaagaagatgtcgtcaaatacgttgtaccttatctccagaaccaacagcctgccgcacaaagcttcaaccgcaagaccaaggagcccttgcatccttaaaacagagcaaaaacctcaattgttatacttatacttagcaaaaaaaaattgttatacttgttcatgcaatatcgaaaaagcctagtgatgactttgtagaacaagaatccttattattgatatattgatatatacatacctatatgaattgtcgaattaatccgttgagaaacgacgaatgaggtcttcatcaccagttttcttcaagacttcaatgattatctcaacatgagaaacttccaactaatctcattttcttatcaagcatcggtttcacaagcttatagctagcagcttcccaagaaagcccatttataaattaactttggccaatcttttgcaacatcttcaatatacataaactaaccaatataatgcatcttctcgatgcttgttgaagcagtattgatcagagtcatcaataacttatattgtctgcttacagaagtgagtcaatgtgtccattgtaagtattatttctatctaaaaaatatttagagattttattctttacagaaggagcaaatttatttgtatatttagttgtcaaattaaaatttagtctatacattatacaaggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccatcatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatataaacataaacgccaatcgcagcttttgtacttttggcggtttaca

SEQ ID NO: 1887 - DNA, 3000 bp, Unknown
  misc_feature (1)..( 3000): cDNA_ID_3064981_gDNA_ID_1620463_Annot_ID_157826 3000 nt of promoter + ATG
ggctaataatattcatgccaattgttaatttctggtggagggttaacacttgtacataaatacttaatttttctttttgcagtttttgtatagatatccatccttatataaatagaaaaatataaggaaattgtaatgatttagcataagacaattggataatcacaaatgcattaaacctattaactagtctatatagaaagagttattagttacagctatactatttgtggtggcattaatatatagtaacttatttaagatatatgtcataatgttaaaaagaaatcacagagaaagctgttattttttttaatcctaaatttaaaactttggatattgagattagcctgtaatacatctttttccaaaaaatttatacaaaaatggccattaataattaatagtaatagctagttggacttcttagttcaaagtaattcaacattttttctaaaataaatcttctaataatagaacacgttggattgactaattaagtcaaatatgaaatatggaaaaggaaaaaaatccaccaacgatacaccaaataatttccgatttttatatatataaataaacatactaagagcaaaagaaaaacaaactgaaaataaaaaaaataaataaataaaaaaaaaaatccggccagataaatcgaatttatgtaataaatccgaccagataaactgatattattgtctttcttccgctcctttgtctctctatctctttctcacaattagattctgtgcttcttctgcgatcaactaagatccgatccgcgagcgtttcagacttcgatcagatccgattaagagaagcaaatcgggtcgggtatgactcgtcgatgttctcactgcaatcacaatggccacaactctcggacttgtcccaatcgcggcgtgaagctctttggtgttcggctcaccgaaggttcgatccggaaaagtgcaagtatgggtaatcttagccattacacgggttctggatcgggtgggcatggaaccgggtccaacactccgggttctccgggtgatgtccctgaccatgtcgctggtgatggttacgcttctgaggatttcgttgctggctcttcctctagccgcgagagaaagaaaggtatcttcgtttgatttctgagattaaattttttatcaaattccaaatttttgtaattgagtttattttgcatcaaagtcgttgattgcattatgtaacaagtggtgatctggtttatgtaacaagattttgatgtgtgtttgatattggttttgttgtaggaactccatggacagaggaagaacacaggatgttcttattaggtttacagaagctgggtaaaggtgattggagaggtatctcaagaaactatgtgaccactaggacacctacacaagttgctagccatgctcagaagtatttcatcagacaatccaatgtctctcgtcgcaaaagacgttctagtctctttgatatggttcctgatgaggtttgttccttcttcattcaaaaacaccatttttatttatattggagtggttacaaaatgtgttgagatactgatttaaaggattcagaagcttattaggtggattggtttgccttctacatttcaatatgaaaagttgaagtctgttggggttctaattgatatgcttgaggatatcattttgtagccaatcctgcttaagcattttggtcttctcatgggaatgtgatcttgaaatgtaattctctttctttattctgcttatgctgtgtgatttgtccttgtaggttggagatattcccatggatttgcaagaaccagaggaagataatattcctgtggaaactgaaatgcaaggtgctgactctattcatcagacacttgctcctagctcacttcacgcaccgtcaatcttggaaatcgaagaatgtgaatcaatggactccacaaactctaccaccggggaaccaaccgcaactgccgctgctgcttcttcttcttccagactagaagaaaccacacaactgcaatcacaactgcaaccgcagccgcaactacctggctcattccccatactatatccgacctacttttcaccatattacccgtttccattcccaatatggcctgctggttatgttcctgaaccacccaagaaagaggaaactcatgaaattctcagaccaactgctgtgcactcgaaagctcctatcaatgttgacgagcttcttggtatgtctaagctcagccttgcagagtccaacaaacatggagaatccgatcagtctctttcattgaagctaggtggcgggtcatcttcaagacaatcagcatttcacccgaatcctagctctgatagttcagacatcaaaagcgtgatacacgctttataaaagacctgaggaagtgatggtctaaaatgggatctggtttggggtttacaggttagttgttggtcacagtaacttaaataagtttttctttgttaggttgtttaacttgggtaggatgttttagttcagctttgatcattagggaaaagaaaaaagaaaaaaaaaagggagaaaaacaaattattattttttgcttacatttctttatatttgtatgcttttattttgactctaggatgcgttaattttcgtttaatctgtactaaaaattagaatttattagttttgaataaataaaatcacagtttgtttatcctctgaccaaaaactataactggattgaaaacggaaattaaaccaagacgaaccggatttaaccggactccagtgttgtaagagaaagtaaacaagttcccaagcgtttcgtaagtaaaaaaacgaatgggctaaacaattagtctaaatgggccttaaaagagtgaataacgtgtcataatcaggagcgttaaatttagggcgatgagtgtcgagagtgttcccgcgttcaccgattcactccactctttggttaaaaagtccactgtcatggaaaattaatcgcggtgatttacacag

SEQ ID NO: 1888 - DNA, 3000 bp, Unknown
  misc_feature (1)..( 3000): cDNA_ID_2146310_gDNA_ID_1620463_Annot_ID_157827 3000 nt of promoter + ATG
gacacttatcaaaggttttccagggagtaacaagcgtgattctgatcagaaattggagtgtaatctctacataaggcttctttactcttatttgaaagcatttgttcctgttttcgacttaaacgctcaccagccttatcgtagttctcttttgcattacggaaatgggtatgatgggtcagtgatgacaagagctgagttcttggtgaatgttttcgtgcattattggcttgttgagaatgacttctcaccatttcctgttgttacggctaaatcttttggtgtggctcctcctttccgttctgctgtggaggagattccacctacttgtgggttggaagaagtagtgaagttgcttgtcaagtatctgaatttgagttgggttacaagtggtgttgggagtgaaaactacattgagtatggcgagagtccacggtggaagacaccgacttcaggatcgtcatcccatgtcgcgaatttgagcctcaggccgctcacttcctggaacacccatttacagaggccgctttatcgttatatattgaggagtttcttgttctgtcccataggaagctcaattaagaatgcatctcaggtgttctccatctgggttacgtacctggaaccatggatgatcagtttggatgatttctcagtttttgaacctgctttaagtggatctgtaaaagatatgaaaaaggaagattcttatgaatcacgcgtttgtggatacacgcctttgtggcagagctatgtgatatccaattatctctactatagttctctggtcatgcattttattggctttgcacacaagttccttcacacagatccagaaataataactcagatggctcttaaggtttgatccctggcttaagctattttctcaaattcatgagtttatctgtagaatatggattgcaagacttctgtttgaaatcttaatgtgactgaatggttctactgtgtctccctaaataggtgatgagtacgttgacatcgtcaaaagagcttttggttctgatgaagaatattgataaagcctttcactctaaacaaactggaccaggaaactcaaaagtgaacgaattgtctagattttctccatctatccgtgagcagttgaaggtatgcctatatttttcctcaacaccagttgttatctgttctccggtcatagaacgcttttccagtgattttactcttatgtatccgccatcctttgtcttcatacttatttagctttttcatcataacacccttggaagtttaacaaaagactgtaaaatcaatctttttttcacataagtcacataagtactcaaactctatactgaaaaatcatgtttaactgcttgtggaacttcaggattgggaagatgggttgtgtgagagcaacgctgatggctcatacttgcatgaaaactggaacaaagacttgaaactctttagtgatggtgaagatggcggacaacaactgcttcaggttaatgtcttccttttataacctactgtagtgataagttaggaataaaaaaatggaagataatctttgtaggatgatatcttcaaatgtacttaaaatagctctattatggaatgatctagttgacaaatatatagataaaccttcagatttacttgtttgttgtttgtagccttctatctatattaacaggagaatttgttacttgacaattagatgagtacgcagtcatcggcaatgttgtgagctattaacttgggaatttgttttttgagaaattgttcacggaaatatactttgagaactagttctcctacatttgtttttcagtaacctagttgtatcgcatgttttcttgtttccgatactctactttagtttatacgactcttgaatcctttagctcatagggggggagtggagcttaaaacctgttttactttgctgaaggcgtttgttctttgcatttgcagctattcatactgcgggcagaagccgaactgcaaactgtatccgataaaaacctcacagaggcccttaagtgtgtagattcactaaaatcagcggtttccaacttctttggcgggcatgtcgtaaaaccaatcgcttttttcctagagccggaccatcctcagaaaaaccgtgacgagctcttcaagccacgtggtgctggtaaccaaacagcaggcggtgtgaagtacaaaggggactggatgacccgtccggtgtcagaagacgaggttgcattgatggctaaactgctaatcaacatgtctatttggctcaatgaacgcctcgggctgaacaaatctgagacgagcaacgacaagaaagagaattcagagtcagtatcatatgtagatgtatcaggggaagatgtgggaaacgttgcaggacctggagatgctgcgaagatgctgttgcgagggatggtgatggtatgtggcacagtgttgcagctgatgagaagattcgggattcgagtcaatcttcgggttatggcttcaaaaaagtttctgatgcttttatttctctatgtcctgtttcttgtagtcaaaagggtagtcacaaggatgatttggtagatgggtgtccaaaatgtgttaaaagttgaagaagtaaaaggaaatagacactctaactcgcgtagagcgtttgataggaattggaaagcttatttacgaaacagggactgagttttttggtaatttacatgttcgcattacaaattgaagcgtgtctttacttgttacaaccaatgagaatggtccacgtaatcagtctccacgtgtcatctgccaataagatccacccatcagcaaaattcatcggtcgttcgtcgctgactatcacaattccgaacaccaaatttcgaatttctgccacttgctttgtgatctgatcgttcgaaattgaccggagaattcttctgtgttcttagatctgtcgcgaatttgttaaagctcctcagaaggttttggttacagatcttctctgtggtcttcaccact

SEQ ID NO: 1889 - DNA, 3000 bp, Unknown
  misc_feature (1)..( 3000): cDNA_ID_2105036_gDNA_ID_1620463_Annot_ID_157825 3000 nt of promoter + ATG
acctcaaaagaaaaaaacaatcatatgaaatacagctttaaagtgtcttacttgcattctagtgaagttgtttgcagattgtgaagctccattaccagaagtgtgaagatcccgctctgacgacgcactgggaagatcataaacaagaattcgttctagcctctaggaagaaacattctaaacagaaaaagctctaaaacagacttctttgcataacagtctctatctacgtcgttttcatcatagagacgtttaagcaaacattggtgtgcaagaaacatcgagagataatctcaaaaacccattaatggatttaagataaagattcaatattagtgaaaagattgagcttaaactattgaagcgagagtaccttttagagcggccatgtttatgagaatccaggcaatgccaagaatctccgtttcttctctgcttgttaccgtctttattcaaatcaaaaccacccatatatctcagccaaaaccttaaactcagatgatgaaagtaatcaaagtctccaaaagaatctcagtaaaagaagaaattgataaaggagtgaattcaaatgcagcaaaggagaagaaagaatgaagaagtaaatgcagagacgaaaactgaaactgtagcttagcccataagaaaggggaccaggttagtagtatcagagtgcctgccaaaattcaattacatttcactttatggttgttgtattgcatttaattcgattttttttttgtctcattttaaattcatagttccatttccctccttttttcgagaaatacaacacttctaggttaggaaaattcgcataaatagttatactcttaattttctctggtcaaataatattaagaacacgctacagtaggacagtgcagtagttaatgttgtcatgtcggtccgagtacattgagaatttaatgttccgatataaatttccttgttttttcccaattttgaaaagtccgttaaattttcatatttattcaacgagacactgtactttcagtttccaccgaaaaataattcattactcatcatttattcaatgttcgataatttcttggaagcagacagcatttgggcctcgagatttaaattggcccaaggtccacgtttacttgggtcaatcacagtcaaaacgttttcccggggtttctctcaatttttttgtcaaagtctctcaacttttaaaaatacaaacactgggatcctccacggcatgcaaaaggatattataatgaagatgaaatcaaattggtataaaaagttggagaaaggtataaacactatgtatgtggctaaaaatagctagaaacttataatttaggtgaaagaagatttgagtaacgttgttgttgttatataataagatgaaataatgacaagaaatctgaaataatatgcgaatatgccaccgacgggagaaatacacgtggacggctgataaagctttgtgaaggaatcccacaataatataagaagatctgaccaaaggttcctttctggataagccgctctcctcgtgtccacgtggcattttcaaacgtgggacctcctaatctatatcactaaacccatccactcatattatctctctttctatcatctaaaatccaaaatgttcgtccatttttttttttctgttcataaacaaaaactgcattgccttttaatttattcttcttctaatccatacaaatgattatggaactataaatctataataataatacaattaaccacaaaataaaatatatcttagtattataagatatgacttttggagttagggggtgtctaatacaaatattatggtatttgtaatcttagcaagaaatgaaatcacaatcatgtttatctttcttaagataacatattttactcagtcatgggtctacttttattttcagtttagattattaaataaataacaatagttttgtcgccttactatatgaccaaaaattagattttctctatgtgtaggatgttggcatttgtttaccatttttcttatgataacttattaaacagatgtcatattttacttatttgtgtttataactgttaaaatctagtcaagctttctgtatggaacgcgtgaagggctattaagatattttaaaatgttgaatagtgtaattaatcttgtggctaataatattcatgccaattgttaatttctggtggagggttaacacttgtacataaatacttaatttttctttttgcagtttttgtatagatatccatccttatataaatagaaaaatataaggaaattgtaatgatttagcataagacaattggataatcacaaatgcattaaacctattaactagtctatatagaaagagttattagttacagctatactatttgtggtggcattaatatatagtaacttatttaagatatatgtcataatgttaaaaagaaatcacagagaaagctgttattttttttaatcctaaatttaaaactttggatattgagattagcctgtaatacatctttttccaaaaaatttatacaaaaatggccattaataattaatagtaatagctagttggacttcttagttcaaagtaattcaacattttttctaaaataaatcttctaataatagaacacgttggattgactaattaagtcaaatatgaaatatggaaaaggaaaaaaatccaccaacgatacaccaaataatttccgatttttatatatataaataaacatactaagagcaaaagaaaaacaaactgaaaataaaaaaaataaataaataaaaaaaaaaatccggccagataaatcgaatttatgtaataaatccgaccagataaactgatattattgtctttcttccgctcctttgtctctctatctctttctcacaattagattctgtgcttcttctgcgatcaactaagatccgatccgcgagcgtttcagacttcgatcagatccgattaagagaagcaaatcgggtcgggt

SEQ ID NO: 1890 - DNA, 3000 bp, Unknown
  misc_feature (1)..( 3000): cDNA_ID_2146287_gDNA_ID_1620463_Annot_ID_157819 3000 nt of promoter + ATG
tataaaccattcaaggatgtgtggttggattgaagccgtcctattcatcattataccatgaatgattgatggtgatgaccatttttagtatggtatttgtgttttgctttggtttgcctcgggacttaactctcttgttgagtacagttaatatattcagtcatttcattacttgcgtatttaaccagaaccttgccgtatcttttttctgtgcagcaagagtcatgacaaacaaagtgaccgggaggtctagaggttatggatttgttaacttcataagcgaggattctgccaactctgctatttcagcaatgaatggacaggttagaaatctaaagaatcattgatctatctatttacctatcatgtcaattgctgtgttgtatggttaatcttccccttttgttggttttgggatggtgaaataggagctgaatgggtttaacataagtgtgaacgttgcaaaagattggccaagtttgccattgtctttggatgagagtatagaagaagctgagaagaaagaaaataagatgatgagccgatctgtatggaaagatccattcgttgatgcgttcctgatgaagaagaagaatgcagctctgaacaggaaaatatggtcaaggagatcgacgattcttcccgagtatgttgattcggcggtgagaatctacaacggcaaaactcatgtgcgttgtaagatcacagaggggaaagttgggcataaattcggagagtttgcgtttacaagaaaagtgaagaagcatgctaaagcaaagtagcatctttgagaatgaattggtcagctgcttgaaaggattgtgttgaaaagccaaaaacgaatcaaatcaataaattctcaataggtaaaactcattagctcacatgatcatgtagacgaatattgagctttagaaagtctttagttttcttgtcgatttcgtatttttggaccacaaaagtgccaatgttattttggaattcgattaacaaatatcaattgtggagcttcaataaccaaacgaacgatgcacctccatagtgcttgttcaagaacttgtattgtttatatacagaagcaagccaatggggccatgttgagtattctattcgatctaaagatgtaaaagaagattgaaaatgaaatgagaatccagtttaaggtgttgttggatggtactagtgatattagaggcaaatggtgtgaacttgttgacaaaattgtgtcttcttctctctttgagttcacatttcagtgtcataattcgtaagatttgcgagactaataattagtacaagaatttattaatcaatattcgtcgttactggttatggatttgatatgtttactcagaaactgtcgtctaggcttgaagggatttattattcagttcacattttcatgcaatggagccctcacaagacctgtaataagacgagttctatttgtaagttttttatgatttataaaaagctcagaaattcatttatagtctatagcttttatggtttacatcttgagctgaaaaattaaaacttttgcttgtagatattataacttacataagctatgaattatatatataaatttgtatttcggagctaaaaatgttataattttattcatagatttcatacttctatgttgcttacctaaaatgttaattcaaccatatattttgagtgttaagggggtgtaaaagcatatggaattatttgtgttaaaatgacaaatcctctgttattcaatcatcaatattaaaaagttttataaaaatccattgttattgaaataatgattccaaaaaagtaccatcaaatccagtattatggaaatattataaccactggatttttgaatgactttaaggtggtttataagattttaacatgttttgttttttggaatttggaagaactttagaacaaatcataacatttaatctaaaatcacccaaaaattcatctaaaaactcattaaaattcgaatcattcaaactatatggttggataacatagaatttgtcatttcaacaccaatcatttcaatgtgatttattgattatattttttatcatagagagagcaaaaatctctgtcaatggcaagtaggtaccaagtagtggcatgagagagtgatgtctggatttattgatttctttggtagcttatacttccatatgtttccttatttaatttttcattccaaatatgggacaaagttataacaaatagtattcgatatcaaacgtcaaaacatgtactcccaaatatattttattggaatatagttttggagatatttttacctggggggagatggaaccaaaataagatctagaaatgtgattggctaacgaaagaagcacaataagttaacaagtgacagtgacaatttatccctcgacaacaacacacattcacatatatctttttattttattatttttctgtgtgtctttaaagtttacagcacaagtagtttctaaatcttataatcaattttcattgataaacagaaatttaaaatatttaaatagacaaataaatgatcaaatctatatttctatacaagagttaattcacaaaaatttgttgtgaaacaaactctttctatatttctatacaagagttaacatatttctatataagttattgtaaagatcaaaatatgaaaattatggtataaatgcatagacacatatatacgtgccctattaaaagaggcagcgagaagataatataggaggaagaggaagaagaagaagatggtgaagaagagagttaatgcaactgcaagaagatagtaactaatcagcaccgtccatttttgtcatctaattctttcttacttggccgcaacttccaaccacatcacacactctttctattcccttatatattcccatctcaaaagttcttggagacacataaacattaaaaaaagaaaaagaaaaaaactataaacataaacgccaatcgcaactttcttgtctttca

SEQ ID NO: 1891 - DNA, 3000 bp, Unknown
  misc_feature (1)..( 3000): cDNA_ID_3065005_gDNA_ID_1620463_Annot_ID_157811 3000 nt of promoter + ATG
gaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgtacacgtaggtgcatgcgatgaaaaaaacatctatttgttcatatttttgcgtttttctatttgttcattctttttcacaattcacaatacattatttcagttaatgattacggataatttagctttacgttaatttattatgagtactagaagaaatcggagtaattcaacatatagattatactagtataaatgtcaattgcattgacattaattgaggaattatagtagaacctagtataaaaagaatgattcaaacatgagatattgaccggcgttatgtgaagttgttcagacaataaatgcataaccgtgattctgtctgaacaagtcgattcttaggataaaaaatggataaacttagtcaaaatatttcccacgtggttagacttttgcttagttacatgacgaatgtgaaagccatccatgcatgtatccagaagaatatatcttgcacggcgaattctctacgtattttagtattttagatttgacgacatctaattttcttttggtatttcgggtttgacatctaatctgctaagaaccttttcttataatcgaagaattttgttgggtcgtcttgtaagatattattttcagtacacactatctaatcattcatcaaggtcactaatgggccttgtggtctaaactttgaatatatactttcacctatgaaatccagaagttctggctgggtaagttctaaaccaacctatcttatacatcgaaacacaaaagataattggaactacaaacaaactttacccaaaaattattagtttgtttttatctccgtagatgaaattgggttttctaaatcgttttcgaagatgaacgctaatcaaacaaaagtggtataacacagtttgttacgaaattttgttaggaaaataaatgaagtatgtgttttgcgtcgacctcaaaataaaatacatattaaatcttgcatgctaatattattgtatagaataccaatcaggtaagaatcgctcgtcatcatacgactattcaatatccaaacatatttatttggaaaacccgaccacgaataatggttagctttacatcattatccacacatactcaaatggttaaattttctagaattgtaatggaagacacaatgttatcacgaatgaggatcatcatgcacttcaggttacctaattatcctacgtggacaatacctaatccttccatgattttcaattattgcagataatttttctgaacgtcatcatttcccataacgaataatcatttcctcaatcaacgcaaacctaactatctatgtcatttacatgtttatgtggtaaaaatctgcttagaataagtaaaccttcacatatatattgtaacaaaataattgaggttaatgttattcaatgcgaaaaaatgtaaacacttgctaatgagtcgtaataaccctatattatttttccaaaacatgtttctattgaagttacaaattaagtttccactctatttggatggagcgtactagtcgtagacacggagagcttccaagtccatcggatcaacttatcaaacttatcgaccttttggtccacaacaagatatcttttgtccatcttcatcatggctctcgcaagaggatgggttacatatatggtttgctttattgcttaatagggattaatttctctaatacttttgattagcttttcgcaaacatttttcagcataaggacgcatctgacgtacaaattaaaaatccaaatgaactaaaatacttttaaacagaaaggacaaggaatctaagccatcaaggcccatctccacgtagctccagcaacgacaagatgctttattatcccattctcgtggatacttgtgtgagatacacgcttcagataaatcaacggacgaaattgtaaaaagcgtgaggaagagagagcctctttccaaaggagagggattggatcattgagatatatccgtttatccatccttgaactcctgaagattccttcgcacagacaactctctcgaacatgttaaagattctctgatacctaactattgattcctttttccctgcatttttcgttcactatttttgcttataactttttgtactaaaattaaaaatcatgccaccatcctgtatttcatatccaaaagctttggattattttataatatatcattggcttgatgtgattgatatttaccaaaaatctattctagtttctttttgtaacaccaaatgttatttaaaatttgtattggaaaaatgattcatttatataagttattatatccctcttaaaaattgtataaaatctctaagacattattaattgtaaaagatagacacaacacgtagctatatgtctatatccaaaaataaaacacgtagctatatgtaatattataaaaatgtacatatattattagggttgtaatatttggtcggttgaaaattgaaatcgcagctcaattggaaattcacgtgtattttgtctttgattgtaagatattaaaactgttcttcgctttccttttctcatttctcacttaaccactcgatccactttaaaccacacattataagtgtgcctcaaaaaaatctaacattactctctcaacacatctctctttcttctccatttccttcttctctttcattctcttatttaagatttaaatctgctcaaatgcttgtaaacaaatttcaagttctttaaacgatttccttttcaagaaaaatccttctccttcttctttttaccacatagatcttcttgatctaca

SEQ ID NO: 1892 - DNA, 3000 bp, Unknown
  misc_feature (1)..( 3000): cDNA_ID_3065001_gDNA_ID_1620463_Annot_ID_157813 3000 nt of promoter + ATG
accttcccattctgttcccgactctgtgatatcgcagtttaccatttcaagtttgtggagactactcaacgtaccaatggctgcaaatgatactttaagtccttctagatatataccctgcgtcatccctgccaatcttgtgcttcctagaaactcttccaaaacagaatcgttattcacagtaacggtcaaaagttgtaaacccttcaactgctccaagatcttgagcaagcagcaatctaatgcagcagcagaaccataaaatctgagaacctgcaacttttgtaattctgaaatcagaccgacgcttcgaagattggaagtggactccaaattcaagtgaatcaatttactcaagactcctaaaccttccggcagatgctttatactcgtccctgataagttgagaagccgcaaagaaaccaacgccgagattccttttggcaactcggtgatttggaagttccaagatagatccaaaaccaccagagtcgacatgaccagaaagaatttaccaacaatatctaccaacctgttattttgaaggaacaaggttacaagatttgtctggtcaggaaattcaggatcgtctggtatgttcttaatctcattgttgaacagagacatctttgtcacagttgtccaatcggtgacatcaggcagttggcttaaaccagcatctgttttcacaacatatctttctccatccctaaattcagatactatccacaatgccatatcacggatcatatcatgcatatacactttcttattagactctaataacaaacctgccccaacaagattatcgatgatctcatagcctcgatcttttgctctctctcttccgtctttttcatctatgaaaccctcacctatccaatactctaccagctcatcttgtttgatataatatgccttgggaaataaagcacaatacagaaaacacttggcattttttgttttcaaataatcatagctcaacttcaaaacttgaaatattcccttctctgtacctttcatctcactccgataagactccaaagtatcgagtgcacgacgccattgaatcacagtagatttagatgccatagtctttcttataacttcaagtgcaaggggtaagccacaacacttagccacaatcttttttgcaatatcagaaatttcatttaacccgtcgcaatggaccttcatatcgaacaaatcccatgcgtcattctccgacaaacattgaacttctatgtcctcatttgccctcataactgaacagacatccttagaacgagtagtaaacacgactttgtattttttaccgagcactgggatgcctattgctgttaaactcacatcctcccataagtcatctaataacagcacgaaccggggcttcatatctcttagtaccctgcttatttcactagctttcttccctcttgagtatgtagaccaattattgtcacagatgtgtaatctttccccgatggcatcttgaatcttcccgacatctgcatctttagacgattcaacccaaataacaacatcataatcatcactgacttcaacgaacttgttgttaattagagtgaggagggtagttttgcctacgcctcccataccgaagattcccaacattctgttttcatcttttctaagactttcccaagtcttttcaagcgtcgtatcaagaccgactgtttgttggcaaagtctcacttctaccacaggaggaggaggttgctcagtcacttcttgaaaatctttaccggagagacttttaacttcagtcaacttcttgaataccttctcgcctaggttgcaggttgagaaccagcacccagatgttgacagacgtcgacgtacagctgaagcattctgagaagaagcatcccgagcggacgcaacatccattaactgtttggtgttttcctcaatgatttcgacttgtgaaagccacgtagccactatagctagccgttgaccacccttaagctcaccagcattgactctgtttacaacatcttctttttctgctttaagctcatcaaaagcactcttcaacaagacaagattttccttcaacatgcaaatgttacccacctttacacacaagtaagacaaagcagacttataacatggctcaactacctgccaacagcaattcattgtgctcaagattgagaaagagaactaagatgagagtagcaaatttaaaacagatctttgtacagaacaggatgtctgaatcgggggagtagaaatagggaaacagaactttgtgcaggacgaactagagagaccagagaaaaggaagagaccagagaaatggagagatgatgaaagaagaaaaataatggagagaggaaaagaactagagaaaaaagttatgtggaatgcctttaatatccctaccccacccgcatgttgtagaattttttgtaacaacaatgatgactaaaaggtgtactgtgtctgtgtggtaggtaacgttattggttcattgatttacaaatccatatataattacgcaacatgtgctaagatattgacgtggtttggtgtcagctaagagacaaatattggttcactgattaataaattcatatgggtttgaactcatacatagaataatatggttgttcttaaatttaaaaacatccacaaaaccaggttagacaaacaaaaatgactaacaaagcataaacgaatactatatgtccaccaaccatatgcaaaacgaaagaaaaaaacaatgaaatccatgaataaagatttataaaatgaaagatccacaaaagtatcaccacaagccacgtaactcccatatgcattaaaacatatcaaatttaatttcaaatagtaaccaaaaaatttcattttgtaaccaaaaaatcaaattaaaattttaaaagggaagggcaatattgtcaacccacaaagccaaaggggaaagtggctgaaaaattcagtctcaattcagttgactcctaaacacacaaa

SEQ ID NO: 1893 - DNA, 3000 bp, Unknown
  misc_feature (1)..( 3000): cDNA_ID_2146279_gDNA_ID_1620463_Annot_ID_157817 3000 nt of promoter + ATG
aggacagagatatgggtgacaagtaggattggtgagaccaaagtggtgtcgtggagcatggtcttagcagtggatttcccgtccgaactattcattttgtctggcataagtttcttggtcgatgcggagaaaaaattcgtcgtatgttgtgataattacttcggagaggatgaatacgataccaaaaacttggttcacattgttggagagaacaacaaagtgagagaagttaatttcggagtatccgaatcatcttggccatttttgtttaattatgttccaagtttgattcaaatctgggaaggtgtaggaggcaaaagaaagagagtcgaataagtaagcttcacgcaaacctgttttttttttttccttctcaccgttatctttggtcatatctagttatgttttgactaacaaatgtttcatacatacttgttgcattactttaagacagtttttttttttttaatagtttcgtgatcaaaaaagatctgcattaatgccgcctccagcaacatgggggtttcattcttcttttcttaacacatacaaagacagaaaaagcaattaacctaatgaagagaccaaacaaacataatgaagagctacgtgtacgttccaagtctagttccccttccaggataagatggttgtttcgtgtttctaagcttaattggtatgtgattgttcatcttctgccatcatatatgatagtgcatatgtattgaaattgactttggtttttgtgatacaacctggacacgttttaggtctttgtccacagttgtatcagtttcggtcatgtttgtggtatcaacaaaactaagatacacacattccaagtatacatgacaaatttcactctatgctacaaataaccaaggtttgtactaaaatccaaatacaaagaatttggatgaaccttacagaagctatatggaacattctaacttgatatacttaatttgaataaacaaaaaaagaagtcattatttagttattgaatactttttttcccttgaccttacagattactgattaccatatacatacatatatgtgaatttttgaagaagacaacattgcatttgtaacatacattgcaaatgagtaacaatgaccaacaacattaacagattgtttaccaagacttacagtaaatgtacaatgttcagtttgtatagatagggtccttatatatgctgagtcaaagatgtcaatcctaaaggaaaggaagacgagtaacggcattcccccacaaacgctatcatctgcttatttcttttcggatgaaggtggcaacattttcttggtggatcgacgagaaagtatctgaagccgcactttaaggtgagtgccgagattctaccgcgagttgataactctatactagctctaactctacacataaacataacacacaaacttatacaaagataaacgtaacacacaaatatctgaacagagattcaattgtcatacacataagcaaaaacagcaagaattgtgaaccagagtgatccacatgtgtatttcacatatctgagtcgatctctaataccctctcgtggtgtaccatatatttggattaaactaaatgatagcatatttttgtaaattatcttaaaaataaaaatttaattacttttttttagtaaaaatataagtctatgtaccgtgattaatatatctagttaattaacaaagttgataactattccgttattattacactttgcaatgtcgatcacatcaataaacgcattgtccctttcccttttcgtatccgccggaaaaaaataacgtctttttttttttcttccaatctctctgtctctctccccaattcccagattctcatgtaagctctctccaaggatttgatttctgtataatgtttgcgaattgagactaagagccctctcgatttcgatttttgttcgtctggatcctttgcgttaggttttttcttctcgtataattagggcttccgatttgtttacccttagttcattttctctaaattttggtttttgattgatgggttttcttgatttagcaatttttaagatttacttgaaagattccgtaattttgttctgattcggattctttgatctgtgctcactagctctctaccaaagcagcttccttttctgatccctagtgttcaattatgtgaacagattgtttactttagcttctcttccttttcattctagttttgcagagattttaggaggaacatgattgtttgaattgggagagacattggttcgtgtaaaatgcgggtgcttggtttgagctcaagcttatgctctggtgaggataaggaagaagaagagattaatggagaaggctctctcacgcctgtttatctcaacgtctatgatctaactcctgtcaacaattatctctattggttcggccttggcatatttcactctggcattgagggtaattgtggcttcttctctattacttacttgacctaactaaatttttctttgtcattgctttctatttgctttcatccatatctggtttatcatgttatcaaagtacttctagccttgaataggaacaatgatattcctcaattgttctccacaagttgtgatttattattcattaggtgaaaatggtgtttattatattagctatggaatacattattagaaggaaaaagtggaacaagttttgaggaatctagaatggaatgctttttcaaatcctgccttattgtctgaagcattctctttcaataattagaacttgcctgatgagttatataactgtacttctgctgaaactgttattgttgctaaatgttcatctaatgtggagttttttttcactttgccatgtgtactactagctcatggtttcgaatatggatatggagctcatgagtattcgagcagtggggtatttgaggttgaacctaggagctgtccaggtttcatctttaggcgctcagttttgttgggaaccaccagc

SEQ ID NO: 1894 - DNA, 3000 bp, Unknown
  misc_feature (1)..( 3000): cDNA_ID_1663168_gDNA_ID_1620463_Annot_ID_157806 3000 nt of promoter + ATG
tgaaataaccatctgaccagaatgatgtgtttgaaccaaaactactcttggaatcgaatatagattaaaaatatatagtaaactaatttttagagagtttgagtgactattgactaaactatgcttccgtgaaggaggtcccttttgcaagtggacatacgtgagagacccaccattaatttgtctttgagccttattgttgttattgacttttagccaatagaaagagatggaaattcaataattatccacaaaattccaaatcattggtgtacaaaaagatctaaggctgttatattttcaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctcttaaccaccttccacatagaaaaaagttcagatatttgataaatcaatcaacaaaacaaaaaaaactctatagttagtttctctgaaaatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatccataaacaaaatagacactttaataaagccgtgagtgttaatttttcaatctagtttcatttcttacatgacattcacggctttattaaagtattacaccatatcccctaatacaatctcttaactcaatttgagttctatattgctaagtagccaaaacttgatcgaagaggtaacaattactaaaaccaaaatccatcaacagtagcgcgacaataaataataacctatctattttagatttttttttgttgtaaatgttgtgagcttaagtgtgtaatcacttgtaaatgtttctgtttgatactcttgagaagatgaagctgtctaaggtcgacaagcaaaggctctgctagagaaaattcatttaagcaatcaatttatatctttgatttttgaagcacataaaactttgaacccaataaaggtttagaatgagaaaaaccgtgtctcgcctagaggattcagtattgaaacccagttattctcttaatggactaagaacgaatattcttttcattaatgggctttaaccaacgagagctgatatttattattgttaatgggcttaaccagtttgtagcccacggatagataaagagaggaccagaacacagttaaatagcacccgccgcagagaataataactcaggaagggtttatagattaggtttttaagtcgcacctctctctctcactgccgcatcttttcttagggttcttgtttcgctatctcttaaacacaaacagctctgtccgaataatctctcttcaagtacctcttttttctgattctgtatatcgccatgaattactgatttccctctctataaacccatcaaagtaaaccaatttctcctgtgacttgtacctaactcgatcttaccagactggtgatg

SEQ ID NO: 1895 - DNA, 3000 bp, Unknown
  misc_feature (1)..( 3000): cDNA_ID_3065059_gDNA_ID_1620464_Annot_ID_157845 3000 nt of promoter + ATG
gcatgctcatcatattatttatcaacgatacattctttctttatattaatattggctagcttaaaacttataatacttgttgagagttacatattagttatcctagagaaacaactcaccaaatgtgcctttggattatacattctctttatctattttatacatttttcgaaattggaattattatggagacattagacatatatgaatattttgagttatacttattttatattttttataagtagagttacacttatttaacaggttagcattacgagttcaaaaagaagaatttagttttgctgaaataaaagcttgtgtttatgtctttaatagctcgcacaccacctaaatgggatttaaacttagccatacaacgatgataacacttacaaaagatcatttatatatacgagacggatcccgccagtagtatcgggaggaacgcgagaactgtttatgacattgcgacctacacttgtttaaacatcagataacatatgattaatagtctaaactcaacggtttattgaaacagttagtgaaataggccgaatttaacgtgaaaaatacgtaacagaacgttgattaatagttatatatatgtggccgacgcaaagcatgacgttttctgcacgagctgtcacgcaaggtgacgacgtttttaatcaaagtgtttagggactataaacgtataaattaatctgttcgatgttaatagttctgatgccaagatgcggttcggttttctaaaccggatcgaaagtgataatttttaaaaacttaaaccctaactggctaactctttcactgacgacatacataacacatttcactgactaaacttattttgattagtgtaataaaagagtaaagaactccagtattggcgtattgcttacactgattctgtcatctccacattatttatgtcaagcggatatgttgggttcctattatttcccttttatctagtttataaaactgttatgttattattgttatgatgtactatataacatcctcgtttgcggtctcaaaaaaaaaaaagacaacatcctcgattgtggtggaatctgttccgatatattattggttaatttttgattgaggcgaactaattatgtaataagtactcttcttttctaaactttgaatcatatatagtcaaatattgaaaataataaaaaagaagatacagaaaatttattcgcacatgattttaaaattgacgataaaatcttgagatggggtcaaaatacagtgcattttagtgcccaaaacagcaaaacaattttgcgtggatctcatgtcggaagataacaataaagataaatatcattggctatgtaatatatatagatagaactgtgatataaaaatctatcgcaatatttctattgtacaaatatgtttcctctaactctttcgtatacgtggatagataaggattttgatagtgttgccttatatcttttcttttcactctctttttaagtaccaaccgttgcgtttactttgttcttccttttggaactagaccctaggtcaaacgggcctgtgtaaatttttggattatacagtttttagccggtaaacgaaaaagaatgtattttactacctaagaagaacatatcagaaagcaaacattataaaagaaaatatcgtataagtatacttcatcatttaagattattgattagtaaaatatatatcagaaagcaaacattatatcagaaagcaaacattagaaagatttaatattttgagagaaaagataaattataaggtatgatcttatgagaattgaatctcgaacacgttgctttataacacactacaaaatgtatatttttattgataatatattaccgaatcttcattactaaaaccgcaaaaagaaatcttaagtaaagctataccttatgatttctcgaagtcaaagtttctgtaattagaaagaaaaatcaaatttgctttcatgccgaactgtagataaagatttctaaatcatgccgaccatactgtccattttttcaatattatttaaaattccatgaatatccatcctcaaagggccctgtctagaatacgatacaactagtatataataagtctacaactacgtaacggagttatcattctaaaagataatacatatttgacaaaataaatagaaaattaaagtttttaaaaaaatatttgtaaaatttatgaacatagtggtcatttggtcgagaaagaagattttttttttcttttaagatgaaaaaattgtatgggtcattaatatcatcttattatttaaagatgtacaagctttagcttatctcatttaaggatgtacaagttatatgcatacacacgcaaaaataaaaataaatcaaagtttaatatttagtttggtgagaagaatttgagtcattgacataataaattttgaaatcatgtttgaaaaggagactataagctagtatcggtccctagacgaaatgatgcctcaagaacatacgaagtttattaattaaactttatttctattcattaacaaataaaacagccaaaacaaaactaattcaataccgacatgatagataaaatccattcaaaacctcaaacaaatttgttttggagttaacagaaataaaatattttgaatttgtagatactcctacatgaaagaaaaatgaattacgatatcaaggaccagcctaattattttattttgttagcctaattttcatttctacaaaacatatctccatcacgattttattaaaacaaatcccataattcgattttattatgtggatgtcatgtttacacgtgtcatattacaattcgttaaaatacagtgtctcttctctgtccgactgggcatgacagatcatccaagcaaatcaaatacccaactctcacacgttctcaaacaaaaacttcaaagagagagagagagagagttttgtgaactcaagaaaataaaaaaagttatagtta

SEQ ID NO: 1896 - DNA, 3000 bp, Unknown
  misc_feature (1)..( 3000): cDNA_ID_3065047_gDNA_ID_1620464_Annot_ID_157851 3000 nt of promoter + ATG
tttatgtagtgtaattgtaaatgttagatatgtaaatggggtttggagaagttcactaaactaaaatacttgttaattattgatgatataatactagtttggtagatcgaccctattttgtcaaaaaaaaaaacggtttggtttgtttgaattgaagtacctgtgcaatgtgtttggcagatataagctcaaccataacaaaggaagcatgccatccttgctttaacccaaagatctcaagtagtccatcatcggcttgtgcctccacaaaacctctctgttacgtacaacacaagcaaccgttaataagaaggagaattgataagtagatttgtgaagtgacgaaaaaatgagctttgttttactttttcaagataatcttgtttgagatttccccaagggtttcttccacttccatagctatgtagattcaatgcaacaactgctcttacactgtcccaaaaacaagcaaacacacatctttcattagaaacccaattatgagatttaaaagtgttctgtctcatttgtgttcttgtttctattctgtagataccttttgggaactggtactttctcccactcggatgagtccaacttttttatatgcaatgtcataatgttcttgagacccctaaaaccagataattacaaacgtgttaagaccacaatttgaggttgtaagttgtaacatttgttgtcttggtgttagtatataccttaaacctgggtcatttatgcagtgagtgaggaaccaaccctgagagcaaccatatcccgagtatataatctgcaacaacaaaatgttagctttctttcttgatataaaaaaaaaagtcttagagaaaattatcattctcaagagaatttggtaaaaccttattggcgatagggccatttgcaaggtaaggcttttcgttgcgcaaatggtgaaaaccgtaagccacttgagcatccatacctatactaaagtaattgtagaagactccttcatagccattcgtcgatggagggatctctccctctatctccaaattctgcaacacaaaaattaactcattaaaaccaaagactaataatcacaaaagaatttcaattttgtgtactaatgaaattataaacctggtcaatgtaacattcttgtgtagcctttaaagaataaggaggatccacaatttcaccagaaggcattgtaatcagaatattccaactacatcaagatttcaacatcaaaagattaagcagagagctcaagaaacaaagtgttcatatcacgctttttcgcggtactaattttacctatctaaacggcttataggagcaacacttgctctatgaagtgttcgttttatcgcagatttccacgcaaatgggaatgaacctccctaagaaaaccaacataaaccctaattagaacagagtattttataagattaaagatacaaaaaaagacaataagatctctttttcacccatccgaaacttcttgaaagatcgtttcccgttccgagtggcattatcgaaaccggaggaacgggtaaccggttttgtaaattaagttcaccgagacatcctagaacccaaccaacggttccatctccacctgcaacctgtaatgagtgatcaaaccagtggcaataacaaaaaaaaaaacacattttcaaatctttgattgtagatcaagcaatggaaaaaagtaccacaattctcatcttttcacgaatctctttagcacattcgtctcctcgagacgcaaatgcctctaagcatcccaatccatatcgaataaactcattaggcttcacttccgttaaatcatacacctgttcttcgctaataagattctggagacgttctttaatgagtggaccttgacgaccaccgcttttgggattaacgaagaccatcaaaggaacttcaggcgtcaacgcgttgttttctaacggtggtgctacagaggaggaagcgtcgaaggaatcgtctttacgaagaatgcaatcgcgtattgcaatgcggagatattgaggaagcataactctttgacgaagctctgctttagagactcttatgctcgcgagattgaccaataaagagactttcattgctccgaatgagtcgagagatgaatgtcgtggaatcatcctcgccgtcaatgaatcaccaatcgacggtgattccatctctttctctctctctctcgctctgccaaaaaagatcgaaactttttatcttcctgaagaatcagtatatgaaaaacagaacaaattgggaattctgggttctttgtgaaaagataagaatctttgttgttgttttttgatgaaagaaagaataaaatctgaaaacgaaaaattcgttagaggagaaaaaggaaaccaaaaattgaaaccgatccgagaggaagagatttgttctgatttttctgtttgttttgtttttttcgaccgttgagcttattttcaggacaaataaaaaccgttcccttctcattaactaccaactttttgttatttatataagcccattgggcttttataggcctgttgtctgtttataaaagcctgtagagttaaatctgcaaatcacaaaggaaaacgttaatggtggatctgagcactgtcaatgtcatcaccaccgaagtagagttgactccactcaacagaaactgaaactggaaagtttgagacttttaaggtaagctcatcttgtattcattgtctatgttttgcattttttcaaaggttaagtttttagggttttgcaaacttgaattctcggaaagacgaaaacttgtaactccgattactatagacttttttctgggaatccgatttggggaaacttgaatgtttacccaatttgacttctttgtaagctaatatggtattgtcttagatcagagcaatgcacatgtgatgttatatctgagatcatggaatttaaagaagaaactttgtatcatgagtaatgttgatatgtttagtgatgaaaagttctcag

SEQ ID NO: 1897 - DNA, 3000 bp, Unknown
  misc_feature (1)..( 3000): cDNA_ID_2046935_gDNA_ID_1620464_Annot_ID_157856 3000 nt of promoter + ATG
aaaagtagatttattttgtattataatcaacgcttaccaaaaagtaactagtcttccctacttaaaaataaaattaaaaactatacctaagtactactaattaacttaataacgtaagaaaaaaaaactataccttaccaaaaagttagcttagctcagtttgaaattttgaatacgattgtttgattttagtgaatctgaatagtgaatacttatacgattattcctgtttatttttgtcaactatgtatacgactttaggcgttgcacaattaaaaaaaacgtataccactttagggctaataatatagaagctcacatctaaaaactaaaacccgcttattatgatcttatgatcacatatctgataaaatctttaggccacgtttcgaaagtacacacgatttactcctaattagagagattataatatcaaactatagatttcgtggaaaaccaaagaagtaaaatcattggtccgcttgattatgtatatctattttcgaagttttaagaaaaagatgaatagaaaagttaataacaaagcaaataataaaacatggaaatagagtatatgtaatagactaatagtagttttaacctttaagccttttctcgtgctaaaatcatgtaagaattcttttgacattttaacaaaaaaaatgtaagaacataaataatgagagtcacgacagcttttgctttagttaagcacacgagaaatcatcgattgcaagttcatagttactatctcgcatcctaactaaaatgatacaaatgcattgagcctatatctctttttttctttgccataaagttattttttatatacatattgcaagagtaaattctaaggttgaaagtgctgtgcctgttatacgtaattaattcagtttttttttttttttttcttccgtaattaattcagtttcagttttcctttttttacatactttcaaacaaagtaaaggtagtcaacgtttagttgaaaattttaaagtgtgattgatagccagtataaagcaagatttttatcttttaatagtactaagttaaaattttaaatgactcaaagtaaacgcagatattatcacgtttactttaaaacgcgtattgactttgaatgacttgagtttttctattttagcaactagcaagcataactttgtatattagtttagtttagttttgttttgttttatctccttacaaaatcgtattacttttttttttgtcggacaaaatatagtattacgtactagttcctgctggagatccaaaacttctattatctacgcttttagtttatagtccaagttttgaattgtttttgtcctattaattaaatctttaatgttttcatataatcgaaagattttcaaaacatatatagaccatcataatttttctaaccctattaaatcatatcagcttccatttaaaacgttgatataatattcatctacttccacctactacttgttcttaaagtgtgtaactatatatcacgtgaactgaattttgccatgaacatctcatgaacgaggtacctaaaaatacatgttcctgttattcacttttgaattttgtttctaatatatatcacggagaaaatgttgaattctgaaaagttgacatttaacaagaaatgttggttaaagacttaaagccatgcttcgagatgcgacttcaaatttttttcgtatcacatatttgtgttaatgacattttttgttatcactcgtttacaagttatctatatcaacaaaggcaacaaaaaaaacaaaatagaaaaaaaaaaaaatcaccttatatacatgaatggtggatttagatgaaaaaatggttgtgaaaggaagtcgagaatctaaactaatctaatggaaaatttaaataaaatgttaagtttgtcttataaatgcatctcatagtatatgttgcataccactctcaattagaataatggttcgaataaagaaaaaaaccaaattatttgctttaaaatttatgtaaaagaatattaattattttctaaacaacaatatataagcaaaaagtataatttttggtgcctttaaagatgtgattgtcatattaaaaagaaaatttccctaaagaattaatggtctaattatttagctagcttgtactccagaccaaacctgttcttctgatggctcaaacttaaaaaaacttaggtgataaatgcaacgaaccaacagaaaaaaatcaatttaactcacatccacaattttttttggttcataattaccacatccacaattattattattacttttattatactcccacaatatttttttgccgtatgtatgaaacataccaatttttatagagaggcagagatacgcgtacagcttttataattgaaaagggcaaaagtaaagtagtacttattattcacttcttcttcaccttttctctttgaattttcttcttcactctgcaacttctcttccccacctttctatatttactattttctatcttcaatttgttggatccgaaagttccttccttttttgtttttattattctttattcaaaagccagtttttgtgatccatttgaaatcccaatttgtctacttctcccaataataactctttttatatctctttttttcttcctttacttcagaaaacaagtctaccttcttctcttcttctaccttcttctcttataaaacctatctaaagccttttcatttttttggccggtgggatattgtttgaatgagttcaaccaaaaatcttatatattcttatccttttttttcccgatcagaactcagttcataaaacttgtctgaataatttaagaacccaactcaaaagattcaatttttcgtttttccattttccttcaaagtcttagcctaataaaagattcgatttttatacaattatttaatacccacatataattgaagaaagagagacagagagataacacaaaagtggaagtaaacgaagaacg

SEQ ID NO: 1898 - DNA, 3000 bp, Unknown
  misc_feature (1)..( 3000): cDNA_ID_2025098_gDNA_ID_1620464_Annot_ID_157862 3000 nt of promoter + ATG
acctcccaatgaccatgttgacaagcttgcatcaaagccgtctgtttccaaaaatttcttgtattcagactacttcaaaaccaatcaataatgcaaagaacaaaaagacactaatcacaacacctgtccacggtagttccggagattaatatcaactcctgattccaccaacagagaaactatctgaagataaacaaaacccaaatcaccaatcaccataaaagtcagaactttagaatctctaatcttacaaagtattgatctttcaagtaattacagttacctcgtggtggccttgagcggcggagtaatgaagaggagagttacgaacgccaaaagtagagtaacgagcgagtcttggattgtaatctaagagagctttagcttcctgtaaatcaccgtctctggccgctgatactaagcgttcgccggacgcagaacaaccgaatgagtttccgacgaggcttagaaacctcatcgttttacgatacaaaattgaaattttgatcggatcaaccctaacaaatcaccatcaacacaacaacacgaacaaattttattggattcacaatttgcagcaaacccaattcgagaaccagctcggaagaatcgaagaattgaatttaatttcaaatgattgcaacaagaaaaatttggtttttattttcttcctctgtttttgttgttgttggtgttctttaattctcttatgtacagatcagatcatcatcatcatcatcataatgatccctctttaagaaagaaagaaactttaaagaattaaccaaaaaaaaatcaaaactttaaaagaattgaccaaaaaaagctttaaactttagaggaaagatcatccagaaaacttctctgacaattgtaatacagagaacatcaaaaagaatggtgaaattaagttgtgggattttttttttggtcaattgattaaggaaaataacaaacaataataacaaattggtgattactttatttttaaaccaaaaatggaaaagaattgttctaaattttttattgtgtgtggaggatctcttaatattttgtgatggtgacactaattaattgacttttaattatttgaacaaaaaaaaaatatgacaaagccaacgttgtagccagaggtttcgataaaccaatagccggaattcgcgcgtttttttgttttaaccaaaatcttaatgattataaagattctctaacaatgaaaaaaaaaagacattcttcatcacaccataagaaagctttctcctttattacatataattaaataaataatcttactatactgcgtaattgaataaatataggttctttttgtgccaacaaataatgattcaattagcaagtctccaaaagtaacatgacattagtggaaaaacaagtgtataataatgaaatgtggaggagcatgtgggtcgtgtcacgtcatgcttataattgcatttgcattagcaaacctataacattaatgacttcaaattttaacattagcaaatcagaatgatcatgccaactctcagcaaatatatttatcaaaaaaactctcaacaaatattacttgattttaaagatgacccaagctatcttcaatctcactttctgtagaatcactaatttgtgtctcacaattgtgcaaaactgtggccagttgctgtaaattgacagaaaattctttagttgacaatttgtcttgtactttggaacttgtagcagagtttctttgtccagagttaacactatccaaactaaactccaactcccaaactggatgtacaagcttaaatctccacttgtgctttatgtggaacttctccacaccaaaaatgagttgtgtaattcagtctgaaacatgtccactattccacatctatgttctctcgagtccacatcacacaatcaagtaggtgcatgtgcacatgttggaaccacaaacacaacaccctcactgtcctagtgttttgtaagagagagatgtgaagtagtctagaatgtctcatcaagtcgtcctccaaatgtaaccatatatcctcaccttctgtacacattttcaaaatagctgcaatggaaagtgaagttcctgaaaagtctagagtataaccagctcaattttgactttctgatatcctttgttgaatggccaactccatagacattaacacacactcatagtttggcttcatagtctgctttgacaagccagatccagacttttgaacattaattctcattccttcccatgcactgcttcaatttcgcgagaaacatcttgcataagcctatgtcccaaaagtttcttcaagttctcaaacaacatgcactgcagctttctcgaattccacctcacaacagaacttgttttttgtcattttgatctcctctaagctaaatttaaacttgaatttccaagctttagggaacttcatatggttcatgtctctgacatactgcatcatcctcattttgcacctactgttccagcttcccttgagtctttttatgttgttcttggtatagccctctgcaaatacgcatgcttgtaattttgtcaggctactttttttcttcatctcgttgacaaatctataacagattctgttaaagtgtctgtctttcgttcgtaagatcattacgttcatataacaatatctttgatgcttgttttgttattcccaattgtcttgattaacgaagaaaaaaacgaatccttttaattttttctcctctgtttgttaatccgttactgctctgttagtctaatgtcaaagaaaccacgttgcttttgaacaacaatacatctgtattgggaaatctatgaatacttgacttctatatttaggaaaaccacaactcactttgcactgaaacgtcaacgttttgtttctttactttttttggttacaataacagagtcttcctattattcactttttttatcttctttcacttatttccccatctccttcctcttgaatctttctcaagaaaacc

SEQ ID NO: 1899 - DNA, 3000 bp, Unknown
  misc_feature (1)..( 3000): cDNA_ID_3065045_gDNA_ID_1620464_Annot_ID_157855 3000 nt of promoter + ATG
atctccctttgataaaacaccgcgtcgtttcccattcccgagcttgcactgactaacagttgcagccaccgcagcggctgcatcattctgccaccaaactttctcggtcattcccttcaacagcttcttaaacaaatcaatgtctaacgaattcccaagattctccttttgcaaaacactgatgttattattgttctgcactgattcagacgatatgcagccgagaaagtctcttacttgcacatctcctgctttctccgaatcctgaaatacgcaaacgcaagtatttagcgtcaggtttgtgatttcgattagataaacattttcatcacagtatacaaacattcaaatcaacaaacctctgctcgtccaagaacaagatcggtctgaaccgggctcccgggaggactcttcttcttggcctgctcagccaccaaaggactcataggcttcaagtgtaccctctcacgcaactctctattaggctgtaacttaggctgcaacggctgacgaagaagcatgttaggactgtaagggctcgttgtcaacgttataggaaccgggatcggaacaatcctctcgttcttgttatgaaagctaggatgaagacgcacgcatgcatcattccatttcttctgcacttcttcaatctttgcttgctgtaataaaaacattacaaaactgataaatttatgatctgcaatcatatcataaagccattgcaattgttgaagagaagattcaataaccggaacttaccggtaaacgatcaaccggtttagctttcaacagccactgtggcaactgtttaggctgagctacttcagatttaacctctggagaagacactgaatcaatctcagcaagttctcgctcgtaactctgtaaacactgtggacaacatttcaatgtcctattcgcaggcacaaagctcttcaatggcgtgaatgattccaaattgttcgcaagcctgaatcaaaacatgaatctaggctaagaaaaaaaatcataaaagctgagatttttctttagcaaaaagaagaaactttaacacaacccacctcgggaaaacgccagacgctggagctttagctgccaccgacacagcttgaagatcccaatcagtctccactgatggatgataaacttgacatcttaaataagtctcacacgtcgccgtccctataaaccagagtcttccttcaaacttctccaaaagcctccgtaactccaccaccgccgtcctcccaatctccaccgcaaccgtagccggcggttgcgttgaactcggttgctccactagccatttcaagtcaccaagatcaagtatcactccgccgccaccaataggatccgaattctttaatcgggtctgaagcaacccatctaattccttaattcttaaagccttatcggaactaatctcctctaaagaaaccacctttgagttcttcaccgctaaattcccaacttcaccgacttcaattttcttaaggatctcacgaataacccgacccggctccgaatcaccaaccaaaaccgggtttttcttcttcgcccgacccaatatatccataacccgctccacatcatcgttcttactcacccctgattgtaccgacgaagcgttctgttgtaaccgtggattaagatacgaattccgggtcatcggacctccaccaccgggtctaaaattcaacccgactgaagaaacactaggaatcggcgtcggagtaaccgaattattcaacgactgttcaattgtagctttaacggcgggacttgaaaagctagcttctctcataacccgactaacactcggatcatccaaaatcgagataatgagctgttcaagctcaactttaacggccaacaacggttgctgttgttgctccggacaaccacggcgttgatgagcttgagctcgtttaagcgccgccataagcgcgtttgagatcggtggatcattccccggagtggttgtagctgttgggagacgctctaaggcgacgctgaagcagagctcgagggctcgacactgtaaaggatgagaagaattggggtgagatcggatacaagctcgtcggagaaacccagcaggagaagctagaagagtggctgcaacgtggagaggagtggtttggccgtgattacgacgcgcggcttcggcgattgattggtttaaaacggtggcagcctccggcgtcagagtctgttgaatcgtacttaaaccagctctcatcgttcttcgtttacttccacttttgtgttatctctctgtctctctttcttcaattatatgtgggtattaaataattgtataaaaatcgaatcttttattaggctaagactttgaaggaaaatggaaaaacgaaaaattgaatcttttgagttgggttcttaaattattcagacaagttttatgaactgagttctgatcgggaaaaaaaaggataagaatatataagatttttggttgaactcattcaaacaatatcccaccggccaaaaaaatgaaaaggctttagataggttttataagagaagaaggtagaagaagagaagaaggtagacttgttttctgaagtaaaggaagaaaaaaagagatataaaaagagttattattgggagaagtagacaaattgggatttcaaatggatcacaaaaactggcttttgaataaagaataataaaaacaaaaaaggaaggaactttcggatccaacaaattgaagatagaaaatagtaaatatagaaaggtggggaagagaagttgcagagtgaagaagaaaattcaaagagaaaaggtgaagaagaagtgaataataagtactactttacttttgcccttttcaattataaaagctgtacgcgtatctctgcctctctataaaaattggtatgtttcatacatacggcaaaaaaatattgtgggagtataataaaagtaataataataattgtggatgtggtaattatgaaccaaaaaaaattgtggatg

SEQ ID NO: 1900 - DNA, 3000 bp, Unknown
  misc_feature (1)..( 3000): cDNA_ID_2046950_gDNA_ID_1620464_Annot_ID_157850 3000 nt of promoter + ATG
atgcgaacggtacaaatgacacataaatgatagtaatgataatttcgaatatggaaataagtaatcgacatggtctgttacttattttctatttttaaaataaatggtatccatcaatgatcaatcacacccaattctcctttagttttttgttaagtcgcaaccaaaatttaatacaactcaactataccgacaatgaagtatttcctttcattattgtttttggaccatagcctacaattatttaaatacaagtcttacataaatccattaatgatagaatctttttccgccaacaaatccacgatatatacgtatgataaataaagtaaatctctaacttatatgattacaataaatatattataaacaatctcaataatattcatcaactagtggcaacttttacaaactcaagaatcgatcaatcaataacttacaagacaagaaagagaacattctttgttcttccgtaagaaggaagtcacactccacatcgatggttcaagagacaaatagctaattaattaatgtttggttcgtacaaatccaagttcacgtgtcctcctcctgcttcaccatgtcggtatggcttcgaatcgatatctgtcgcagtcttgagcaccacatgctgcgtatagagaccactcaaaacgtgattgaataataacatcaaaagaaacaaaactctttgttaattaatcacatttaactgtcttaatttataccttaatttgtgtcctgttatatgtataggtgacgtggacattgccgtctccggcttgtataacagccgggtacgaatactccattcccggagattcctccaacgttaaaatatcggtccatgaatcaccgtcgtctaaagaaactcctaatttgagcacacctcttgagtctgtgttgtaagcaagcactagcctaccatccttaagcttgactccatcaatacctgtcaacattttcttcaataaaatcgcgctaaaacgaagactagttatacaatgtgtttagtttcgatttcaagaaacctgaatttgggtttgggagaaccgttggtactgcaaaactccagttctcaccgccatccaaagactctgagatacagattctgtcaatgccagtaaaggatctgagtaaaatccgtaagttcccagctgcggtttggtatggaactggttggatcacgctaagactcttgccttgaatgtatattggccctttctttctccatgttctacccgcatctgaagtgacctgaatcaaccaacacatttcagtgtaaaatcattgtagcatactctaaatatagaaatcaaactaaatagttttaagaaacctccatccatgctccccaagaattccaactctcaacagatgatccgcaaaggagagtaccgtcttcaagcaaaatgggctgcagaagaaagaagagatgaagaaggaagcttaagctaagtctctaaccagtacaaaaggtttagtcttaatcgagtaatcgagtctgcgcaacgcaacaagtaccttgtttttgataggaccgagaatcccaggaggaagctgttctctttcagtccaagttatacctttatcatatgatcgtttcatgcaaccactccatctgagctttcaccaaaacacttaacatatcaaagaaatgtaacaaaacaaaaaagagttactcggttgattgaaagacatacttttgaacctcctggccgattttgtagaacaataagagctcatgagatggaagtttgaacaagacagggttatacattggaactcctggctcttcatcaacaataaccggtgaatcccattgaccatcctgagaaaaccaatcaattattacacacaattataacctcagagagtctctaaatgattgaaaagtctatataataccttgaaatgctgcaaccagattttgacatcaggtgctccttccctggtgcctccgaaatacgcagccaagaaatgatctttaacaaccttttcacaaaatgtagaaattcagaacccaatccatcactgatactactaaagatccagtcaaagagacttgtggtgatcttaacctcaactatggtagaggcatgacaactcttgaagggagcagaatcagcaggaaatgtgaatgtctcaagcaacactttaaattctgtttctgacatctgagaacttttcatcactaaacatatcaacattactcatgatacaaagtttcttctttaaattccatgatctcagatataacatcacatgtgcattgctctgatctaagacaataccatattagcttacaaagaagtcaaattgggtaaacattcaagtttccccaaatcggattcccagaaaaaagtctatagtaatcggagttacaagttttcgtctttccgagaattcaagtttgcaaaaccctaaaaacttaacctttgaaaaaatgcaaaacatagacaatgaatacaagatgagcttaccttaaaagtctcaaactttccagtttcagtttctgttgagtggagtcaactctacttcggtggtgatgacattgacagtgctcagatccaccattaacgttttcctttgtgatttgcagatttaactctacaggcttttataaacagacaacaggcctataaaagcccaatgggcttatataaataacaaaaagttggtagttaatgagaagggaacggtttttatttgtcctgaaaataagctcaacggtcgaaaaaaacaaaacaaacagaaaaatcagaacaaatctcttcctctcggatcggtttcaatttttggtttcctttttctcctctaacgaatttttcgttttcagattttattctttctttcatcaaaaaacaacaacaaagattcttatcttttcacaaagaacccagaattcccaatttgttctgtttttcatatactgattcttcaggaagataaaaagtttcgatcttttttggcagagcgagagagagagagaaagagatg

SEQ ID NO: 1901 - DNA, 3 bp, Unknown
  misc_feature (1)..( 3): cDNA_ID_2146320_gDNA_ID_1620465_Annot_ID_157875 3000 nt of promoter + ATG
agt

SEQ ID NO: 1902 - DNA, 3000 bp, Unknown
  misc_feature (1)..( 3000): cDNA_ID_3065076_gDNA_ID_1620465_Annot_ID_157892 3000 nt of promoter + ATG
catattgtatgaatgtaattactatgatttaagggcactgcttttctgttttcacgttgttttcgaaattgctattgcgtgtgatatctgtgttggaccaattattgaaaaggacaaggctgactctggtttttaatgagtagtccccatgggagttatgttcatttaccacacatttttttgtatagtatagtatgagtttttatttgatatcttttatcttcggaaaataaatggttcaaattgtttgtctaaaaatgcacacatgaatatcttgtggtctcacacaattgtaggaaacaaattaatatttgttgcgaaaataatgttattattttatcatacgaaatcctagagaaaatggtggcaaaagaggcaaagactaaactaatgaatttaaaatatgaaaatgatggaatgactggtttaccaatattacagtatattgtaattttataaaaacgaatcctgaagaagagggcaaaccccaagaccacgcaaatcagtctacaaatatgaaaatttccaataactagaaaaacatgtgcatttatctttttccatcattcggatttttacaatggaaattttgaccactgagcgcaagtgttatagtattttattattatccaatattaatatcattattcggatccatgcattctatataactatgtccaccatcttacttgtgtctatgttgcaacttcaacgtcgtatatatatagggattgttgtcacgaatacaatgctaattaaggaagattgtgacttctcggaaaatttagaactaattaagagtggaactaaaatgccaatgaaaatagcctaaatcaaaggagaaccacaaatataaattggaagaccttaaaaaacaattaaacgaggacgaaacaaattttggaatcatcaattatacgaaaaaaagaagaaagaaaaaagaggtttcatgaatcacagtagtgctgacaatcttcgaaccatttgtgggtttcatacaatcgatcaccaatagaacaaaagagaaacagaggaacagaaagaatagaaggagtgggaagtgtatgaggaagctgtgtccgaacatagacaaagacgatggtctggagacggtgttggaagttccgataccggaggagatgttttccggtatgggcaacaacgttgcacttaggtggcaaaatatgatgacgtggatgaaagctcaaacgtctgataaatggtcgcaaccgcttatcgccgctcgtatcaacgagctccggttccttctctacctcgttggctcgcctcttatacctctccaggttcaagtcggtcactctgttcataagcccgtcaaagattgctccattgtaagtcattcaaaatcaatccttatgaaaacataacaaagatgttgaaaatatgattcctcttttttttttctttttttcttttatgatcaaaacccaaaaaagtcattaccctgcttcgtaagtattcaacataaagttgttaatccatgtgttgtactctgcaagtctgcattacattattcatcgtacacagagtcatcaacttcagtttcattgtttttttgcttatgaattacgattgcagcaagcttcaacggcgaaatacattgtacagcagtacatagcagcgacgggaggaccacaggcgttaaacgccgtgaacagcatgtgcgtcacgggacaagtgaagatgacggcgtcggagtttcatcaaggagatgattcgggcgttaatctaaagagcaacgacgaaatgggtggtttcgttttatggcaaaaggatccagatctttggtgtttggagctcgtcgtctccggttgcaaagtgatatgtggaagcaacggtcggctttcatggcgacattcctctaaccagcaaactccggcgtctaccggaacgccaagacctctccgccggtttttacaggtccaatccggttattgattttttttttgatgtaatgtccggttctcaaaatgttgaaccggtggtttatttattgtttgagcaggggttagatcctcgttcgacggcgaatctgtttcttgacgcaacgtgtatcggagagaagataatcaacggtgaggattgctttatcttgaaactggagacgagtccggcggttcgagaagctcaaagcggtccgaattttgagataattcatcacacgatatggggttattttagtcaaagatcgggacttttgattcagttcgaagattcgcggcttttgagaatgaggaccaaggaagacgaagatgtcttctgggagactagtgctgagtcggtgatggatgattaccgatacgttgacaatgtgaacatcgctcacggcgggaaaacatcggtcacggttttccggtacggtgaagcgtcggcgaatcatcggagacagatgacggagaagtggaggatagaagaagttgattttaatgtttggggtctctccgttgatcattttcttcctccggccaatttgcagatcgaaaaatgatttagctttttattaaaaatattgttattcgtttttagccgatatcataactttttgagatacattatcaacacactcgtgcaactgagatattcttgacacaatttttgcatttgaaattggcaattttgtactactcatatagtttgaagcttcaattcactacaaaggttattactaattgtgtcgacaaatccagcagatttaataatgcccattccattaaatgttttttagtttaataataggatgatcatatgaccaaaatcgtaaataagggttaggggtaaacctgtcatttcaagcttcccgcccatgggcgctactcccaatttaataaaaaataagaaaataggcgtaaatatgagagtgtgttttttcaatataccctcggttttgaatttgctctcaaaagcgacggagacgactgtttggctcggtgatttctcccgccgtttgggtttttcttaccggaatttccttctccttcg

SEQ ID NO: 1903 - DNA, 3000 bp, Unknown
  misc_feature (1)..( 3000): cDNA_ID_2991503_gDNA_ID_1620465_Annot_ID_157893 3000 nt of promoter + ATG
tgaaaaaccacaagtgtaaattgttgagggaactaaaacacttgaagatggataacaaacttctgctgacaggaacacctctgcaaaataatctttctgagctttggtctttgttaaattttattctgcctgacatctttacatcacatgatgaatttgaatcatggtacaaacatggtccttttctactattatccctaactagtcttctttttttttttttttttgttaacactggtggcagctttttgacatttattcctttcttagtatctaactgatagatgagtctctacaggtttgatttttctgaaaagaacaaaaacgaagcaaccaaggaagaagaagagaaaagaagagctcaagtatgtacaattatatcaattttcctttatttctttgattgtatttatgtcttatgctaagggtacatcttgtctaggttgtttccaaacttcatggtatactacgaccattcatccttcgaagaatgaaatgtgatgttgagctctcacttccacggaaaaaggagattataatgtatgctacaatgactgatcatcagaaaaagttccaggaacatctggtgaataacacgttggaagcacatcttggagagaatgccatccgaggtacatgatctattttttttttttaatactttgtttaattatgtcattttctgcattgatttgttcatcccctatacttcaggtcaaggctggaagggaaagcttaacaacctggtcattcaacttcgaaagaactgcaaccatcctgaccttctccaggggcaaatagatggttcatgtatgtcagtttcttttaagaaacgtaagaaaaacttctgtcatactgttctgtctaattgtttcatttcgtgacagatctctaccctcctgttgaagagattgttggacagtgtggtaaattccgcttattggagagattacttgttcggttatttgccaataatcacaaagtatgtttcacaaacccatggctcgtagctcatttccctttgagaacttctctgatccatttgctgatgaccaggtccttatcttctcccaatggacgaaacttttggacattatggattactacttcagtgagaaggggtttgaggtttgcagaatcgatggcagtgtgaagctggatgaaaggagaagacaggtttcacctgtgcttatgctgcttttgcgttgcttttaagcaatattctgaccaaatattataaccataaggtctctctctctctctctttgccttgaaacagattaaagatttcagtgatgagaagagcagctgtagtatatttctcctgagtaccagagctggaggactcggaatcaatcttactgctgctgatacatgcatcctctatgacagcgactgggtaatcaaatcaattaatttattttctttgaaggaaaatctttctctttcgtgttgtctccaactgtgttttgtctgatctccagaaccctcaaatggacttgcaagccatggacagatgccacagaatcgggcagacgaaacctgttcatgtttataggctttccacggctcagtcgatagaggtaaaactctttgttgttcatatcaatcaatcttaacttcaaaccattgagattgttgcctcatgagattggtttatgacatttgctcagacccgggttctgaaacgagcgtacagtaagctcaagctggaacatgtggttattggccaagggcagtttcatcaagaacgtgccaagtcttcaacacctttagaggttttaacttctcttaaagctcaatcctttttagatacacttattatcaacaaaatctcctattgacagcttgaaccaaactaacacacaggaagaggacatactggcgttgcttaaggaagatgaaactgctgaagataagttgatacaaaccgatataagcgatgcggatcttgacaggttacttgaccggagtgacctgacaattactgcaccgggagagacacaagctgctgaagcttttccagtgaagggtccaggttgggaagtggtcctgcctagttcgggaggaatgctgtcttccctgaacagttaggacacattaataagccaggccttgaaaccacttctgtgttttttttttttttttccggaacatgatcggttacttttggctgggaggatttaattattagagggctcggaagtttttgtaagttaaagaactcacttaaaaccctgaaaacatgacagttaatggtgattagctctcaatgtgatgaaaacaattggccctctgattttgctgttgcggtaatattatgacttgtgtacgtttatagtctttgtagtctgcaattttggcattgagctatttctcacgaacttatgggatcttatgttttggatttgggatttgttaacttatatgattaggctcaatagtttcacagaatattaaaaacttgagtagggtttaaaaaagaagcaaaaagctccgatgccgggaatcgaacccgggtctcctgggtgaaagccagatatcctaaccgctggacgacatcggatttgttgatgtctattcttgtaaatagtaaatatttagttttatcggttttgcatctaatggactaaaacatgaacacgagacgccgacaagaatgaatggggcaggcaccaaacatttgggtaaaagtatgcagtggggtattattgacaatttgaccattacaagagctaatcttagggggttttagttagtaaagcaaacccggtttaggagtaaatatggagtgagaataggggtaattaagggaatttaagagaagtcatcatcgttttccatttttcttattttaagcgcctcggtggctatctctcactccgttcgcgtcttcctcttaaaggaaacctcctctacgcgaaattcgtattctctcatttcttctacggagatttgcatcgaagaaactgactcgcttgtggaatcaacaacaagacg

SEQ ID NO: 1904 - DNA, 3000 bp, Unknown
  misc_feature (1)..( 3000): cDNA_ID_2146370_gDNA_ID_1620465_Annot_ID_157891 3000 nt of promoter + ATG
aaacccccaaaagaaaaagaaaaaaaatcaaaacttcattacccaagaaatctcttaatcatttaacccagactctctcttctccacacgcatcttttatccaccgtccaccgatctgatccaacggctgagatttcaccggagacgagttatccttactacttccggcttgtttctctctgaagaatcaccggaaaaaaaaataaggcggcttgtgtgtgagactttgtgtgaaagcttcaaccttttttttctttttctttggcttgtccaagaaaaaggagccttcttcttcttttctctctctggagacaattatactaatttttttctctcaacttttcacccttttttttttgttaacaaacattttttatacataattgtgtcgactttcaagttccaagtatctaaatctgtattttggactcccatgcaaataattaaaatagaataatctttttgtagattttaaattgaaaacggtgtagaaaggttaaaagcaccaaacaaaacgagtaaatagatattgtaataattttttcacctttatggaaaagattatatcatagacgatgtacacagatgaaaattagaaaatggcatgtgaatatatgcagtacccaatgaatgcaatatcaggtttgtattatttttctattgtatctctacatgttacgtaatcaaacgatcaagtaatttattaatattgtcgatggcgtagaaattataaatttattttatgtcattgtttactatatagattttgagctaaacgacttattttgtcaaaagatatatccgtgtttggtttaagattgggttttagtatttccaatattaatctaaattcttagcttatgaacatgtcaataaacaaaaaaattattttactgtcactgtccttagacggggacaaaggagggtattaccgtcgcgttgtcggaccgtaaaataattaaccaaattttgttgttgaacgaataacattttttactgtgggaatttgtcgtgtagcattacgttcgaaatcgcaatttgttttcttctttgtgggtgtatatttctggttaacgaaactataacccaatttaatgcaatgttcgtctgtttttgttgactttgacccttttttggtaatattcgttcagcttttgttttaacgttttcattgccttgtaggcatctgagaagctcagattctgacacgtgtcttttgttatctgaatttgcatccgttggataaacatgacgctgacaggtggattgaaaagtaaccagcttggatttctgtgtatatgttacaccgccacttcccttaatttcttcgttcttagttaaaataaaaaaggtttaatttatgagtaaaagtatgtaaaacgacaacgattactataagaattaaaatttatctttgcttagtaatttgcacttaagattggattcaaattttgtaaaaagcgaatgttacatatatgtccattgaaaaaattgcatttgactttacaagcattgaaattaattaatttgggacccctttttttgttagtttcaaaggaagaattattttaggctgagatgggtccctccataaactcactattctgccagcatacaaattccttaacatatggtccaaatagcagttccaaccactagtatccaataataatctgaacaaattatctttctttttttttcctgataatcttgtatttgtttgttcaatgagcttaatacgtatattagttatgacttataactaaatactttgactcacttgatccgtacacattgatttcgtttattcaaatccgaacaacgtaatgatctttttgggccgagttatttgtattctcaacctgagtccaaccatgctttatgggcttttctgtttatttatgcatgtaaagtttataatgcttgcaaataaccacatattgtatgaatgtaattactatgatttaagggcactgcttttctgttttcacgttgttttcgaaattgctattgcgtgtgatatctgtgttggaccaattattgaaaaggacaaggctgactctggtttttaatgagtagtccccatgggagttatgttcatttaccacacatttttttgtatagtatagtatgagtttttatttgatatcttttatcttcggaaaataaatggttcaaattgtttgtctaaaaatgcacacatgaatatcttgtggtctcacacaattgtaggaaacaaattaatatttgttgcgaaaataatgttattattttatcatacgaaatcctagagaaaatggtggcaaaagaggcaaagactaaactaatgaatttaaaatatgaaaatgatggaatgactggtttaccaatattacagtatattgtaattttataaaaacgaatcctgaagaagagggcaaaccccaagaccacgcaaatcagtctacaaatatgaaaatttccaataactagaaaaacatgtgcatttatctttttccatcattcggatttttacaatggaaattttgaccactgagcgcaagtgttatagtattttattattatccaatattaatatcattattcggatccatgcattctatataactatgtccaccatcttacttgtgtctatgttgcaacttcaacgtcgtatatatatagggattgttgtcacgaatacaatgctaattaaggaagattgtgacttctcggaaaatttagaactaattaagagtggaactaaaatgccaatgaaaatagcctaaatcaaaggagaaccacaaatataaattggaagaccttaaaaaacaattaaacgaggacgaaacaaattttggaatcatcaattatacgaaaaaaagaagaaagaaaaaagaggtttcatgaatcacagtagtgctgacaatcttcgaaccatttgtgggtttcatacaatcgatcaccaatagaacaaaagagaaacagaggaacagaaagaatagaaggagtgggaagtgt

SEQ ID NO: 1905 - DNA, 3000 bp, Unknown
  misc_feature (1)..( 3000): cDNA_ID_2146350_gDNA_ID_1620465_Annot_ID_157883 3000 nt of promoter + ATG
aattaaaaattcaaagttaaaccaatcaaatatatatctaatatttttttcgcgttccctatatatatggttttgtttgttagtatttagtaatcgtaattaattggtttactttaattatatatatagttttcttagagatgattggtccatcgtaagagctagctaccccctcaattgtcgtatacaactcaatattatgatcatgtatttcataaaatatcttctgaggaatctatagaaaaatgaccaattaatcaccacatgatcgggctcacgttggagatggtggatcacatgcccgatattatattttatgtaaatcagtaattaatattgaccagcacatattccaatggtgaaaagaattgtatacacattcagacattctatcgaaaaaggaagaagaaaaacaaaaagtgaggagaaaagaaagatagtaactgttttgattctatgatgaaagtaccttaataagcaggaatgcaattataaacttatagcccatgtattattagatcaccacacaaccatttcttttttttacaaacctaaccctactttcttcatcaaccatggattatcgtttgtttgattgctggtaaccaattggtcacattttctaatcccatatatcacgactcacgttggtaactattccatcacatggctttacgaccaccaatgaaaatattgagattcacgaaaattattgtttttttttacttatcatttttgtcaggtgaacatacagagctttaaacgttaaacttataatagcggttataagaaaatacaaatcaaaattataaaatgcaagatcactataaaatgccaaacggatgccgtggcttctgtcttttgggtgccataaaatttgattcattcaaagaacattattctaaataatggcggtcactccggtcagagaaaataatcagttaatagtaaatcaaaattggatgtttgttgttgaaaattccgcttattatgatatggtcttatgactaaattttcttgatattacgtaatatattcttcctgctctctaataaaacaaaatatataattaaatttcataatagaggaaatgattgaattttatttatggttctatggaaggaaatcatcaaattaatcaaaaaataaaattagatttgaaacttaactagctctatttagtttttttatatacaatgttttgtaaccaaatttcttatcacgctatctccgtagttacgtaacattaatcccgtgattctaatgagacaaatatatttaacttgttatatggtaagtcaaggctggaacgaagaaagtcgatctccgtcttacgtgatacgatcttaatcttgttctgacttcgtatttgataatgtattatatgaactgttttttatcttcttcttttttaccaattaaagtgaataattgatattactattagaatatttaattggcgcgacaagttaaataaactcatcacatgtcacaatgttacgtggtccaatcattctctcacctgccacaatgataatttcatattatatatgtaatgcataagattgaataattgatgttacttgccatctagataggtaaatattgggtccgagtttaggtttggaggaaaaacgaagaattgaaaaccaaatgatagtggtttagtggtcactatttcaagaagaattgtcatgtataagtaggaggtcgatttactctaacagcgaaatttactaaattatttcatatgtatagtcgaaatggtgtattgttttaggctcattagaaaattcgatgaatgaactattcgacaattatactgattttaaaaagattagtcggatgaacttttatgaagtggaattgtgaatagaaaaataaaaagtaaaaaaatatatatagtaaaagagtggaaatattgttgtactttcctccaccactaaaggaactgaataaataactatttttattcgtttttcattttgattggtgattttttagtaagttataagaataattttgtttttctttgtttagttctaggcttctagctaacaaaagcttccagtgaaatccattatttgcggtcccaagtatctctcaaaagtcatggccatctacaccaacggctcatacagagcaaactcctcatataataaacactgatgatgcaactcctcatgttcgctcacgctccactataaatgttgtttattgcaagaaataaaattatgattctgccactgatgttttttagtggttaagcatcaatattggtgatcaccgcttgatcaacaattgccaaaacatattcagcgaccacaatgacgttcaaagaatttggttgaatattagcggtaaaattaattctcttatttcattggtcaaatacttaaccaccaaaataataacggttatttttggcgaccatcactaattatcgtagtggttatgtggtaattgaattaacatttgatatccaataaatttggctaccgatttagtcatcaaaactgtcatatttgtctaactattgttaaaatatacaatatatttttttatttttttactaattttaaaacaaaagttatactccaactaaataaaatataaccgttttttaaataattttaataaatggaaaaaagaaatacaacaaaaataaaatttgttcaacgattgatgaaaactgggcaaatcaaagcatctgccatctggtctggtggttggtgaaacccaacccacttcaatgccaaaataaaaagtcttatgtaagcccattaatttaaagcctactaaaggatttgattatatatttcggcccattttcaatatttcgagcagtacgaaaacgccgtcgtttgagagtacgtgatcgtcaacgcctgggtccgttctacgatcgaccatcgccgagtctgcttcttcttctctctctctctctctagtggtcacactcacttcacacccgtgaaaaaaccctaggaaccaaatatg

SEQ ID NO: 1906 - DNA, 3000 bp, Unknown
  misc_feature (1)..( 3000): cDNA_ID_2146358_gDNA_ID_1620465_Annot_ID_157887 3000 nt of promoter + ATG
tcaccactttcccttccttcgtcattattctttttacttctcctttgccattttaaataggccaatattcgtatttgtgcaacaaaataaatcaaatatccaaaataattattatcctctatttacacattcgtattcgtataaatgaaattacattagtcaaaatttcggttataaattataattgtgatcttctgtatcattcttaacatattgttatgtacaatcagaaatagcaagtaccggttttattttggaaatacgttcgatttgagataaatataaaactgcaatagctaggtccattaaatttgaagatgtgacgttagaagagacaaaatgatggccggggacaccggacacaccatttctaattttacatagtatacatgcccaatggaaatagcttttagtatgtgtgagttgtatgatgcgtcttcctccaatagtgagaaaagctaatgggggacatatatacaactaaaaaaagcttttctcgttttcatcttctgattgggtgacgaataatcacgtttgaaatacccgagaatttaccataaatccgtacctcaaaagattcatttgttgtaaagatatatatacagaaagagcttctttatttgttatttttagcttctttcatatgttatcaaaacattggttttcaaacatctaatccatttgatctataactaactaacatcgacatataatctcttaattaccttcaagtcgttttctgtttttttttaataaaaaaatagagttacgtcaaagaatttgacactttgattccaacttattatcttttcttctttttgtttttcaacctgcaaggaacgtcccagtagataagttgaattttatcctcgtccctctttgaagtccacgtgaacttcacgtgcatagccgtcactcaatgtcggaatacattgtttttatttttcttcttctgtgaattatttagttcttcctaattatataccttcccatgattcgtgttcgttgcccacacattactatctctcttttactcacctaaaaaggcacactataaccttatgtatcaagtgaccgttttttaagatgaaaagtgttgactgctatattttatcatatactattttaaaccaatcagtcgtgtcaattctgtatatatgtttttttctcctttagaagctagggttgaacaccttacaaatcgaaagcaaggcattgtaaaaaaccacgtacccttctactaattaagccttccacaaatttaatataattttagtgttcgaatggtgataaaggatagtgcagaacatgatgctaaaaacgaaagcaatatatggttatgatagaagagattgaccaaaacatgttgaacaaacataatagaattattaacataacatgtgttcaactcattttattggttattttgtgcaagtgtggtgttttaaatttttctttaaacatgcattccaaattcatgtgagcgaaggtgtgaaagctttaatgtatttgctgcttgtggccaatctttaattattccaccacattattcattcccttaaatgtactaaacaaattgtaaggaatataatttaaggtttttggtacgaagtaatgaaggcatgaaagcgtttatgtctttgctccttatggccaatctttatcctcccgttgttgtgtctcaaactcggaaccttaacttcctccttgatcaagaaatactagttcaactataacagacgtatatataattctcatacaccaaaataggaccttaatctcaaagacctgcaacgtcgatgatacgtaagttgtcttgtgtcaacacattacatgataatctatggctgaagaaatttcgttaaaatggtacaaagagaagggtttaaaaatatgtttcgtatacgtacaaagtaaattaaagcaggctatgttcaattaatcgcatggtgtggaatattataacactgttgaagacgacaaaatagagtacaatgtttaaatataaagaaagaaaactcgggaagattcgtggttatagactcctagtcactggtgtaaaataataatctataggaaagatgggaaaaagaggagcacactgcttttcaaaggaaaatgagtggtctcgagctccgaaaacaaagaaaaaataacctacaaaattgactaattaacagtaaaaactaaaataaccaaagacaaagacagtttatgttatattatacatatatacccaatagttatccacaaatgatcggatcgcttgtttactacttcctccaaaatttggtcatcttcgggatccacaccacgtctcttgtccagaattgtcgtcagccaccttatttttatgtttacttattctgatgggatgcgacaatgttttcgttacatgaagttcttaaaaatatctgatcaaaaagaatgaagctcttaaatattttgaaacataaccaacaaacatttcttttatataaagttaaaatgaaaattttaaacatccaaaaatttccatcaaatatatcttgccttaacaaaacagatacatgttttcttgttggataaattatttcataatttggatcaagtgaaacaaaatgtttctccacttttaactacgtttgtacattgtgcaaaaatctagagaacaagtatatctggaagaaatgtaaccatgcaagtgtattctctcatttagggtaagtacatcccattaaacataaaaatagaaaagtatatgtatatccaattcgtctcatacatgcataccacacaattaatgattctttattcaattacatctttttacataaaaacagatggcataagtgtaaataaagggaaagacgacccaagaataaggggtcacagtcgttgaggttataaaaagcatctcataggactcaacctcaccaaagtcatatcctattgcatcactctcctttaaacacagtcagagaaaacagcaactcttgtctgaaaaactagagagagaaa

SEQ ID NO: 1907 - DNA, 3000 bp, Unknown
  misc_feature (1)..( 3000): cDNA_ID_3065081_gDNA_ID_1620465_Annot_ID_157889 3000 nt of promoter + ATG
taggctattttcattggcattttagttccactcttaattagttctaaattttccgagaagtcacaatcttccttaattagcattgtattcgtgacaacaatccctatatatatacgacgttgaagttgcaacatagacacaagtaagatggtggacatagttatatagaatgcatggatccgaataatgatattaatattggataataataaaatactataacacttgcgctcagtggtcaaaatttccattgtaaaaatccgaatgatggaaaaagataaatgcacatgtttttctagttattggaaattttcatatttgtagactgatttgcgtggtcttggggtttgccctcttcttcaggattcgtttttataaaattacaatatactgtaatattggtaaaccagtcattccatcattttcatattttaaattcattagtttagtctttgcctcttttgccaccattttctctaggatttcgtatgataaaataataacattattttcgcaacaaatattaatttgtttcctacaattgtgtgagaccacaagatattcatgtgtgcatttttagacaaacaatttgaaccatttattttccgaagataaaagatatcaaataaaaactcatactatactatacaaaaaaatgtgtggtaaatgaacataactcccatggggactactcattaaaaaccagagtcagccttgtccttttcaataattggtccaacacagatatcacacgcaatagcaatttcgaaaacaacgtgaaaacagaaaagcagtgcccttaaatcatagtaattacattcatacaatatgtggttatttgcaagcattataaactttacatgcataaataaacagaaaagcccataaagcatggttggactcaggttgagaatacaaataactcggcccaaaaagatcattacgttgttcggatttgaataaacgaaatcaatgtgtacggatcaagtgagtcaaagtatttagttataagtcataactaatatacgtattaagctcattgaacaaacaaatacaagattatcaggaaaaaaaaagaaagataatttgttcagattattattggatactagtggttggaactgctatttggaccatatgttaaggaatttgtatgctggcagaatagtgagtttatggagggacccatctcagcctaaaataattcttcctttgaaactaacaaaaaaaggggtcccaaattaattaatttcaatgcttgtaaagtcaaatgcaattttttcaatggacatatatgtaacattcgctttttacaaaatttgaatccaatcttaagtgcaaattactaagcaaagataaattttaattcttatagtaatcgttgtcgttttacatacttttactcataaattaaaccttttttattttaactaagaacgaagaaattaagggaagtggcggtgtaacatatacacagaaatccaagctggttacttttcaatccacctgtcagcgtcatgtttatccaacggatgcaaattcagataacaaaagacacgtgtcagaatctgagcttctcagatgcctacaaggcaatgaaaacgttaaaacaaaagctgaacgaatattaccaaaaaagggtcaaagtcaacaaaaacagacgaacattgcattaaattgggttatagtttcgttaaccagaaatatacacccacaaagaagaaaacaaattgcgatttcgaacgtaatgctacacgacaaattcccacagtaaaaaatgttattcgttcaacaacaaaatttggttaattattttacggtccgacaacgcgacggtaataccctcctttgtccccgtctaaggacagtgacagtaaaataatttttttgtttattgacatgttcataagctaagaatttagattaatattggaaatactaaaacccaatcttaaaccaaacacggatatatcttttgacaaaataagtcgtttagctcaaaatctatatagtaaacaatgacataaaataaatttataatttctacgccatcgacaatattaataaattacttgatcgtttgattacgtaacatgtagagatacaatagaaaaataatacaaacctgatattgcattcattgggtactgcatatattcacatgccattttctaattttcatctgtgtacatcgtctatgatataatcttttccataaaggtgaaaaaattattacaatatctatttactcgttttgtttggtgcttttaacctttctacaccgttttcaatttaaaatctacaaaaagattattctattttaattatttgcatgggagtccaaaatacagatttagatacttggaacttgaaagtcgacacaattatgtataaaaaatgtttgttaacaaaaaaaaaagggtgaaaagttgagagaaaaaaattagtataattgtctccagagagagaaaagaagaagaaggctcctttttcttggacaagccaaagaaaaagaaaaaaaaggttgaagctttcacacaaagtctcacacacaagccgccttatttttttttccggtgattcttcagagagaaacaagccggaagtagtaaggataactcgtctccggtgaaatctcagccgttggatcagatcggtggacggtggataaaagatgcgtgtggagaagagagagtctgggttaaatgattaagagatttcttgggtaatgaagttttgattttttttctttttcttttgggggttttaaatctttttgaagaagagaggtcagagagtgagttatcagaaaagtttggtggcggaaaggggaaaaggagatttttacgaaaagcagattgactggtagctgaagaagagagagagaaagagagactaaacagagtaggaggaggatgataaaccctagattgagctgagctgagatttgcttcttcctttttgtgttcaaagattggaatttagtatctttgaaacatg

SEQ ID NO: 1908 - DNA, 3000 bp, Unknown
  misc_feature (1)..( 3000): cDNA_ID_2146324_gDNA_ID_1620465_Annot_ID_157876 3000 nt of promoter + ATG
caacgaaggagggattcctaattcaagaacattcactattatgattgagcatcttgtgaaattggggaatcttgatgcagccatgaagatttttgagaccttgcctttgatgaggattacgcggactctgaagcattattcggttttggttgaagcctttgttgatgcacaacggtttgatgaagtcaagactctgattgctgagatgaaatctgatgggaagttccctagtagacgcatgcttgagcccctgaaacgcatgagggaggctggttttgaacatgaaacagaggagtttttgagagaaatgttgccggatgagaggatcaaggacatttctatgtattctatggataatcccagcgatagcgaagacgaaggagacgagtacaaagatgatgttaatgaagctcaagttaagttgaagccatggctggatccaaaagctttagcaacttcgttaaagaagtggagctctgatgcagtcactgctttggaagaagctaacttcgtttggacaaatctattggtctgcaagatgctaagaaacttcagagcacctgaaacagcatggagtttcttctgctgggtggcgattcaaccaggattcacccacgacgcctatacgattgagagaatgatggctatgttagcacgcaatggccaagttgaactggtcgataagctcatctcgaaagtgagaatcgaagggatcaaattaccattcagcaccatcaggctgatcattgatctctacggaatttcaaagaaaccggaagcagccatcaaggttttcaacgaagacagaacactctgcggttcgatatctgatttcaacctcatgctgttgtactcatccctcttgagaacattaacaaaatgcaagagaaacgcagaggctttagaaacgctagaagatatgatgttgacaggagtttctcctgatatccagacgttctcgggtttaatgtaccactttgcattgcagggagagattcaaacagttgagagacttttctcaatggtgagacagattggtcttgaacctgatccgtacatgttaaagcttctagttcaagcgtattgcagatgcgaaagatcagtgcttgcttacagagtgttccaagacatgaaagattcgaatctgatgcctgacagagagacgaaagagctgcttgttaagagtttgtggagagaagagaagcgaaaagaagcggctgcggttgaagagagctacgaggaagagaatgataacaagaatagtagtaacgttttgcgtttggcgttgaagggtcatgtgtggaccattagttctacagacatttctcgagtctacaatctctaccgcgattgtgttctgaaaacttcgacttgacaacatttattctaagtttcgtttttattgggcccaatgatcgttaaaggcccatagagtctgttgctgatatattatcttaaagctggttggtaaattaatgggtcaacgccattcaaactaggcaaacaagaatatacaaccgtgcctcacacgctctcatatcttttctttgatcgttgatagttactttttggtcagtattcggactttgactatgagaaccacgtgaatggcccattcaaataggtgtaagtgtaacatctttttatcctttttttaattaggatcatactaaattaataacaagaatcataaattccattggcaatatttgcgaaaacatataaattggcaatcaaatcatttgtttttgaaaatcagatagtcaaaatattctatactgtatattgaattttgcaaccgaaatcatttacactataaatcgatttttctttggtttcaaccatagaagattatctaaaaccgatccagggattatgttcgaaataaaataaaatataaaccatcatcatctcaaaagaaaaatactatagtaagcctaaaagtgaaaaaatcacacctagccactagcatataaagaaacaaaaacattttcatatattaccaaatgttgagagcacatgggagctgttatattatattattattatttgacgttgaccacttgaccatctaaatgaaatgggatgaatctctctacgcggtacctaaaaaaaatccaaaaaagtaactttaacccaactttacaaaatttatattttctccaactttacaaattaattatttttacaaaaaaatatgttaattatattatttctctataattgtgtacggtcgcctccgtagaatttattcattagagtagccaaaagtaaatatttttaactttttagaaagaaaaaaaattaagccttaaactgtgtaaatttcgcaaatctacttttacataagaaaccttagtattttagtgttctactgatatggtactttaggaatatactgatatgactgacattctatttgattttatcctacggcctgacaaatctgaaactctatacattctctgcaaatgttgtgcctttatttaacatttttataatatagtttttcttttctctttcccttgtatataaaaccttataagaaaagctaggccactagtgcgctattctccctcctctctgctcccctagtatctctctctgtctctccctctcgagattaattcaaacatgaaaagcaaattggctctaatatttcaggaaatttcttaaacatttcattgaaactttggcgaagtttccatttagagtaaagcaaagaattagatttaatttggtgtttctttggccttttttccccctttgaacggtggagaagtgaatttaagagtatgtcgtgttgcttctcctgcttcaaacatgatccatctaaggtttttagattcgttttctttgcttatattacaagtcttttaatttgaaaagtcctggtccatattttgatttctaggcttacctatgtataacttttaattggcaagccaggatcctttaaataccgccttggtaatttcacggtatgaagaagaagatcgc

SEQ ID NO: 1909 - DNA, 3000 bp, Unknown
  misc_feature (1)..( 3000): cDNA_ID_2146397_gDNA_ID_1620466_Annot_ID_157906 3000 nt of promoter + ATG
ggtctttttggttttaagaattattagtgactaaaaattgaaataaagtcggcaataattaaataggtgatgcaaacaaaaagttattaaaataaaaccataaagatatttataaatttaataaagatgaaaaattaagaatttgatagtgaatcatactccctctgttccacaaaaagagtcattccatatttttcacacatgttaaaagttctatactccttattaatacactaaataaaattatactatctcctattaatacattaaagcaatagagttaaaaaaaggatttttattcaaattttaaattggaaatatcaaaagacactctttaatgaaacaaaaattaaatcttaaacgacactctttgcaaacggaatgaatatttcattacgattagaggtgtgttacacaaaacacaagcatgactcactgaagttggaaatcttgatgggcttttactaggaacataccggattatagctaaacccccttaatcgcttctttcgatcaaagtgagaaaaatcagaaaggtcaatgaaagtttgtgatgatcaaaattcccacaggaggaaaataaatgggaactgaaaacgaaaaggtttaacatttaatcgtatgattcaaaattcatctccaacattaatgtcgtttatcgatatttaatgatatgattcatctgtatactatatatatatatatatatatatatatatatatatcatgtaactaatcagtttataagaacaatccaaccgtcataatagaaagcgaagcgatgtcgtcgtctgacaagaaaccgttgattccgtcgtcacatatcaccgtcaaagttaaaaatcaggtacttgaataaatttcgccattacttatgctaaaaacaagataatggtgtagttttgtaactcaattttgaaaagaatcacttttttgttatgctattgtgaaaacaagaaaaatttcaaacataattatattttggagatttttgcaggacagcaaaacaatcattgatttgtaatgttcattagtgttaggattttagtttttttttgttttaattttatatattttgcaatagatttcccaacaaaagtgtatatcttttatagcaaaaattataatattcaaccgtcctaaaactaagatacgtataacatgttaaaagttttgtaacaattactatttaacaggacgacatatgtgtgtacttccggattaagagggacgtcgagcttcgtaagatgatgcatgcatactctgacaaagttggagtagaaatgtctactctaaggtttctcttcgatggaaataggatcaaactcaatcaaactcccaacgaggtattttttaaaaagttactccaataatgtatatatgaatcaagttgataaattaacgaaaacgattgcagcttgggcttgaagacgaagacgaaatagaagcatttggtgaacaactaggagggttcagcttctttcatcgccattaagagaatattaaagtcgttagaacgactcaccaaaaaatcaataatttatagtcttgtttaattcttttcacctactttttcgtactacaagagttggttattcatcgatgttaacgagtaacaacgataaggtgtttatgtatgaacgagttatctataagttatttgaatgaagtgtaagagatatgagaatagatgggcattgatatatatagatgggcattgtccttgatcgttatatttgtttaagtcacgaaagatataagaatcaaagaggtaatgtttcactcgcatggaaattgcaacaaagaaaagagttagatatatattctatttccgtattaaatgtgatatatacacaagtacaattacaaatcattgtcaaatatgatcatcattagaagccgtggcccattttgactagtcaagctatacagataacaaaatgaatataatcagaactatctttttagcattacatgtcgtctagttcacgtgcgaaatagttttttcatttgcccatcaatcaccacaaaaaatttccgaatttgcagaaaatttctcgtaattaccttgactgggccatatcatatgaattacgctagatagaaatatatattacgttaacaattactcaatcgaaatatatgttgtacaaatttttaattagcgacgaattatgcgctaacacaaaaaggttaaaaggaaaattaaaaagtcaccgtcctaataaaaaataaatcaaacaattaggtttgtcgatgaccaataagaaactgccatttgtcaaccaaatacacttccctttcttgtccctctctcctctctgtctctcttctttctctctcctcgccactgactttgctctctctgatttacagaagaaatttcaaaactttcaaaagctcaaatcttttttccctttttcgattatattcatcgtcgtcgagaccggagatatctttatctgatcaaaagtttcttttttccgatcgtcttttctctcccagagaaaaattaaaaatcgctcctttagattatttcctttattttcttggcgcggtttcgatttcacgtttctgggttttcttcatcgacccagaaaaacaaaaaaaattcaaaccgcaacgatcaggtacgaatcgaattttttttgtcaccatcgcttgttttgaagatttcttcgtcggtggaagagacgcttcttttattctaagattagcctctttggtttgtagaatctgtaacaaattttggtgattatgtttaattaaaagttaccatctttgatcttcgtttaattaatctttcccttaataacatgttcttagggttttgattttttccttatgtgtgtactgtttgatatttacttaatttgcttaatcttctattaatggaacagaaataaactgattttgagctctctgtgtttgtgttgtctctctctgtatcaggtagtgaatccttgattttatagtctatataaagaaagaaaatgcaaa

SEQ ID NO: 1910 - DNA, 3000 bp, Unknown
  misc_feature (1)..( 3000): cDNA_ID_2146413_gDNA_ID_1620466_Annot_ID_157912 3000 nt of promoter + ATG
aaaaattttttatgacattctatgtaattctttaccctttatagggttatttatgttagagtgattcccaattaatagtatagattaggattttttttttttttgataaactatagattaggatttagttaaatatatctttataacgatatacaaattagtgttcagtttcttagattttttttaaaaatcaatccattaaaacaacattaagatatgtgtatgtttgacaaatgattttggtttacaaaggaaaatgttagcttaatgtttgaaagttaaagaataatactactttcaagagtgaggtcataaatgtaagtgtaaattatcagcaaaagtgcgtatttggaaatagcacgaaaatcaggcgttaatcaattatcaaaacgtacacagtcgtcgagtcgtgaccacttatttacaggtgttttctaatataggaaatatccacgtgtattttagttttcaatttttggctgtaaacataatacaaagcccaaaaagaaaccctaaagtgtacggaatttaaaaggggaaaatatttgaatggtttcattgtgattgttgacggttttgcagagctggcaaagtcgagtgactatagattcctctcctatatttacttttagcagttttatcatttatcggttttatttatttatttaaaagctagagagctcagaaaataattgaatacgttgctaaaacaaattaaagggagagagacaaaatatagataatcatttttccttttgataaacgaagagaaaaatttacttaccggtctaaatgaatcccaaagaaaattttaaaggtaaacatatcatcagaccataatatcctgtcacatagtcacataattgattcactacaaaatgagagatcatacaaatataaccagataattacatcttgatattgattatttcatcgaaacatcgccaaattcatttgataagaaattaaatatttggattgattaataaaaagtgtgttttaaaagtttaacaaagaagaaactgtgtttatagtttagactattagttatagaataaataaaataaatatttatctatcgttttttataagtaatttttgttaagagcgaactttaacacccaattcttcccctaacagtttcccgctcgcgtgaattaggattttgcttgaagttcgacggttacgtggtgcgtggagactgacaaggaccaaacctcttaggcgtgcgcgtctggagtccacgcgtgtggaagacgcgacaacagatttgtcatgcgtttctctaaaggtacgaccccgagacaagtggatgagggtaagagcaaaacctacgattgatttggcggttatttctttgttagggtttcagaggagtgttgagaatccctagatcccaatctgttcagagttgacactttcacccgttagcttgagctcgttacttttgccttattgttgagatgcttctgtttttttttttgttttaactagtgtgtttttttgtttaaaattgctatccaaagtttctggtaccatttcccgaccagctcaaggatgatctcgagaagattcgtgatcaaagcacatatatttggtagagattcgtgaaagctattagacgtttctttagaaaatttacgcaaaatctcccaaagaaaggtacgttgtcgattaggttaatgtttctttcatatctccctttttatggtgtagcgtcataatatgcgtccttgtaccagatcgcacagtgatgggaaaatacaattggagttcgatccggattattccaatctgagactctggcccgaagccgacatgatctgaggagtggatgatgaaggaggtgctgaggaatagtcttctggacaagggaggtcggcattttcatatgggtgggagttcgaggcctctgagtccaacttctcagaaggagaagaagaggcagccgaccgcggttcaattagctgaggccgctccggagagatgttcgatgaatatttggcattgccctgctttgaagttttcgatgttaagttcgactcgatttatgtcgacattgaacgacgtcagaaattctttcgggtctcctttatcgttgtagctttccaatttgatcttttgataccctcgaaccgatacgtatgttatccttcgggtaaaggagtttgtagcgtctctttgaggacgtggtcgagtttgggaaccgtgcttgtagcacggtggatcttcgagcacatctccaagactgcacacctcaactcggctatctctgcgtcccttgtatcgcctaagacgttagcgaggttggtttgttgaatgttcgttgtgcggttggtctggagaaaaagcgtgcgcgactgtcagggatgcgaacttatcgtcgctcattgcatcttgcctgcttaaaatggtcgtggatgctctaaaatgcgttggcgaacggtacacggccgggttaccttgcacgctgctgtgtggttcaaggttggtcggacgacgtctgctcggcgatgtttgttcgttgttctcctgcattggcggggaagtcttgatgattatcccaaacgcggtacctttgggagttggaggtagcaaaggcggcgcaactacgatactaattagtgtatccttcttgtgaggaggattatgtcggtctgtggcgtatcggttccttctcttgagctagagtcattgtctcctcaagcactggttcccttcgtagttattttgatctgtaagcgggctcgtctggctagttggaagaaatcctcaagctatctctctacctggcacgccaactgttgagggcgaacttcaactagtatgagaaagaaattctcaaaaaagtgagaagatttttcttttagaaacgaagtcgaattacatggaaaataaaagaataacagatgatgtactcttcgaggcggatttggtctcgttgtacaagaccgcccagatcatcaacggtgttgcgaaaatgaaaatataagctaaatg

SEQ ID NO: 1911 - DNA, 3000 bp, Unknown
  misc_feature (1)..( 3000): cDNA_ID_3065102_gDNA_ID_1620466_Annot_ID_157908 3000 nt of promoter + ATG
aataaatacatcattaatctataaattagaagttgaagagcttacattaattatttagtggacacatggcaaatgctaaaatgatgatgtgtgaatcatatggaaagagttggccaactttcatatatatgattccatgaatatgcttttctgagctaatgactacatgcaatcaaaaaatcattcaaatatcagattaatatgttttttagcaaatcagttttttggcaattaatcagaaaagtcaacaaagtcgagagtttgtcctgcgctaaacatcagctaaaggacacacatgtatcaaacagcttgagaatacaaagaaacctataatttcacaaatccatagtcaggctcgtctagttataacaaacaaattcatgagattgttttcaatctaatatctaatgagatttactcaataaccaaaatactttttaagcaaatcaaacattatcaccatagaaaatagttcgtatttaaattggcgcatactattttatcaaacagtgagagaaaaaaatgtgaatcaccaatttgaaaaaccaaatttcatatactaagatttatgtgttgttttaaaaattaaatatgtattattagtggagggtttgaccgtgattaaaacgaaatcgaattaagattatatcggatctttgtgagcaaatcctttcctctatattaatgtatttaggtatttactgtgaacatcaatctcaccaattaggttttttttctttcttactctcttgcagcctcgctttctctgaaaaagcattttagtcacatgtctctgcttctcaaccagccctcgaagctactatgcttccggaggaaatctgttctggtaagatcctctcctcttctctctaatggtttatcatcttcattgcggcaaactccgccttgtaccatcatcgacgctgttccatgtggagaggatctcggaaaactcgtcatttacaatgctaacgcagttcacttcacttacttggaaaagaaggtgcctctggagttggtggataatccaatggtaacgatcgggtcgtcccatggttgggtagctactttgagtcaggacgacggaatacttcgtctccaagatgatctaaacccggctgcatcggatacaaaccctaaacgcattcccttgcctcctcttgtaactctgcctcattgccaaactcaaatcgtcaccaatgtgtcaatgtcctcatcttctcccgaggatgaaaactgtgttgtggctgtcaagttcttgggacctcaaatcagcttttgcagaccggctcaacgtaactctgagtggatcaatgtcagaatcgcaaacccttgtttctactcctctcgtgtcatgttttcggagaaacatgacttgtttcgcattcccggatcaggaggccatatcattgcttcatgggatctccacaaagacaagcacaaaaatcccaagtttcagaggttgcggttccaaaaccttccaaagctgacaaagaccaaacgagaggttatggattcgtgctacaaaagcgaacacttggtggagtcaagaaccaccggtgaaactttcttggttaagtggtacaggaaggccgtctggagaggtatgtcgaaattgagcacaaaagctttaatggtgtttaggctagacgacgaaggaaatgctgtttacactaaagacattggagatctatgcattttcctctcaaaatctgaacctttttgtgtctctcttagctccttaccacgcatgtttttccctaacaatgttgaatacatggatgctgacgaagacggatatttcaatctagccagatcctccatcgttggtgatcttactagaatggggaccggtgtctatattccacctcaaaatatagacaactagtttggaactgagtttgagtctagagtctgtcttttctttttaaatcttgaaacatcaaaatctattttatcttctttatagtctatgtgagattaataagcatatcctccatccctttgagttgatattcaatatatatttatgtcattgctcactatttaatgtctgtctatgtgcctctagacgtgttcaatgatcatactgggaaacaatgtgcttattgctgctgttgatgttatacgcaaagagccgacataatatttctagagaaacagagtttaataatgcatttcataggaatggcagagatgttgttctggatgatcattagtatagtgataaagatttttgggtgaataaagtgggtactggaggagttgtgggcctagttcccgatcatctcacttctctacatactcttatcgaagctatcaagtttgtttttaaactggacgaagctttgggaatatccaatcttctcaacttattatagaaaaatatcaagtatataataaacaaattcataagaagatataagctttggactgattctagaatcttaagtatacatgcatgatgaatggtgatgacaacatttttttggaaatgaaatcatgggggaaaaagaacaattactgaagggtttgattgtaattaaaatgaaatccaattaagattgcgttggatctttatttatagagatagtgttgaatcaaatcacaactttgaacagaacgaaccaaagcaaatcgagaaaatttcggttctactgaccgcataaacttatttattcatcaactagggtttgtttaatactttcttaatcaaatctaaatctattggggatagagtagaatctcttgtgatatattttgtgacagagttatgtcctataatttagggattcgagtttattttatacgatgactctcttgtataaatatcacactttgtgaatcaataaactcaagttagtgcaatacctaattctacatggtatcagagctctaaagatctaaacctataaaaattttcgtttcttattcgatagtttcgaattcgtttccgcttttctctttaaaaccttggttcttgcgtgtcaagaaatcatg

SEQ ID NO: 1912 - DNA, 3000 bp, Unknown
  misc_feature (1)..( 3000): cDNA_ID_3065116_gDNA_ID_1620467_Annot_ID_157919 3000 nt of promoter + ATG
aaggcaaggttcaagaagtggttcgagaagcaggttgctgcatgagtttgcctttccttggtttccagtttcagtgttgttgagtttttgagcttttgagttgttgttgttatttctctttcatttgtatattcgtttggagttgtaacgatcatgacagttgatgattaataagatgagtattttttttcttggatttgacttgagttgtcttatttaagaatgtgttgtgcggtttccaaaaatggaaagtttcctagaaaggacttgtctatttttggaaagtttgagtaaacaacctaagagaaaggtgtgtttacgagatggctgggagttggtcataaggatgttctcgaggggatatgatggatggtgaggcatagaggtgtcttacgcgatattgttgctcggaagcgtctagagatatgctcggaagcgtttagtattgttgctcgagggacatgagggtcccaacgactcgtgaggagcggggtatgctcctgaggtaccggtaactcgagggacatggtgtctttagagtacgaggggtaccgtggcttcgggtgacgatccgagagcacgctttagggtgacgacccgagagcgagttttgtggtattattttctccaagtgtcgtaactcgatgactttgtggctgagagtgagccgacacaactcagggtttgactttgagtggggaagataatatgtgtgatacccgagataccgtaggccgaggcctgagagtgacggtttatgctcaaagattgcagtctgagagtggagagtgagttgtgagcaacaatgactagtaaatcgtgagtatatcgactggatagagagacctagagggggtctggttggaaggagtgcggaaatactattttatgaataaataaataattcgatcaacaaaaccaagaataactgacaatcctaaccgggttccaataaccaaaaacaccaaacataaaacaaacgagttcctagatcatcctctcttccttgccatgattccacaatcacactttatctttacctgcatcaacaacacaatgagatgcgtaagtattatcataaatacttagtgaggcgatcctcccatctacgagctatacacacaagcaaataaaaaggtataatcacgaatacaatacaaacaaaccagtcattgaacaattcacccaaaacacattcaccacacctacatatcatcacacaaaacaaatcacacaacccaatcgctcagataagctcatggtcacgcactcaccttaacaaattgattctaatagcaattaaacccaggagagactctccttacgtctgaaacagtccagaaacgtccgttaactattcaatcgctctggtgaaatcctagctgcagacatcacaaagctgcccacaaaatctcgtgccgatcggaaaacagacgagaccacgatctcagtttcaatctccgctggtcctaattcgcgtatgagaaaacgtgtctcacgaaactgcgaataactcaaccaattttaatccaaatccaattctgtaaactggagaataacgataaaggacttgggaataactctaccaaatttcgttaccttttaccacgatttgatatgacgaaactgatttctcccaaaccctaacgattctgctccttctccttttctctctttttctcctttataaaacgaaaagtggctaaccaaagccctaatttcgagtttccttcttttataggcacactttagggtttccaattaacccaaccaattaaaccggatgatttaaaaaacaaaccctaaccgattttccggttcacgggcgttacactcttttatgttgtccatttttaaaaatacccattctcttgaacagaatgaccaaattaccctcatctaataggaacatgtaattggaaactgaaatattcccgcccattttttggcgccgaaatttatttttcccgccaaaaaaaaaattccgccaaaaaaaaaaattcccaaccaaattttttttcgtaacaaattttttctcaacaaaaaaaaaccttttaaaaatccttgtaaattctttttggtgggaaatagatttacaagggattttaaaaggattttaaaatatttacaagggattttaaaagggtttaaaaagatttacaagagtttttaaagggtcttcttgtaaactctttaaaaatcttttaaaaacccttgtacgtcttttaaaatacttttaaaccttttttttttgtcaaacaaactttcattagattaaaagttatgggaatacaaagctaaagcttccttagctaaagaatcagctagaacatttgctgatctcgggatatggatacacttaaaggaaatacaacgcttagtcgcctcaaaaatatctagaagaggaccatggatttccactagaggggtcttcaagttaatcgcctttaaaatccttaaaaaatatttaaaaaaacgtttataaatcttttaaaaccctttaaaatcccttgcaagtattttaaaacccttttaaaatcccttgtaaatcttttaaaacactttaataaaccctttaaaaatctttaaaaaaccattgtaaatcttttaaaaccctttaaaatctcttgtaaatattttaacgataaccggataagcttgatagatgaacataatgcatgaatctctttctctaacatctgtctgcttcttttttaagcaacgatggatttcaggaggtacgattttcatggaaagaaagacaatgatcaaggtaaatcagagaggataggaggaacagatcgtcgaatgtcgttctaattgatcaagagatccacttttttctcatcagatatgataacataaaaataataattccatttatttatttattcttaacgatagattttaatatttattttttccatccaatggtttatattaaaaactacataactaaactagtttgtttttctattgtttggtagaaaaaagttgatg

SEQ ID NO: 1913 - DNA, 1666 bp, Unknown
  misc_feature (1)..( 1666): cDNA_ID_3239137_gDNA_ID_1620467_Annot_ID_157950 3000 nt of promoter + ATG
ctgaaaatgaaaaccaaacccaacaaggaaaacccttaagtaaaggaacaacaaataaaagcccaatgcctaaatgtaaatccttagcgtgaaggaaaggtagtgtagacacacgtgacaagtgaaaaacagaatggatgacacgtgcgaagttgaagatgagggagtctccgatcaccggaaagttgcagtgacgttggaagcttcctttcaagccgaaattgttgggaaggtcattcatcttcttcgcccaaagaaacaaggcgaaatttcaattgagttttgatggattatgactccacttgatgtagacctgtaaatcttcttcatcttcttcttcttcttcttcagttaaaagcttttcaatcgataaggaaaattagatatttgggatttgctttcatcaaacctgagaataaaaattcaatcatccaaagcatcagtccagaaattaagcctaattacttccaaaaaaaccaaagatactaaacgtgactttgctctgcaacttcaatttgttcttaattgattaaaaccaagaagtttgaagaacaaaataaaccctttaagcaaaggaggagcaaagaactacacacccatatgtaaggatctaattaaagtaatgaaacttaagaaaactgaagttaaagagagacaaaggaaagaaaaacaaaaaacaaattcagaaaatagccgacgttgctaagaaagccaacgacgctagagtaaagctgaccaacaccactaaaaaagctggccgttgccggagccaaagtggaacatcggagaagacttcctctctctcaaagattaaaatagaaaagagaaaggcattgttagccggaattaggattgtattttctgccctagttgcagtatcaatcatgaacaacagaccactacatgtgctctctgttcccaacagatcactatatgtgctctctgttccccaaggcgtcgtttcatctcatatgctctatggttgtcaaggttcatggactccaagatatcgtttattgcttgagttgtatgttcgcctgtatctatcttgtaattttctgttgttatggttttcgcttggcttttgtagcagcgaattgcttagccttcatggcttggttttcttcccttgtaatcaagacctcctttattggagtgtagcagtttctatataaattatgcatgacaaaaaaaaaaaaaaaaaggcattggtccttccagttttctctactctaagaaaacttttttttcttttttgaaagaatggggttttaaaattcataaattaatacagggctcaaatataaatttagtaaacgtataggatttaatcagtaaattatcaaacccaaaacgcgtcgttacggatgaagaagaagtgaagaaccattttcgtcaaagtagatccgaatcctagttcgatcttgatcttcccggcggagtaaccaaaattccggtgagttcctccgcaagccctctctctcttattactcatagttgtatcagattattagtcgtcgttctgattagtaattaatttggaatcggtttggttttgcgtgggaattttcgttcctgattgattctagttttagatacagattcgaacttatggtgtttatgatccatctatgtgttgtgttgtggttttgctgattagtaaatg

SEQ ID NO: 1914 - DNA, 3000 bp, Unknown
  misc_feature (1)..( 3000): cDNA_ID_2047023_gDNA_ID_1620467_Annot_ID_157936 3000 nt of promoter + ATG
tcatggcgcttttatagaaataacccaaatatttgaaaataaacattttttatttaggtttatgtagatgggcatttttatttgatgatttgactattttactattgaatcatcatctcatcatcttctttctcttagctgctttctcaatccaatgtttttgcaaaaaaatcaaatcttttatcccaaaatctctttctaatcacaaaactcgattgatttaagataactaaaccctaatgatgataccatataaggaacccaagcgataatataaacgatcatttaatcaaattttttggatgtgtaattgactaattaggttgtttcttatctggatttcgaaagagaaatagtctggcaaaaatatcttagctccattgtagcaaacgtcggcatcggtggcttctgcgtttccaaattaatttttatttcacttataagatcttgctaaaacctcttttgtacaaaaatcagtttcaaagaagaaaaaaaaaacaaaggtcaaattagtcttttagagaaagtaaaagagaaatttgcaaaactaacgcaaaaaaaaaaacttaaattaagaaactatcacttgacaaaaaggaagataatattttatgtattttatgtatatatgacaattttgccctcacacatttcttccatttcttttgtttttctcttctttttttatattattttttgtctacgttggcttccgctccgccatgtccagaaacggaagccttgcagcaacccaactcgaaccctcgatctcctcatcactcttaccatcaccactcttttttcaactccttcctccacagaaacttcaaatcctaccgccggagctcgccgtaatccattttggagatgtcgatggggttgtagatcactagatccatcttgggtatgtcgttgctcttcttcaattccagattctgatcatcctcaacatcaaaatccataagagagagctgcatgagaagcacggcggcttgctcttcctctccaaacattagtaatttattcgctactatgtccattcataacttcgtaatccccacattcgtcagcccatgtttcaataattcactcaatttaggatcaactttgagaacttgatttttttggtttcttattattgtctgtttcaaatctccactcatggcagcaatactatactatttcaatattttttagtcctttgtttttattgaatttgatattttcttataaatgttaccttcttattcttggttcaataattcagcttgagttattgaaactgccgaactctctaatttcatgtttattatatagaacacaaaatcattagtagtttgaggataaaagaattagagtttaattgattggatcatgtctaaaattagtttctttggattttctaaattctcttagggtttagatttcttccatcaaaactctagtttaattcaatcaaaacatactataatgtatgtttttggttatattttttatcgtccaatttattttttacaatacttcatgaatttgttatgaacaattaaagtgtataatatgatatacttttatgtataatagtccatttatattttttatacagctaaacactaaaattgtcttttccattgtctctcatgctagtttattaattgttacaattatgctgctatattcttaattcatttattaaatatggctattcttgcaaatcaccaaaagtaaaaatactcatctacataaacactaaaaaaatgggatcaattacgaataaagcacttaaaattctatgtcgttgtcgatacaggcacaaaatgcatgtgcttatagaattaagtacttctatctcttgatattgacgattttacccttcgtcacccagacaaacctaataatttcctcttctctcttttttaattttttttagttggattatctctcacccacacaaccataaggaatccaaaacccaggttcgaaacacacacaaaccatacagaagaatactcgtaattgctattgttcaatgactaccataattattcatctctttgtctctttaaatctatcattttttttctttttgccccaaaatacgaccataaaagttatatttatctgatttccaatctccaatttgagatttgaaaattgcagtttgaaggcctaatcgaccagcctttgactgcctgctttcaagatctcatgttacaaaccgtgatgggaagcttcgtcgacactagcaactaaatttggtttagaatgaattgatttaatttgtgtctaaaattagaatccgtggattccctagacattatccccatagagtttagattctttgcatcaacactcttttaagtagatctatcggattttaacggaggaggttggtgaagaaaatgttgtatgagttgtcagaggtgaaggaacgattttgttggacctgaaaattatgattttgatagagtgttgagtcggcggtgagaagcagaagattgttggtcggaaaaatcaggcgcacgacagagagacaagggaattgagggcaatattgtcatttcacagatcaaaaagttcttaaacttataagctcaagtcaaatgtgtctcttttctaatttttgggccaaaatatgcctatatctataaaagccccaaaaaagttcctaacttcacaataccccatacattattatggttttttcatatggtcctaaaattcatacttggactggtcttcaaatgtcatgttttttttttttttttttttttctggtattggcttcccaacttctgtaactttttatttgaaatcagtacgttgctataaagtattcagtgcgtctactttcatagtggctatacatgttgctttataccccaaaagcaggcccatcaaccatttaattcttcatagatctcggccttttaagaaaattaacactctctttgtctctttacgtacaaaactgtaaattaaagcttttataatcgaaaaatg

SEQ ID NO: 1915 - DNA, 3000 bp, Unknown
  misc_feature (1)..( 3000): cDNA_ID_3065136_gDNA_ID_1620467_Annot_ID_157939 3000 nt of promoter + ATG
caatacaaaataagacattcccaaatgtcataaagatatagataagattcaacgattttaaaacaaagagagttgtgaggcaatagcaagggagcgtattgagacatgtgaggtcatggttaatcgagagatcattttcgaaagattcgaaagacgacagataagtcatggccacaggaatttgtgacgttgatgaaagaatcaatgcgttgattctcaccggagcaagatgaactacccaaagtagcacgaggacaaagattcgggagactatggtgatgtaatcgattgaggattgctttagaaccaaagcataaggtttagatctcttcgagaattttcagaatatactttgaagcataagatccatatgatgggagcaggtgaagcagaagccaaaattcggatatggatagatgtaaaactggaacgaaataagtggatcctctctcacatgaatacctcgtacatggagattaagcatcccacacaaagcttgttttaggtttgacatatgaagaattaaaacataccagaataggatccaggccttcgaggtcattcaaaaaagggtattgatgacagtttacatagaatgcatatatagtaattatttttaagtaacctcttttacttccaactagatattgacccgcggtacaccgcggataaatatgtttatttaaaagttatataaatcttttttataaaaattattgtttgtatatgaatgatatattcttgacacctagtttttatttatgttaaacttgggtaattcatgttttatgttctgatatttgttgtatattaatttaatattaaaattcattatttttctttgtggttagagttttgtagaggtaataataatttaaaacttgtattatctagatattgacccgcggtataccgcatgttaatatttttgttagaaaattagagatttttattttatttaatattttatatatatatatatatatatatatatataaataacatattcaagaggtacatcataagcttatatttttattaaataaaaaattaaatttttgtttttaagatgaactatagatacattctattgtttttttaatgtatgatattatgatacacctcaagacgattttattaactaattttttttgttgaaattttaagttatatatttgtttcgttaatattttttttagtgtttaaaattgtataattgtattttgattgttaattctaggatttcatctatagtgtaccatcccgtattaatttcaatccaaacccgtcccaccatataacctcgtcccatgaaattattcatcattttgtcattttcttataaagttcgaatatttataatattagaaacttcaaaaaagtttaaatatcgatccaaacttcataatttcattttgattattacatataggatttcacccgtagtatatcgcccgtattaatatctttttaatatttatatgtttaaacttcttataaaattcaaatatttacaaaatttaaaacttcaaaaaattaaaaattgttaatatttaaaactttttatggtcttaaaaattgtactacttgaattttaataaagttttaatatatttaatattttaaaacttttaagtttttaataatttaaaataaagaaccggagtaaaccgaataacacttttaattttggatgtttgatatattaaggttcccgctcattcatatccaaaattattttggtcttttttatagtatgactctaaacgatttattaattttaagcaatgtgggatcttgtacacttattgttttcattgattgagtattatattatatgtctgtttttaaattttgaattacagtagatgtagaaaacttaaatattttattaactatatgtattatatatataaagtcaaaataaattatatataagacaaatatagtgacagaaaattatatattgatctttaatgtcgatatagagattttaggaaattagccttattcgaatatagttcaataaagaaaaattaaagtataggataaaaatttaattgaaatatttaatgaaagttgacaatttgtaagtttttagacatagaatatttggttatgattaaatttttaaggactaatattgacaatagtaaaaaagtgaggcatttttggtcaaaaaccttaccaaaaatgtatatgtatattttcccttattacaatttctattagaattagcttgatattaagtgattaaaaaggaaaggaactcaagattatgtacatatgttcaatcttttgttgattctcgatataaacttcaattccacattcagagggcattaagttttgatttaatactatgacaggaaaaaaatgaagccttgtgtggataaggagagacgcaactcgctcccatagttcctgggatcactcgcgacatactatagagacttattgttcagaggttcggctatccctttgctctgatcttccctcccatctccttcctctgtttcttgtttcttaattcttatttccatcttcagttgcccttttcaattagttgacatttaagttaagttatgatggaaatagcaataaatttgcatgtttgttctgtctttttccgggttaagtagctctactattttcagtagttgaactattctctcttagttttatgtttcagcaatgcagagtagacattatccaattcttattgctacaattgaacttttttgcagatgtgcaaaagagtttcagagagtggaagtagatagtgatgcgcaaatatattgtagctctagagtccaaagttttgtttgtttgttttagatacatgcacttatgcacagaccattgaatgagaaaattgatgaaagagtgatatggtaatgatttcttctctcttgttcacatgttatatgaggattgtcactccatcttagtgacattgttatcttccttttgaaattttgtgaggttttaacagagatg

SEQ ID NO: 1916 - DNA, 3000 bp, Unknown
  misc_feature (1)..( 3000): cDNA_ID_3065127_gDNA_ID_1620467_Annot_ID_157942 3000 nt of promoter + ATG
aatcacaagttgtctcttgcgcaagatggttctttttcagaccctacaaggtatagacgtcttgttggtcggcttatttacttgggcaacacacgacccgagctgtcctatgtcattcatattttgtctcagtttatgaatgatccacaaaacgctcattggaacgctgctctccgtgttgttcgctatgacaaaaacagtcctggtcagggcattctacttcgtgctaacacgcccttaacattgactgcttggtgtgactcggatcatggtgcttgtccgatcactagtcgttctcttaccggttggtttatacagtttggcgactcaccgttatcttggaaaactaaaaagcatgatgttgtctctcgttcttcggctgaagctgaatatcgcgccatggcagataccgtgagtgaaattctttggctttgtgagttattaccaactcttggcattaaggttaacacaccaatcactcttcactccgatagcttatccgccattatgcttgctgctatccggtgtttcatgctcgcaccaaacatgtcagacgtgatgttcatttcgttcgtgatgagattattcgtgtggtcatagcaaccaaacacgtttcgactacgactcaattggcagacattatgacgaaggctttgggacgtcaacaatttgaagattttcttgtcaagctgggtatttgtaacctccatactccagcttgaggggggatattgggcctatgggcttagtcggttttgatatttagaataggttaactttatgctcaagttgtaacctatatataaaccaaacaatgtaacctaaaaccctaagagattcagtttatacaaacaagagtttcttgacagaatattttacgaacgagtgttaccagcttcgtcttgggctcgagattcattgtttctgcaacaagaaacatgagctccatctccggctggagactccctgcttcaacaacgaggtccatgaacatgtattgatccggctccaagtgtgtatatagcgttggtatgagagagatattttcgagaaatgagtgatatatataagcttccttagcggtctaggctgagaattcaaatctaaagagttgaagacacatgttgtttgagtaatgagtgacatcagctcagattgtggcttcggctccgaatccaaatccattgaggtggccaagtagattatttgaataatacatgatgataactttgaaaccgaatccgggttcgaatttgaatcttgacaccaatcttcactgagagtatagacttggcaagtgagtgatatgagtttcgactccggctccaaccccgagtccatagagttgtgggcgagattatttgatgagaggttttaagaatcactaagtataatgcaagcaaaatagtcgtgaaaacatctcagaacatatagagcatatatgttcacacatttttctttgtttgagttctatagtatcccgtattagtaactcagctcaaaacgacaacacttcgcagttgggcctaaagctacagaagcccaacacgatccagaacacaacaaagccttgtcgtcctcaacggttatctgcagaacaagacaaaagtagaggattagcagaacagtcctgcagtacggaggtagcgacaatgaacatatttgaaatgcttggagcgtgcgatgattaagacaaactgataagtttggaggaaaccttagtagtataatagtttctctcaattatattcattagccaaaaggcttatttatacaagaatattacttgcataacaagttctttagatttatgataatagtaaatctacctatttaataacaagaatatattttacaatattaactttcctttcaagtcgatctcgtaattcccgagatctcctaataccctcccgcaagctcatatgtggtaacacatatgagattggacaatcatcaaatcatcttcatggtcttcatacccactatagggtcatcaatgacatttatatcatcaattcgatagaaaatactttagtagttgtatctccatcgattttagatcacaagtcttggttgctcttcgaactttcgtgttcatgaagaaacttgtgtagtagtcatggttgaattcaaattaattaccgccggatcagcatcatatccgtcagtcatcttcgtggcttttatcttttcgtagtgtaaacaaaaaccacataaagaccggttaaaaaataccaaacataaccatatggttttgttggtcatcatccttatccaagtaaatcgttggttcaggtcacttttgtagtgcgtgacaataaacaacgtcttcttcgtcagtatatcttcttcttcaaataactagcaagttttgctagcaaataaaaaatctaccgtggccaaaaaaaaaaaaaaaaattgaccgaatcaagaagatgatcacgtctctcctcttctctttttttttttttgttttttttttttttctataatctaaagaatttgctatgcaagtaatattcttgtataaataagccttttggctaatgaatataattgagagaaactattatactactaaggttactctcatcaaatttatcatgctatcagagccttcgatcctaattcctatggattaaaggctttttttgcttccgcaactatgaaaaaaaataaaaatgttgatttgagattcgtctctttgatttactacttttcatctttggaatatcaaacatgctcttttgatttccttttccatttatttttattgttaaaaaaaaaaaaaaaaaaaaaaagagaaaagaaagcggagacgacgtgatatggttacgtagcatttaaagacagctaagcaagacaaggagacactaggttaaagaatagaaactctataaaaccaatgtatctttgtcattgaaacttaagctaaataaaatcaaaacatcaaagtttacagttttggcttctttcctttatggtatcagagccatg

SEQ ID NO: 1917 - DNA, 3000 bp, Unknown
  misc_feature (1)..( 3000): cDNA_ID_2024884_gDNA_ID_1620467_Annot_ID_157947 3000 nt of promoter + ATG
ctaaataaaaatataaaatcagaatacttcaaagatgtaaggcacaattagaaaactagatttaggtttttcaattcaaatttttttgtaaaacaattttcatattaacaaaaatatttaacaaaacaaatatcaaaatatttatgtaggactttttgtccgatccgatcctagccggactaagctccaaaaacatttagtctaaaagagcaaatttttcaagacatatatatatttaacccgaattcgctgtttttagagtaaggccaggccagcatacgagcattatctctagttgacatgcctaactattaggctcaactttccacatacatttataaaacactagtgttctaaaatacggcttatacggtgtatctatactgtacagttggaagcagtactgtattatggttatacagttgttaaatacaatgaaagctatatacgagtatatacaatgaattctgtgtaaaaggtgtattaaaaaaaatgctcaaaaacaaaaactatggtattttattggcaggaaatttatttggaatattttaggcaaaaaacaatttccaaataagggtaaaatagtcattaaaaatttactgaaagtagaaatgaaaatgtcaaatatgaaagggtataactgaaaaaggtagtgtgaaaagggcattctcagcaattattctacatttgaactatctattttatcttaataaactgttttaattctatagactacatccatcttattgatgatatttaaattttaaataataattcatatacttttcagtatttaatttagtatttccttaaaccaaatttcaatcttacatattcaattttgcaatacaatttaaatatctattttattatataaaaatacaatttaattcgattccatacaattcatatacaatttgattttgcaatacaaatacaattttattctatacactccatcttattgtgttagttttccttcttagttaagaaaattttaagttaaatttttcgatatagaaatataaattggtatatgtatttgtttttgttaaatttcctatttcttttagaaaaaatatttaaaaaatctcgattttgcaatacaatttaaatatctattttattatataaaaatacaatttaattcgattccatacaattcatatacaatttgattttgcaatacaaatataattttattctatacactccatcttattgtgttagttttccttcttagttaagaaaattttaagttaaattttttagatatagaaatataaattggtgtatgtatttttattggttaaatttcctatttcttttagaaaaaatatttaaaaaatctcgattatgcaatacaatttaaatatctattttattataatacaaatacaattaaatttgattgtatacatttcaaatacaattcgattttgcaatacaaatacaatttaattctatacactccatcttattgttagtttcccttcttagttaagtaaactataacttattttttttagatatagacatataaattagtatatgtaaatatttgtttttgttaaattgcctatttcttttaggaaaaaagtaaaaaaaaatccgacacaatatcaacatatgaacgattgacttgttacgtgtcacgatcagttgagttattaactttaaaaactctactttatataataaaatgcgtctgaaacttcttaatttatccgctttatcattagcacgcttttatatatagaaaactagattttaacccgcggtataccgcggagacaatttattttttaaagttactatatataaaaatttgcaaattatatttatctataaaatatttttattttatagtttacgattgttattaagtaacgtcctgtcaaacccgtcccgccaatccgtcccgtaaaaaaaattcactgattttatttatgatatgtttatgaatcattgtctaaatattttttaattttgtagtaattaaatgctatctaatatctctgcggtttgatgattataatcgaattattatagtcatgtagaaaaacaatatcaaaaatgataattttgtagtaattaaatgatattaaatatttcggaagttttattttagtaactaatcgtgtagttaatgtggaaagattttgggaagattgtcaaatatttaatttaaagattttctttctaattatcaaaaacaattattaaatgcgagtggcagccactgtaaataaactccaactctaggatttatttcacaaagtggctgcaaaaatgtatatatagatcataaaaacagtaatataaaaattttaaaccttaaaaaactagtttttcaaacaaaaacagaaaatgggcaaaaaggccctaatttaagggcttgcaaatggcaataaatgtttatctgggttttgtggtttcttgattcgtcattaccaattttcaccatgaagacttaaaaaaacctgactcagctctgcgtcacctacgagttggaaatctgacttccccaagaatttcttcagattacatcgtaatttacaattctgccctatttatacccatcaatctgattctccttgtttctgtatatttcttcgctctttgtttgaacaatttatctgggtttttgattctcggatctactccaagacggttttcgaaattaacaagcttttcaggtaaattgacttttttttctttgtaaaggtttatcaattttgtcttctaaactcaaacttgtgagtctcttgtttggtttcagaccaaaaccaccattacaaagtagttatgtcggtggttcttgtcagttttcttacaagcttatggttggtttagattagatttgatgaaatgaaaattgagttgaagaatgtttttttttatttgagcaagttaatatgtttactgatgtttttctatagagaagttgctaagagagcttacttatgagtttgatgttgaattgggacacaggaaatg

SEQ ID NO: 1918 - DNA, 3000 bp, Unknown
  misc_feature (1)..( 3000): cDNA_ID_3065122_gDNA_ID_1620467_Annot_ID_157945 3000 nt of promoter + ATG
ctctttagggtgggatttacactcttccaagtcatttatcatctgaggctagagacctgatcccaaggatgcttatagttgacccggtgaaacgaatcaccattcctgagatccgtcaacaccgttggttccagactcatctccctcgttatcttgctgtctctccaccggatacagtagagcaggctaaaaaggttggtttcagtgccatttggagattaatagagttcacttgctgtgatagtaacaatatctcttatgttttgcagatcaatgaggagatagttcaagaagtggttaacatgggatttgatagaaaccaggttttggaatctctacgcaacagaacacaaaacgatgtatgtagtttcctgtctctaatgcttttaatccccgaaactagtttccaatagtcactgaaatgccatttgctccttgtaccaggctactgttacatactacctgttattggataaccggttccgtgttccaagtggctatctagaatccgagtttcaggagacaacagtatgtgtttttctttcctctcagtagatagctttccaacatttttgactaacatgttcaccttttcaacgttactcatctaggacagtggttccaatcctatgcgcacacctgaagcgggcgcttcacctgtaggccactggattcctgcacatgtggatcactacgggttgggagcaagatcacaagtccctgttgatcgaaaatgggctcttggacttcaggtttgttcctgattactgattctttttgttcctcaccataaagtcttctgaatgcaacacacaatcagatatctgtactctttgcctctacatagccaaatcgataatcattctgttaccttgttgttttgaacagtctcatgcgcatcctcgtgaaatcatgaatgaagttttgaaagctcttcaagaactcaatgtgtgttggaagaagattggtcactacaacatgaaatgtcgatgggttcctggtttagctgatggtcagaatactatggtcaacaatcagctgcacttcagagatgaatccagcatcattgaggatgactgtgccatgacttcacccactgtcatcaaatttgaacttcaggtaactataaactcacacatacatttgtatcaacaacattccttggagaaaataaacaactgcctagttcggtttgttagggatatgaatcgatcaacggggtttacattcgtagaattgtgctggagcaaagactaagatcctgatgttgttttatcccactagtagtagttcaacaaaactaaaccagctaggacatagactaaaaccttctttagaacttgaaccaactgttttcgaagaacaattatacactttctgagttcacttttgattttgaaacagctatacaaagcccgggaagagaagtacttgctggatatacagagagttaacggtccgcagtttctcttcttggatctatgcgccgcctttcttacagagcttcgtgtgatctgaatgttttaaccatttgttgagacattttttttctttcatgttcaatggtttgtaatagtagagaacataatataatatgtgggtgcagtgtttactttgccgggttacttttatatacctggattctaagttaaactctactgtaatagtaactatcctttcttctttttgatggtttttaaggtttgatcatgtgtacataacttagctgtttcattctaactattgtatttctcctctgatgccaattttatacaacgtttatatcagacacattatacatgtcatacctaaaaacattgcacgcagagtccatcaaaattccatttcacaaaattcggctacccaacttaagtccttagcatcaatacaagatgtggaacacgatattaatacagaacattggagagctactttgtgtggacaatgcttcttgcaaaaggagtaaataggtcgccgtcggacaataatatatcgggcttcaaggataagtccaccccaaacatacattgaatgtgtagggtaacactacagtactcatcacacataaaaccgctccttcggatttattttgctgatttttcatcatcagtcggttcggaccgcaaacttcacaccaatacatcgttgtacttatctcatccccataagaaagagtgaacatatgtttatcatgcttatacattaccttatgaggtaatgtagcacatttgaaacacaaagaaaagtagtcacactcaatgcaattgaatgtttcctttctggaataatgtcctagctctttgcaaactgaaaaatgtcttcgcttctctcccggtttggttgttaggaataaaggatgcaaatgacttggatggactagtggctcagaaatcttggcgcattgcatgtgtagcagaaaacaacatcattctttactacattcatagaagaaaccagctttacacaaccaaggacaagcaaaacatgtatccttatgatagtccataacaccgtcataaatttctgccaccttcgcagaaaaagtgtgtatagccttcttctcctggttgcctaaatttctgccaatttaaggaaaaacacttccacttgttattcgtgggccgcaagacttctccaatcacatggattattccttctttaaaagttacttgtgcttgagggcaaactgaaataagtttcttcaactttgaatttttgagatgacgagggagaatatattgggcctatgggcttagtcggttttgatatttagaataggttaactttatgctcaagttgtaacctatatataaaccaagcaatgtaacctaaaaccctaagagattcagtttatacaaacaagagtttcttgacatggtatcagagcaaaacctaaactactcaagggtttgttcgattctatgatctaaacttccgctaaaacaactctgtttcttattttctgttttttaaaactatctcacaaaggagaaaatcatg

SEQ ID NO: 1919 - DNA, 3000 bp, Unknown
  misc_feature (1)..( 3000): cDNA_ID_2047053_gDNA_ID_1620467_Annot_ID_157926 3000 nt of promoter + ATG
tgaagaagaagagatcaataataggacacaaatcgactagggcacaaatcgtttgtttataatttatttttgggtgtttttttttgtattctaaaaaaattagaatttgttttctaaatccagtaaaaaatcgtaatcttaacagaaaatatactattaaaacataatatttaataaatatttactttactttttcaaagattcactttctatatctaggaattctaaatagtttagtaaaaaaattctaaatttgattagaatataaattgtaaaagtgaaaatttcttagaaaacgttttctactgttttcagaaactataaaaaaatttagaatacaatttaacacatagtttagaacatgaaagaaattttagaatacatattctacgatatttagactatttttatttctaacaatcttagaaaataggatattcaatatctaaaaattgtagaatatgtattctaaaaattgtagaatatgtacaaaatattagaacagaaattctaaacaaagtagatcactagaaatcgttttctaagaaatttagacaaaactttatctataaaaaaatcaactttttcaactaaataacaatttttttttttacaaatcaactatatttatgtagatctacatgttatcaatgttaaactttttcaaaaatgcttaaaatatagagtatgggtattttggtccaagttggcattctccaaaaaaaggtgtatatggacaaaaaaaattgtagaactcctttaaatttaattttcccatattaattagataaagctcaaaacaattatatctaacgaatgttgtttacatacatgatatgatgtttttcggtatagacttttcatgccaaattgtccacttttacatttgaattacgagagattaaagataaagaaaagctagtgaactctcccttgtcgttctgtaattcctccaaatatgctgaaaatgccggtcattcggttgaacagtttgttaagaaaactacatcttggttgtcgacgtcaatcatgcactttatagctcaaaaaggacttccacatctacgtgtattggagacaaactccttagattcacagctcccatggttggtggctctccatttgatgatctacaataccatcatgttctagaaaacttgtcactttctttccataaaccatccacatagcagcggtatcctgattaagtgatatcataagtgatatcatgtgagatatttcttactcgagttctagtgtaaatttaagtaaccataaattttagtatgaaactgaaaaacactttttgttcattgctttctaaacatccaaattattcgtgacagaacatatatttacaaagactcataaaagtagcgatagttaagtaaattatctaaactattatttaataatttaaaaaatttataacgttaagagtttaaaacaaaataatttcgaaatgatcaataaacgtaaaatatatttagttgaaattctaagatacccttaattttaatttgtcgttgatgttaaaaagtttggtaaacctatcccagaagacaaaaaaaccgttgttatggtaagaagaaatttggcttcagacattttttttttccgattaaaaggcaagaccataattatgtttacaaaaagagtttactctagtacaaaaacccataaaccccaaagaagaatctagatgaacctaatggaaatgtagtaaattccaactggtagtagccaactcatttgagaattataaagcgatgcagtcttcaacgaatttctgattcagtagagggacatccagtgttgcatgatttcacttgtcacaccatatggttattggaaattcctacaattatgagtattgttagagtttggatgaccgtggatgttactaggagtacatttatttgtgaattataatttcttttatggttgcatgattatacacttatatagtagaaattacataaattaatacttgataaattaataaatacgataaaattaataaaattttgctggtcccaagtcgggctaatgtaaaaattaactaaaatcgataagataacaagataataatttttttgaaatctttgtgtaaaaatatggtcccaataatattataaattaataatcataaagcatatatttgaaaactaattttatgtgaaacttttctgcaagccataattgcaactcttttagagtacagttgatatgatattttttgtactcacataatgttttgctttgatctgtcatatttgattttgtaacattttttatatgagaaaccattgttaagatttatgtaaggaaaaattagattaagcatcacgttaacgtcgtagatatacggacacaatatcttacaaaaaaaaaattacaaaaagaaaaaaaataaattctaatataattgaatatacgaacaacaaaacataagaaaaactaaaataaaaaaaaaatttaaaaagaatttaatattaaattttatgtaaatactaaatatctataaattaatatttataaaaattattaatttatagaatttctattcctcaactttcttttgaataagttgcaagttttttattttttgtcaaacctaaattttatatattttcttttagtgcaacaattaaaataactaaaataaaaatctctaattttcactgctccgtaattacattcgccggatctccccgtcatccacattccgttatcgccggcgttcatcttctctacagatcgattcggatcttgtaagattcttttcccttcgtctatcctaatctttctttcttccactttgtctttaacatgtttaatctcccctaatttcgccgatgttaattttctcttcccctttaaatttatacgtgtttatgcgttctaggttgttttagagatcaaattatttactgattttttgttgtaattgattctgcaggattattttttagcaagtagtggtttctgggaacgatg

SEQ ID NO: 1920 - DNA, 3000 bp, Unknown
  misc_feature (1)..( 3000): cDNA_ID_1377348_gDNA_ID_1620467_Annot_ID_157925 3000 nt of promoter + ATG
gtcagaatcttcaggggagggattagaggggataggggcagagggtaatataggattggaggttttgatttggtaagagaaatagaagccttgtttgtgagcaagagagaggttgattttggtttaagtatagtgaaagtttcagctaccttatcttgtattgtagcagtaattccagatctagaagaatttgaaaccgcatctggacaaacagaaataggagtctcaacaagatgcatctctacatcagtagtagttggatcagaagcaacgaccaacacagagcctaccactacaggctcaagaacacgagcagtttgcaatgaaagctttggggtcttggaggaactggaggacagggaagggaactgggacagggataaaataggggaagagggatcagggggtcaggagggagaggcggaggagggatctggttaccaccagcggtgggaagcattggattcaaggcggaagcacgaccattcgagaaccagcggttctgcattgggaactgggacagagagaaaaaagaaaaaagaacacacaataccagacaaaaaaactatttagcaagttatatattcatatcacctcaataccatacatcacaatgcttaaaataaatagagaatatagtataactattcgattccataatttaaggtaaattgacctcgaaaaaaatatctacaacctccaccaaataaatttgtttcgaaaacgtttgatatattccttaaacaacgtaatttataaattcaaatcaaaaaacagatcttcaaattcgactaaatctatatattcgattcaattgattgtcattgaacaattaataaaattaaatacccgaatatatcaagtatatatcttaactaacattatacacaaatattattctaggttgtactttcctaaaccctatatcaaacaattcacgaactagattactataaatatatggtgaagaatgcaattgaaagtcaactaaagaaaagtgaacaagctacacaggttcatcagatatggagagtggtgaagaatttgatagtagttattattttacaaatataagaaatagaatttatttactaataaaacttttttattctaactattacaataggaatatattctgtaagaacattgttttttgttaactaaatcaactttcagttatccaaaaaacacaaccaaacttttcaattaaatcataatgaattgtataaattaacattattctctacatttgtaatagatcagacattaaataaaattcagtttaccaacattaaaaataccaaacaattaaatgtataatatttacgtaaaatatatatactaatataaaatttaatatcacaaaataagtacacgttttattttaacaaaaaagttttaacaaaattaattaaacaaaaatacctacatgtatgtgcgggtcatgatctagtattcaataaaagaacatgaacaaactctatatttacataaggaatttgaatacaacaagtttctctcatatgtggctttagaaattataaatgagagaaatttaaaatattcattttggcctaatacaaataacaataaaaattgtctacaatgagagactaattttctgatacttatgttactgcgagataaatatcttttaaatttgacgactctttactaggaattatacaatcaaacttatgtaatggagctatatattttaatagtactccaaacttttaagtaatattacatgattctacaatatttaataaatgtttaaaaaatatacacctgattgaaataagtttcaacaagaaaaacatggctattttgttggtgtatcaaatttattttaagcaatctacatctctttttaatctgtttattcctagatgataaaggacaaacaacaatatcagttgtacatggtaaaatagtctaccctctacgtatacacataaacggttaaaatgaacacaaattacaatttagaccaatggaaaatcgattttactcaaacaccaacaaactttgaacaaagaactgttacacgtagaaccaaacaatatgatgaaaagtattattaaaatttagatcctttagaaattcaccctcttttggaataaattcattttatgcacatttttttttctccgattataggtctagccaaactattactaactcggaaaaaaatacagaaaaaatattcacaaaaaaaagagaataaacctatcaaatttcacctaggtgatttgatagaagtcgtatcacctagttttcctacttctccaaaagtttcagatttgaaatagacaaagaatatcaaatttaaattagagaaaaaaatatcttaaaggagaatttttatccaataaagttaaaaataaagaaaaatggtactttgacaccttcaaagaattttttttttaaagagaattatggtataaagatatgaagtacatattctattttttgcatggtttgaaatatgtgctgtagaaaataaaatagattatccttacaaaaatgaatcaataacattagttcaatagtatataatacatgggaaatgactattgagaaatacaaaagaattcatccaccattaaaagatatatgttgtgactagtgcatggatagaaaaacaagaatttaaagaaatcagaagaatttatacttcttctctttcagggaatacagttttcgtctcaacaaaaaattctttaacaattcctgcggctggacttggactggttagaattgctccttcacgaaatttggggtgaatttacaaataaacataaataaagggaggtttcacgaatttttaaaaataagtatcctgatcactaaatattacaaaactaaagaacgtcacacagatggtgatcgaacaataccgacacctaaacctctgtaccacaattcgacgcaattcatcgttacccaaaaacctctgtttcgattcctagacactctcactagggttttacaact

SEQ ID NO: 1921 - DNA, 3000 bp, Unknown
  misc_feature (1)..( 3000): cDNA_ID_3065174_gDNA_ID_1620468_Annot_ID_157955 3000 nt of promoter + ATG
ttcttgtctggtgttcatggccttcaaggcgagatttgcataaaaccaaacactgattttcctgatttacgtttctctaaggtattcaaaggatagaaatttgaagaaagtttgtgttttttttcttctcttttcttgaaaaacaaatatgtataatttgacatttttttttaccattggcttgattgtttcattagcctggtagaagatggttaaaacaacaattgttgggacaagataagattgatgaggttgaattagtcgaaggaagacctcatcctgcgcagaagagttggattcttaagtttcgagggttggacgatgttgatcaggtagtgtagtgatccatgggagattttaaaagacacatttgaaaatgatttgttacatttgatggggtttccgtttccttcaggtgagacaactcgttggtgcaactctgcttgctgaggacgatgatcgtcctgagcttgatgaaggagaattttactctcgagatcttgtaggcatgagagttcttctcaaggtatatttgggtttttgccttttgtataatatatcgaaaatgggaaagtctggggtctaaatcagttatcatatacaggagaccggtcaacttgttggaactgttgctaatattttcgacaatggaggaaatgatcttctacatgttttgcttgactcatccatggaagtctgcaatgggaatgcaaagaccaatcagcttgtttggataccttttgtagatgcaattgttcctgatgttgatttggaaagaaaggagatgtatataactccaccgaagggactcctcgaggtgaatatgcgagcagatgatcggtccaagaaagaaaggcggcagcttgtgaggcatattcttcttcgctcttcatattgaccagtctttatagactttccagattgatctttcttggtctcttaaactctacgctctggtcatttcaggaatggaaagaaagaaaaaaacagcagaagcgccttattgctgctaaaaagaagttatgtgaaatggagcaaaagcatgtgtttgatggattaaggtttggagaaaagtctcaaaggaatttacttgctgatcatatccttaacgtaaactccacactacttcagaaagctttgcaaagtattgacacctcatcgaagaggtaaattaacttcaagaaatttcccaaccattgcgagaagtgtgtcttctcatttttcatttaaattatgatgaattagatggaatgtaactgaggaaatcaatgcactgagagctagagtatcggaatgtaatctgagtgtgtcacgagaatgccttagttttgatgcaagcaaagagaacatgggtgataacttcagtttccttcaacaagggcaaaatctgttctctgagggtaaagtttctatttgtttggttctcaatgatcacgagaatgaagaaccagaaggtgagaatggtgtagtctcgtaccttcacgcactacttgatgaggagcagaggttcataaaggttagctgatgcatacttaaaagctatgagattttcttgtcatttagttatgattttacaggataactgttgggttatgtgcaggaagaagatcgcgcttgcgtgccacttgtcatagtttcccctgaacataccattgaagctctgcagaagctatttcaggataatgatcattttggatttgagtcagaaaaggttaaggcttgaattcatccaagaatagttttgcatttcggctatcagattctcacaaagtatatgtctttactaatatatagatctggattctcaaagaagaaacgcttccagtagtttgcagctcaccagaggaaccgaaaaagcacaaaattttgatgaaatctccatgggagatacttgagtccccggttggctctggaggagtcttgagcatccttgcttcacatggaactacagactctctttccaccctgggaatcaattatcttcaggtatcgatatctaaagatcatcgcttaatctctttgaacttgactcatatccagaaattgttcctttctggttctctccttcaaatttggtaaaaggcattaagctttacgatgttggcatttttctataggtacacagtattgaaacaaaaccacaaccgtcacaacattacatcaatcccatgcttgttggtttcgtgagcgcaagaggagcagagattgggatccaagtgaccgaagaatctgaactcaagaacttggaaatgacattctcaatgaagtttctgaagagattaaagggaaaaatcgagtttgaagctgtcatgaagatgaattcacatgttcagaatgttgaaaaggagtgggttgagtcagtaccatcagaaccaaactcgtttgagtttcgttctgatatttacagagtcttgagtgaatgttcttcatcagctaagatttgtttgatgaacattaccgtttagaacttgtacattttgctacttagttgtttgtcctcacatctaaaaagcttctagagacgcaatttatgcccgaacacattactcaagcaagagagaacatcattgtagcttttgacaaatcgatgataacaaaaacccaaaccaaagctattgctctttcatagcacaaaaaaatatattttttatcaaatttcaaaaatatatccctctttttgggaaacttaagatccaactgttgatttgcagccaaaaaagatcgaaccgttgattctattgaccaatctctgatctttaacaaaattacatttttgaccatcacacagagaaccctaatttatatatttataagaaacttcagtcttccgaaaaacatcctttcacattgcggcggaggaagctctaatcaccgtaagcttctctctttcactctctctgaatctcatctttctgttagtttatgtatatatatctactgaaatcgatgcttcgtctcacgcataccttttgttgattttgttgaggaagaggagtaaaa

SEQ ID NO: 1922 - DNA, 3000 bp, Unknown
  misc_feature (1)..( 3000): cDNA_ID_3065162_gDNA_ID_1620468_Annot_ID_157962 3000 nt of promoter + ATG
gaagtgactctacggtcagattaatagtatggggtatacgcctcatcgaggactgttcatcatccgagaaccaacttggttatctaaatactctgtagcatgttcgtgaagacagtgaaacggtgagagtgccaaaagttccaagaggctcaagacattgagataggctatgagactgatcagagtgaagagcgtggatacagagtgatgatattggtatagacagtgagactgatcagtttgaagagtgtggaaatagtgatataggccatgagattgatcagagtgaagaatgtgaagacatggacgatactggtggtatatgcattgggattgatcagagtgaagagcgaggagacagtgatgaatagtgatagtggcagtgagactgatcactttgaagagtgcgaagatagtgatataggcaatgagattgatcagagtgactaatgagattgaatacaatgaagagagtagagacagagagaaccagtacacaatggcaggtaagtattaatcaagaactgaacagaataacagatatctcgccgtcaggatctttaatattataaatcactgagttgttttcttttgcttgcagattatgtgaaaaagaaatgaatctttgagatacttttgtggtgatggaatgagtagttttgctgccggttctatggaacaacaagaagagcccaagattcctcattgtctccctagctagacagacattttcaggtgacccaaaaaaactcataaaccatttcattttagttccacatcaattgtaaatacagagcatatatatagtagcatgcttttgaatttctgattgtctggttatagactttttattatatagatatttggctgtattcaattgataaatttcacagccatcaatgttgttcactgcttggttaaagactttgatattatctattatgggataattagatacatgtgtgctagtattatgaggcatatatttcaaaaaaaagtcgtgatgtagttacaaaaattgatggaattcaagccactggtttttaattagattataaagctgaaggaatggaattgtctcaaatggcagatgaagatggtactgttcatgtcaatgttttataattttttgttttttttcttaggttgcacgtttgtgataagcttatttcattactataacgatttaatttctgaagaactatttgtgttatttgtgttcacaagaatttgctgtctggaacaaagttttacagtgtacctgaattgagttttcttttattcgttttcggatttcactctccactagttgaaaaaggtctgaggctttctagattgtttcaaacttcgttaggaacatgaaaatttgcatctagacaatgccctgtggtatctggtaatcaaaattctgtttctggttacttcgtttttacatgggcagaaagtgaatctcctacaggtcttgcgacacagttagcttttgatttgataagcttactgttactttaaccctgttgacatttctcacctatgtcattcgtttgaaagcttgttttgattctctaatgatatgcttaactttcattctctgatgattcttttgtcttgcaattgttattgttcaggaaagctggaggaagtcactttgatgaccaatgttggttacggatctgacaagatattaatgtaagaataagaggctatggacatggtttttacttgagtggtggcgattaagtccaaatctaaaagagatgattaagtcaagatccagcagaaaagaggaaactttcgttaaggtgtatgacaacagtggtgcaattgctaatgtttgtgaattggtcttttttcttattagggatatataatgaagcaagcatgattgaagaaatcgccaagtcttaatcggctcacgttaggtggtggaaagacgacgcattgcaaaagttttgcaggctgacgaaaaaagaggagaatggagatcaattggaagaggttcttcttatttgattggttaatttttcttttctttctatatttagatatacatggtgacacccattattgtccaatttgtcccttttttctgtttcttttgagaccatgtctatatatgagaattgagaatcttacaattaaatattttgaactaataagtcttttattttgtttccaactcatgtgtttaactaagtcctaagctaacactagattttttttaaaagaaatttggttttcctccacagtatttttattgttttttgtggacttgaccacaaaacttcaaaagactcggaagaaaattaaacaaatattatgcacaatttcgcaccactcaatgccttgcctcccctacctaaaatgttgacaatgtcgtcttattctttatgtcaagcacgatgatgtgtctgactttaagtaatttacattttttaaaaattcgtgatagatattctcccaaattctttcaaatatcataggctttaagatgttaccaactaccaagtctcctaaaaagaccaaaaagtctccttagatatttatcaaactctttgatgttttgttgctcgttccttcgttcacagtttcctgatttaacagtggccagtaggataatgattacgttgcttcacttttcactgttactgtggaattgcttggtaatttcgaaaacttgtatccttattaagaatttgtaaaaagttttgcaacttcgtattgtacatctttattaagaatttgtaaatgaatgatatacagtagtaaagacaagaggctatgaaatatggttatgacgattgagtcaacaaagaggaaacttccgccaagtaaaagtctaagaaataattgtgaaaacttgtatggccaagttacctctcagctgttatgttaaatgttttatatccaccaagacagactcactacttgtcctctatttctcttcttaaaatctcaatctccaaagtcttcgtttctagtttcctccttctaactctctct

SEQ ID NO: 1923 - DNA, 3000 bp, Unknown
  misc_feature (1)..( 3000): cDNA_ID_2148002_gDNA_ID_1620468_Annot_ID_157963 3000 nt of promoter + ATG
tcattactatcacgattcctttaatttctgtcaggcacaaagttttaaagtggacctgaattaagtttttgatgtataatagttctcttttgtttatggagagacaacgaacgactgacttgctttgtagccacacctgcaaagtttttaggcatctttcaaagtccataaaccaacttagtctagttccgaataatctttaacacaaagcgtcacaattgtttcaaatgcaagtcgtgttgtggatacaaaaaaactgatggaattcacgcaaatggttttaacaaaatgaagatttctcaaaattggcagatggaattcatttatttgttttcaagtactctgtttctttcttagcttgcacatttgttttgagcttatgtcattactattacaatttaatttctgaatcctcacattatacttattttcttgtttcttacagtttgaggattatttctccataaatcctttcctaactcgagcaaggatcacctcaactacggtgtggagaattatgagctcacatcttcacaagaattttgtaaataaatttaagggacaaagtgtcaataaaattgttctcaaaaatttgttgtctgagattggatgaaatctgttgtttgaaactcttttggctctggattctcctctatagctgaagtcaactacggtcatgttgatatacaactttcatctaacagatacttcatattaaaaggatttggtataagattctctgaacatggtaatgtagagggataattagttggtccataaaatatttttgcttgtggcaaccaaatccctagggacggctctggctatatggctttgtagctatgtaagaaatgatatcgcataattttcaattttgcttccaatctgattatgcatatagagacgaagctgcaactatgtaacatattaaggccaagacccaagagtgaataaaccatattctgttgttactttcctatgtgatatcaaaatgagtaatggagtttctataatttgattgttgaacttttaaaatctgtcttttagagtcatgtccagaatatttgtatcagttctacttcttgtatactacgcaaaattgtagcctgtaacacaagaaacaagaaacagagtaagaaaaaaaggggtaccttcttcaacacgcttccattggaacagttaacaagcctacagaagaagaagatgaagacgaagatgaagacgaagataaagacgaagcataaatgatggaataagtagccaaagttttatgttttatgtaaacagtaagcctaacacattcaatagaacattttgactttcccggagaagcatatatcatactataggattttaattatgtttgtatttggaaatttatcaaagatgtttcatcatatgattaaagtgtgagtggaggagaatggaccacaatccacgaagataattatattaactccaatcccttttcttccaagcaatttcttctctcttttagctacagcaatccaaaaacacacgtatgatattatcaaaactacgactaccatcctgctctagttaaaaatattatgcataaattcaaaaagtattgttacggataataaatattaatcctatgagaaagtaatattcttttgctttttcagaatttagatggttgctttccaagaaacatattttgttttgtcaaactttcaggtcttgtttgctagtaaactcttttatcgcaggaaaatcaaaagacacactcataaactcttttgttatcttgttatatatatgctgcgtgattcgacttttataataagcccaaattgaagatttttttgagatttttttaacctttaattattatatgattatttaaaacaagtaaaaaaaaaaatcaaacaaggaggaaagaagaattataaatttaaatcagaaccaaatttattaaatatctttcttattaaatatagaaacataattagtggacatgatccatttttgttaatatttgtatccgtcttttaggcaaaaaaacagtggaagagtcggtttaaataaaatccgatccaatcaaattttatgaacaatatttctaatcgggtcgggtatcatttgtgtcggaaaactatttaactcatccacaaaaattacttcaaaaatactatggagatttaataaatctacggctagcaaaatggtccataacttatatgcttgggaaaccactcggtcaaattagatgtcatatttttaaggaaattatgcatctcaccaataattttcaaactcgataatattgacgaggtttccttctcaggttttgagcaattgactgaagttcaattgcctgaggaagcaaaagacaccaataatgcttgcaccaagttgtcatttatcacctgcactaactgtttcaattcaaatcaagaagccttaattaccaggtgtagaggtgtctgacgggttaacagaacttaggatcatatgacttgctccacaaggtacatccatcattgttttcctctaacaactacttatacacgtttctttttctatttttttacttgtcttgatatctgtaaaatgtctctgaaattttacacttctgaatagaatatttattcgtgtatcaaaagaaaagaaaatctaaaagcaatataaaacaagaaaaatgcgaaagaaactaagtgaaccaaagaatcttgaagtttccaacggtttttattaaattaatattaattacttttcaaatatttaattgttccctatgaatgaagcaaaatatggattctatggagacagaaaaagttaaccacagcaactcagctttacaactgcggaaacaaaaaaaataaaatgaccttatcaagaaaaaccaaacagccttaaccaagaaaagcaccattactctaacctctcttgaacctatataaaccctaagctcttaagctttaacaagaaaaaaaacataagctcttaatcaagtcatttcacacccaagaaaaa

SEQ ID NO: 1924 - DNA, 3000 bp, Unknown
  misc_feature (1)..( 3000): cDNA_ID_2147984_gDNA_ID_1620468_Annot_ID_157956 3000 nt of promoter + ATG
tgaagattatattgtacattgagatgagagaagagagaagagatcacatcttcaaacttatcagaatctgatcacagtgaagaaagagtgtgaagacaatgatgtggagaaaagggaagcagtgagagaatgtagattatctaatgacatgtggcttgttagagaaaacttttatctaatgacatgcatcttcaaacaaagttttctctttttgttttttgttttctacaacttcatctgcagatgctttgttgaagtaattcttgtaccatatatataacgattgggaattttcttgctgactctgctgtaacttaaacgcaaatgaggaacatgaaatgttgataagattttctgttgtattcaagtttgttacatagagagcctcttatttaaaaagaggatcctggtttgcctacattgtcccagtccttactaaacctgtatactcaatttaaaccggtccagaagattcaaaatcgcgaagccaattttgtcggaaagttcaaaacttttttgactctggaactttgccgttctatacacgaagctacattgagtgtggctttgtgattgttttacgctgatgtgaccgttgtaggaaatgtggagtcgtgccatttttcaacgattcaggtttcgagctttctctatatctcacgttatccatgggaaatgttacagaagtttctcagttactgtggagtttcagaatcgcgaggttttgatatgtaatcacttgttgagtcgacgaatcgatgaggctcgagaggttttcaatcaggttccatctcctcatgtgagtctttacacaaagatgattacgggatacacgaggagtaatagattggttgatgcgttgaatctgttcgacgaaatgcctgtgagagatgttgtatcatggaattcgatgatcagtggttgtgtggagtgtggtgatatgaatactgcagtgaagctgttcgatgaaatgcctgagagaagcgtggtttcatggacagcgatggtaaatgggtgttttaggtctggtaaggttgatcaagcggagagattgttttatcaaatgcctgtgaaagatactgcagcgtggaattcgatggttcatgggtatttacagtttggtaaagtagacgatgccttgaagttgtttaagcaaatgcctgggaagaatgtgatttcgtggacgacaatgatctgtgggttagaccagaatgagaggagtggagaggctctcgatttgttcaagaacatgttgcgttgttgcataaaatcgacttcaagaccattcacttgcgtaatcaccgcttgcgcgaatgctccagcgtttcatatggggatacaagttcatggcttgatcatcaagttggggtttttatatgaagaatatgtatctgcttcgctcataactttttatgcaaactgcaaaagaataggggattctcggaaggtgtttgacgagaaggttcatgaacaagttgctgtgtggactgctctattgtcaggttatagtctgaacaaaaagcacgaagatgcgttgagtatattctccgggatgttaagaaacagtatcttaccaaatcaatcaacatttgctagcggattaaactcttgctctgctttgggaacattggattggggtaaggagatgcatggagttgctgtgaagcttggtttagaaactgatgcctttgtgggtaattctcttgttgtgatgtacagcgattctggaaacgttaatgatgccgtttcagtgttcataaaaatcttcaagaagagcattgtgtcatggaattccattattgttggctgcgcgcagcatgggcgtggaaagtgggcgtttgtcatatttggtcaaatgatacgcctaaacaaagagccagatgagatcactttcactggcttactctctgcttgtagccattgcgggttcctagagaaaggaagaaagctgttctattacatgtcaagtggaataaatcatatcgatagaaagattcaacactacacttgtatggttgatatcttgggaagatgcggaaaattgaaagaagcagaagaacttatcgagagaatggttgtgaaacctaatgaaatggtttggttggctttacttagtgcttgtaggatgcattctgatgtagacagaggcgagaaagctgctgcagccatttttaatctggactcaaaatcaagcgctgcttatgtcttattgtcaaatatatatgcttctgctggtagatggtcgaatgtatcaaaattgagagttaagatgaagaagaatgggattatgaagaaacccgggagcagttgggttgttattagagggaaaaagcacgaatttttctccggtgatcaaccacattgctcgaggatatatgagaagttggagtttctgagagagaagttgaaggaactgggctatgctcctgattatagatccgctttacatgacgttgaagatgaacagaaagaagagatgttgtggtaccacagtgagaggcttgctattgcttttgggttgattaatacagttgaaggaagtgcagtcacagtgatgaagaatctacgggtttgtgaagattgtcacacagtgattaagttaatctccggagttgtgggacgtgagattgttttaagggatccgattcggtttcatcatttcaagaatgggacgtgttcttgtggggattattggtagaacagtgatttggaaaatttcaagctttcacttgtgatgtggaaagtgacttgggaatttacattaatacctgatcttaccaaaaaaaaaaaaaaatcagatattattatgttagaatatatacagggttttggcttgtgtggtggtgattaagtcaagactcaagaaccagtccaaaagaggaaatttccaagaaacaatgatgcaattgctagggaccagctactgcaatttatagggtttcttaacaaccacgcgagccctcacttcgactctaaatttttccagaatctcctctcttt

SEQ ID NO: 1925 - DNA, 3000 bp, Unknown
  misc_feature (1)..( 3000): cDNA_ID_2147994_gDNA_ID_1620468_Annot_ID_157959 3000 nt of promoter + ATG
cttccttcctttatacgaaatctcaataagctgttgaaattgaacatggcattctgcaacagtctggaaactcttccaactggtttcaacctcaaatctctggaccgccttagtttctctgaatgcacaaagttgaagacttttcccaaattctcaaccaacatctcagttctcaatctctttggaacaaacattgaagaatacccttctcacttacatctcgagaatcttgtcgagtttagcatatcaaaagaagagagtaatatgatacaatgggagggagcgaaggtgagtagttctaaacttaatattctctccaaactattttactatcactgtttatatttaaactattgtcgcagactcaaattttgtacacttgtgtattaaaacttaaaaacttaagtgacttttataaaatttacaaattttatattattcaatcataagttttaaaattctaatgaattctaatgttattgaactaacgatttaaaaatcctactatattatttgggaagtacattttaaatgtaaccttaatttttgtaagtaattacataggtatgccattagaaataaaattttaaagagtaaattaatttatctttttaatgattaaaagtcaaatactaatttaattaattaaatttaattaattaaatttaattaaaaaacgaaatacattattattttccaaaaataataaccaatcaaaatcaacatataagatttgatatctaaattttaattaatttaatttaattaaaaaaacgaaatacattattaatttccaaaaaagtaaccaattaaaatcaacaaattatatttgatatctaaattatcatattatttttttattaattattatagttcacttctcatctttatatgattttatttttgcggaaaaataatatcatcattataaaaaaataattagagttatttcgcatatgccacaatttgaatttttaaaaacgaatataaactgttcaatacatgaaaaaatattataacgggtgaaaaatagatttaagaaaactttctactgagtaacgggtcataatttgaaatatttatattcaatttcatacatattatattgaaaatttataatcttatatactacaataattaataacatattagatgtgattcaatttttaataaaagctggaaaatcctagaattgacgggtttagatcgatattaatacaagatggaatactacaggtgaaactcttaaattaacaatcaaactacaagtgtataatcttaaacactaaacaatatagataatatcaacaaaacatatacatgaactcacagtttactatacatataaaatcaaataaaataatatcatatatttttaaatcatctttacaataaaagattttattttaactaaaatataagcctacctgcggtatactgcaagtcaatttaatattttatatacgaaatcaattaaatcttaatcacataaaaattagcacaaaaaaaagtattcaacaattaaaaaattatcaaatctctgtgttatataagttttgatactatattcgaataatgtaatataccttttcaatttgtattctttaactaatttaagctaactaatatatttgctaattttatacctatcaaaaccgactatcgtttcttatctctatagtatttttgcaagacttttttggtggatttggataaaagtgtattcgggtcatatgatacattcccctattaaataaatatggtgcactcctatgttattagctaaaatgtttagaatataattcagagtcatatcattaataaaattaatattaataaactaaatgactttttggcaagacgaatttggagagacgggtttttgaatcaacattaataaaaaagtaaaatatgattaatccaccgtttcaatacgggttaaatctttaatttattattttgtaagaccactaatattaaacatatcaaatcatcataatttaaaaaagattatataaaaccaaaaatgttatgtggtatgtataatgttactatatataaaattaaataataaaatataaatgtattagagaatgatacaatttgcaaaactttaatatataaaaaataattcttaaattttaaaaattactactttaaaaaaataatcacgggacgggtaaaaaaattacagaacgggttttattttggaattgggttatatggtggatgtatttgaatcaatatttataaaattttaaaatattattaatatgctgttttaatagggattaaaacttcagttttttaacaattatctcatggattcgtggtatagggttacctaataacaattataaactggaaaataaaaatattttataaaaataaaatttgcaagttttaatatatattacttttaaaaaataaatcgtcaaaatctagttttacctttaaatctactgttattgaaaccaatttgtggatttaattcttattaattttaaaggatttaagaagatttgaaaagatttctttagttaaaaatatagaaatccaaatctcatggttttagatggaatttgaaaagattttacaataaattacatcaacttccctaaaatcattaaaatcatataaaaccccagtaaaactcaaatcattctttgtccaatacaccctcctaatttcgttttgtttatgaatactttaatttgattgaaaagtaacttttggttacaaagaacgaagaagaaaacatttgattttaaaaaataaaataaaaatacaaaataatggatttcaccaaaacaatatacaaaataacggtaataaaagagttccaaacaatctaatactgtactgatgagatttacccataatactgttattcttttgattttaaaagatttattttctaaatttaagataataacactttaaaagtaatttgccactgaaacttgttatttggttcagccgcttacgcccttcctggct

SEQ ID NO: 1926 - DNA, 2836 bp, Unknown
  misc_feature (1)..( 2836): cDNA_ID_2147824_gDNA_ID_1620469_Annot_ID_157967 3000 nt of promoter + ATG
gccaggattttggtaagatgtgctaattttcatcaggcttgttaaaggtttgagatcactttgctcaaggtttgagacacctgaaagacccgggatttcagctagaagattcaaaagctctctgtagtttggcttaacaatggaaagtggtaattctattataccagtcccctgtagattcagtgtctcaatatttgggggaatttctgggaaacttttgatctctgtgcaacctgagagatttacaactcgtaaatgtagcaattgaccggtggctgggaaactctgcagtcttgtacagccttggagatcaactacctcaagattttgagcttttaaaagatcgtcaatatcaactagttgttgggaatgacaaagcctgattgtcttcaacatctccaggtcctacgaaaaaaaatgtcaaaaaaagaattacaaaatctgtctttgagtatagataacggcgaaaaacgcatatttgagattgcttaccttggttccaccccaaagtttcttaagttggctgtacggcatgttgatttcaacaaggtgtataggatcaaaattttgaggcagaaactgcagaggatagttctcccaatgcaggagtcttagcacattaggaagagaactgagagagcctttgaggaaattgtttacatgatggacttcaggattggaactgtaaatcttgaacaatctaaggttcaacatattatcaaaggcaacatgcttaatatcaaaacttaagtttgatgtgtccagaaacatgccttcgatctcttcagggacctgaaagaatattggaagtggattatagtaggatgttggctcataaaataggttcaatataaaactattaaatgataacagacctgagcacgttcaaaagttgttttttgttcttcattttcgttttgttccttatcttctaataaatatttgatgctgcaaggttcccacagtctgctgcgcctcttagtctgtcttgtttctctatttattatttgtcggccaacatcttggatcaagttatgcatccgcactcggttttctgaaatagtcaccagactcttctccacaagaacatcaattccaacatgtggaaagaaaccacaaccctcaagcagttgcatcacgtagtcaacattttctccctggaagaaacaagctatgtccaaaaaaatgtttttttccctgtcattgagtgtgtcatacgagctcttgattgcatcaacaaaaatagctggaggacattccttgagtttgaggaatgctatctccatttctggtggtcttttcttccccatcagttctctgccatagagattgagagctaatggatggccattagcatatttaataactttcattgacacctcgtggagattctgctctgccatatcgtctatagacgcacacaaagagaagagttgaagagcctctttctcatttaaaccctgaacctcgtatatttgattgactcgacaaaggcgaaacaccgatttatctttggaggttatgatgattagacttttgggaccaaaccagtcaaaccctccaagaaaagactccacaaccagaggactgcggacatcatcaagaacaacaagaaccctcttattgtttaatctatccctaagcaagctcaatttcgtaacggtaccactagcaccagcattttctttcaaaaactgttcctccagcaaacaataaacacccttctcttgaatagctttggtgtagtcttcaataaagcaatgagcatcaaactcaccagacatttggtcaaagactgctttagcaagtgtagtcttgcctatgccaggcataccccaaattccaacacaacggatgtccaacggttgcttgttaatcattttctcaatctccagcagcttcgaatatattccaattcgttccatataaaagagcttctcatacacatctctaacagtctcttttacaagctgggagtcactacattctttcctgcgtcatatttgttcaagaaaaagaaatgcacttcatagaaacactacacataaacttgaaactgaaattgtaatgcactttttaagatttagagcttatgatctcagttttaactctgttaggtattaacatgactacacatgaacttcaatggaagaattcactgatcaacacaaacaaggtagtgaaagacacttgctctgcgattcatatataactgtgaatagcttcacagaagaagatagtttatgaatacctggaatggtgtactgatgagaatcctttcgaatccagcgcgctaagccattcggtctctgatgatctgacaccgtacaacaccggaaccaccacttgatctttgttcttctggcaatcgagaaccttcacgagcttgtcaagagataccgtacggtttcctggtaaaatcataacagaaaccctagctctctcgaccattgattgagactcgttggaaagcgaatcatcgctatcgatgaagacatcgtttacaccttttcgctggagagctttggagaggtggctgacgaaggagtatcgtacctcctctatgcagctgatgtagacgatttgctcactctcggtcattattttagaaactgtgcgtctgggtcgcacccgaaaccaactctctaaaacgattgtggtccctaagcactgaagttggccaatggtagtcgcactccattctcaagtcaaccattctcaaacagttgttgagggagaaggagaaccactcaattcctagctaaaaacgtcaacagttggaaaagtaaacttattagatgattcaacttgcaaattgtctgccttgtctcccatg

SEQ ID NO: 1927 - DNA, 3000 bp, Unknown
  misc_feature (1)..( 3000): cDNA_ID_2147844_gDNA_ID_1620469_Annot_ID_157972 3000 nt of promoter + ATG
agaattgtagatcaagcccatgaaaggagaccattggaagaattaggtttaagttgcttgccggcagaatcttcaccggtacggacgacgagcatgaactccagaacaacatggcttctcgaaacaaaatgcagatgatgcttggagaagtcttcattaaaacgcgaggaggtagaagtattgtcgacgatattcggtgagaaagttcttcggggagacccgagagagatctagatccattggatccgagagaaacagtgagacaaatctcatatttcaaagatgaaaaacagttggaatcaagggattcctcttttgacgacttcgaaaccaacgttgtgaacagaggatatggaagaaggagactcgccggaacacaccttctttctctgtcacatatctcggagacgccatgggaagaggccaaaaagagaaatagatccaaattcgcaaaaattgaaagaaaacagaactaaaatgagcaggtcttgaaaaggaagctaagagaagacgagacatcccgacgccggcgagttaaaactccaccggcgtcggaaaacatggccaacgatggtgtctcgaaaatggtgcctgggagagagctaaattattatcttaagatttccaagaagaatattgtctttcttctctataggctatatgtataataatagagattacatattgaaacttcttcacctactctgggctaatatcctaatattaatcaaaaccttattatgaattaatatgtggacattacatattgaatcggactgcttaattaatatttcctttgtctcacacataaaaaaaacataaaaatctcatttaatttatctattttctgtaaaacatcattaactacatctaattctaccaataaaaaaaatatattgtaaaatataattaaccaaaaattattaaatacatttaagttttgaatagataagtgaaaacaacacttattttataattttttttttaaaactatatataatcagaaatagagggaatatacaaactactaacattgaaaaaatagtattcgaagtaagaaatttattattttgtatacatgattttagttaaagaaacaaaataattaactagtaccattcatgttgcggatgttaaagatctttatcgaataaaaggattgaaaaaattaggatttgattgttttaaacggaaaatgatatcattagtttccattttccaatgatgctaaatcagtttttaaagatttaaaaaaaacatcgaatattttaaagcggcccaagccaaatggagagaaaaacgcaaaatctgttttagctatcgaccttcacgttgggatttctatgtaatcattatacattagactaaaaagaaaaatatgttctggaagaagactttgttttttataatactaagtacaaagaataacactgagtgctatcatcatcattcatgtttggtttatattggtcagtcatgatatattggccgtgacagcaaaatctaatcagtttaatatcacaataaaatagcagttggattagttatgaaattaattaccattgtttatttttttggttgggtgttctgcaaaaaaggctctccaaatctctgtctgttttattgcaattttactttccgtcgtcttcaaaaaatacagaacaaatttatgaaattaaaaataatatgttttataaccttcatatgtatattttaaaaggttttatggttgcatacattatatattcaaaagggttcatggtaattttaaaaatggatttaaacttgtcatcacgagagattcgatttgctatgttgtttataaaaaagtattttatgtatttttttatgtattatgaaatcaaatgtacgttatcgtaatacgtttacaatatatatatatatatatatatatatatatatatatatataaaggctagtttgcgtgttattcttgattttgtaggattattctatattttttagagttagaaataaagttaaaaaaataaacgattttgaagatgtttttgtaccatacccttttctttatttatagttttttcaggtacaagtttgcgcaaaaaaatctttattctaaacaggcttttatgtctacatcaaaacattatgggctttgatatttggatgggcttttaaacacccaagtctgcgaagatatttggatgggctttgaactgggaactaaagtacattgataaattctagaaataagagaaaattgctttccgtatttttgcaccatagaagaagttatatcttactcgtttttgcagaaatttagtcagtgaagaagtcaactctcaactcgttttggagagattcttcgaaaagtatttgcagtttccatttttggactaacgttacatggaaaatttccaaaatgtacatttcagaagattaattatactaataatagtaataacgacgatcaatgacgataataatgtcatcatactaagtatatatatatatctcacaaagatatgacttacacattaattaatttcaccaatccatgttgcaaattcaaacaagaatcgatcaaacgatcctattgcttgctcttcgatggtaggagcatctttagtttcttcttcttcttccaatgtattatttattccaacgagacctcaagtattcatcaatttccgaggaaaggagctatccctaaagaaaatatgaattagacattatatttaggaagttgcttaaatatatatatatttgtgagttttcctaatgagaataggaacttatctaattcttttgttatataagaaaatgcaaagatgttgcataacttatgagtttactttagagattgagagattaagagagagctttaggtttttatagttatttttctaaagaaataaagagaatcattctttatattttgttcttgatcatatccctaaaacaagaattggtattagagtttcaatgttaaagcaaaatccatagagaaagaagatg

SEQ ID NO: 1928 - DNA, 3000 bp, Unknown
  misc_feature (1)..( 3000): cDNA_ID_2147864_gDNA_ID_1620469_Annot_ID_157978 3000 nt of promoter + ATG
cctgtacatataacaatgactacaagacattaaatacacagagacacgcatgaatgtgtccacagacacataaaatagactttttccatgtggtccacttatttatcccacatctaaaaacaattatgtaaatcacttattgtccgtacagtgttataacattatcggataattttcagttttatttcagcgtattactttcatttgttttaattgttttaaaaaagaaaaagaaaagcgacgagacaacaaactttttcccagcaaagccatggaccaaaaacaaaagctatattttcagattcactaaaatagtaaaatggaaacagtgaagtttaaaggaatgggttccaccaaaacgtggtttatgttgtttctccccatcatggacctcacacgtttggcatgtgtaaaaactatacgcacttacaaaatagactatttatagttttaagagtaaacattggcgaaaaaaaaaaaaaaagttaacagtaataaccctataaaataattgactctaaatttgttttatcttcgtatatataaaagaaatgaagaagtgtaatccaaaattttgatagaaattgataagatagaatttgaaaaaaaaaattgtttaaaatgtaacactaactagtaaaaatataaataataaacatataaagtaagtattttagtgacatggcaaacgattgcaataatatttttatatttattgatattattatgtttttcgtaattcattttctactacacagtatcctgatttaatattatgtattatgttttataaaagacataatatatcctaatcttttaacatacaatattttcaattacaattcagaacaaaaattgtacaaatttctttcaataaccattttttacaagtaataatagctgagattggacatctcacattatattactttgattatcccatagatgaatcatctgacaataatcataatcaaaacaacttacaagtagtttttttttcatttatacgatctaggttataaacttaaactaagttttgaggattgataatttgattataattttacgatttttgctttcaaagtatcttaaattaaatcctgttaaattaaaaatcaaatatttagtggtgtgctcctccaccttacaccatcatcaagtccttttttcagtgaaagatggttttgattaatgctaactgctaactgtttccccttacaccatcattcagttgtattctttttacatgttaggtctaaaaatagtggaatgtggtattaaaaataaaaataatgagttaatcacaacaaaaccattattgggcatacgatatatattttctttgctcaaaaagaaaatgaaaattgaactatgcaattcaaaaatatatcaggttccttaccttttatttatcaaattcaacgtcacaattttactacatgacagcaattgtaacgaaaaaagttaaagttgaatcttggattgtgaaaatttttcgtaatttggtatgaaaataatttatgagcaataatcctctttcattcaacactagtcacttcaatcaaaaataactcccaacattgttatctttaagttggcgatgttgtaaaaatacaaaaaattttgaatttcttttttcttaaaattctaaagttttgaaactaaaaaaaattaagaagacatttcagtgagtactcatgctcacaattttgtctatgaatatatcaaagattgacagagtgttaatatggattttaatcactcaaacacccttgattatagaccttatttgagattcaagattaacaaggaataagaatagtaaaggtggcatatcagattaacaaatgaataacaaaatcaatagaaggataacaactgtaagccgaacaaattttatttttttaaaacgccataaagctaaaatttagttataattttaaaatgtgctagtgctagataaattaaattacttattatttccacgttttataattcaatgcaaagttttgtgaattatatgtattcaacaaatcaaattttcaaactgtaaaaacatggaaaattgtatatcattcaatccctaaatcaaactagacacgacatttatttaaaatacacacttactcaatcaatatgtttggaaaaataaacaacaacaatacaatagagttattatattgtcaaaaatatatacacggtcgaatcttcttggtaattgcatgatgtagcaagcgtggagaggaattaacacataacagatacgacttgcatgcttctcgatttgtttttgttttctgccagtacatttgagaaaattgattttaccaaaataccccttaagattcttacctatgacatatactgaccaatcatatcaatgcttatagatagtaaaaaaaaattaaaaaatcattccgtttttatgtatagtcaaaagaaaactgaaaaaggtattttaaatgattcctaaatttcgtatagtcaaaacaaaactgcaagaaaattttatattagctagatttatttccttttgctatgatatattataccaagatataaatagcatttatgcacgggaaaaaataacagattttaaggaaaaatagctaaacaatttctttctttaaacattactaacaaataaaaatcaattttaaatttacaaaattaggaatacacaatatttataccatatcactacaagtcaagtcaatcaaaaaaaaaaaaaaaagtatacatatacagtcacatgtgctggtgtttgttaagatatttatatataggaaattaatttaaaaaaatgtaaaactttcaaaaggataatttattctctttctagaaataatcttattttaatttattcatttttgactttttttctctctctctcttccttaaataaaaagcctccctccatagatttcttcaccagtcttcttcttcttctgcctccaaactctctctttctctctcgagaaccttaagaaaacgttacaa

SEQ ID NO: 1929 - DNA, 3000 bp, Unknown
  misc_feature (1)..( 3000): cDNA_ID_2105961_gDNA_ID_1620469_Annot_ID_157981 3000 nt of promoter + ATG
tatatgacccggtccaagccacgccaagtctcttttaatacacgaaaactcaaatatcaaaggtggaaacgcatgttatataaacttttttaattgatattatatcaaattattcgatattataaaaaaattacataaggagactttgtatgataaaccatatattccgcgtagcttctcagcaggaactaggaagcatcaccgacactgacacaccaccccattggatcgatgcttcaatttttatttccagtaatacatttacatgagtcatcaaggttgttttctcttccaaaatataaaaaagttcatcatatacaggttcatacattttagatgctttgggacaaatttaaaagatatattccttaatatcataatttttttatatacttcttcttttaacaaaaacattaggtgccttttgagtatatacaaaaaacaaattgtgtccatcttgtatagatttttttttttgtgccctataaatttatgtatatgtagttatgtaccctataagtttatattatcggcccctatagttaagccggcattgactatatatttttatggaaaatttaagagttttctttttgttttgttatttttctttttaattgtttcatcaagttaagtttcgtttccaattcctcttagaatgatttttatctcttgtgttaggtcacgctttactagtttacactcctctttagaatgatttatctcttgtatgagttttgtttttgtctttttgttaagaatttaaatattccactaaaatgaaaagtgttaggattttcatgaagtaaagcctgaagtttttggtcttatggcaaaaaaagaaaaaaacatgaaaacaaaagaaatcaatccattgacatcaacaaaacaaattacgtttttgagtcataaagtgatataacaattttgaataactaccaatatatatgtcctcaatcttgtgtgagttcaaggctttatgggttacatcgttatacttagtttatgtaagaaatttgtaaatttgaatgggttaaaacttctgatctaaataacgaattggtaggaaacttttttttgtcttgttaatatttgatggttttagccaaagtaatacataaaataattatttagtgaccaaaacttatcgcatatttgatgatttaagccatagtaatatgatttgtattagtgacgttgatggtttaatatatgatttagtgatacttagtgaacgaaagatacaaattaacatatggtttaccaaagtaacgcagcgtcactagtgaccaaaacttagcgtatatttgatagtttaagtcaaagtaatatactaatatgatttgtattagtgacgttgcattgtcactatccaagtttacacttatatgttattttttgttaaaaatatatatttatagttagaattctatattcgatagcattaccgaaagtcgaaaatttaatcataggaatcattgccaatcgaaataatgctaattaaattttatttcatataaaaatttgatgaataaactattcaacgactatccttaaagagtttttttttttttaatagtcagctaacgcatttcaccgattgtatttgtagccttgtaggtagagtcgaatttccgacgcgactagaatgctagcataagagacttcaccactttgttacgaagccaagaatcttcttgttttaaaaaaaaaaatcaagacaaaattgtcgtccctcatatctatattcaattcatttcaaaacgttatttatgtcttaaaatttggaactaggccacaaagaatgactttggtcatcacaaaattataaatttaataaaaatttggaccactataggcatagctattgcctattataatctctactattactttatgatttatctactattccgaaagtgtaattgtttaatacgtcatcacattgcagcaatccacacacaagccacgtcattcatatgccgttcgtatttgctttcgtcacttccttccgtcatcaatagtgacggctatttcttaatattaatcttcttgacttaatgctatttcgtgacggcattaattggcatatcattacaagttatttacacctaagaaacaaattaaaactattgaataatatgatgtaaataaaaatatattaatgatgtgatatatcgcagtcaaataaaaatagtgattttgatgagaaaaaaaatatgtgtttatccatagatttgttaaattagagaaagatgtggaaaatgttagtgagtggcgtcatacacggagaacctttggcatcatacacggatttttctagtctttgttttctatttgtcaactttcatttgagtctttctttatacactttattagaccatgtttttaattctaatgcttattaattcatattattaaatttacaaaaaaaactattatattaactctcttgtttcctctgtatcttccttcacattgaagctgtctctttctttcaccatcacttgcacctgttgtgtcctgtttgttctcaatttcatcatcatttatcctttatatacctctctttctttcttgacttttcctctaaattctcttcctttttatctctttgatacatctcaatttggttcttttgccttctctttgatcttatctcttacgattgtgcagatctcaatctctatatccttggttgtgtcagattctcttagggtttattttctctcccaattttgtttgattccttgtccaaagtttcttcctttccttttgacttttttttgtggtacattgaatcagaggtgtaagagtaatagtttcataactcaaatccccaagtgtacaaattttcctcttttggttctgggtttggttgattccttgttagaaatgtaaatttagggcttttgtatctgaaaccgatcttcagacttgtgtaatcttcttgatcttcatgcaagattgataattctacaagaagaagaagaagagaaa

SEQ ID NO: 1930 - DNA, 3000 bp, Unknown
  misc_feature (1)..( 3000): cDNA_ID_2147840_gDNA_ID_1620469_Annot_ID_157971 3000 nt of promoter + ATG
caagaagaagatgtgagcaaaggtctgatcaattttctcgaaccggtcttacaaaacaaaaatataaatgtcttcatagacgaggaagaggtaagaggcaaaggtctaaagaatctgtttaaaagaatccaggactcaaagatctcactcgcgatcttttcagagtcaaaatgtgattttaatgatttactgaagaataatgaatccgccgatgaagcgattcctatattctacaaggtagatgcgactggagacttggccgatctccaaaacaggtattgtttcttttcctctgttcttggtgaaggacacgttttacttcttatttggtctttttgaatatttggtctgacccaaatgtttaagtaaagtaaaaaaagtcagtctctcagtaaaaaatgattataatttcaaattttattttatattctagtaaaattgtaactaaaagattaactttttttttttactgataaatactgtatatccaattatcaaacatgctttggttctaactggcaccctatcgattgaattttttattatccgtatcgaatgacagcgtaaagtgcaagaaagatctcataaattctgccgtggaggaaatgagtaaattgctggcgaatatttctgtgggagtatacagagaaaaagaagcaaatagcaaatgtttcatggtccctgcaaggaaactccagatgagtcactcggagaaactgataaattggacatggagttctatctacgagacaccaaagtgagtgcaatatatcagatcaatgtattttgtggttagtgtttagtacataggtacataaccataaatttaaacaagttaggtaaaaactgttattataataaaataacaaataatatttaattaaggtgtgtcgaataaagttgtagttgtaaaataagttagtactcaaaagtattttactaacttaaggagttatcttgatgtttaaccgaaaagattaagtgcactaatttaaggagttctctaatgagggtttgttggagtttaaaaaactcttaaatttaaggggcttgtttgagatgctctaactattttgcttgccatactacttttgacatacagtcacatggttttcttctgtcctttttctatttttataagattgaaaatatcattaaagtgatagttttggttttacaagaaatgaagaaagtaaacctataagacattttatgaaactaaaaggtcctatgccaaaaaaagtacaaaatatatgatagcataaaatttcgaaattcaatgtatcgaagtaaaactttaacgcttaggtcagcgatgtgataactttaaacatcttttttaatatatttttttattttaaaaatggttttattatgtttcagtgacgctgcaattgaagttgccatgttgaatgaagtccactggctgcacatgtctggaaattttcacacaagaaatctgacaccagggacaaaatatgaggttgtctttttggtgagcttagatgatacatcttcaggatgggagcagccggtgaatctgaacttgaaggtaattaatccagatggaactgagagtttgcaggagcgagaaacaagcttggaatgtcacataggtgaaaactgggtggatattcaagctggagttttggtggcacctcctaggaatgcggccgcaaagatgactttcaccatgtatcagtatgtgactagtgaccggaagagcgggctcgtggtcaaaggtgttgctattcgtcccatgcagtaactaaagaaaaagtaaaacattggatctttttatctaatattgtgattgcgtgtattgcacgaaattattattttttattgtatacgagaaatccaaattttcaatactaaagatatttattttggttgaataatttaattatatatcatatctagcaaacattagcaatacaagatgtgtatttaaagtaaattcctacgtgcttttaatactgtggttcaaatcctaatatagctaataaaatttagttatcatatcgtatatatatgatgcatgacttgattctgatatccccgcgttcgagatcttaatttttcatgcatggtcattgatatgaaaaagtccacttctcttgatatttcttgaacttttcgcagttgcagttttaagttgacactgttttttctaattaatatctacggaaagactttatgaattgccgaggtcttcgacacttgatgtatacaacaacactaaaccctcgtaaaatggttatatataaaataatttaaaactcggtgtgaatttcaaaacaattgtagtttagtggtttattcatgttgatcaaggtcataatttgattatgattatatgcatctgtcatcagctacatattttaatcaattattctgagttatctcttttaccaaattatccatcacataagaacatactcggtgttgacctagagacatccatacactacaagaaaacagacaaacaacgactacagaaagcgacaacagatgtagtcgttgtttttggcgactacgtcacgaccgttttacgacgcatatacgacaacatgaacattagtagtcaattagtcgttattttacgactaaaaatgttagtcggcaaatactcgtatagtaacgactatttaacgattatattatagaagaaaaacgtttgttgttacatagtcgcaaatggacgactacagtttccgactgcggaagttagtcgcccaatcggcgactaaaatacgacacatatctgtaatcgtaaactagtcacaactgagtcgcagaatagtcgcattaagttgttggaaaacgttttccgcattgcgaagtaggtacacctaatttgtttgttgtagtcgtaaattagtcataaaaattcgtctatataatcaaaattcacgacactcttctttcacaaacaaatcaaaacaacaatcaaaagaaaaaaaagaaaacaatggaaatttagtttattctataatg

SEQ ID NO: 1931 - DNA, 3000 bp, Unknown
  misc_feature (1)..( 3000): cDNA_ID_3065206_gDNA_ID_1620470_Annot_ID_157994 3000 nt of promoter + ATG
cttcacgaatcaaatcataaccggtccttaaccagctccagttgagatcacaaatatattttattttctgttctttgaaagtttgaaacaaatacatcataccaaactacaaaatttattttatatttatcgtatttgttcatcaaataaacaaataagaatggaccggagcaaatcataatgataatcacattcatgagcgcaaacattacaaaaaatgttataccactgacctgttgattttcttaagtaaacaatcaaaagtaatatcaaaagcatctcgaaacttttcaaacttagcattggagtctccatataccaatccaggcaaaagctgttgaactatgtaacttttcatatcctttttctcctttagagtctttgccttcaatatctccaccacatttactctcttttccttcacatcttgttcgcttatatacactgagtacttccgatgatcctcaggaagatgccacgcgtactggtaataagctgtgtacggagtaaagatcaccggaatgcagccggagattagtgaatcaaatactgatctccttgttgcactatctccaggcggctgcagacaaaactctgaatcttgaaacaaatcaaggacattcttgggattcgtgcagctttcgtttgtacaatttaagaaccgacattggttggaagatatgcattgctcgattagcgttgatcggatgttattagggttatcgggtcttgcacctcccgcgaagcttactagattccggcgaagtttactcatgatcttgatctgccagcgggtgatatcatcatctgttcgcggatggaaataagttgggtgaggaatggcgatgtcgttgacctgccatggctgtctttctatgagtagcttggtagggttttgcatttcttgtagctcaaggaaccttgagccccaagggtccttatctctcctaaaatcccaagttatttttcctagaacgaacacatgatctttcccggcgtttctcctccatgattcctttgaattaagccattttaaaacctcgatccccaaacggtccttcacatcttcagaaacattcctatagtgccatctcaaaacatcatacccgccatagtaagggacaaagaagagcttagcttgggtctcgttgtaaaccctacaaggatgcttcaaaaccctagagtgtaagatgggctcaagagaatacatgtgtgtagcaaaccaacctttgccaagattcttaatagcttctccaaagccttcattcttgaagtagctacacaagttaacccctggaagtatatcgttgcatcctaccaacaaatcgctgttgaattttgacggtaaatcataaacgtaaactcctttaccttcacacgatcgcggtttattgaggttttcatctcccggagatagccatgatctttgtaggtaaagatacttgatggctgcccttaacgcatatccctcatcttcactcgtaggtttgatgtatttgctgtattcttcctcggcttttagttcaatgagtgaattgagatcaaccttgttctttgttttgtgttcttgaacaggaactgaattaagaatcttgttgtgatccttagaaactctatctcctgcgatctctccggcgaaagttacattttcttcagaaattatttggaaaccgggtttagaaccagccgtgttacaataagggtcgttgaactttcgagagaagatacacatatggaagttgttgtaggagattccggtggtgaaagataaacaaagataaagaagaaagaagaagagaaataatgcaggaagagtatagtacaagaatctgaagaagacagaacatagatggatacaagaatcttctatagtctttgaagttcttgactttctctttgaaaccatttttctgacttggtcctttacttcttcactttggatatttataaaaactcatttggttacctatgggatttatattgtttactttattttaaccaaaaaatatattttctctactaaaaatagcatagaaaattaatgaatagataaatttaagtattaaattttctaagaaagtagctgaaaatattttcctatctatgtaattttaatattttaactaggggaaaacttactgtttattttatttttatttctattttttcctttcctttcctcttatgttaaatgatgaatttatgttgtataatcagaagagttagaatgaaaatggaaatatatagtgtacaaaattatactaaaacaggtcagttttgttaatatacattatacttttaaacatagaaatatatagtgcacaaaaaaataagggactatattacttttcaaatgcaatagtatacaatgctatttatgatatgtatgccatcaatatatattttagtctagctacatttattgaaatttgcataacttatgtgctacagtacttgaaagaaatatattctcagaaaattatatattcaacatattcagttttataaacttgtgagtaattccaaaactaattaattttgctattagcaaatatgagttgtttctttagaattttcttttttgacacactgttgagttgacttggatactctgctttgctgtgttcattttggatattaaaaaagatcagaactttattttgttaacaaaaaaaaagaagaattatctggcaaagtgtttaatttccgagaaagttgaagcagagaagcagaaagtttcagaattctcttttctccaagtttaacgcttttttagctcaaagctcacacacacgaccactctattcctcctttaacctttgtgtttgtcaatttgtgtttcctcttttgtcgactcatttctcgattcaatctcgattttttttttttttttttttatggaaatctaatgaactttttttatggatttgatctgttaaagtttcgattaagaagatagtggtttaggtttacggttttgtaattgatttattatctgta

SEQ ID NO: 1932 - DNA, 3000 bp, Unknown
  misc_feature (1)..( 3000): cDNA_ID_2148046_gDNA_ID_1620470_Annot_ID_157999 3000 nt of promoter + ATG
atgttctcatccataagtcaactcttttgggagaatccaagaataaaaacaaagaccaaaaaaaccaaaacttaaaacaaagaccaatctagcaaaataacaaagaccaataaacttgttaaatcaacgaccttctctctaatctctatatataatacttcattttcttttcttttatttcataacctctaaaaagattaaaaaacatggaaacaacaaagaaactctctgttcttctctgtctcttcttcaccatgaaccaagctatctccgaatccgattctgacgagcacatggcgactttttgcaatgattcatccggaaatttcactcgcaatacaacttacaacacaaatctcaacactcttctctccactcttagcaaccaatcatcattcgctaactactacaatctcacgaccggtttaggttcagacacagtccatggaatgttcttatgcataggagatgtcaacagaacaacatgcaacgcctgcgtcaagaacgcaacaatcgagattgccaaaaactgtactaaccatcgagaagcaatcatttactacttctcttgtatggttcgctactcagataagttcttcctctccaccttagagacaaagcctaatacttattggtcgtctgatgatccaatacccaaatcatatgataaatttggacagagactgtctgacaaaatgggagaagttatcatcagatcatctttgttatcttcttcgtttacgccatattatcttatggataccactacgttcgataacttgtatgatctagagtctgttgttcagtgtagtcctcatttggatccaaaaaactgcactacatgtctgaaacttgcgttgcaagaactcactcaatgctgtggtgatcagctttgggctttcatcttcactcccaaatgtttagtgagttttgatacctcaaattcatcgtcattgccaccgcttccaccgccaagtcgcagcggttccttctccattagaggtaagcatatatatcaaataatgatgggttgttaattttttatatatacttttatttatatagattagatgatacgtaccttaatttgaggctttgacatgttatgcatgcttagaaaaattcaaaatctattagaatatatattgtagtaaattttcgattatatataacttatgtttcaatgtaacacattttgtttttttcaaataaatttagaaataaaatgtatttaagacaataaagaacaaaataactgcaattttagttctctcttgtatctttattttagcattatggtcaatcttgttatgttttgatttttgtttttcttttacaggaaataacaaaatacttgtgggaatgattcttgctgtttcggtgtttgcatttttgggtttatgatcagatctacatatactaagaaaaaaagtttggtttttgagtttgatttggagtttttctaagagcaaaataaacatcattgtttccgttaattatgcttcatgcttatgtttttcctcgttttatgtggttatacattcagttgttgcaaggattgtcccatttttatacacggaattgttaatgagtacagctttctgaagaaaagtgtcatgtaaattcactttgtgaaaacatttctcacaattctttcgatttatcgttctttgatatccattaatttgtaattacttgtatatcaatgaccatgtataactcttttaaatgtaacccaaattaaagttttaactactagagtatcttataatgttttgttgggttagtttcatgtgtaaaataccattttatatgtataatatagaaaaatattttatttcatattattattcaccaagcaaactaattttttcataaatactccactattgactcaaaataattatgaaaataggcaaatagtcatgagtaaaaaatatactaacctcaaataaaagacaaaaatacaacaatgtattgtaatttagagaaaaatatgaaataaatactaattacacgaaatccaaaaataaaaataatcaatactgaaatattaacgacgtaagagaaatatccaatgagaatcagaggaaaaaagatcatttaataaaatagcatgtcaatactaaaacatttaggaataacatgttgttgttatggaggtgacgatggtggttgttaatggttacagagatggtgatagaaaaattattataagggaaacatattatattatataattaatatgatatatttttatttctctaagttactaattaatattatcatgaatagttatcaattaaatattttatcatgtgtcatgatttaaagggatttagtcaccattgatcgatcatctttatagttttaacgtgtctaatttaaagttatttttgtttcattcaccaattttatgatgaaaatttttaattttaacttttatataattattcaaagagttattattatgcgatataatttttattcatatataagttattattatataatatatttttcattcaaataatttttaatcaataattttagttgtgaatgaaacaatgcaagagtaaaatatatttccttttttatctttgaaagacaatttatgtttagaacgttgttaattcttacttttgttaaatttgatcggactggttcgtgtctagtatatatatatagattgattggtttaagatcatttcatacattacttttacattgtaattggtttcacgtcttttaattcgtccccctttgtttttttaatcccccacttgaaatatacatatgttctcatccattagtcaactcttattgggaaaatccaagaaaaaaaacaaagaccaaaaaaaacaaaacttaaacaaagaccaatgaacttgttaaatcaaggaacttctctctttctctaatctctaattctctatataatctttttcttcttcttcttctctttttttatttcataacctctaaaaagactttaagaat

SEQ ID NO: 1933 - DNA, 3000 bp, Unknown
  misc_feature (1)..( 3000): cDNA_ID_2148066_gDNA_ID_1620471_Annot_ID_158004 3000 nt of promoter + ATG
aatgggccgctaaaagagtttcttatccaaaaaagcaaatattttattaacccaatctctttttcacacaaagataaaatacatcaaagttcacaaacagaggcatcatacaaaaacacaaacattcaaaagcaaaaccccaaatcttcagttcccagaatcttgaactcccttacctccgccactgcctcccaactcacttccaccggaatccgaaaaccccatagtccctaccatagcaaccaaaacattttgagtaaaattacaaaaataatacacacatcaaaatcttaacattacgtgtaacacaaggacgagggagttttaccaacggtggtgccaagtgattgtggagactcttcaacggaccgtggcgacttcggtttaccaccgagccaagaagtgaccgctcctttaactttccccaccattccttctccaccttttccttcctctgcaaccgcctcaccatgtcctttcccctccgctatctggtcggaaggtatcttctcaaccgtcacttccacctcctttgtagccgttgtcttcttctctcctcctcctccaaaatgaagtttctcagctatcatttccgataaagctttgtcctcttctccaggtttcagcttctctgatatataatttttagccgtcacacctttctcttccccttgttgcgtctccttcactccacttccacctccggagagaggtagctttgtcatcaccgttgatcctgtttctttgactttttcgtaaaccggagtcaacttctcagcaacagttcccgccactttctgcccgtaagcagtaacagatctcggagtttcatcttttacagggctctcgctttgcccgccgccattctctccggtgtaacctagctttgaggcaacgacgttctttgcggctatagctttgttagttatggctgatgtagctgaagctaactgctctgtgtaggtgcttggttttgtctcatgtgtcgactcatctttggtttcctcagaatcatctctctctttgggacgagatagttctggtgagaactgatcatgagttcccgtcggtaagtctcttcccaatccactctctactttcacatcacctcttgtcggaaaatcttcctccatcccagcttttgattcccctccaaatcttgccggagaattcttgttgatatcagattccttcttcagatcaaactcatggcttctcgtcggaaagtcttcttcgcgtccttgtcttgatttctgatcaggagactcatcagtcactttcattctaccaagagactcagcaatctctggtactccagcttctccaccttaaacagaacagacaagagttattacagattcataaaccctaaaaaaagtctcggccaaagtcattacctttatgcgtgggatcagtaactttggactgataattagatacaccactgagataatccgatcctcctcctggagcagccggatcttcctccaaacgttttggcgtctcgacgttgactttccgttgaccaccgagatagtcatcttcaccaccaggagcaaacgtcctagtcacgtcctctgttgctgaaagcagagacacaggagtgttcaatggctcttgatgagcctctctgctctctcctctgtctgaaaattctgacactccgagaggataatgagtcggtgcctctcttttcgcttcccagtccgatgtttccgtcgttcttacaggatcagccagtgcctcatgtccgtaagaggtatcttgtaatgatacaggctcaatgggtttggtgtggtcagaagacacgacaggaaaaacttttgtccctggaggaacaatctcctccgatgccggaacattagtttctccggcatgactaagagacttaggtttacccgttacaccacctctcacggcagaggattcatacactgtgcatacacataaaaaaacagaaaaaccgttaatacacaaaaaaatataactgctgattgacgaggactttaatacagagaaattaacctggtgcgccgtgaacttctgggtcttgctcgtcatactcatcatcatcatcttccacatcgtgatcatgaccatttccatgtttagtgagactgttcttgattttcttagccttttcttttactttcttcaacactttggatgctcccttctcatgatgctcttcttcttctgtatccgaatcacaataaataaggcaaattaagagaaaagttctcaaattagaatcttctgtcatagatatatatatacctggatggtgaattctgattggttcttctgcttgctcatgaccataaggacgtgtcaactgtgactccattttccaaagctgtgttttctctttttcaagtgaatcaatcaaaccctctttgttctagtgttgttttctttcttttcgtgtctctgagaaaatcagaacaaagttccataaagtttatagagagaacgatgacatatggccgaaccacctctctctggcttctgtctctttacttctgtaggattctgacacgtacgatgcgtccgtttcgtcctgccacgtctcagccagttgctctctacgtggctatgcgacattatcttttatccgatctttagagaagcctatcgatgtatcttctattatttagttttagtcggtccacgtttattggcccatcatgtagttatttggcaaatgcactgtgtgttgtttaaatataacaaaacggcaaaagaaaaaatcaattcagctatcaactgtgtgctgttttgaacatttaaaacggcataacgtactcaattaaaattaaaagacgacaagtggcgagagttgctttggtatctccatctccctcttgaaatcgacgggggatattttttaatttcttaaaaattcaaaaccgccaatttcaaaattcgttctcttcttcatcatcatcatcatcactgatacagtctgagctcccaagacggatctagaaaattacgatg

SEQ ID NO: 1934 - DNA, 3000 bp, Unknown
  misc_feature (1)..( 3000): cDNA_ID_3065243_gDNA_ID_1620471_Annot_ID_158020 3000 nt of promoter + ATG
agttttcgtcgtagttatttgcctcatgttcttgaagctctttctgcgttgttggatatggccagttcgagctcaaaagaagcttagaggaaacggatttgttggtccagctcctagttttccatttggaaaccttaatgacatgaagaaactgaaaatggcctcggttgtggtggataatagcaaatcttccaccatcatcaatcatgacatacactctattgcacttccacatttcgctcggtggcaacaagaatacggtaactaataaatctatatcctcttatttaaattccggacaattagaccatataagttgtttagctaacaacatttggattaccatatctaaatattaacgtagattattggttacgtgttatgtgatgcagggaaagtatttgtgtactggctagggatagagccgttcgtgtacgtggccgatcctgaattcttgagtgttatgtcgaaaggggtattggggaagagttggggaaaaccaaatgtttttaagaaagacagagagccaatgtttggtaccggtttggttatggtcgaaggagatgattggacacgacatcgccacatcatcactcctgcatttgcccctcttaatcttaaggtatagatatgtacttacaatagttaaactttttttaaaaaaatcgtttgcattggcaagagtccaagttgtagaaaattaatagggtgactaatctagttcaacaatttagactatatagtccttttccaaaagcatgagccaccatttttcatgacataaatttcaaggtcttatgatgttgaaaagactagaaagtactatattagactcattcaaaatcaaagattcatacgaaatattcctctttttctcattacttttaattattcgtcttaaaaacaggttatgacaaatatgatggtggaatcagtctccaatatgttggaccgatggggcatacaaataaactcgggtaatcccgaattcgacatggagagcgagatcataggaacagccggtgagattatcgccaagacaagcttcggtgtcacgggagaaaatggaactcaagtcctcaaaaacctaagagccgtgcaattcgctctcttcaactcaaatcgctacgtaggcgtgccattcagcaacattttgagttacaagcaaaccgttaaagcgaaggggctaggtcatgagatagatggtctccttttgtcgttcataaacaaacggaagatatctttggctgaaggagatgaccaaggccacgatcttctcggaatgttgcttaaggccgatcagaaagggaattttacggcgaaagagcttgtggacgaatgcaagacattcttcttcgctggccacgagacaacggctttagcactaacgtggacgtttatgcttcttgcgatccatcccgagtggcaagacacgatcagggaagagattagagaagtcatcggagattccaagattgagtataacaaacttgccggtctaaaaaaggtacattaccaaacacagtacacaacaatccacgtgcttaattatacgcatgcatacattatgtttggacgcgttcacaaaatagtttacaatttggcttggcatgttcatattttcttaataaataaacgaattgaatgcacgtaaaaaagatgatattagcctgaacgcctgatactacataagatttcataaaattaaaataaacgaaaaatataccttaagtatactttaagcctaattaattaatactttaatatacatctgatcaatgtggtcaaagtcagtggtcacatagaagtcaaaatctacaaaacgtacaatgatcaaaccatagaggcgcgtcaacgactgcgctgaccaatgaacacgccacgtaatcttaaaaaaactgaaaaatctaagccacgtggcaatatcttctcataatgaatattctatctgtttttattcatgactaaaacgtgtgacacgcatatcatcaatgatacaatgaaatcacatcttttagttaattaaatcacttaacctcctgaatgttaactttgatactaatgaatataacttccgatcattttatgcagatgagttgggtaatgaacgaggttctccggctatatccaccggcaccgaacgcacaacgacaagcccgaaatgacattgaagtgaacggacgagtgattccaaacggaacaaacatttggattgatgtggtggcgatgcaccacgacgttgagttgtggggagatgacgttaacgagtttaagcctgagagattcgacggtaatttgcacggtggttgtaagaataaaatgggttacatgccgtttggattcggagggagaatgtgtatcggtcggaatttgaccaccatggagtacaagattgtcttgtcgttggttttgtcccggttcgaaatctcggtttcgcccggttatcgccattctccgacgtatatgctttctcttagaccgggttacggtttgcctctaattatacgaccactttagattacattaccgcacaaatataaagtttttattttcaagtttaattaggaggatcaattcttttcttcttttttttttttggtcggcagatcaaaatttaactatttaagtcctcgacttttagtatatttgtaaacgtgtcttctttttccggataacggaatacatcatcttttatttcttgtaatttcactgattaatgcaatatacgattttgagactaagattcaagattgtgtgtgtgtgataaaatatgtgttaatatgtaagataaaagatggatgggttacacctaataaataaattaaggtgggtaaattttgaaagtagtagataaatgtaagggcctttaccgtaattatacgaaaggttcgtatcacgtttcttgtctcgtctatgaagcaacggaccaaagtaaagcgtaaatggaaaattcagtttcatgcgaattttcgaatcgtttgctaaattatggcgtctaca

SEQ ID NO: 1935 - DNA, 3000 bp, Unknown
  misc_feature (1)..( 3000): cDNA_ID_3065239_gDNA_ID_1620471_Annot_ID_158024 3000 nt of promoter + ATG
cctttttgttctgtatattatttcgatgttttcttttgaacaattcagtttatgtagtagttcacagttgtattagatttcttacgataataaccgaatctatgtttctgaaagaacagaaatgaaaatgttttagtaatgatatagaataagaccattcacgatctcagttcaaacaatatatttgtatgaaacagtaaaacaagaaataaacaatttatatcaatgtaacaagattagatgtaggagctgatccaagaatattccaaagtttccaactacatgagtacagaagttaactgcaaatcaaagctttaagcttatttattcagtgtgtataagttgttagaacccaaatctcttaccttttttcacgatccatgttcaaggtttgttacttatagggttttatatctctgtctttggtaatgaggaagaagaagaagagatgtcattttaatttggttagctgactccagatcgtaaccccgggaagaaactccagctgtttcctgcaaccttctcgatattctcgtctttcgtgttgtcgaatttaaattctttgctagatccaatcgatgaggaactcagcttctgaattctatgctgttcgttctctctgtctcctgaccttttctctatgtttcttcttatgtctgttgatgaactctcctctgtttcgatccggtcattgttgttcattctgtcgtgtgatcgatttagcttgcttgcaagacaacgtgcaacgtcttcacctgttaactcaaacgaaactctgtgatctgctaccatgacttcagagccatgatccgaatttgccagtgaagcgacctcagagatctgattttgaagaggccatgtggtattgttgggtgttaagtttccagatactatctctggaccatttggtgtcagagcgcctgaagccaaacctgaaccatgcccaacaggtgtgatcgatccagaaccgaacctcgatccccatttacgagctgtaaagtgctcaaaacccaagaactttggaggctcgcctattcgaaactcaaccatgggtgatttaccagggtaaggagaagatgtaccagagtttgaaatcactgacccgggagagattagattaccaccaccaggactccccggacacacctgattagaccgaaactcatagtgcgaagacgaaaacttttgattcatcccactagtactatccctccgagttagctccaacgaagaagtaagcaactgagcaaagggcacttcaggtgaagaaggtgtagttatatggactgatgattcaggaggtggagtatacggtgcagtagatggctcagttataaacgcagagaacaccggaggagtgactggttgagtttcattagcataaggtccaacggtaaagacagattgaggctccttaggcgagaatgtattgctagtaagagaaagtggaccaacaggcgagtgagaaaccgatgaaggatccgattgcaaaaacgaagctggagatgaaggaggagctataaagggaagaacaacagtagttgaagtagctgagttttgaacagtaactaccggaactccagatgtaaccggttcaggtacaagcacagcattaccaatccttttattgttcttctgagttccaaaacatgaatataaactccaacattttccccatcttcccttctgtacaaattaaacacacaaaattagactcatcttgatcccctttagagagaactgtttcaacaaaactttctcaaagtaaaagcttttgataataaagttaatcttgtttagtttctaataagtagctaaacgtttgtaattcacttttggagaaatttatactatccgtggaaaattaaccaaacatgaaatagaaacgcttttaacctttttaatcatggatgctattatgacttgtaaagccaatccacaaaaagattgaaaaagcaacaacgcatctttttacctttttgagaccacaattgtaatccagagagaacaaatcaaagtcgtgaaatcaagaactaagctcaccattagctctgatctagaatcgtaatcaaaatcaaaacaccaaaatcgcaaattcaaatcacattcactacagtttcgtaactatgagctaaatcaaaacagcaaaatcgcgaaattcaaaactaagaacagatcaaattttcagagcaatcattcaaacaaaagctataaatctcggaatcacgatctaaatcaagcaagtaacaatactgatctatgagcagaagaaaaacacatttcaatcacggaaaatctggaagaagaagcttagtagtttacctgagaagaagacggctgtactcgagactcggcggtgacgatggcggtagcggcggcgttaacagtctcaacgctgttattaacaacgttcctcatctttcgaactcagattcacaccgactacaataacatccagatttgcttgcttactactactcagaaaccaccacttggatctactacgcagagagattttcccgagaaaatcaaatgagaaaaggataaataaatcaaataaaaagcgaagaaggttttgtataatgatggatcgaattctctctctctctctctcactcacaccggtcgttatctagtccagcttttcattcaatttcaccacgagcttttgccacgtcatcacattttagatggttcatggttcctttccttcacaccaccacacgcgcttcacttaaaatagttatgcatcatttgggagggtaaataacggtttgatcggtttggttcaatccctagaaatgcagattcaatttttatctacatacatagttactaaaacttgttaaagaaattctaatatattggttgtgaacatatatttgtctctgcattgtgggttttctcaaatcaaagttccaaaaagaaaaagggtaatatctagaacttaattttttttggtatatatagactagtatcgtaaaatactaacgttggcca

SEQ ID NO: 1936 - DNA, 3000 bp, Unknown
  misc_feature (1)..( 3000): cDNA_ID_3065233_gDNA_ID_1620471_Annot_ID_158027 3000 nt of promoter + ATG
aatccaaaggtttgcatatatgtataggaaaaaaatcaaaaaaaatgatattaattaccaaatcaagtttcacattcagacatttattcctaatatcctaaatttggaagatttttttttggtaaattaaattaaagattaagatacatggttaagaataaattgatatgggaatatgtaatttgtagaaagacagagagagtgaggaaaaactgacgaggaagctgaaaccggtgacggaggcgaaagaggtggcgatggatgcggcggagagaggaagagagccaagatggccaacgaacatgacggagataacttgtagacaaaactgaagaagactcacggcgatgagtgggcctgaaagccatagctgcttcttcacttcttccttgacactacttttctctccgatcaaaggccatgacaaatcaccctctcctctttctctgtcgtccctcatttttttttgagaaatagcaaagctatgacaaagtatcttcctatctttaagggctttgtgtttggtccggtctctctcttctctctcgctttgtccctattgatgtgtgatttgtggtgtgtagggattagtacttttttattttgtcaactttataaatagagtgaatcattacttggctaataatgaaaaatcaaatggattttattccttttaaaatatttattggcagtcgcatacaagagcgggttgaatccagaaaacattggcaaatctattattaataaaatttaaaaatataggaatttgataaaatttcgttttattcggttcggttttctttgtaacactaaaattgcaaaaaaaaactatcatttcaattttataaaaaaaatttcaggtttgtgttctataacttcaaaggtaaaatctaaaattgtcgaagttggtatgtagtattcaattccctcataaatttgtatttttcttccagattctcgatgggcccggcaatggtaaaatgttatgcatcaaagaaacaatgtgtccaatatgttcaaagaagttagaatatgttcccatatagatgtggttttgcaccaaatggtaagagaatatacattcttcatttaaacacaagcgtagacgttgttgaaactctaggcatagactttaagaccgtttctatcacctctctctcttcaagatggaaggttgatatctctctcttcaagattgaagattgaaaatgttcccatatagatgtgactgtcactttctttaaacactttgcattagcaaaaatgtatcttatgagctgtgtctcttcttcgtttcctctatatccatgccacacaaactcctcatctaaatgagccgacaagcatctgggaacagtaccttggttggtaccatgacaatgggagatttccgggtcgatatccacttacctggatgcaagtacataaaaatctatgaggtggaatcaaagaatcagtttatacaacaaggagattgcgttgttacttgttacttacagaagtgatagcaagaaatcttagtttaggagagttgttgagaattagtggaattatatccaaccagagatggccatgtggacatatcactaattttccaagtcgagtgaaggtaaagccacgaaaatccagagccttcaatgactaaatcaaaagccaatataaatcaatgtgatcaaacctaacagccaagaagaaaaaaaacaataataataaaaaggatagataccattggatcttccaaaggtaacacaagatacgtgaccaaggaaatagctttgagaaacttgtcatcagtatgacatacaacgtcgatatgtggcttttcaaggcgaagcttatgcaccttcgcgaaacggtagtcccggttatcactgatggcgaggcccactttcgatcgggcaagaactgagcaacttgatataagcctctctagagaattttcatctttgaacaccacataaaaaaggcgtaatatgttgagtgacgggaggcaaaccgaagaaggaacatccactataatcttgtccgaaagagtcaattccacaagtgttttgcatgtgtaaagactcttaggcaagctggtaggctctgccgtccagtggagctctaactctagcttgcgcacaaagcgatcaactgcatttgcaactaatttcccaacatctacctcaatagaaaatttttaccgagttggatgcacaaagtttctagaaaaggtgccttgtgaagttccaataacttttcaagaaacttccacacgctttcgcattcatcaccaggatcactgtactcgagtttaggcaacaacgtccagacataacgccatcgttttgacaatatcattgtcccaactgcatctttgatcggtacaagcaacaaaatctggataagcaaatcgtcgggcaacgaactgatctcgtctctagaagcaacaacctcttcatcaattctttgacaacgttcggccattagtgatgtaatagctagctgagtttgtgataaagatttcaaatataggtaagcagagacgaggaggagcaagtcgaaccctaaaaactttagatgatcgagaaccttagatatattcgtaatttctctatgagaaattgagaataagtgaataactaactcttcttgtctcacaaaaataaaaccctaacttatcttttccgtgagacataaacaaacccactttgggccaataaaatcggcccattattatcttgacccaatccggatcaaacccaactccatactttggagtttggacccatcgttaccaatgtagtagactaatgtagttaagatatatataatagaagggcctatttataaaatacaagaaatgttaccaaagcataaaccctaaaagccctaaaatcttaatatataaaccaactcacagagactctaaaatcagccaccaccgcacatctctctcctttgccctcgttttttttcggttctcgtctttcgttcttcacttttagacaagcaaat

SEQ ID NO: 1937 - DNA, 3000 bp, Unknown
  misc_feature (1)..( 3000): cDNA_ID_2148131_gDNA_ID_1620471_Annot_ID_158025 3000 nt of promoter + ATG
tcactttgcttcctcctttcattcctccacgaggtggtcctccacgaccacgaggcgcaccacgtcctctgccgcgaggcccactacggcctctgtcaccactacggcctcctccaaagcttcttccacctccaaaacctcttccaccaccatctcttccacctctgaatcctccaccaccacgtcctcctgattataacaataccaacatacagaaaattaactaaacggaagaacagagtgttattaaaaatctctacttttatctttgaactttattgaaacagtgaagatacaaaaggctcatgaattaaaaccctaactaccaattcaaactacagaaaccgtaatgatacgaattcagatttgatacggacagggttatactctagaggcagacagaacaagaaagacataaactttaactaaggttcttacctgtaactgggggtctcatatttgcttgtctaaaagtgaagaacgaaagacgagaaccgaaaaaaaacgagggcaaaggagagagatgtgcggtggtggctgattttagagtctctgtgagttggtttatatattaagattttagggcttttagggtttatgctttggtaacatttcttgtattttataaataggcccttctattatatatatcttaactacattagtctactacattggtaacgatgggtccaaactccaaagtatggagttgggtttgatccggattgggtcaagataataatgggccgattttattggcccaaagtgggtttgtttatgtctcacggaaaagataagttagggttttatttttgtgagacaagaagagttagttattcacttattctcaatttctcatagagaaattacgaatatatctaaggttctcgatcatctaaagtttttagggttcgacttgctcctcctcgtctctgcttacctatatttgaaatctttatcacaaactcagctagctattacatcactaatggccgaacgttgtcaaagaattgatgaagaggttgttgcttctagagacgagatcagttcgttgcccgacgatttgcttatccagattttgttgcttgtaccgatcaaagatgcagttgggacaatgatattgtcaaaacgatggcgttatgtctggacgttgttgcctaaactcgagtacagtgatcctggtgatgaatgcgaaagcgtgtggaagtttcttgaaaagttattggaacttcacaaggcaccttttctagaaactttgtgcatccaactcggtaaaaattttctattgaggtagatgttgggaaattagttgcaaatgcagttgatcgctttgtgcgcaagctagagttagagctccactggacggcagagcctaccagcttgcctaagagtctttacacatgcaaaacacttgtggaattgactctttcggacaagattatagtggatgttccttcttcggtttgcctcccgtcactcaacatattacgccttttttatgtggtgttcaaagatgaaaattctctagagaggcttatatcaagttgctcagttcttgcccgatcgaaagtgggcctcgccatcagtgataaccgggactaccgtttcgcgaaggtgcataagcttcgccttgaaaagccacatatcgacgttgtatgtcatactgatgacaagtttctcaaagctatttccttggtcacgtatcttgtgttacctttggaagatccaatggtatctatcctttttattattattgttttttttcttcttggctgttaggtttgatcacattgatttatattggcttttgatttagtcattgaaggctctggattttcgtggctttaccttcactcgacttggaaaattagtgatatgtccacatggccatctctggttggatataattccactaattctcaacaactctcctaaactaagatttcttgctatcacttctgtaagtaacaagtaacaacgcaatctccttgttgtataaactgattctttgattccacctcatagatttttatgtacttgcatccaggtaagtggatatcgacccggaaatctcccattgtcatggtaccaaccaaggtactgttcccagatgcttgtcggctcatttagatgaggagtttgtgtggcatggatatagaggaaacgaagaagagacacagctcataagatacatttttgctaatgcaaagtgtttaaagaaagtgacagtcacatctatatgggaacattttcaatcttcaatcttgaagagagagatatcaaccttccatcttgaagagagagaggtgatagaaacggtcttaaagtctatgcctagagtttcaacaacgtctacgcttgtgtttaaatgaagaatgtatattctcttaccatttggtgcaaaaccacatctatatgggaacatattctaacttctttgaacatattggacacattgtttctttgatgcataacattttaccattgccgggcccatcgagaatctggaagaaaaatacaaatttatgagggaattgaatactacataccaacttcgacaattttagattttacctttgaagttatagaacacaaacctgaaattttttttataaaattgaaatgatagtttttttttgcaattttagtgttacaaagaaaaccgaaccgaataaaacgaaattttatcaaattcctatatttttaaattttattaataatagatttgccaatgttttctggattcaacccgctcttgtatgcgactgccaataaatattttaaaaggaataaaatccatttgatttttcattattagccaagtaatgattcactctatttataaagttgacaaaataaaaaagtactaatccctacacaccacaaatcacacatcaatagggacaaagcgagagagaagagagagaccggaccaaacacaaagcccttaaagataggaagatactttgtcatagctttgctatttctcaaaaaaaaatg

SEQ ID NO: 1938 - DNA, 3000 bp, Unknown
  misc_feature (1)..( 3000): cDNA_ID_2148128_gDNA_ID_1620471_Annot_ID_158023 3000 nt of promoter + ATG
aagaacaaaagcatatgcgcgcatagtatagttagaccactcactgggatcatttgcagtcacaggagcttcagtgctaggaactgatggtggtggtggtggaggaggaggttgaacaggattcgttctgttttggttgtacacgtttggcgttgagatatcatcaaggccaatttcacgctcaagggtacttttaaaatctcttgaaacatcctaaaacaaaagacatgtaaacaaacaaaaacagttaggcacaacatatacaaacaaacctcataatttctgaaagtcttgagatagaaattaaacctgtagctctctaatcgttggctgaaatgtacgcagagtttttccaagattccgagctacctgcacggatcatagcaagtaaaacacttcttcaaagagctaaaacaactctaaaagactatatggagaagcaacagtgatatcttgagctcttttctcttctcattcccaaactcagactctcaaatggctccgtatagacgtcgaactttctccaagttaagattttaaatccacagagaatcaaacactattaagccaaaaggtcatctatctctagcctcaactatacaccatactccaattctcataagagaaactaaacagtactaattcataagttgcttaaaccctaaaaagatatgattccaaatcaatcatcaagaaattttacacacacaaagacactaacctcagcaagacctttaggaccaaagactaacaaagcaacaacaccaataaccaaagcctcaggtgctccaacaccaaacagagacgcacgaatcatcatactcttacatcttctcttcttctctgcacacaaaaaaccacccaacttcagaaattaaacaactttacaaaaacccagaagtaaagaagcaatcatatctctgaaatcgaaacctgggtttgaagatttcggcgagattgagatgcccaaatgctttaaaccaatgtaaggagagaaacgagaagaacccagaagagaaaaccatgaggagaggttaggtttcgaagctttataacgagattgcagaggaggataagagaaaaggtgagattttgtaatcgttggtgatgaagaagaagaagctataatctgtaacgccatggccatgggcagcttcgaaattgtaatatagttttgtatgtagctttgaagactatcttaagccataaattcactccctcagcttcatcaccaatcaaatgtccagagcttgaaaatgaaataacaacacacacaaaaagataaaacagagaaaatctaaattatcctttggaaaatctgaatgagatagtcgcaaacacagaaatattgggccgttaaaaatgtatgatatttaatttgggcttgatttattgggcctgagctgagttctttggttgctctctttctcttggataaactttctctaaacatagtggagtgtgcaagtatcatagtattctttccattctgtttcgggttttcttttattctcaatcgaatcgagtaacaagtgagatttgtgtttatagttcttcctcaaacgtcgaatcatagggataaatttcaacaacaacaacttcttttaaagttttagtttagttattctttagaaatcttaactcgataatgatacagtaccaaacaagttgagtattataaagatacacaaccaatttgattcatgtattgattggtggtattgaacttaaacaacataattaattagggaagactcttagttttgactgatgtcaacatggttcatatcctaaaaaggtaaaaagaaagagtaataattagttttcattgtagagagacttaataaagaagaaagtaacaaaagtagaaaagaaaggtaaaggagtggcagccacacacacgcacgagggtttgctcaaaaagccatcacacacaacaagatggtctgcgcacgtgtgcttcttaattcttcttgttaccaacctttctccaattattttattttgttttacttaatgggcataaatagttacaaagttaaggatacaaaatatattgaaaacactaataataactatttgtgaataattagagaatagtatagcaacagtagagaagaacattcaaaagaaattaataaaagtgactctagttataaaaagattaaagaaatgctcaaaacttgagaggaggtcacatgggagttccaatgatgaagcggcttctattatattacctctctcacttattgatcggtccccatatcatatgcgtacataaaggctatgggtcaactcttccccatggtctaatatatttcttctttcctttgaacaagtatagaatcatccattttataggtacatttgaagaccaataattattctataaaaaaaacacctacatatagacattggccaacgttagtattttacgatactagtctatatataccaaaaaaaattaagttctagatattaccctttttctttttggaactttgatttgagaaaacccacaatgcagagacaaatatatgttcacaaccaatatattagaatttctttaacaagttttagtaactatgtatgtagataaaaattgaatctgcatttctagggattgaaccaaaccgatcaaaccgttatttaccctcccaaatgatgcataactattttaagtgaagcgcgtgtggtggtgtgaaggaaaggaaccatgaaccatctaaaatgtgatgacgtggcaaaagctcgtggtgaaattgaatgaaaagctggactagataacgaccggtgtgagtgagagagagagagagagaattcgatccatcattatacaaaaccttcttcgctttttatttgatttatttatccttttctcatttgattttctcgggaaaatctctctgcgtagtagatccaagtggtggtttctgagtagtagtaagcaagcaaatctggatgttattgtagtcggtgtgaatctgagttcgaaagatg

SEQ ID NO: 1939 - DNA, 3000 bp, Unknown
  misc_feature (1)..( 3000): cDNA_ID_2148095_gDNA_ID_1620471_Annot_ID_158014 3000 nt of promoter + ATG
cgacggttttagtattacatcgtttattgcgtccttatatatatgtacttcataaaaacacaccacgacacattaagagatggtgaaagtaggctgcgttctggtgtaacttttacacaagtaacgtcttataatatatatgattcgaataaaatgttgagttttggtgaaaatatataatatgtttctgtttttggtttttaatgtttaaattaaattcaaagaaaaaaatatcttttgtacaacaagtgcaacattttgttttaagaaataaagctaaaaatcagtagttgatgaactcaaccactagattcataccaaatttgaaggccttttatggtaatgtctatcaccaatggctcatattgaggacatcctgtaccgttcattaattgatactagaatggcaacaagtagaaaatgtagaaatttgggtatctatactccaaaaatgatttcaaataaccaaaattcaaaagtttggttattcgtactcaaacgaataattgatctcaaatactcgaattgaaagtacaggtgttagaatgtcttacgttaaaagtatgtacattagttttctttattcataatcaattggtttttgagtatatgtttattagcattcgagtaaccaaaagaatacgtatatatttcgattgggtacgggtatacgaacgccaaaagtttaaatgcataccgctaaatatttaggaacttattagaaggcaatgtgcccatccctagaccctagttgatacttgttaacatggttagggaaatgttcttatacagtgggataagttttgctatgcttatgtgagtaagctaggcaataggcatgagcgaaaaaaaaaaaaaaagttaggcatgaccggctccaacaaaactttgactctgactctgactgttctaaaatttgaaataggcccatttaaaacacaatatcccttagcaagattaggtatatgaatatttgggtctattaacagtgggccagatgattgaagcccatttaaatcacaacatcccctagcaagagcttcttcaacgaccaaacaaacttgtgtcttcctcgtctcactgcctccaccgccgccggcgaaatcaatcgtgtctttctctaattacagtagtcaacaatggtgaaccaaaggagaagacttgcgcagaagcgatacaaggaagctaatccagagctgtttccaaaagcagaaccaacgccaccaaaggaccctaataagaagaagaagaagaaaagcttgttcaagaaaaagaaacctggatcttccactgatagacctcagagaacaggctcttccacaagacatcctcttcgagttcctggtatgaaacctggagaaggctgttttatatgtcattccaaaacccatattgctaagctttgtcctgaaaaatctgagtgggagagaaacaaggtttgttcttttcttctttaatcattggttttgggattagggttttagttcaatttagttttagatttagtagggttttggcagctcttgttagaatcagttgagggtttaatctttatgaactcaaagatgaaatttttcatgaaatgttggtactttgatgatcactagacttgttggttactagaaaatgaatgtttttggttttgttgtttgtagatatgcttgcaatgtaggaggagagggcatagtcttaaaaactgccctgaaaagaacaatgagagctccgagaagaagctctgttacaattgtggagatactggtcattcactttcccattgtccttaccctatggaagatggtaatttttctcttctctggatccggaatatttatcttttctcatattacaagatttcaggaaacctagcatcgaaatttgtatttttttttacctctgtacacagatatttgacttatgatctgaagtgtagttcatgttatttagagagtttaacattatattctctgaaaacgtatttgaggctatactgtcacttgtttgtttgtttgttaagagtagtcactaagattagatttggttgctgtattgattcttttgtaggagggaccaaatttgcaagttgtttcatatgcaagggacaagggcacataagcaagaactgtcccgaaaacaagcatggaatctacccaatggtacaatgctcaaatcttgtttcgagccttttcttttcctcatagaagatgagttttgatatgttgaacaatggatttggtgggccttcttttgcagggcgggtgttgtaaagtgtgcgggagtgtggcgcatctcgtcaaagactgtcctgataaattcaaccaagagtcagcccaaccaaagaagacttcaagtaacattttcttttgtctcactcttccaattcttgagcttctaattatgtgatcctagtcaagtagtttctctttcaagtgattcggaacagtgaatgcgatctcatttatcttataaagaccataattgtatctccctgactgaaatgacaggatttgatgctacaccaagaggaaagctcactaagtttagtggggacgatcttgaagacgatttcactgaagagcccaaaagcagcaagaagatcaatacctctgatgattcagctcagaatagtgtcgaggtgaagaaaaagaaacaaggtccaaagattgtcaatttcgttggatgatcacaagaggatcgaaaagggtcatcaattttgtaggatatatcaaaagttttgttttctaatctcccttttagtcttgtgtaagaacaaaaaaatcctagttattcagaacaatgctatgtaatggaaccacacagccaattctgtttcagataatcttctaaaccgaacaaaacccacctagaaccaaattaattataacatatagtctgtttgtgaataaaccaaaagttgtgcttctcctcctcaacctcagtcgccgatcttcaacagtggctgaaacttgagagagagagagagaggaagagagcgacactatg

SEQ ID NO: 1940 - DNA, 3000 bp, Unknown
  misc_feature (1)..( 3000): cDNA_ID_2105598_gDNA_ID_1620471_Annot_ID_158007 3000 nt of promoter + ATG
catcaagagccattgaacactcctgtgtctctgctttcagcaacagaggacgtgactaggacgtttgctcctggtggtgaagatgactatctcggtggtcaacggaaagtcaacgtcgagacgccaaaacgtttggaggaagatccggctgctccaggaggaggatcggattatctcagtggtgtatctaattatcagtccaaagttactgatcccacgcataaaggtaatgactttggccgagactttttttagggtttatgaatctgtaataactcttgtctgttctgtttaaggtggagaagctggagtaccagagattgctgagtctcttggtagaatgaaagtgactgatgagtctcctgatcagaaatcaagacaaggacgcgaagaagactttccgacgagaagccatgagtttgatctgaagaaggaatctgatatcaacaagaattctccggcaagatttggaggggaatcaaaagctgggatggaggaagattttccgacaagaggtgatgtgaaagtagagagtggattgggaagagacttaccgacgggaactcatgatcagttctcaccagaactatctcgtcccaaagagagagatgattctgaggaaaccaaagatgagtcgacacatgagacaaaaccaagcacctacacagagcagttagcttcagctacatcagccataactaacaaagctatagccgcaaagaacgtcgttgcctcaaagctaggttacaccggagagaatggcggcgggcaaagcgagagccctgtaaaagatgaaactccgagatctgttactgcttacgggcagaaagtggcgggaactgttgctgagaagttgactccggtttacgaaaaagtcaaagaaacaggatcaacggtgatgacaaagctacctctctccggaggtggaagtggagtgaaggagacgcaacaaggggaagagaaaggtgtgacggctaaaaattatatatcagagaagctgaaacctggagaagaggacaaagctttatcggaaatgatagctgagaaacttcattttggaggaggaggagagaagaagacaacggctacaaaggaggtggaagtgacggttgagaagataccttccgaccagatagcggaggggaaaggacatggtgaggcggttgcagaggaaggaaaaggtggagaaggaatggtggggaaagttaaaggagcggtcacttcttggctcggtggtaaaccgaagtcgccacggtccgttgaagagtctccacaatcacttggcaccaccgttggtaaaactccctcgtccttgtgttacacgtaatgttaagattttgatgtgtgtattatttttgtaattttactcaaaatgttttggttgctatggtagggactatggggttttcggattccggtggaagtgagttgggaggcagtggcggaggtaagggagttcaagattctgggaactgaagatttggggttttgcttttgaatgtttgtgtttttgtatgatgcctctgtttgtgaactttgatgtattttatctttgtgtgaaaaagagattgggttaataaaatatttgcttttttggataagaaactcttttagcggcccattaataaaggttacaaatgcaaaatcatgttagcgtcagatatttaattattcgaagatgattgtgatagatttaaaattatcctagtcaaaaagaaagagtaggttgagcagaaacagtgacatctgttgtttgtaccatacaaattagtttagattattggttaacatgttaaatggctatgcatgtgacatttagaccttatcggaattaatttgtagaattattaattaagatgttgattagttcaaacaaaaattttatattaaaaaatgtaaacgaatattttgtatgttcagtgaaagtaaaacaaattaaattaacaagaaacttatagaagaaaatttttactatttaagagaaagaaaaaaatctatcatttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaa

SEQ ID NO: 1941 - DNA, 3000 bp, Unknown
  misc_feature (1)..( 3000): cDNA_ID_2148081_gDNA_ID_1620471_Annot_ID_158010 3000 nt of promoter + ATG
atgcattattacctaaagatatggtcaagaacaaatatctccacagttcgtctaccccactcatttaaacatatctcataagcttccttgttgatatcttcttcatccttgtcctcctagatttgcatccaagcaaaaaaaacaaaatttatcaatacaagtaactttctagtggaaaagtgcataagataaacaataacgcggataatggaattaagccgaccttaatacggttttgaagagctttatcatctttcggaggcaatggctctggagcagccctctctaggagtgcagccctctctaggagtaacaacacatcatcatcaactaatacgaacatatctctgtccactttaacaaacggagctggcaattccttgtcatctaacagttttgggctagctttcttgttcttagtttggacttcaagatccttcaacccattatacaagcaatccatcgctataggtgatgtaacaacattttccatgaaaaagtgttttacaaatccttttaggattacgtccattttctctctagacatctcacgcctagagtttttgtccattcctaaccagaaaacaccgaagctgcaaccaagaatgcaaatttataatggtctctagagacatggttggaagacaatatattaatctaacatggcatggtttcctcaaaagaagaggtaactacatttatggaatctggaggagttaagggtacaagttgaaatgtgaaataccttgtccatttggccttgtcctctatcaacttctcaagcttgcttcttctctcctccacaaagcgtaggaaaatttgctctatatttcgaaaatacaccctaacaatttctgtcttgtaaccataatcaaggaagaaaggtcggtccaccctgtctctgcaaggaccaattatatggccgaggaaatgaaaaaatataacatatgaacatgtggagatgtaacttgtaagtatatggtagcatggaaaaatggaccgtgcatgtggtaatattttgctcatagagtcggtcttgcattacctgatcacctgaactttagtttcaattgtaagacagccagaatcatctatgaagccatcccgtaacttcggtaactccataaactttttccatccccaatcatgttctttcttccaaaaccggtgcagcgtatctacaagatcatgaattcagttgtctggatatcgaaatggaagcaagcaattaaagattcgaaaaatcacctgaaaacttagacttctttggatctttatgcatcacagatatagtaaactgagccaactgactccagcctggtgtccaagatagcaaaagaatatatatcactaagtatccagagaaagaaaacaaggaccaagcagaccagtggaaaaaaatacaaacctggaagaagttcatcatggtttgcaacacagagaaataatgagagatgattgctaacatcacatccttctggatacattaaaatatgcctgacacattgaagataaaagtaacaacacaaagccttcaaaaccatttccagagtttttttgagacaaaaattaaagatgagaaagatatgcatgccatgtaccaactgtagcctccaatttcaaaaacactgctagcgaactcccttttgctgatttgtgaaaatttcttaatcttccatgtattttttccatataactcagagggtttaagacctgagaaaaataagaaatttcacattaaattagctgaaaaagagaagtatattactaaaacacaaaaacaaacaaacgggtatagtatctattaacatatctcgaaaaccttaatcatttgtggacgggatagtggggacgtttttgacgatattcataaaaaaaatcatattgctaaaacacataccatactcatcatccacatcagtctttgccattctaaaggatgattttttcgtcaaagctctcttttcttcaactacgaacaaaaaaaaaactaacgattagagcaaataaaattagattattgaattctgtaattccccctaagatgcacaattctattataaatttatcgtaaaataatattatatgatttgaaaagttctaaagagtaagactagctgaaaaatcaattgatttgatcaaaaactgaaaaatgaacaaagaacaagcacataggtttggattatattcaacaatctgactccctcaaaactgtatcgaattcatagcttaaatcgaaaccctaagaacccccatcagatcatggatgggcaataaaccctaaattccaatcttaaaataaataaatagattgttaaaaaatcaaagaaggaccagaagttcatttctattatgaaatcaacgatcggaaaatcataaccactctctcgtatttaaaaacaaaattaaagaagaagaagaagatagagattaaccatagaaactttgattctgagtgtagagactctaaaaatccatctctctattcttacatataagatgattgtgatcgataataacgatgaagtgtatcctaaaagatattttgtttacctaataaaatatatgattctttacctaaatagatgattcattttttggtatgagagtagattttgttttccactatgagaaaggggtaacgatttttatgtaacaaccccaaatatattatagggaaaatatcttgtctatttgtttattaagcttatatttttttccgcaattaataaaaacaagtagggacccacaaaatcaacctaaaaatatgaaagtaacgaaaccatcgcttatgtggtggggtctctccaagcaaaatcgcatgaaactttttaattgtatcgtcgtctcacgaatcgtagaggagcgtctctaactacaccaacaaacacatttacatttttccaatcctcaaaaaatttctgaatctttacgcaaccaaaactattctctatcaattttcaccatcttcttttttgttcatcgatccaaatcaagaaa

SEQ ID NO: 1942 - DNA, 3000 bp, Unknown
  misc_feature (1)..( 3000): cDNA_ID_2148087_gDNA_ID_1620471_Annot_ID_158012 3000 nt of promoter + ATG
ttagtaagccaatggaacctgatcgccttttcgaatgtcttccgagtaatcttcgaccatcatcagaaggtgaaggtggtggtggaaagactcatgatccccatcacaagagcttagaaaacgctatttttactgtcccaactgtcattcctccaagggttctgcctctgcttcatgacttagctcaacaaatggttcaagctggtcatcagcaacaacttttcaaatcttacaggtccaacttctcagttttctttcaagtagaacctctatagtcacacatattagttttgtaatccatatacgttttcgaactttattagggatactcgagctgcggtgttggaacagagtttgaggaaattaggagtggagaggcttagcaaagatgatgttcagagaatgcaatgggaggtattagaggccaagattgggaattggatacattacatgagaatatccgtaaaaaactctctcccacaaaacaagaataccttactagatcgctactgtttccttcgtttacacggcacttgcttttgttgccttgagacaggtgaaactgttattcgccgcggaaaagaaaatctgcgaccaaattcttgatggtgttgagtctctcagagatcaatgttttggtgaggtcactgtaaatagtgtagctgtgctgcttagtttcggggaggctattgctaaaagcaagagatcacctgaaaaactgtttgttctgttagatatgtatgaaataatgagagagcttcagcctgaggtaacgtttaatgtctcacaccgtcaaagaaactatgtgtattagctagcccctctaattgtctttcatttatagattgagttgctctttggaagcaaaccatgtgctgagatgaaagaatccgcgctgaatctgacaaagcggttagctcagacagctcaagaaacttttgctgattttgaagaagcggttgaaaaggatgctacgaaaaccgcggttatggatggaaccgttcatccacttactagctacgttataaattatgtcaagttcttgttcgagtaagtaactttacttagaccaacggacattgtcatttttgttggactaatcagtggtttttgggatatggaaacagttaccaaacgacgttgaggctactttttcaagagtttgatagtaaagatcctgatagcgagcttggagctgtaacaacgaggatcatgcacgctttacagaataatctggatggtaaatcgaagcagtacaaagatgtagcattaactcaacttttcctaatgaacaatgttcactatatagtgagatctgttaggaggtttggttctgtttcttcggctccatctttcttaaacagaaccagaaaagcctaaacataatcctgagttagagttacatttttcacaggtcagaagcaaaagatttattaggtgatgattgggttcaaatacatcgaagaattgtacaacaacatgcaaatcagtacaagagagtttcttgggcaaaggtttactcaatcgttttaggtttatactttaaaaatgctttaaaatgtattttctgattagtcttttcttctgcagattttgcagtgtctcacggttcagtcgagtgggagcggtccgatagaaaactcaaatatatcaagagcatcagtaaaagacagattcaagactttcaattctcagtttgaagagcttcaccaaagacaatgccaatggacagttccggacagcgagttgcgtgaatctcttagacttgctgttgcggaagttcttttacctgctttcagatcgtttcttaaacgttttgggtaagatcaaaaacacttttaaacagattttgtttcgcgcttgtcaagaaagagttaaaagttttgtttctttggttgtgttgtgtatcaggccgatgatagagagtggtaagaacccccagaagtatataaggtttagtcctgaagatcttgagagaatgcttaacgagttctttgaaggcaagacatggagtgagccaaagagataaatatgtattcatctttgtttttccattttgttgtacattctcttcttctttgtttttgcaacattactctttaatatttataagttcttttgtatttctccttttcttgaaggttttttttttctcctttcagttttatttttcttctaactgtaaagttgatgaagctgtcatgttttttctaagctgtaaaagtaaattggctaatatccatatatactatttcaatgatgattcagcgttttgcattttatcattgtatatatcatatatatatatatatatatatatatatgtaagtttaagtctacacgtatacatgttatgcatgcagtagagaatgttaaatcttctttagagtataatctcgttcaagttgtataacatgctaagtcaaattacttttaatataatgttttctgtttataaacagtagacgtcgcatatgatttgtgtcaacaaaaaattatagtctggaaagtggaaacttaagaagaattcaaacgagaaaaaggtcatcaaggacttaagaagaattcaaacgagaaaaggtcatcaaggacattagacatgatttaacataatgccaattagctttatatatgttctagagttgacatattctgtaaaacaaaattgcaaacatgtagtagtgtttatatatatatatatatatatatatatatatatatatatatatatatatcattattcattaattaatgagttcgttattcgtacatgttgtaactaaatctatacatagttaggttcctaaatgagtttctattcgttgtagaaagtgtgactactattcttttagattatagttttgttcaaatggcattaaagaaataataacatgctaagtcaatgtcgtgtaaatagtgtcaaatgaggaaaaagtaatgatgactttgatgaacgttatataaccaaactagtccttaccagatcacacatatcacaaa

SEQ ID NO: 1943 - DNA, 3000 bp, Unknown
  misc_feature (1)..( 3000): cDNA_ID_3065266_gDNA_ID_1620471_Annot_ID_158005 3000 nt of promoter + ATG
aagctttcctttagatatgctgagtaacttaagtttatcttctgataaattctctgattcatccttcacaagagttaaatagctcttcacaaattccccaacaagagcctgaatattttctgaagggcgcacactgtgaagtatcatttcctctgtcttcgggtttgggtgcataccaccagatctacatgaagccttcgagtcaatagacatacatttatggttggtagtcttagcagcttcgactctagactcgagattatcttcaatcacagccttcttcggatccatgaaaaaggttaagtcatcaaaagcagacattgatttgaacaacagcgtagccttcttagcattatcatccactgcacaatcccttgctcctgttttttggaaagggttttccaataacccatgcgaagtattaacaggagcatgctcatcaaggttagatataccatagaaaggttcagtgcatttctctacaagtggctcgcagaaagcatcttcagagaaaatgaaatcataaacccatttgtctccttctgaagcttcccagttataatcaatgttgaatgtaactatttcttcaaacggataatcacaatggttgtggtttctttcctcaagaaggttccacggcaagtatatgtcatttgaggcagacaaggattgaggcttgatctttgacaaaacatcctcataaatgagctccagagatcttgtcatctcataatcatgtaaaataggagtaggcaaagacttgaaggcatcatctgtgaaggcaagttcggaactgacaactaattcatcgaaatccttgaagttcatctctttactgaacataccgtaacagatttctggttcaatggctttttgaagacaaaggaagatatcaaaaacatcagagatatccacatccaggatctggaattcctcataagttactggtacagccacctttccctgaaattcctcagcatttgatatttccaggatagtcactatatccatttcagaaaattcatcctctggtaccacatcagattggccactcttgttcaaatagcaatccgtagagagtacatccaatagatcataatcctttgagcctataagctccttagaattgataatgagagaactccctgcattagtgtcttggggttcaatcgtctcaagaacagtaaatactttatcaagcacagataagcttgatagttcgctcaagtttacttcatccacttctagaaggggaaatctggcatctttgaaccatggttgaatcttgcggaagcattcattttctgctacagaagtgttgttctctgtaaagtaatcagaaggaatgtaatcaacagaataaatctgctcttgaatgtcctttgagttctgcaggataatatctgacccctcatatttaacctgcaataagaagactagctaaaatcagatgatgccaagaacaggaaccagctctaccactctacagcaaaagcaaaaactactgttgtgtgtgccaactaaaatcaactcagggatttaccgggtcatttttgatctctagaacttcagagaaacattggagatgatcctcactcgtgcataagagcttgttctcctgtatatcaaaagatgctttatctcgcaatgaaaaagaaaaagctgaactagttcaattagtacaatgcttacacagcttgagcaataccatctcaaaatccaactctggagtctccaactcaataattttaggtgtagctttatccgcaatggcatctccgtcatccttctgcaaatagatcataacttcggttttcaaactccggtaagattcgcttaagctaccaaaatttccaacccaagtatgaatataagatctaagcaacaatcagaaatggaaactgagaaaacacaccacaaatttcgaaaaatctacaaccaatctcactataagaaacaaaggaccgttgacagaaacagtcagcgagactcaggaaattcgaaatttcacctccaggaactgataatatctagatcgaaggaactttacctcgtctgagtaataaactccgagcgaagagtcgtcgatttcaaaaactcgatagtccacactgacgcggtcgggaaccacgtcggaaaggaacttcgacaaagcagcttcaataggcaaatttccgatagggatactaacattttcgatcgagccaaatcggagacggtcttcttctccgttgtagacgatgggtgccgggaaattatcaggagccggaagattgaggaagcctagggtttcaaatacgtgagaaggtggagtagagaagtaatcgatgttgagaaatcgagttcgcatcgtaattttctagatccgtcttgggagctcagactgtatcagtgatgatgatgatgatgaagaagagaacgaattttgaaattggcggttttgaatttttaagaaattaaaaaatatcccccgtcgatttcaagagggagatggagataccaaagcaactctcgccacttgtcgtcttttaattttaattgagtacgttatgccgttttaaatgttcaaaacagcacacagttgatagctgaattgattttttcttttgccgttttgttatatttaaacaacacacagtgcatttgccaaataactacatgatgggccaataaacgtggaccgactaaaactaaataatagaagatacatcgataggcttctctaaagatcggataaaagataatgtcgcatagccacgtagagagcaactggctgagacgtggcaggacgaaacggacgcatcgtacgtgtcagaatcctacagaagtaaagagacagaagccagagagaggtggttcggccatatgtcatcgttctctctataaactttatggaactttgttctgattttctcagagacacgaaaagaaagaaaacaacactagaacaaagagggtttgattgattcacttgaaaaagagaaaacacagctttggaaa

SEQ ID NO: 1944 - DNA, 3000 bp, Unknown
  misc_feature (1)..( 3000): cDNA_ID_1712019_gDNA_ID_1620472_Annot_ID_158034 3000 nt of promoter + ATG
aaaacaggaaacatctaatcaatcaaagtagtttcacattttattccacagaaattacgacaaaaaagtagagagtgaagagtcttacggctaatattgctctcccagatgcagaaaagcgctcaccagcgatatcaatctcgactgtagtttcagcagcaactgctggctgggaaacacatgctaggtaatggcggacaactagctcatatacattctgaaatagtggaaaagaatgttggctccaacgtagaaacatatacctatgctcgggtatgttaaaccaaactgacagccatacttacaaggtgatctctgctccagttagactctccgctagaaaactttgttgggtgaatgggtgggtgagccttgtcatcatgaccaccattagcagggtttctccagaggcccccctcaggttctaataatctttgtgcatatgatccccatgcaggatgtcttgtttgttcctccaccatagcctacacacaactagagatcctaagagactatcaaaggaaatgataaagtccaaactaaccttactggctcatgagaaaaaagttacttacacgtaaatctgtcctgctcgaaaaagaatcggtctccgtacgaggatagctgatgaaaccagcctgatataattcttctgccacctgtccagacatttttgatgtcatttaacaaaagagagatgtaattgtaattcaaagacatatcagcctatacgacagcataaaactctaccaagagagaacagaatttagattatgttgaacatgcaatcctaataggccaaagaatcatagaaagtatcttaaccaatctaaatactcattcagaccttcatggtgtgctctgaactcagacggaaatatcttgaagcacgtttttcaagttcaatcgtgttcaaaggataaggaggatacttgaatcgttcccttggatgtgggacattcattacctggatggagattataaagtaaatacacaatgttaactagagatggagtgtcagatgatataattccgtctgataagatgtttcttttttactcacagtggcagtaggttcctcaacgcacatctcatataatatgacagctgaagcataatcgaagagatgaccacgcctgcaatagaaattatatcaatgtaactttcaagaagattgggaacaacaataaggaaggcagttgaaaatcgtacatccaattaaaggtggcaaggccttcttctgattggtgagaacagttgattgtccaaaactcttctggttcatgtgcctggatctcccagtatcgctcgacaataaagccaagtgtaggaaacttcagttgaagcagagaaatatcaaatctagctacattaactggctctgatatgtaaaatgggacagattgttctgaaacttatcgatactggtttcacattacctgacacggaccataacttataacacgactcctctcctcacccgtagagtcaatagcaaacctatctctcagcagcatagtctgaaatctagtgaaagaagcaccaatgcgtaggtctatttcctaaagttttcgaaaaaaacattagctaatacaaattcggtaggaaatactgctaacacataaacagaagagggatttcaggagaaactcacttgtctagcatctacagcctcagcaaacaattgattaggatctctaagattctgaactgcttcatgaatatccctagcaattacatcattggaatcagttcaatcgtttgaaatagagtgcttagtagaagatatatgaggaataacgtgtaaagcaatctctacctgtcaattaacgcagagaaatgagccctgcgtataaaaagattatgcttgacagctctgcaaacatctacaacttcaaatgcaatgttttcaccttccctatcacaatcaagccacagcacaagccagtcgcttttccttgcctcctcctccaatgtcttcttaatatcctttttgtcctaattcactcaacaccagaattaaataaaacttgcaagtcagaaaaccccaacttcattataaaggcgaatcaaagatcctagtcccgttttatacagttgcaattaccaaaacaaatcagacccaatcaacaattcctagttagagaagcaatgactaaatcaacaacccagaactatacaaaagcatacaagtacaatgggacattaaatcaattaggcgtgcacacacatacaatagaattacctcgggaacgtgtttcatgaccggagcttggtacagatctgccgggtcgcaggagtgccatttgcggtaacgatcggcgaactcaagctccatcaggtggccgatgacggaggtcattagcatacgacacggctgcccattgatggcgtaatcgaactcgaagattttgttgtaccgagacctaccctcccgagtccggaaagttccacgggatagaatccccgccactgacttcgccacggacggcttctccgccacgttcaacactgtcacggggccaccgcctcgtcgcgacatcgccggtaaagaaaaccctaacggttagtaattacgtttttttgttttcagtaggcgaattttcccgctcttatgatatagcctagctactattggtggtgtcactgagacactgaccgaacagttgtggaaatttgtgcctttaatgggcttcaataattcggttaaagttgatctcacaattgaaattgaatcaaaaccggactcggatccggttagcttcttatgatatatgactatatgataagtatgtttaaatcgtatagaatatagatcttgagcttaatgagattaattcaatttctttagaacacttgcaaaataaataaataaaacaaaataatatttttcctttatgcactatagagttagtccgataggataagggcccaagaaggcctcattgataatttacaatcgagagagagagcgataaagtcaactcgttgactaaaatg

SEQ ID NO: 1945 - DNA, 3000 bp, Unknown
  misc_feature (1)..( 3000): cDNA_ID_2148185_gDNA_ID_1620472_Annot_ID_158045 3000 nt of promoter + ATG
aattgtcaactgatatgagtattttcgaattaggatgtgaaaatctgagattttttatttatgaaaaaatatgaaatggggatctagctagacgtgactgaaatcttcgatcttgttatctcttcggtttcaatgtttataggaattgggtttttgttttgtattttagtcagattataacaagtgaaattgatttgctttttttccaggaagtgaggaaatctctgttggtaactgacgtttggaacaaatcagatgatagtcctgttactgttgctgattatggttagtagtaaaattgtgtatcactcagaaaaatgatatctttctctgttatactctttagatttcgatatctttattggctcattaatgaaacaaagtcatgttgttttaggttcgcaggcggtggttagccttgtactggaaagggaactccagaatgaacctgtgtctttagtggctgaagaggtgccaaacatatacaaaataatacattgctggtttttcttgattgaactaagatggattttgtttatgactttgtaatttatgtgtaggattctggtgagttaaggaagattgctgctgagaccgttttggctcgtattacagagcttgtcaaagatactcttgcaagtgatgaatcatatgctattgcttctcctttgacttcggatgatgtgctcaacgctatagatcgtggtaaatcagaaggaggtcctaagggtcgccactggatcttggatcctattggtggcactagagggtgagttctcatatgttgttgatatttcactaagcacaaacttatagttagttacttttggatttgttttgcaacttcatctcgtttcattgttcaacgcctgtgtcagagactaatcaatctcagagtattgttgcattattgaactgtcgtcatagatttgttttgcaacttcatctcgtttcattgttcaacgcctgtgtcagagactaatcaatctcagagtattgttgcattattgaactgtcgtcatagatttgttttgcaacttcatctcgtttcattgttcaatgcctgtgtcagagacttatcaatctcagtagtattgttgcattattgaactgtcgtcatagagcatcggaacttaaatttaactataacctgcgaatttccattttgtagatttataagaggagaacaatatgcaataggattagcattgttggtggaaggcaaagtagtactaggtgtaatggcttgtcctaagcttccattggcatcaactgctggtaatgcactcaagtctttacctgaaaaagttggttgccttttctatggttcggttggcaatgggacttatgtccagtctctcagtgtcgactctcttcctgcgaaggtaaactacttgaaaccactctgtttccatgcatttactatcaaatcttttcatatattgctaaagaaatgatcaaatgcgctattaggtggaggttagcagcatagatgatcctgcgaaagcgagtttcttcgagtcataccacacacctgtccccatccataacaccattgctacggtaaaacatcttcctcacattctctatacgtatcttcttgcttactctaaattttactctgtttccgcggtgacagaaattggggataaaagaatctccaatcaagatcaacagccagactaagtatgcagctttatctagaggagatggagaggtttacttgaggtttactcgcaaagcaagacccgaatcaatatggaatcacgctgctggctcaatcattgtttcaggtaaacccatttagctcttacctacatagcttttggtctattatagttcatgaatgatcacacaacaaatccttgtatgaaactttcagaagcaggagggaaagtgactgatgcagcagggaatccattggacttttcgaaagggaagtatcttgattacaagagaggaatcgtcgttacgacgcagaaactgttgccaaggcttttaacagcagtaagagaatcaattaaagaagaagaagaggaagaagaaaaagctgcttctctaaaacttcactaacacgcaactgtaatatacttattattgttgtctttgggtatactctgttgtctctgtgtttttcacagtctatttattgaaaaccagaaacaaaaaaaaaactcacctttgatatatataagaaacactaattctcttttgaatatagtttttgatgttacgaagctcgtttaaaatgtattttaaatagtttatgtctgtaatctgagatacgttaatcaattttgaaagtttttaggaaggttggtaaaactagggaaaaaaacaaaaaacgtacgtagctagtgcctagtgattgctatggggataattaaactcgacaatagaaaaaagacagtgcctttttctggcatatatgaaacagacaaatgagaaggacctttcttaataagaaagacaaagaaaatttcttaattatgaaatagattactccagtcgaatcttctgcgaagtttcttgtgaaataattaaaacataatgtagtataaagaaagattagtgtattgattaggttaaaataagcccaatttgtttttttttgtttttttttggtaaacattttttttttctaagtatgttaaccatttctgatcagtcactctcgtcaagtcgtcttctaacgaatataattaaattatgacaaccgatgcaaaaaaatccgtgaaatattctacagaataataatccatattctttggtctacatattctatccatcctcttctttttttagcgtcaacttgttgtgtataattacgtgaaagatggtttgcaccaactccgtctcacacgatacactcggttatattatatcattcaacgatgttgactacgtcctgacttagagtacggctataaattgtttcaatatataaaaccattattagatagaataagcttttacatagtctattcttgaagcttttca

SEQ ID NO: 1946 - DNA, 3000 bp, Unknown
  misc_feature (1)..( 3000): cDNA_ID_3065281_gDNA_ID_1620472_Annot_ID_158043 3000 nt of promoter + ATG
tatctccttgtttcggcaggctaagaattacatatgaactacaactcgagatttatgctttacaattcttctgcttggactgtacaatgttctacagaagtataaacatgaagctcaagtgcttaaccatataatttgtctcatctctaagaatttttccgagtcaagtgtacagccttatccttgttgttattggttgtctgcatagtgggcatgttgtgataacaactccgcattccttgcatgtctttatttgaaataaaaagtatcggagatgtcacaaaatcgatctagaagcagtacagttcatagaacaagtaagagtataattgttcctttgaaattttcacataccgtgtgaccgcagctaaaagccatgtcctttggattcgtcaagcaaatcgggcatacctttttgaaaaacaaaaggaatgtaaatctcagtatcagagaaactgagtatactcattgacaaaagaacagaaacaaaggcagaaataatagagtatttaccggcactgtggaaggagcgagtctgtcacttttctctgcagtttctgtcatctgatttggcaccgatctaacagcattgtcacgctctataacctctggtggtggcgggagtggcttgtggtgctgatgggaactgcgcactggttttctactgttcataagcacaatcaaaggttggtttagttggcaaagaatctaatgcaataagaccataaacagtgagtgatacaagtagtttccaacggtaaattttttattgcatttacttgagacttaatgtagccttgtattgaaaagggatctccatgagagctgcgagtgcgaaagcagcctccttcttagccgcatctttgtgctctgacattatcttcgtgaagtttacaaactgtggaacaaaacacagtttttcatgattcatgtttcaggaacaaaacagagctattcagggttttattatattacctggaagttatcgaattcacggtgaggaatattgtcatcgaattgtttcattgtgtcccatggtccatctcctactccaaccaagactatcgacaatgggtaatggctggaaaatttatatcaaacatcattagtatacatatgaagtctgatcatgaatatgagcttattgaatagttttacctcgctgccattatcgagttcatagtagcttcttcctgtggactaagtcgaccaagcggcacatctggatttcttgtgacctgaccatctgcgataatgacgagaacatggtattgcatattgttctgctcaactatgttgatggcagcatcaataaccggtgcaaacgaggtaggacctgtgagggaagaatacactgattaatctttacgataagagagaacaaaactgctccatttttgaaagttcaaaaataccggacaacttcaaatgtgggacaatctctctatatcttttaactgcgttttccaatccgtcgcagcttttgttctcgggataaaagctgaatacatattgatctcgcgttgttactgcaggaagaagaaaacataaaaccattaagaactttggtttatcttattcattcatcttgaaagcaagaaataagaaactaaccatcgccaaaaccgaaacaaggtataagatcatcttcatcaaagggagacaaagtacgaccaataatcgatattgctttctcatatggattctgtcttttaccaatggcatgaaggctttttctattgaatgaatatctccctgcaatgaaaattcagaacattaaccaaaaccattgaatcttttcgtaaacatgtgtagcattttttatcaaatcaaataattacctgtccactcattgctcttggtaaagtcaattcctagaatcagatttgaagattcaagtccagcttctctcagagaagttatcacctaaaaagcaaagttcacaagaaattcatcactatgaaagagactaaaatcaagaaataactaagtaagtttatgagacctgatccaaactgctgaaatgatcagcaatatacgaaggttgctgattacgtttattgctcatgttcattgaaaaaaccctgcagcacaagaaccttcagaaatccaatctttggagaagaaaccaatcaaaatcaagaataaaagatacagttacacaagtggcaagtatatatcaacctggagtttgttgaaaacacaaaagacttctcggaatctttcttgtaagaaaaaacttttgttggagattatcttctgtaggaagattaaattattaaaaagatggcacaaaagagaaatatgaacatataaaaatactttagcagaaaaaaatgaacatataaaactatagaaagtgggttttgttgaatcttgaaagttagtggaacgtgaccctttgcttgcgccggcaaataatcaaaacgtattttgctctctcacacgccatcatcaatctagaaatcttttttagtcttgtctctgcgtcattaatgatttatccataacccaaaatcatagaccaaatttcaacatgattcatgtggacaacgtggcaaagctgtagctcttgtctgaagaaaattatttgggcttttgattccctcaaaatatattaacccagaaccgtttttattgggcttcttcattcatcaagaagcctttttgtatcttcaccacctataaattcacttatgtttcaaccacaacatccacgtgcgattagcccaaaactcaacaaccaatctacgaagatcactaaagttttttatttttatgattttcaccgtttgtacttgttctttcaattggtgccacatggacccctaaaccaacagagcaaatatggcctttcttgatctaaaataaagtttagggtttaagttcagagaataaataagtacactggtgtaaatgggaaattcaaaaaagtaataataattgtctctgcaatcagaaaatgtgaagacatatatttatcttcttgaaaagcgaatg

SEQ ID NO: 1947 - DNA, 3000 bp, Unknown
  misc_feature (1)..( 3000): cDNA_ID_2148196_gDNA_ID_1620472_Annot_ID_158048 3000 nt of promoter + ATG
ccaaaagaataaggacgatcaaggccagtgatacactccctctgagtatatgactttttccaccaaacatcttagagataacatcaactctctcaacaaagaaagctccttgctatgttgttaagttcaagatcctaagaaagaccagtcagatagtgtaacaaaatcttgtcagtcgttgaatcattcaaagacaaaagaaaaaggtttcctctttgttttaacaatcaaaatcccaaattctagcaattgaattttgtatagttttaaggatggtttcttcttcaatccgaattcatccaaatcagaaaacataaccaaatcaggaaatttgattaaacccatggataataaacagaattatatccttaaacccaaaatcaaatatctaactaataaggttctccacaaaatcgagctcgaagatgattgaaatcatttaccggaaacgattgatgatgattggatcttcaacgagcaaggatagtgaagtgtagatctggagagcaagcaaattacgaatccccctccgaatttggatctctcacatgttcgttggtcaataaacaatattcattgtacgagtgactcatcaaattcaacgttgatgtttttttttcttttcttgtgtttggcttcttgaatttttcggcgcaataaagtggtggtaataatttgggtgattcatgttcttttcgctttaactttgttcccataaaaaaaagatactataactgatgcgttaatttctggatggtataattagttaataaataaataaataaaagttctatctcttcttcttttacaataaaacaatctgaatggaaagaatggttcaataccataccaatcaaacaacctgttcaatcttcaaacgaatagttaaaaaattgaaataaaatattattcatcatttaaaaaaaaaaaaatcatcataaacaaattacttatttaaatgcatcaaactaatcattttgttaatatatcacttattcatgtttacattttcaaaacatgatttcactataatttttttatccatattaatatctaatacacgtattcaaaatataacttaaaacatgaaagaagaacaataaccaacaaaatctagtttatatatatatatattatttagcattgaataaaaatctacttaacattacttttattaaaaagtattaactttttgtatattcagataacatatgaatatgtgtgtatttagtagttgacaaatgaaaacgatgtgtgtctttttagtattactatattctccaagacgtgttaagaaaaatagatgaaataagcaaagacgtggacattgggtctgtgtgatttaacaaaactatagagtctcgattgttactaatcgaaaatatttggtctctctaagtaaaataaatgacctttacatcgttggagtgaaattgaagggatctatatccctacatcttatttggtccttcaatattttactttaatcgttttcatgccaaaataataatatctctcatccaaaaaaggaaacaaattgtattgtatctaatcatcgaattaattattaccttcaaaacatcataattaagacgtataaatatggcgaaactgtatcttttagaaacgtcaaaactttaaaaacgcaagacatgtatcattttcacctttcttttgttgttaatttaattttgggacattatggtaatcgacaaagaggtgacaaaaagattagttctatgaataatcaattataaaacaaaatttaagctagagtaattatcaaaacaaaaaaagcaaagaaagagtaaagtttaaaaagtgttatattttattttttttgcttttagctaaaatcatgccgtagtaaccacttctcaacaacttgatttaatttattcatatcatgatgatataaaattccaattagtaaattataaagtcttaagcaattgactaaactagtcttttgtccaactaaaataatctaaaaatgattttaataagattttcgaccactactaaattcacggctactccgtacttctctcattctctctgcttattgatgaagcatctaaaataagcaaaatttattaatatgtcttttgatcactaataaagattttgttgttgtcatgtgtgtgtaaaatcaaaatcgtaaagatcagaatcaatattctcttgccacatatatcctttatatatacacctttctctcccgcatcttcaacatatatccagtgccattgcaattttctcgagaaagtgacggaaaatggctccgcagctgcaaaattgagattcggattctcccttctttcgtcactctcattcattctcgcctgtatcaggtccgccttgtgcacattcctctctattttttccttgtgtgatttttttttttgtttagcgttggatgatctctaggatgtagaacaatggtgattcttccgagatctgttacagatctacagtttttttcatagttattgtgttgatagatttcttgtttttgttcttgaggttttttgttgaacggcgttgtttgttccttgattatcttaacttgaaattctatagtttcgtctgcttgatcctttgtgtttgctctaggatgtgaaattccatgttgtgagtgtaacttttagtagtgattttgaaattttatgtggccgtgacaaagccactcgaagatttcgtttctcggcggtatctgggttatactttaatggcgagggtttaagcagatctgctgacattagccttttgtttcgatctgtgttacaattaccaatttgatctcgttagagaaaatcgagctgatatatgcatgcatagatcttcaagaaatttgatagttttcttaactacacttgccttgctgtgtctttggatatgatgatactgattttattgctcgcctaacatctgtttccttgttactctatccgtgtaggcgtacacgcgttgttatcatctgttgcttatatttgaacc

SEQ ID NO: 1948 - DNA, 3000 bp, Unknown
  misc_feature (1)..( 3000): cDNA_ID_2148192_gDNA_ID_1620472_Annot_ID_158047 3000 nt of promoter + ATG
tcactgtagagcaataatttgatgagggcctcctgttatctatcctagtgtaccttggttgcgccatggttcaaatataagcaacagatgataacaacgcgtgtacgcctacacggatagagtaacaaggaaacagatgttaggcgagcaataaaatcagtatcatcatatccaaagacacagcaaggcaagtgtagttaagaaaactatcaaatttcttgaagatctatgcatgcatatatcagctcgattttctctaacgagatcaaattggtaattgtaacacagatcgaaacaaaaggctaatgtcagcagatctgcttaaaccctcgccattaaagtataacccagataccgccgagaaacgaaatcttcgagtggctttgtcacggccacataaaatttcaaaatcactactaaaagttacactcacaacatggaatttcacatcctagagcaaacacaaaggatcaagcagacgaaactatagaatttcaagttaagataatcaaggaacaaacaacgccgttcaacaaaaaacctcaagaacaaaaacaagaaatctatcaacacaataactatgaaaaaaactgtagatctgtaacagatctcggaagaatcaccattgttctacatcctagagatcatccaacgctaaacaaaaaaaaaaatcacacaaggaaaaaatagagaggaatgtgcacaaggcggacctgatacaggcgagaatgaatgagagtgacgaaagaagggagaatccgaatctcaattttgcagctgcggagccattttccgtcactttctcgagaaaattgcaatggcactggatatatgttgaagatgcgggagagaaaggtgtatatataaaggatatatgtggcaagagaatattgattctgatctttacgattttgattttacacacacatgacaacaacaaaatctttattagtgatcaaaagacatattaataaattttgcttattttagatgcttcatcaataagcagagagaatgagagaagtacggagtagccgtgaatttagtagtggtcgaaaatcttattaaaatcatttttagattattttagttggacaaaagactagtttagtcaattgcttaagactttataatttactaattggaattttatatcatcatgatatgaataaattaaatcaagttgttgagaagtggttactacggcatgattttagctaaaagcaaaaaaaataaaatataacactttttaaactttactctttctttgctttttttgttttgataattactctagcttaaattttgttttataattgattattcatagaactaatctttttgtcacctctttgtcgattaccataatgtcccaaaattaaattaacaacaaaagaaaggtgaaaatgatacatgtcttgcgtttttaaagttttgacgtttctaaaagatacagtttcgccatatttatacgtcttaattatgatgttttgaaggtaataattaattcgatgattagatacaatacaatttgtttccttttttggatgagagatattattattttggcatgaaaacgattaaagtaaaatattgaaggaccaaataagatgtagggatatagatcccttcaatttcactccaacgatgtaaaggtcatttattttacttagagagaccaaatattttcgattagtaacaatcgagactctatagttttgttaaatcacacagacccaatgtccacgtctttgcttatttcatctatttttcttaacacgtcttggagaatatagtaatactaaaaagacacacatcgttttcatttgtcaactactaaatacacacatattcatatgttatctgaatatacaaaaagttaatactttttaataaaagtaatgttaagtagatttttattcaatgctaaataatatatatatatataaactagattttgttggttattgttcttctttcatgttttaagttatattttgaatacgtgtattagatattaatatggataaaaaaattatagtgaaatcatgttttgaaaatgtaaacatgaataagtgatatattaacaaaatgattagtttgatgcatttaaataagtaatttgtttatgatgatttttttttttttaaatgatgaataatattttatttcaattttttaactattcgtttgaagattgaacaggttgtttgattggtatggtattgaaccattctttccattcagattgttttattgtaaaagaagaagagatagaacttttatttatttatttattaactaattataccatccagaaattaacgcatcagttatagtatcttttttttatgggaacaaagttaaagcgaaaagaacatgaatcacccaaattattaccaccactttattgcgccgaaaaattcaagaagccaaacacaagaaaagaaaaaaaaacatcaacgttgaatttgatgagtcactcgtacaatgaatattgtttattgaccaacgaacatgtgagagatccaaattcggagggggattcgtaatttgcttgctctccagatctacacttcactatccttgctcgttgaagatccaatcatcatcaatcgtttccggtaaatgatttcaatcatcttcgagctcgattttgtggagaaccttattagttagatatttgattttgggtttaaggatataattctgtttattatccatgggtttaatcaaatttcctgatttggttatgttttctgatttggatgaattcggattgaagaagaaaccatccttaaaactatacaaaattcaattgctagaatttgggattttgattgttaaaacaaagaggaaacctttttcttttgtctttgaatgattcaacgactgacaagattttgttacactatctgactggtctttcttaggatcttgaacttaacaacatagcaaggagctttctttgttgagagagttgatgttatctctaagatg

SEQ ID NO: 1949 - DNA, 3000 bp, Unknown
  misc_feature (1)..( 3000): cDNA_ID_2148188_gDNA_ID_1620472_Annot_ID_158046 3000 nt of promoter + ATG
tatgttatctgaatatacaaaaagttaatactttttaataaaagtaatgttaagtagatttttattcaatgctaaataatatatatatatataaactagattttgttggttattgttcttctttcatgttttaagttatattttgaatacgtgtattagatattaatatggataaaaaaattatagtgaaatcatgttttgaaaatgtaaacatgaataagtgatatattaacaaaatgattagtttgatgcatttaaataagtaatttgtttatgatgatttttttttttttaaatgatgaataatattttatttcaattttttaactattcgtttgaagattgaacaggttgtttgattggtatggtattgaaccattctttccattcagattgttttattgtaaaagaagaagagatagaacttttatttatttatttattaactaattataccatccagaaattaacgcatcagttatagtatcttttttttatgggaacaaagttaaagcgaaaagaacatgaatcacccaaattattaccaccactttattgcgccgaaaaattcaagaagccaaacacaagaaaagaaaaaaaaacatcaacgttgaatttgatgagtcactcgtacaatgaatattgtttattgaccaacgaacatgtgagagatccaaattcggagggggattcgtaatttgcttgctctccagatctacacttcactatccttgctcgttgaagatccaatcatcatcaatcgtttccggtaaatgatttcaatcatcttcgagctcgattttgtggagaaccttattagttagatatttgattttgggtttaaggatataattctgtttattatccatgggtttaatcaaatttcctgatttggttatgttttctgatttggatgaattcggattgaagaagaaaccatccttaaaactatacaaaattcaattgctagaatttgggattttgattgttaaaacaaagaggaaacctttttcttttgtctttgaatgattcaacgactgacaagattttgttacactatctgactggtctttcttaggatcttgaacttaacaacatagcaaggagctttctttgttgagagagttgatgttatctctaagatgtttggtggaaaaagtcatatactcagagggagtgtatcactggccttgatcgtccttattcttttggtcattatactcctggtttctgaggaaaacccgcttcgtgattctctctttgaagtaaaacgtcagttttcatcttcttcttcttcttcttcttcaggtatttatatgcgcttcacagcttttagtattcatttttttggttataatggtcgaaacttttgaactcttgttatcttcagaatttcattgtctgtttttctgatacattttggtttcctattattcagtttgtaactttgcaaagggaaaatgggttgaagaccggaagagaccattgtattctggttttgaatgtaaacaatggttatcatccatgtggtcatgtagaataatgggcagacccgatttctcatttgagggttaccgttggcagccagaaggttgcaacatgccacagtttgacagattcactttcttgacaaggtatgtaagtttttctccaatgacacattcttcttatacatggtccttctctgtatattggattttatgagaatatgtggtagcagagcaagtttctgaaaatatctcaaatttgcttactgccactttgcttttgttttttagaatgcagaacaagacgatagcatttataggagactcattggggcggcaacagtttcaatccctaatgtgtatggccagtggtggtgaagatagcccagaggttcaaaacgtgggatgggagtacggtttggtgaaagccaaaggagctctccgtcctgatggttgggcttatcggttcccaaccacaaacacgacgatcttgtattattggtcagctagcttatcagatttggtacccatgaacaatacagatccacctagtcttactgcaatgcatctagatcgtccaccagcattcatgagaaactaccttcaccgtttcgatgtattggttctaaacactggtcaccattggaacagaggtaagattgaaggaaaccattgggtgatgcatgtaaatggaacacaggtcgaaggcgaatatctcaaagatatcagaaacgccaaggattttacaatacacagcgttgcgaagtggctcgatgcacagcttccattgcatccgcggttgaaagctttctttaggacaatttctccgaggcattttaaaaacggagattggaatacaggtggaaactgtaacaacacggttcctttgtctagaggcagcgaaatcacaggggatgatggatcgatcgatgcaacagttgagagtgctgtgaacgggacaaggatcaagattcttgacataactgcactttctgagctaagagacgaagctcatatctcagggtctaaactcaaaccccgaaaaccgaagaaggcaagtaacgtgacctcaactccaacgatcaacgattgcttgcattggtgcttaccagggatcccagatacttggaatgaacttttcattgctcagatttgaagtattcaacatcatcacacacacaaagctagctcaatggattggctctgttgattctttgttatagaaaggtttttttttcagattctttcttgggagaataacaaagtttcagttcttaaaaataggttttagatggtttgtcagtaaatgattcatctgtaacaatcacaatctggtttttaattatacacgagaacattgaaattgaaacaatctttttcttaaccgaaatctggtacgatatcgggacggttaaaaattgataaatggaattggcttttaaagaccggtttacgggagaagaagacttttgtgtcaaaaactcgcgaatgcttgagcttttttcttgacatg

SEQ ID NO: 1950 - DNA, 3000 bp, Unknown
  misc_feature (1)..( 3000): cDNA_ID_2148150_gDNA_ID_1620472_Annot_ID_158036 3000 nt of promoter + ATG
aaattggaattccaccaggctttgatgttaatcacttaggtaaaaaaaattgcagccaatttgttttcttgtttaccaggctttgatttttttaccaggctttgattttaatgtcatcacagccaccgtgccaatttcatcgtgacttcttctaatatgtcctatggtaatgttgtgatcaggttgcgtgggtggctgtgatgacattcttaaacagttgatagacatctgtggaactggatcccgttctcaaggttagtgctttgttgttacgcaatacatatacctttgtattagacatcatacaatctttctttcatcatcttctgtcctaaatgagaatgcaagaactttagtatagtgtcttgcgaatagagaacatttaggctaaaaagaatcaatgatttgttcttgcagcaaggagaactccaggtactgcaccgtcaaacaatatccaaggaagcaacacaagacagagtaatgtctgcatacattgtcagcaacgaggacatgcttccacgaattgtccctcacgggttccagcatctcgaaattctcgtcctactgcaacaaatccgagaaacggtactgatccttgtataatagtttagcaaacaaagatcatcgattagcttttgctagtatgtactatatactagtcaaaattcaagcaaattgtccagaccaagtcttccttattgacatgtaatttatattctagtattgttggttataatgcagatgaaagtacagtatcatgtaacacttgtggatcacaatgtgttcttcgtacagccaacacagaagctaacaggggaagacaattcttctcatgtccaacacaaggctgcagtttctttgcgtaagagtctggttttaccccaatttcttcgcataatccatttttttttccttttacatcactcaacacatcagttttttgtttgcactgcttgtaaacagatgggaagatagcataaacaacagtagtgggaatgcaacaacagggtctaatagcggcgggagcggtagacgtggcagccgtggtcgtggccgtggaggtagaggcggccaaagcagtggaggacgacgcggctctggaacaagctttgtctctgcaactggagagccagtgagtggtataaggtgcttctcatgtggcgatccttcacattttgctaacgcttgtcctaatcgtaataactctaacggtaactatttctaagtctacttactacgaactttgactatgtatgtagcatgattaattagtgctactaacttaatttgggtttttgtattttattttattttattttatgaccactttttctctggaattcatcctaatttgcgtagatcactgttagctggatattttaaatataatatttcacgtgctattctgaatcactgaatagtttccacctattttatttataaatcttgaatagtcgtttttaatttttagttatgttcttagtgagctaatgtggatccatatttcatcattttttttgtattgtctcataattcataattcatacatcaactatatcactatgtatatgccattgatcttgagtctagacatggtcaagtaatagatattaacaaaatgcttaagctacaaagtttagtcctccgaatttgtttttagagatggtcaagtaatagatattaacaactgttaataacacaaaccacagtcgttttgctctgtaagaaaacgacacaacaaccggaataaacgccgttttgttgtttaaaaacggcacaccaattttcagtccattttgaacataaaagatttaaaattctcaaatcgaaattgagataacagaggatccggcgagcttctccggcgtaggattcgggtcattttcttcggcaactatgaaagggaaaaaaagagagagagaggtgattactgattaggccgtctcctgtggaacaagaacgcgtttcttcttacattcctcatcgaaggagttgttgtagccacttgaggtacttttcatactaatcttggaatttgtatagcttggttcggtatattgaacagtcaattaggtatcttgctgtgaatgatcaagtgggtacttatcattgcctcttcttagtagtctcattacaagactgaagtttggtctcaaaattgacaagcttctcgaagcatttgtccttggactataacttatagtcgagcttgttgtcccttctccagttgttatcttggttgtcgtctgtatatagaagattaaaacaactgttttgcttggagtataattgatactttacaatagaataataatgcacgaaattgaggtcgtgagagaatgaggaaagccaagttctcatgccatgtcggccatctctatcttgttgatttgagtacttagagtctattatagcttcaaagttacaaaaaggaccatcatttttaagccttgtagttctcactttgactaattcatggcttactttatttgttgcttcaaagacaaaacgaatattgagtttcttttttacttgaaataaacaaaagcaaagctgataggcttctgaaactaatattaaaagacaggccagtactaatagaagacttttttaatgaacaaatttcaaacttcaaagctttcaatgatcaaaaaactaatcatagcttgaccatttcctttttatattgttttcctggaaagaagaaaaaaaggtctgcacctcttctattctctctttttcctttcctgaaaccagtttcaaaggttgttttcttgcctagaattttcatagctatgtgtcttggatccagatccatagtttagtagggcctgtattcttctttcaaatatgcttgttatgctacatgatttgagtttttttggatggttttatggtatgtagtctttaagagatgtacaaagtgaggtttttgcagacatgattacatcttgtttgatgtcttctaatgaagatttaagggcttctgtgtatgcatga

SEQ ID NO: 1951 - DNA, 3000 bp, Unknown
  misc_feature (1)..( 3000): cDNA_ID_2148166_gDNA_ID_1620472_Annot_ID_158040 3000 nt of promoter + ATG
ttgcagtagcaacataaagtttactaaatctttcactgagtcctccaggatttaacaactgtaatagaacttacttttgcaagcaaggtgccaaaaaacagatgaagaagaagtaatgcatatataataatgaagaggcaaaaacaataccctccaagctagtaagacctctctttctgtttcaaaagacatgacatctacgcctacgattggagcacatgacttaagagtcatgacattgcgtacaaatgggtgatcctctccctgaagagtaacaaggttcgctatctagaaaagcaatgagaatgttgtttcaagaagaatgcaaacaaaggtaacaaaaaggtatatcaaaaaatgacaaaaacagctaacctggattacaggatcatgcttagcttccggaaaatgtcctttacgacctgcacactcaatatcgaaacttagtacacggaatggagccatttttgagtattcaccttctgcagcatgactgattagatctgagtacctaaaacccatgttaaagaaagcactggcataaaatacaatatgttactataagcatattattgttccagaaaagaaattccgatgaggatacaggcaatggaactccaattggcagtatgacaaagttcttgcatttttcttatacttcccagtaggtacttcaatccaatttcctccgacaatatcacaatcaaccatgaaacggagaacgaaaagaatattgctttcatatgtctggaagctcttcatacccaatccatcaatttgtaggcctctatcaaggatgcctaccaatttaataattacaatgactttaaatcagtaaaggataagagatagtagacacatagcgcacaaatatttgggaagtcataccgcgacagcttgccaccatagtcggcaatgcaactgtaatcttcagaaaagtttgggatttttgctgttggtaatacataatgcttcttttctgcaccatttctatacgtttaacaaatttcgggaccttggcatttttattggattccctcatccttccctgaatgaatcagctgagctttaaaacaaaaccagcgagatcaaagtacaaaatatacagagatctacatagtaaatacctcaagactctgatggaaattagaaatatcgtctggccccattccaggagggcaagcaatgtaaaagtatggctcaaatccatgaacaaagcaacacacactgttacctgacaatataccagaaactcaaatccaacgaaatcgttccccacaaagagcaaaagaaaaagaggtttaaaaacactcaccttctctggtaaccccaaacatcctaatgattggagcttgccctgaggaacccggtaacagctccttatgactctccgcgattatagagtcaatctccaattgttggaaaactaaacaaatcaaaatacacaaatccaagtgttgagaaattttccagcaatcataagatgaagaagcccttatcaaactaagatagtactcaactgatactctgtgaattcgagagatacgcgggggagagcggaggtcgagcccaagccgaggaacgcgattcacgctcctcaatgtcacggaggattagggattcctcatcttcgtcgccgtacaagagagtttcgtccagaaacacgtcctcttccatcataaattcatcatctagggttccgatggccggagatggtgttgaatcaccagtggctcgatgcttacccgccggtggtggggtattcgaaggaggcggtcgctttttggaaataccggatctattcatggctttgggtgagcgggaaaagaagagaatgtgtgtgattttgtgagctcgtggaggtctgagagaagtagaaagtgagactatacaccactccgattcccgccagttttaagggttttgctattagagatttgatgtcaatgtgaagttttttaaggaacttttctttaagtccctagacaatgctattattaaccaaatcgttacggactttttcttattgtggttgcaattattttgaattaaaatatattttgtcggatgaccaatgtttaagacttttaagtgcttatacgaagttttgattgctaaaaaaaacgaataattgtagatcaaaagagacaaccttataatagagttcgatcgtgatacacatagaatcgttcattgttcatttgatctacaattataagagaattcgacctctctttaattattttatttttagtatatcaggattcatgaccaagacaattaggcaagtgatggtacacttggtagctaactagctaaggttgatgccgcatttcataatggaacttggtttatgttggaagcagaactcgaacatgtcgagcatcttcaaatcaatagagtctccaaactcttgcagcaaattttgttgtactgtatatggaaggagccaagtatttaccaaggtagtaagtaatgaaccctccacgtccacgagctcacaatttcacacattctcttccttttcccgatcatccaaagccatgaatagagccggaaattccaaaaagcgaccgcctccatcaaaccgtcattttttggttccatcatgagatattgaacaaattattacttgtattatctgaaatgacttgtaatatctgaaatgacttgtaaaaaaagtgtaccacatcggatgttcttgttactaaacaattcagaccaacgcaaaaaatattatactattatatctgaccaaaaaggaaataaaatcatattttgttgtattgtaggttaaatgtgagagagagagagagagagagagcgcacaagagccatttgtctcggaactgagaaatcttcaaaattcaaaaaagccaaggaaggcgggattccaaacattctcttcatcatcttcttcttcttctcactcttctctccatttatcacaatcgatcatcgggaaacacaaactcatctccagaaaacggtgtagcaatg

SEQ ID NO: 1952 - DNA, 3000 bp, Unknown
  misc_feature (1)..( 3000): cDNA_ID_3065284_gDNA_ID_1620472_Annot_ID_158041 3000 nt of promoter + ATG
caaattaaagaaagtcgctcttactccctagtcatttgtgaaagtcccacggtagctaattctttcatccagtgaggcagcaaggtttttggggccactaccagagcacgcttgatcaatttggagtggaataaaccagcaagaaaactacaaatctgcaatgcgaatcaaccaaaatcaaagatacattattgataacgaaaagaaaagtgcaggttgcagatttccgtacctgcatagttttacctaaacccatatcatctccaagtattccacctttcccttgggtatgcaatgaccaaagccaattcaacccttccctctgatgtggatataacattgttgcaatctttccaggcaatgtgtaagacaaattgaggccagttaaagtgatagacccttcatcttccaacgatctctcatcataaccatgtcttttggcgttataagaccgagctggcttattaattttcatttcagccgcctttttcccggacaaaatgagacagtcatcatcatcatcatcctcgtctaagtctcttagcttggcagcattagaccttccgactgttcttatcttctcacttacctctatgtgcctggtcgtcttcatactttggtcgacttccttgcattggctcttcccacggtcaagattgtatccctgcctattatcttcagagttatcgtcaaagtgccgaccagaatatgagttttgctttccaacattcgaaattctttcttcccattcccttgaaaattccttactagtttgctcttcccggatggcaaaaccagatttgccttgcttgtccttgatactattaacgccagcattatatgtggtaaccacatctggtgaggacttagatagatccgatagcaaggaaaatgaggatttggcatcctcaaaatcaaatttatcaacctggctcttcactccacatgcatcaaaatcattgctttggctatccttcttcttctgaatcgacattgtcccaagcttagaggtcaaatcatccaaaatacccatgatctcgttccttcctccatcaccttgcatttcctctttttgcttcaactgaggtgagggcgaacaaaagtctgtgattatcgaaaagttaggctcgccagccagctcagtgttagcttcctttgattcatcccaagatgtgaatttgttcccaattccagcgctgtctagtgatgtctctcctttaactgattagagcatcatgcaaaaacaaacgtattcaagtaaagttatctgacaaaacgcagtataataacagctataaagaccgaaaatcaaacaccagactagaaactcagatttcgaagaaaccctaatttcaaagtaagctactaggacaaaattgaaatacatcatcaacggaaacaccaatttctttctgtaaactaagagacatgggtttgcgaaaaccctaaaatcgggtgaaatctcaaaattacctggggaatagaaatcaaccaaatcaggatcgtcatatccatcagcttcgtcttcctttggcaaggccttgcaaagacgacgtcgtccagcaagcttaatcatggacttcttcgtctcttcatcttctccatctgaagtccccaaatataataaataaaactcaaaatcaaagacagatacgaatccgaaaccatagagaaacgatagaagagaacaatcgtacgagaagaagagggaggctgtctaggaggcgcagaaagatcctggaggatactgtagtgacgatcgttcaagctccgaggttttcttctatggctggccgtattttccgccattgctacaccgttttctggagatgagtttgtgtttcccgatgatcgattgtgataaatggagagaagagtgagaagaagaagaagatgatgaagagaatgtttggaatcccgccttccttggcttttttgaattttgaagatttctcagttccgagacaaatggctcttgtgcgctctctctctctctctctctctcacatttaacctacaatacaacaaaatatgattttatttcctttttggtcagatataatagtataatattttttgcgttggtctgaattgtttagtaacaagaacatccgatgtggtacactttttttacaagtcatttcagatattacaagtcatttcagataatacaagtaataatttgttcaatatctcatgatggaaccaaaaaatgacggtttgatggaggcggtcgctttttggaatttccggctctattcatggctttggatgatcgggaaaaggaagagaatgtgtgaaattgtgagctcgtggacgtggagggttcattacttactaccttggtaaatacttggctccttccatatacagtacaacaaaatttgctgcaagagtttggagactctattgatttgaagatgctcgacatgttcgagttctgcttccaacataaaccaagttccattatgaaatgcggcatcaaccttagctagttagctaccaagtgtaccatcacttgcctaattgtcttggtcatgaatcctgatatactaaaaataaaataattaaagagaggtcgaattctcttataattgtagatcaaatgaacaatgaacgattctatgtgtatcacgatcgaactctattataaggttgtctcttttgatctacaattattcgttttttttagcaatcaaaacttcgtataagcacttaaaagtcttaaacattggtcatccgacaaaatatattttaattcaaaataattgcaaccacaataagaaaaagtccgtaacgatttggttaataatagcattgtctagggacttaaagaaaagttccttaaaaaacttcacattgacatcaaatctctaatagcaaaacccttaaaactggcgggaatcggagtggtgtatagtctcactttctacttctctcagacctccacgagctcacaaaatcacacacattctcttcttttcccgctcacccaaagcc

SEQ ID NO: 1953 - DNA, 3000 bp, Unknown
  misc_feature (1)..( 3000): cDNA_ID_2148174_gDNA_ID_1620472_Annot_ID_158042 3000 nt of promoter + ATG
atttctttttcgaaaatggaagaaattctcactggtgaaattcggtgaaagaaaatgaaacaacagttacagagaaacaaagaacgtacgagagaaaaaaacaaatcagagagctgaagctttctcttgctcagctatggagtcacgaactgctttcaaaagcagaggcattagcttctcgttagcaacgataatgcctgtgtccaaatcaagatacttccctttcgagaaatccagtggctttcctgctgcatctgtcactattccacccgcctctgcaccaaaaagaagaatcaaccttgcattccttatctatttacatccgcatgtcgacactataaaattagcttcatagagagtaagctttaatgttacctgtaacaactatagcaccagcgacatggtcccaaatcttttcgcggtatcctttatgaggaaaccgtaagtatatagctccatctcctcttgataaagctccatactttgcttggctatcaatacggactggtggagctttgacaccgagtttctgtatattacaacatagaacatgatcaaatggatgaggaaaattagttagctattagctggaatcacatggaaggaaagaagcaatttacattggcaatggagctggataagtcatgtagagagtgagctccttcgaatgactcgaagaacgatgcctcttcaggattctcaacactagagacttgcacttttacaggagaagattttgaatctaggagctgcatatatgtccctgaaccaattgtagcaaagaagaggcatccaatttcgtctgacgaagatttgttcttgttgtttcctgctatggatgctaacggcaagtttggacaagcaagcacacctaaaactactttcccttcctcgagcaatcctagtgctactgcgtattgatctcccctcagaaatctaaaatcatgaaaatgctcagtgtcaggaacataacatctgactcaacattctatcaaatttacattttctctgaaataagaagatttgactttaggctagttagttttaaaacgtaccctttagtgccatcaattggatccaagacccagtgtcgaccatttggaccaccttcagatgttccacagtcaatggctctaagtagatcatcagtagacaaagtagagccattaaacgattcctcggtagccaaagtgtcgttcacgagttttgtgatgcgctccagagtatcctgagaaccatccttgcgtagatcgcctgagtcctatatagatcattttagacaatgtgagtccataaacacaaactcaaagataagtaaagtgtgagacatctaacaaggatttattaagcagtttcacctcttcagccaccaatgaaaagggttcagaactgagctctttttctaagactaaactaacaactgcttgtgaacctgaaattcaacacaagacagatcaaattaagtgatttcctaacaatctcagtaacattcaaagagaagagctttttctaatcagggacaggtataacaaactaaccataatcagcaacggtcactggacttttatcagattttgattgcacatctgattgcaacaaagccttttgaactttctgaaacaaacccaaaacacaaagataagattttgatcaaagatttacacgagcttcgtatgtagaggaccattacactatatcactagaatctattcccaattacagatgcaatgcacaataaacacaaaatgttaaacgaaatttggaagatttacaaaatgggtttcttaaagaatcaaactttagaatctatgggtcatgattgaatcgaaaaaaccctaacctgacagagacgagcagcgagtgaagcagctttcttagcagcatcaagctctttctcgtaagccatcgatgaaacaactctgagagtaacaaatgaaggagaagaagacttgcgtccgaatacagaaacgagacggttcgatgaatttctaggtctcgaattcgttcttactgctacaaatgattgaagcggagccttcgctgttcgaaaacaatttatagacatcattcgcttttcaagaagataaatatatgtcttcacattttctgattgcagagacaattattattacttttttgaatttcccatttacaccagtgtacttatttattctctgaacttaaaccctaaactttattttagatcaagaaaggccatatttgctctgttggtttaggggtccatgtggcaccaattgaaagaacaagtacaaacggtgaaaatcataaaaataaaaaactttagtgatcttcgtagattggttgttgagttttgggctaatcgcacgtggatgttgtggttgaaacataagtgaatttataggtggtgaagatacaaaaaggcttcttgatgaatgaagaagcccaataaaaacggttctgggttaatatattttgagggaatcaaaagcccaaataattttcttcagacaagagctacagctttgccacgttgtccacatgaatcatgttgaaatttggtctatgattttgggttatggataaatcattaatgacgcagagacaagactaaaaaagatttctagattgatgatggcgtgtgagagagcaaaatacgttttgattatttgccggcgcaagcaaagggtcacgttccactaactttcaagattcaacaaaacccactttctatagttttatatgttcatttttttctgctaaagtatttttatatgttcatatttctcttttgtgccatctttttaataatttaatcttcctacagaagataatctccaacaaaagttttttcttacaagaaagattccgagaagtcttttgtgttttcaacaaactccaggttgatatatacttgccacttgtgtaactgtatcttttattcttgattttgattggtttcttctccaaagattggatttctgaaggttcttgtgctgcagggttttttcaatgaacatg

SEQ ID NO: 1954 - DNA, 3000 bp, Unknown
  misc_feature (1)..( 3000): cDNA_ID_2148158_gDNA_ID_1620472_Annot_ID_158038 3000 nt of promoter + ATG
ctctcatgctgattgctctcattgtctacctcatgagacgcccagtgagaacagtcgcttcttctgctcaagatggccaaccatcggaaatgtctttggacatatacttccctccaaaggaaggattcacgttccaagatttagttgcagccactgataatttcgacgagagctttgtagttgggagaggagcttgtggaaccgtctacaaagcggttcttccagccgggtacactctagctgtcaagaagctggcatcaaaccatgaaggcggcaacaacaacaatgtggataatagctttagagcagagattctaactcttgggaatatcaggcaccgtaacatcgtcaagctacatggattctgcaatcaccaaggatcaaatctgcttctgtatgagtacatgcccaagggaagccttggagaaatacttcatgatccttcatgcaacttggattggtctaagagatttaaaatcgctttaggtgcggctcagggtctcgcctatttgcaccatgattgcaagccgagaatcttccaccgggacataaaatcaaacaatatactgcttgacgacaagtttgaagctcatgtgggagattttggactagcaaaagtgattgacatgccacattctaaatccatgtctgctattgctggctcctatggctacattgccccaggtaaagtttttgcttttgtttgtgcaattaagtatccaatgagggaactgaaattaaactgttttaacaactttgcagaatatgcatacaccatgaaagtgacagagaagtctgacatctatagctacggggtggttctactggagctgctaaccggaaaagccccggttcagccaatagatcaaggaggagatgtggtgaattgggtgaggagttacataagaagagatgcattgtcctcaggagttcttgatgctcggttaacgctagaagacgagagaattgtctctcatatgctcactgtgttaaagattgcacttctttgcacaagtgtgtctccagtcgcgaggccatcgatgcgacaagttgttctcatgcttattgagtctgagagatcggaaggagaacaagaacatttggatacagaagaattgacacaaacaactaccccatgacacaatacacattcttgttgtatcttcttcttttttcacacgagattattcttctatgtaaccatggcgaataattattgtaaagtctatacgcacgcagctatatcaaaagatataagcagtatctatatctacaagttaccgttaggtttaattaattagtgttaatccaatcattatccatgggacccaaacggtaattaccgttgtctttttagtatgaacaggtaaatagtagtactctctaacattggatattgtttttggtcattggatcatttaatagatcataatttaatactatggaagtatccatgttataatcaacttgatttttcatagtgattaggtctataaattattgttaatttaatgaagacaccaataataatacggtcacttttgctctggaaatcataattagcgtagatcacggttagctggatttgttataaatataatatttcacgtgctattctgaatcgtgcccaccagattatatatctaatctcttctagtttttaattttagctatgtggtagtgagttaatgtggatctgtttttctcaatattaattttgttaaataattagtcctcttagtcttcacttctctagggatatgattttaaatcaaacgaaaagattcgagtcatactaagacttattcgtacgccatgaaagtttgaaaggtctttttttccttttcttcaaactgaaaattcaaaataaaggataggatatgaataatcgagaagttcatctttaagtaaatgtgattaatatcttagttataatatcataatgccaaacattatcttgcgtgtattaacaatatcattatggttagaattgagattcgttaacaatactcgaatcactatgagatctttagcgataggatgatatgtgtattcctaactcgatcatgaactttaatatgtgctagaaacatctaatgtagtttctgttttttctttgtcgttcccaaattccaatgtaaataaggtatctaattacctcataagataattcctagtagtctaatttagaatacttctttaacaaaaaaaacatccaaatatatacttttcacaatttctactgaatgtagtgtgttggtaagttatgtaacaaattattgaggaaaaccatcaaaacaactgtaaattaaaaccacctacaatataagaagaaacattaggtctcatcttttattttgttaaaacattaggtctcttcaccgacggatctatttgtgtcctctacttttagccattctttaagaaaaaagaaatgaaaaaaaatgagggaattggctaccctttattgaaaatgaaacatgcatgatttgttttcgttagagatgagaaatataatgacataataaataagaatccaaagtgaagaagaagttggaaaacaaaaaaaaaaaaaaaagagagaaaaagattcttttgtccattaaaagagaatgaatgataacgatgtccattattattctccgtcctcgtgcttaatttaattatcttcccctctttaattaaaactaattaactattagagaacaataaataattaaatagtatagtaagaatcggatcgtaaggtaaatcaacggctgagattcattcaaaccagaggacacaaaacatctcttctctctctcccactttttctcccggagacagttaacgtgattcgcccttttctctttgcccaagagctatacgacaatacctccaccacaccccacacacacacacgagagacagagagagagagagaggaaatttgctactgagagatacattcagtgagtgtgtgtctgtcaccgtggaggagaaacggaaggaggatag

SEQ ID NO: 1955 - DNA, 658 bp, Unknown
  misc_feature (1)..( 658): cDNA_ID_2148146_gDNA_ID_1620472_Annot_ID_158035 3000 nt of promoter + ATG
ttggcttgatttaagccggtggaaacagagtagttacggaggaagtgagctacggatgagcctccgatcccactcccgacgatacatacggtcgctggagaatcatcctcgacgccgccggtggaatcgccggagcaaggtagaagaaccggcgatagtagagcgaacagaagggagattgctatcgggaaatctttcattttagtcaacgagttgactttatcgctctctctctcgattgtaaattatcaatgaggccttcttgggcccttatcctatcggactaactctatagtgcataaaggaaaaatattattttgttttatttatttattttgcaagtgttctaaagaaattgaattaatctcattaagctcaagatctatattctatacgatttaaacatacttatcatatagtcatatatcataagaagctaaccggatccgagtccggttttgattcaatttcaattgtgagatcaactttaaccgaattattgaagcccattaaaggcacaaatttccacaactgttcggtcagtgtctcagtgacaccaccaatagtagctaggctatatcataagagcgggaaaattcgcctactgaaaacaaaaaaacgtaattactaaccgttagggttttctttaccggcgatg

SEQ ID NO: 1956 - DNA, 175 bp, Unknown
  misc_feature (1)..( 175): cDNA_ID_4359993_gDNA_ID_1620473_Annot_ID_158051 3000 nt of promoter + ATG
gatctttgcatcagacagctttcttgaattgacagagtattcacgcgaggaaatattggggagaaattgtcggtatgtgaaaattcttctttttgtatcttctactcatgagatttatcatgccttttaagttatgcagtcttctccggctgcgtttttgttgtttcgtgatatg

SEQ ID NO: 1957 - DNA, 3000 bp, Unknown
  misc_feature (1)..( 3000): cDNA_ID_3065358_gDNA_ID_1620473_Annot_ID_158058 3000 nt of promoter + ATG
ttctgacgagatatgttgacttctctcgcaggggaaagaccagtgatggctgataatggcgtccaacaggtaatttaattcaatcttcttcttcttcttcttctattttgaattattgtaaaaccaccatcctaggtttaaaatgcgttgttcctttcaccaccagcaggtttctcacgacgatggaaggaacattgtttcttcgtcttatagttcttccgtggttccttctcctgatcccgctccttattataacgttcttcaaacccctaccaatctctatcactacgattgggatatcgcaaattctggtaattttttgtcttcttctctcttctaataaatcaaacaaaatctgtaagtgctcattgcattgttgtgttttctctaggctatgcacaaggcatcaatacttgggatggatatccacgatatgctactactacccctgaagccatgcatgtgccaccggttagtatgacttgccctatttatgttctatcttcctcttgctacttaattaacttagttattctttatcctcaggttgtctacaatgacaattcatctcttatgtaccaatatcctggttatggatttaacccttatccttctgtaatgttggagggacaaattccagtctccccagcttattacccacaaccttttggtgcaccttctgcaatgcattatttaccctcagatattgacccaacatctgctgcttatatgattccttacgggcaatatggtggagggaattattccggaaatcaaggggacatctctttaacatctcatataccttatcctcaaacgatgggtatacttgggccatacgaccataatgcttcacaggttaatactcttccctctttagttttaactattatgggcttatgtacataacctttatttggtttggttcggtaaacatttgcttactaggaataaaactgcataaaagtgccactggttattagtatcactagttttttgtgagtccatctctttagctttgtcgtgcaagataatgaatacatgctgacacactggaagagccatgatattttctcatatatgattgaactttcagttttgttcttccctgtaatggttttggggaatagaggtgtctttggcatacgccttggattcaaatcagttcactgttttattggcttatcacatttctttggcaccttttatcaggtagcgttgcatgggagcggggttgcttcaagctcttctttgggaggttattatcatgtaggatcttaccagaatcctagctctaccccctcatattatggagttgataatcgagtcagattaacccctgacataggtaaaagacgagagaaggatcagggctctatatctagcaccagtgatctgtatggtaatcgaggaccacgggcatcaagcagggtaaagagcaagaacagctccaaaccttgctctactattggtgattcagcaagcgattcaagtacagctggaccaaatcccagtttgtacaaccatccagaatttgtgacagattataagaatgccaaattctttatcgtcaagtcatttagtgaagacaatgtccacagaagtatcaagtacaatgtctgggccagtacaccgcatggcaacaaaaaattagacactgcttatcgggatgctgagaagatgggaggaaagtgtccaatctttctgttcttttcggtatggcttttccactgtccaatctctctgttttctttctgtatggttttttttcgatgtagtagtatatataattcctgggaataaccaaaagcgtaattgataagctgcttcaatgaaacagtaagcttaaccaaagtttaaaatcttgcaggtaaatgctagtggacaattctgtggggtgtcagaaatggttggacctgtagattttgaaaaggatgctggttactggcagcaagacaggtggagtgggcagttcccagtgaaatggcatattgtgaaagatataccgaataaccgattttgtcatattcttttacaaaacaatgacaacaagccggtaacgcacagccgagattctcaggaggtgggcattacttatttttttgtcttatgatcattgattcaatgctctcttggttgcggtgccatagtgatatttgtcttggtgtcactgtgttaggttttatgtggacaagtcttgggcaatttcacattatcatgtatgactaggtgtatatacccagtaatagggaaatccttgcatatgtgtattaggtcaaacgttaatagttggtatagggatttggaagctacttaattatgaggtacttgaaagttatactttatagtctcccagggaattaaagcttgcactttttgcgttgggttttcttgagtgggatattaagcaaaaaatggaacatagaagagtaagtttttgtggtagggagagagatttggaacgcattaattggatgttgcatggatttataactaaattgattgatgaactgtaacaggtgaagctacgccaggggattgagatgcttagaattttcaaagaatacgaggcacacacatcaatccttgatgatttcggctactatgatgagttagaggggcaaaaggtgggagaagatggaacaaggaaaaaagctggggaagaagagacctccgtggagcaattatcagagcgccttcaagctgtcaaagtagaagatgggaaggaggaggaaaaaaaagagttaatagctgattgatacagtaatagtcagtagaaggagacattcttttggtaacaataagcaatggggttctcttttttctatttgggtggggatgtatactagaatggtcgggacaaaaaaaatccaattccttgtaggcttgtaagcaattattgcttttgtagcattgtatcgtaaaacggcaacgtttcgccttttaacaagagactcgggttatataacaaaaaataaatataagtcttcttcttctcca

SEQ ID NO: 1958 - DNA, 3000 bp, Unknown
  misc_feature (1)..( 3000): cDNA_ID_2148624_gDNA_ID_1620473_Annot_ID_158064 3000 nt of promoter + ATG
caatgtttccacctttcagtacaagaggctttgcgtcacttgtatttgtgatgtcagatttctcctgaaacagtaagagaataccacataatcaattcaacatgccaggagtgcatactaaaaagcatgcatttaaagcattatcataaaaaaaaaagtgtttaagaaacttaaccaaatgcagagtttaaagaaacaattataacatcctcacatacctctagcaactggaacattgatttcatgtccacaaggctctgaattgtttcacggtaaacactacccaaaaaatttagaggaagagacagctgaaagagaagtccattcaccataacctgcatcacccaaatatgcaaaagcttattagaaaacaatttggataaaaaatgcagagaaacataaaataccaatgtcaaggaaaaatcaaaggacgcactgaccaaatcaccgactgtcatctggccattcatgataccctgagagcacaacaccattgctgttgataaagctgtactaaatatgatactttgtccaaagtttaagaaagcaagacttctttgagtttgcagggcagcatcttcatattctgggataagcagcagaatcgtcacaagataaattaaggtaaatggacggagcaataatatattatggtaaaatatcaatcggttttcttcctagaaaaagaacgtgtaaataaagatgtaaaaagagtcatcagcgcattttctgatctacatttgttacttgttggcttgttgctactattcttgctcaaactaaaactggagaattttctctttttttttggaaattaagataaatgttttcatctaaacagctagtagagttacttacttttcaggaactggtcatacttttcagcctcataaccttcattgttaaaatatttgacagtctgaaacgaaaaagaaattctgtcaaaactgcaagtcaagcaaaatgattaagattaaaaatttacctcataatttatcagagaatcaatggcccttgtgctagcatcattatcagctttgttcatagcctttctaaacttggttcgccactggataaaataaataaaaccgtgagcaaagcgtttgacaccaaaaagatttgtaacaagataatgaaagttgaagagaatgtatgaagacaactatccttctatacatcatcaaacctaatatcacaactagaatgatttaagccgatccaaagagttgatacagttaagattagagaagcttagtaacgaattccagaacaatgtatactatagtagtttcttaaataaaatatcacagttattgctggattatcatgataataacgcaagtattgcattatagttggcattgaaaagagaataccgaaaaaggcacagtacctgtgtcacagctaatgtgaaaacgatatatgatccaacggagagagaagtaatccaggcaaaagcagctccaaacttgtatgccagtatacctgataccatagatatctgaaagatacatattaattacgtcgagtgtttttagagacgaatgaatagtgaaatccaaatatgaatgagcaactgccaattattcaaaatgagaaaaaaaacaatgatcatgagaaagcaccaagtggtcagacaagctttacctccaatatggtaggaacaacattgaaaaccatagctgagaggataaaatttattgcacggctaccacgatcaataatcctgttcaagccgcctgtttctcgactggacataagcaattaagtaaggaagttatgatgagatgaatctaagatggaatgagcgagactactcacaagagtaagagaggagagatagataccttaggtggtaacgaaggtcaagatcatgtaaatgtgagaacacctgcaaagcgaccatatgaaattgattcatacattaaaatatctctatcgacaagatagtttagagcagcagcagcatacctttctagaaacagatcgtattgttcggagagctaccttagagaacacagcagtacgaagttctgcgatgatgaaaagtaacaaccaagagtgaaaagtgcattcttttttaaagaaaactagagctattgagagttaccattaaaagcagaagaacccgtccgagcaatcccgtatccaatgagaacagcagcaggagtagcaaaaacagtaagaagagttgggtttgtagcagcgaaggtggtaagtgaggctccagtaccggtagctgaagcaagccaatcaacagctaatttgaagaggaaagggacttggacattcaagaccttagcacccacgagaaaacccaaagcagcgatgaccctgaaacggaattctggattgtctctcatccacaaatagccagcaagcgtacggagaatcttcatgtcagccatagctgagtctgaatccgacgaggttgtcttgatttccttagtcttggtggtggtttggtctggattgggagtagaagtcgagaagagacgaccattaagcattgaactccgttgaacaaaacgaattggggatggtgatggtgacggggatggtgagttatctgagaggaaggcattgataaccggagatgttcgaattgagttacgtctgatgtaattggagaaaccattatgaagacgataatcagagcgaagactgtaggaaaaagatgggattttgggttgaggttgaagattaacgcgacagagtaagagcccaggagccctaacgaatcgagatcctctcgacatcccttcttctccgaaagtttcacagactgaattttgctccggcgagctagctaacaatgtcacgacgttcggcggtgcttaatgggcctaataaataaagcccaatacattttaagcccattaatgtctatccctttgtggagtgagtcgtcgtttctccaccattctttcatcatcatcgtcgtcaagcaatgtttattatgagctacttccacaagaagtcattgttagtaaagaaatg

SEQ ID NO: 1959 - DNA, 3000 bp, Unknown
  misc_feature (1)..( 3000): cDNA_ID_2148544_gDNA_ID_1620473_Annot_ID_158067 3000 nt of promoter + ATG
aaatattccacgatcgttggggaaagggggctcaaggtcagtattttgatgttatatctggaatgcatgattgagttatggggagttagtcacccgtcgtttttgtcattgtcataatcaaagtaaaacaagctaagtcaatcaggcttccaagtcaaagttcacctgttgaaaacttgatgaagaatatgatctaataaactagtttcgcaggactgtaacaatcatgaaaaataaaagatttaactgattgaggttttctatataatggcaaagagtagcattgatgagtgaccatcctgagtttgagtagagtcatatattgatggggtttttgtattgtgataaccatggagtggtgttgtgtgcagttgagtggtggagagaaacaaagagtggcacttgctcggacatttttgaaatcccctgcgattctgtaagtaactttgcacagaagcagcattgagtttacttatgtgattatgtacgtgtctagtcctcacatacatagagatggttggtgtacacaggttgtgtgatgaggcaacgagtgcgctggacagcacaacagaggcagagatactgaacgcactcaaggcactagcgagtaacaggacatctatcttcattgcccacaggctgaccactgcgatgcaatgtgacgaggtttgtagtaaatagtgtttgtcaacttagctcaaagaaacaatgtttttgcataactgaaacttttggttgcgggcagatcgtagtactggaaaacgggaaggtggtggaacaaggcccccacgacgagctattgggaaaatcagggagatatgcgcagctatggacacaacaaaacagcagcgtggatatgcttgatgcagctatcaaattggaatagtgaacctcagagccaaatgtgtaaaatttatatttatctcattgattttctatggagcttatatagttaatagagtcccaaagaacacaaaacaaagggaataataaatagtggtgaatgatataattttaacacgagtttttgttgagcaagtaaacttacgataaaaaaatgatcaattttattagttaaagcccaaataggcccaactagttattaattaattaacaagaagaagtccgtgatttcgaaattcaaacgaagcgccatttctttctcctcctaggaaactctgcaatggccatggcctatgaggaagctcgcaagctccgtcttcaagagaatcacaagcgatttcaagttacccttcatcgttaccgcgtttcttcttctcctccttctctgattcgtttatcaattttgattattgaatctcaggatttaggaatttcccagatttctaagactctgactcagattacaaagaaaacgcctcaggtttcgtgttttttccttccatttctgcttcattcctagtccaattttgtagctttaccacaatttcagcttcttcagcagcgtaatcacaaacccatcgataaagccctcttagctactgctgaaccaagacgctcttcccgtgttcgtaccgtaatttcttcctatcgcgatgatgtaattttcccagctttctcttacttctgtaatagatttttcacagcaatcaatcaacccaatcccttgtctcttttcaggtcgtcgtagacactggtcgtacttcgaatctgaggagatcgcgacatagctctacatgggcgacgtaagtgccctgctccacaattttgccctaaaaaactatcctttcatctgatcaattagttaaaattcatcagctacatttctcgacctctccatgagtgcaagtttgcatcttatgaagaaaaggttggagcattcaaggctgcagagaagttccagaggagccttaaatctccacatccttactttgtgaaatctatggttcgctcccatgtttacagttgcttttggctggtacgttcgttcacaacacttgtgtgtgtttcttcttcaaggatttcgtgttagtaccttacttgacctacatgggtttgcttgcaaatttcaaggggcttccttcaagattctgtgcagacaattttcctgaggaaactatggaaatagaactagaggatgaagaaggcgaagtgtatgaagcagtgtacattggtagaagagctggactcagtggtggttggaaaaggtttgctcttgatcataaattggatgatggtgatgctctactctttgaattggttgaaccaaagaagttcaaggtatgtatgtgtcttgaacaagagtcatgtggttggagttagttgacattctcacatgttgattataaaatgtttgcttggtgcagatctatgtgtttaaaggaaatgagaacgctaatcttacaagcgccagaaagagaggcagagcaacgacgccaagtgaagaagaagaagaagaagaagataaggatgttgaagaatcaggtgatgaggaacacagctcaagagccactaagagatcatccgtaaggttactaaggaagaggaaagcataagagagctttcttttgtctacatgccccatatatttttttggtttttgagtgggctgctaatactactaatactaatggcatatttgtaagtttatcaacccaaggtaaactttgtttttttcaatttgaaagtagaactgaaactctgatgagcggctttggttcggaaatttaaattgtttcctctcagttttggttactaggcgatgatgagctatatacttctgatgataccatttagaccaactccgtcacaaaataaacaaattaaaatggagagagtaaacgggctattaaatatcaaaactgggccttactatgacaaaaggcccatttaatctattttccttttatttagatgagtcggctcacaaattaacatttcttttcctctactccaaagatatctcggttcgcaaaagtctatttaatttcatagcaatctcacttttctcttcccccaccctcaaagatctctcaaaga

SEQ ID NO: 1960 - DNA, 3000 bp, Unknown
  misc_feature (1)..( 3000): cDNA_ID_1032303_gDNA_ID_1620473_Annot_ID_158070 3000 nt of promoter + ATG
tgtgccgactcaagcatgtcttgcagactcttgagttttgcatcatcagacttgcttttctcgacttcttttctcatgataccgttttgtttttctgcctcccgaagcctcaggcttgtaattctcagctcttcagacaaagtctcaatgtccagttcttgagttgaagctgccccttcgctctgttcatcatccaacccagatggcaagtatctagcaagctgactctttaaaatatagatttggtcttctgaattctgtaacttctcatttacatctttcagttcttgctcacaagcagcaagttttgccgggaaatcaacaaatttagtctcacttttcaccctcggcaacaagctctcagtgttcccttcaagttgcatcctaagtctttctttggcttcacgtagctcaatctcaagatccatgatcctcttgcttagggactgaaagtcagagcctatactcacataaccagggtaattagtcacagaagaatcatcagattcaagttcagaatcagtaatggaagcagaatcatctccatctttgtgataaagatcagaaggaagtcctccattgccaaggaagtattcaaaaccaggagcacgtcgaccagaaggaggacgacctaacctattaacctcattagaggtccataaagcagagaggtcagaagcagagatgtcagaaagaccagagccctgtgactgaagctctaaaggagagccttttctcaactctccggtgatgttctcgtaccgctctgccaaagcacggtacatacggtgaaactcatccacaagagcaataagctcaggtcttgactggtaatacatctctgccttcttagcaaaagaatctgcatcctcctctatcaacttcaccatccgtttcacgctccggtccatctctgatcataatcatcacacaaaacataaacttggcatattttttatttcctttatgaaaaaagactaaccacctaatttgggaaaccctaagcctaataaggtattttcattacatgaaaacgacataatgtgaatggactcaccatcgagattattctcaagccacttagaatttttgagaccgatatgactatcccaccaccatggatttgatttggtggattctacgcgtttgatactcttcttggaacgaagctggcaaaaaaaaaaaaaaacaagaatcaagaatgagaattcggttgtttttggtatgaagaaagacaaacttttgatggttttggtatgtaccagatcataatccatggctgcaaaaatcaatggaccctatgggaaagctggaaacacacaagagacaatcatgagactattgaaaaaagatgacaaaataatacagattctgtctgtcagacaaataatacaaaaaacgtcggttatttttatttttcgctaatcccaaaaaaaaacgatcggtactgttcacagagaatcatgacaaaacgtatttacacaaaagaggacaaaaaagagaacctgagaagaagaagaagtagaagatatgatgatgaatgatgatggatgagggaagaagatgaaactactttttagaatgaagaaaaaccgtgaaaataaaatatagtcaaatgaatttatacacttacctttaagacagatattgcggaacaagtcttaactagtacctagcaatttcaacgtggccaagtgattaggttgtctctctgtaattaaaatatgtaattaagggactaattccgctgtgtccacgtggtgagagaatcgtattatagagagtcattgacctctccttctccactaatcaaaaccgaccattcacaagattaatggccgtcgtgactatttctctctcgttttaattctgttgccatttgaatacttgaaggctcatgcagtcaaaagatcagatttatacagtcattgaaaacttgaaatggcttttctccttcctaaatgtaatacttttaagggttttggagtaatccacgttattaattagtctcgagaggccaacactttctatcaccttttcaatttgtggcgctccacttctctagctttttcatttcatttcaaatttaatgcatttaaaatgtcattctatatcattaattattgatataaaattacgtatgttgaccaaacaaaatatatatactataactttttataaagagatatctctaagatatatgaagatgatgtaaacacaaagaaaattattctgccaatgtgtaagcgactagattttagattacatttctttttcatgaagttgtcaacacctgattttaatttctttttcaccaaacagacattgttcaacaaatgttattagagctattagactttttgaataaatataattaaaaatctgttttatttcatacacacaaatagagaatattatcttgcaaatctcaatatcttctagttagaatcatataattaaaattaagtagatttgtaactatcaagttttcatattaaaatctatattttatatttaaaaggaaatctatagatgcaacatgtaagagtctttatttcagtttcactgtctattcttcttatgtaatttttgaaaactagaaatctcaataaaaaaaacttatagcgtagaaaataagaagtgtcagtggtgtggactcattagttgaaggagtaaatctcaattcaaaaaaacaaaaaacatgtacggtacatattttcttaagaaattaaaaaaagaagaagacggtatctatcttgatttgggcctcactatagaatatgtgtttgggccttcaaagttgacccagtacacatcaaagactggtaatggcagtcttttagatgtaatctttgtgagttttggacaaagctgccgtttacatcgttcatttaaagaacatgatcatgatcatgaaaacattacagccatacagaaatatcacactaactacaaaagatagtgcaaggaatgtgatgtacgagaagaggattaaagatg

SEQ ID NO: 1961 - DNA, 3000 bp, Unknown
  misc_feature (1)..( 3000): cDNA_ID_3065332_gDNA_ID_1620473_Annot_ID_158072 3000 nt of promoter + ATG
catcacatatattatagaaaatcatatatttatttttattgacccaattgtaaatctaaaaatcgaaagtttgacaaatcttacttgccaatacaagatactcaaaccacaaaaatgaaaaaaaaatcatcaaacgtgtaccacattgaaaacacatggctaaatatgctcaaaagatgcccttgtttattttgtgaaccacaaacacaattgcaaagaggataagagttaagaaagtgtggatactgggaaatgcgatattcaggaaagagttttgtttcttgaggaaactgcacaattttcaattgaaccaattattagtttggtgaacacaagcaatccaaaataaatagattgaggttaacaaaaataaaacgacaaagaaaaggggaaaagtcagaacagaagtggggaacatgacaagaagttgtagagaatagagtgatagtgacatcaccgttgaaaattgttttgtttttgttggcggccagttcctgcagccctcaaggagttcacggttctgtaataaactaataacacgtaacaaatatgcattcaccaataaagtatgtgcatgagagctcccatcatattacttcgctttttatctaaggagggtctgaatgttaacaggcaatatctaaggagggtccgaatgtttgacaggcaatatcatagatcaaaatggttatgcattttttgactactgttttgttctggtttagatgttagttgacacgtggaaaaggagagagggaagcatggtaggaattaggaaatgaagataaggatggaatatatctaaaacaagaaaagccgtataagtttgacactgactgactacagaggttgcagccagaatttttcccacaagcatataattatattctgctcattcatcattatcattcaccacacaacatgggaatggccctttctccaccatgttctccacagttgatatatcacaatacacaaaggtaaataactctacagcattttaaaacatatagcacaagattcacaaaagatgttacctctacccaccgactaagttcctccatttatctttcaaatccacctaccaagttacaacatttacatcactcacacttggcatatatcttgttcaagtaaatggtgagtatgaatgttaataaggaaatgttcacctctgtcctctccgcaaatactgtagggtttccattctttatatctttccatgatttaccatacctgcacaacaacaacaacaaaatgagccagtggtataatcttaatgaggtccaagatgtatcactattgaatattgataatagagtacgggactaggcaaagagtgtttgcatactcttttactccttccctcagagcttccacttcttctggcttccagaatttctttggtctcctgacatgtggtttcgccaatccgcctttctttaatggagatacactcagagttacaggggttggtcgacgaggccgaactctgctagaccatgtttcctgactatccgaacctttctcatttacattatcctgttttcacaattaaaccacaaattcatgaaccaaagaacaagatttttagaaagcatcttgagggaaaattgactaacactcaccgatgcttcgttatggtcttgacagcctgttccagtcctattcacccgagtaggcggaggagtgacatctactgagtgatcaattgcactgttaggttcttccccttgcctagtggaagggtcgatgtgtccttgaatctctactaaatattccttcagctctcgagcagccatttcgtctcccttatcaagacttggctcatgttcctgatcttgtgcactcactgtgtgctcctcgtctgctgcattcacattatcaatcccatcattctccagacattccattccttcaccatcattagcgttgtctctaccaatcccattcccgtcctccctttcaccacgcgcctcgttggcgatatcaatagtatcactcccaaaacgtctcgtgctttcatcaacatcactttgatcccctctgttgtcaacaacatcaccctctacgttcacagccttgcgcttaagaaaccttctttgagctactgattcaagagaggaactcccaagtaatgcccactgttctttgagaagctgagtgagaaaggaaatggcagtgtacctgatgttagtctcacgaattcgctgatagagctcaggatctccaagggccttcttcaaatcactctcccatttcaacaagtcacaagtcaccaaatcgctaccactctccttcaaaatcccaatcctcttcgtccatatcctctcaagcgcatcggtgaacaaaccatccgaagcaaacattggccacataaatctaagcgtacactcagtagccgtccagcaataagcagacttgtgagaatccatgagtagcgaatgttgctgcaagagaagcttctcaagaatctcgagaagatcgagcattccctcatcaatcgtacctcggatcaatgaattggagatgtcacgcaagacggaagatatcttgagctttatgcagtcggaggaatctcctaattttagcgccgaaatcagattaataggggaagccctaggattgtgttgtcgaaggaggaaaaattcagcaacccattgatcaatgacctccattattgaaactttcgcgatcaaagtcgcaacttttttaattctctggtcagcggatgcaatgtcgccggcgaagacgaaaatctccgatcagtgatcaaattcgaacggtttcaggtatattctgttattgggccttaactgggcctaaaagtcaaaagaagataaacggtgaggatgctaaaagagtgacaagtgtcaagagctgagccttatccatagattccccaatcctctttcttactactctgtcgcttggcgcgctctctctccatagttccagttctgaaatctcactttcacagtttgtgtctgtgcgataatg

SEQ ID NO: 1962 - DNA, 3000 bp, Unknown
  misc_feature (1)..( 3000): cDNA_ID_2148369_gDNA_ID_1620473_Annot_ID_158079 3000 nt of promoter + ATG
agacattgtagatgtaggtagttttgaatatattggttatatttctagctaatgaatgcattttgtaacttcatatttacaagagttcaatacaattattccacaagtcctttcgtattcttagtctcatcaacttatcaatatatcatatccttaacacatgctcatgatgaatttggttttacccaaaaaccggtctagttaatctgatccgaaattaatttgatccatccatcaccttaagagaacacatattagaaatcctacactgaaaacagaatgagaccaaggtaatttatcaatggatatggatcaaacccacttaccagcaataggttttgataggaaacccttcaaatttagcatgtaaaactttagatcgaaccactttggattcaaattagatggcacatattctactactttaatatcatgtaaagattcatttgctttcaaatcaaaaccaatgtgtggattgattagttattttattatcacaactttgaattataattactgtcatctatctataacataaactaaaataataatgtacattactatatatgtttattatatagtatatcgcaaatcttgatatggttatggatatatcaagtttaataatgtatgctcaccttaaaacgtatatactcccgacgaataatgaacattagagttttaatttgtataataagatatgcttggtagaaaacaaaaaagggaaatgtgctgaaaaaagggaaatgtaaacatgcatgaatatggtaaaggtggcgtaattaaggagtaaggacccagtaatatagtggatattcgagaaaaacttttctacgtgaacaaaaataacctacgtgtaagttatcctctctataaagccctcatcaagtctctgagtccttcaacgactcataactcatagctatatcttgtcttaaaaagaagaagcaaagagaattagtggagtacgataagcagagaagtatgttaaaggtggtgttgttgatgatgataatgatgttggcgtcacagtccgaggctcagctgaaccgtgacttttacaaggaaagctgtccatcattgttccttgtcgtgagacgagtcgtgaaacgggccgtggccagagagcctcgcatgggtgcttctctccttcgtttgttcttccatgattgttttgtcaatgtaaggcactttttttcaatgcaaaaacgaagcatgctttgtatgttcccatgaattactcctaaaacttagtaaatgctaagcatatgatttgataggggtgtgacggatccttactgttggatgacacaccgtcttttttgggagagaaaacctcaggacccagcaataactctgtgagggggttcgaagtgatcgacaaaatcaagtttaaggttgagaaaatgtgcccgggcatcgtctcatgcgcagacattctagccatcactgctcgggactccgttctcctcgttagcacctctacccttttactctttgtcatgtcttacatagatgcatgtaataattgttgaatggttaagtggcttagtgattcggattcatttattttacctagctagaaccagagttcgaatcttctagtaattaatcaattgtcccttttcaaaacttaaaaagaagggtaaaattgtagtgcaacttgcatctttttccttctgattttcttgtaaatcattgattttctaaatcattctcacatacatctagccaaaatagcataaatctaccattactttacgaattcctaacaagatacttttacattttggtcgattttacagcatatgaacacggaccaatttttgttttttgtttttccctttgttacaaacccttcagccgaccaacatttatctaaatgtttaacacttcttaatatgactaaacagctaggtggaccggggtggagcgtgaaacttggaagaagagactctacgacggcgaacttcgcggccgcgaactccggagtcatccctcctccgatcactacccttagcaacctcataaaccgtttcaaagcacaaggtttgtccacacgtgacatggtcgccctctctggtgctcacaccattggacgagcccaatgtgttacattcagaaaccgaatctacaacgcaagcaatatcgacacctctttcgccatctctaaacggaggaactgtcctgccaccagtggctccggagacaacaagaaagccaatcttgacgtccgctctcccgataggttcgaccacggcttctacaagcaacttctgagcaaaaaaggtttgcttacgtcagaccaagtcctctttaataatggtcctaccgactcgctcgtcatagcttacagccacaatctcaatgccttctaccgcgactttgcaagggcaatgattaagatgggagacatcagccccctcaccggatccaatggtcagatccgccaaaactgtcggaggcccaactgaatgattctcttttatattatcccaagcccattgagctcaataatcacctcttcgtcaactgttttttcatgtgcattccccttcttcgtcaactgttaaaatacatcttcattatataaaaaacaataaacacgtaaaagtttgtgactatgcagttttccattataaattactgtctatattctcttcttatttttttttttttttttttctcttcttactttggctgattgaaagaaataaaacttttaaatttagttgagtagatgatttgttataaactctatgctacgatttttcaaatattagtagataaaatatcattaaaaaaaaaaatggtgagcaaactatcataaaaatatatgatggcaaaatgtgagccgtcggatgaaaagtgaataggcgaatgagaggacaagtgtaaaaagtcataaggtagacaaggacacagaggaacaagtggcctctgctcttctgcctcaattaaaaaattatttttatttttgatgtgcgtggaccgccaatg

SEQ ID NO: 1963 - DNA, 3000 bp, Unknown
  misc_feature (1)..( 3000): cDNA_ID_2148352_gDNA_ID_1620473_Annot_ID_158074 3000 nt of promoter + ATG
gaatttgatcactgatcggagattttcgtcttcgccggcgacattgcatccgctgaccagagaattaaaaaagttgcgactttgatcgcgaaagtttcaataatggaggtcattgatcaatgggttgctgaatttttcctccttcgacaacacaatcctagggcttcccctattaatctgatttcggcgctaaaattaggagattcctccgactgcataaagctcaagatatcttccgtcttgcgtgacatctccaattcattgatccgaggtacgattgatgagggaatgctcgatcttctcgagattcttgagaagcttctcttgcagcaacattcgctactcatggattctcacaagtctgcttattgctggacggctactgagtgtacgcttagatttatgtggccaatgtttgcttcggatggtttgttcaccgatgcgcttgagaggatatggacgaagaggattgggattttgaaggagagtggtagcgatttggtgacttgtgacttgttgaaatgggagagtgatttgaagaaggcccttggagatcctgagctctatcagcgaattcgtgagactaacatcaggtacactgccatttcctttctcactcagcttctcaaagaacagtgggcattacttgggagttcctctcttgaatcagtagctcaaagaaggtttcttaagcgcaaggctgtgaacgtagagggtgatgttgttgacaacagaggggatcaaagtgatgttgatgaaagcacgagacgttttgggagtgatactattgatatcgccaacgaggcgcgtggtgaaagggaggacgggaatgggattggtagagacaacgctaatgatggtgaaggaatggaatgtctggagaatgatgggattgataatgtgaatgcagcagacgaggagcacacagtgagtgcacaagatcaggaacatgagccaagtcttgataagggagacgaaatggctgctcgagagctgaaggaatatttagtagagattcaaggacacatcgacccttccactaggcaaggggaagaacctaacagtgcaattgatcactcagtagatgtcactcctccgcctactcgggtgaataggactggaacaggctgtcaagaccataacgaagcatcggtgagtgttagtcaattttccctcaagatgctttctaaaaatcttgttctttggttcatgaatttgtggtttaattgtgaaaacaggataatgtaaatgagaaaggttcggatagtcaggaaacatggtctagcagagttcggcctcgtcgaccaacccctgtaactctgagtgtatctccattaaagaaaggcggattggcgaaaccacatgtcaggagaccaaagaaattctggaagccagaagaagtggaagctctgagggaaggagtaaaagagtatgcaaacactctttgcctagtcccgtactctattatcaatattcaatagtgatacatcttggacctcattaagattataccactggctcattttgttgttgttgttgtgcaggtatggtaaatcatggaaagatataaagaatggaaaccctacagtatttgcggagaggacagaggtgaacatttccttattaacattcatactcaccatttacttgaacaagatatatgccaagtgtgagtgatgtaaatgttgtaacttggtaggtggatttgaaagataaatggaggaacttagtcggtgggtagaggtaacatcttttgtgaatcttgtgctatatgttttaaaatgctgtagagttatttacctttgtgtattgtgatatatcaactgtggagaacatggtggagaaagggccattcccatgttgtgtggtgaatgataatgatgaatgagcagaatataattatatgcttgtgggaaaaattctggctgcaacctctgtagtcagtcagtgtcaaacttatacggcttttcttgttttagatatattccatccttatcttcatttcctaattcctaccatgcttccctctctccttttccacgtgtcaactaacatctaaaccagaacaaaacagtagtcaaaaaatgcataaccattttgatctatgatattgcctgtcaaacattcggaccctccttagatattgcctgttaacattcagaccctccttagataaaaagcgaagtaatatgatgggagctctcatgcacatactttattggtgaatgcatatttgttacgtgttattagtttattacagaaccgtgaactccttgagggctgcaggaactggccgccaacaaaaacaaaacaattttcaacggtgatgtcactatcactctattctctacaacttcttgtcatgttccccacttctgttctgacttttccccttttctttgtcgttttatttttgttaacctcaatctatttattttggattgcttgtgttcaccaaactaataattggttcaattgaaaattgtgcagtttcctcaagaaacaaaactctttcctgaatatcgcatttcccagtatccacactttcttaactcttatcctctttgcaattgtgtttgtggttcacaaaataaacaagggcatcttttgagcatatttagccatgtgttttcaatgtggtacacgtttgatgatttttttttcatttttgtggtttgagtatcttgtattggcaagtaagatttgtcaaactttcgatttttagatttacaattgggtcaataaaaataaatatatgattttctataatatatgtgatgcaagcaaggttaaggcaaattgtctttattctttttatcccaaatgggtgattgacgccaacgactgttcaacatattttctgctgacgcttctttaatgaagtagcacgaagaagtaaacaggacgacttttggccaccggaaaatttctctgttataaaaacgaaagtctgtgtcctcttaaacatttttgggatcatcaatcggtttttggtcaacc

SEQ ID NO: 1964 - DNA, 3000 bp, Unknown
  misc_feature (1)..( 3000): cDNA_ID_2148381_gDNA_ID_1620473_Annot_ID_158082 3000 nt of promoter + ATG
agacatggcaagcgtacgcttcctttcttttattaacaaaaaaacaatatataaaaaaaaaaaacgaaaagaagacctacgttgacgaagcaatcatggaagaatagtcggaggagggaagcagctatccgacgctctttggccacctctcgctgcaccacccgcctcaccgtagggagcagtgatggacagctgtccgaatagaagtcagtgcgtagttgggcctgtgcctgggatcccaacataacgataaacaacagcacaacgaacgcagctctctgacgactctgctcatagcactccatctttgtgtttttattttatttttgttttacttctgtttttctataggagttacgagggatcaagaagcaatcccgaggctgattgcttttatagaggtttacttccacgtaggtgtttttttatttactgtgccaaaatcctcacgtcacctctacggctctaccagactaccacattattgttcgcgttttccttttctttaagaacatttttgttgtttatcatctatataaaagttaaactctctactctctagtctctagtcctcgtaaagctaagctagttctatcaatagatataacacacgtttttatctgcccatactttattatatgcatgtcaatagccgtatcaacattgctatatacatatatataatatatacgttattaatttaaggtatatgaagcgtacatcgtaaataaaaatggtatctaccgtaatataaagagaagcgacgtccaattttggggcttgtgttatagatcaaattttgatactatatgataagtcgatgactgatgggaacataaaacatctaaattaatatcaatataataccatgatatgtaatagcctaataggtttggctgacgtgtattggttatatgaatccatgataagttgatgatactaatatttaataacataacacattatatgaaataaatgtgttacacttgattttttttttaaaaaatgtgttgcacttttaaatatattcatgcactatctttatataaacgtaaagaattctaaattaagacagacacatctttgaccaaaatattaaagacataataacacattctaaaatatattccagatccttatacagtcttcatgtcagtgagggattccgatcgatctcggtttttgacattggtatcttccaacttcgtttaattatttcccttcaaataatttgtgaacacgaaaggaaatgatcgagagagtgtgggcagagctagtgatgatcgtataattggggaggatgagataggtagaaacagcttacctatcaatgcatgcaaccaccaacgacattctcataaatatcagtctttctcacctttcaatttccactttcatgaagttttatatattttcaaaagaaagcgtacccctaagattagtttgtttatttttcaaataaatcatgttcacaactagtttactcctgcaaattttttgttattgctattatacttaccaaacacatatattatatatacagaaaagaggcttaaacaccaccttaaatgattttatccgttagaatcgctagtaatatttaacctaattaacgattttgtgctctgactttaattaattattgtaagctagtataagttttatccgctacgcacacccacacaaagaagaaaaaaaatactggtcatggaatatggggcaagggcaactatatgacatgctgttcaaattttaattggatgagaactagaagtctagaacgccaaaaccctaaagagtatcgttgatagctgatctacgtattcaaaactaaataaacacgccttagatttccgactaagtcacatgggataattagtgtgtggcttgcataagaagttgaatttcaaaattgggagacaaagttttttttctttcttcttttcgtttattttaaagcgatagtgagaggtagttaacagaacatactattattcgatcgaattgtctatcacccacagtaaccctaatctacaatcatcctcttcaaaaatataagaaaacgtacatatttaattattcacgtggattgttgaaaactgaaccacaaatattgtatttgtttttgttaaatcttgtaattttgctatgtccgctttttaggaataactttttcttttcgtgaacctctctatatagagtttttgttgttgttgttgatgaaagataataattatagttgataccaaaaaagaaagaaagatgataactatacgacagttcttcaagaaaataattctatattgtttgtgaacctttaatatgggttttttttagagttggtatgtagaattgacattttcttttctagcgttggtataatgagtaattttgttttttcggatcataaaagatatttatgaaatttgtaaaccttttataggatagtgtagtaggctcaacagattagattatagagttcttttggtatatagagactctgtaaaccttttatatttgggaatttctcactttgtgaaactttcatcatgaatagtacaaatgatgatatatactactaaattcaaaatgtacataatcgaattgatgttatattttgacatgatttcatatttaaataagaaacagaattagtgactacggaataattcacaccctcatccactcaaattattgatatttgaaaatctgggtctgataaggaacaaactaaaatatagaggaacttttgtgaatatttataaacgcgaccttcctcttagttgggccataaataattgggcctaaattaagcaaatccaatactaatggcccattattggtgggtaatatccgacaaattctctttacctctttctacgacggcgacgactgaatcgccaccgccttcccgctccgactcttgacttccacctgtttactcctttgctagaccgatcagacccatctgaagcttttctgtctagagtagagaaggag

SEQ ID NO: 1965 - DNA, 3000 bp, Unknown
  misc_feature (1)..( 3000): cDNA_ID_2148377_gDNA_ID_1620473_Annot_ID_158081 3000 nt of promoter + ATG
agacgggagaaacataccaagaaggaagcagagtcttcgtttgacagagaagtttggaatctagagctaccgacatagcccccaaaacctacggcggctgcagagccagacggcaacagagaagctgccaagctgttcagaagaagctcaattcagtaccgaaccaacgaagcatagactcaaaaaacaaaagataaagtcggaagaaattaaacgttaagaagagattaaaggaacaaatatgacctgctgctagatggacgtgctttgcttcttgcagcatctcctttgggtttgcccatctccttctctactctagacagaaaagcttcagatgggtctgatcggtctagcaaaggagtaaacaggtggaagtcaagagtcggagcgggaaggcggtggcgattcagtcgtcgccgtcgtagaaagaggtaaagagaatttgtcggatattacccaccaataatgggccattagtattggatttgcttaatttaggcccaattatttatggcccaactaagaggaaggtcgcgtttataaatattcacaaaagttcctctatattttagtttgttccttatcagacccagattttcaaatatcaataatttgagtggatgagggtgtgaattattccgtagtcactaattctgtttcttatttaaatatgaaatcatgtcaaaatataacatcaattcgattatgtacattttgaatttagtagtatatatcatcatttgtactattcatgatgaaagtttcacaaagtgagaaattcccaaatataaaaggtttacagagtctctatataccaaaagaactctataatctaatctgttgagcctactacactatcctataaaaggtttacaaatttcataaatatcttttatgatccgaaaaaacaaaattactcattataccaacgctagaaaagaaaatgtcaattctacataccaactctaaaaaaaacccatattaaaggttcacaaacaatatagaattattttcttgaagaactgtcgtatagttatcatctttctttcttttttggtatcaactataattattatctttcatcaacaacaacaacaaaaactctatatagagaggttcacgaaaagaaaaagttattcctaaaaagcggacatagcaaaattacaagatttaacaaaaacaaatacaatatttgtggttcagttttcaacaatccacgtgaataattaaatatgtacgttttcttatatttttgaagaggatgattgtagattagggttactgtgggtgatagacaattcgatcgaataatagtatgttctgttaactacctctcactatcgctttaaaataaacgaaaagaagaaagaaaaaaaactttgtctcccaattttgaaattcaacttcttatgcaagccacacactaattatcccatgtgacttagtcggaaatctaaggcgtgtttatttagttttgaatacgtagatcagctatcaacgatactctttagggttttggcgttctagacttctagttctcatccaattaaaatttgaacagcatgtcatatagttgcccttgccccatattccatgaccagtattttttttcttctttgtgtgggtgtgcgtagcggataaaacttatactagcttacaataattaattaaagtcagagcacaaaatcgttaattaggttaaatattactagcgattctaacggataaaatcatttaaggtggtgtttaagcctcttttctgtatatataatatatgtgtttggtaagtataatagcaataacaaaaaatttgcaggagtaaactagttgtgaacatgatttatttgaaaaataaacaaactaatcttaggggtacgctttcttttgaaaatatataaaacttcatgaaagtggaaattgaaaggtgagaaagactgatatttatgagaatgtcgttggtggttgcatgcattgataggtaagctgtttctacctatctcatcctccccaattatacgatcatcactagctctgcccacactctctcgatcatttcctttcgtgttcacaaattatttgaagggaaataattaaacgaagttggaagataccaatgtcaaaaaccgagatcgatcggaatccctcactgacatgaagactgtataaggatctggaatatattttagaatgtgttattatgtctttaatattttggtcaaagatgtgtctgtcttaatttagaattctttacgtttatataaagatagtgcatgaatatatttaaaagtgcaacacattttttaaaaaaaaaatcaagtgtaacacatttatttcatataatgtgttatgttattaaatattagtatcatcaacttatcatggattcatataaccaatacacgtcagccaaacctattaggctattacatatcatggtattatattgatattaatttagatgttttatgttcccatcagtcatcgacttatcatatagtatcaaaatttgatctataacacaagccccaaaattggacgtcgcttctctttatattacggtagataccatttttatttacgatgtacgcttcatataccttaaattaataacgtatatattatatatatgtatatagcaatgttgatacggctattgacatgcatataataaagtatgggcagataaaaacgtgtgttatatctattgatagaactagcttagctttacgaggactagagactagagagtagagagtttaacttttatatagatgataaacaacaaaaatgttcttaaagaaaaggaaaacgcgaacaataatgtggtagtctggtagagccgtagaggtgacgtgaggattttggcacagtaaataaaaaaacacctacgtggaagtaaacctctataaaagcaatcagcctcgggattgcttcttgatccctcgtaactcctatagaaaaacagaagtaaaacaaaaataaaataaaaacacaaagatg

SEQ ID NO: 1966 - DNA, 3000 bp, Unknown
  misc_feature (1)..( 3000): cDNA_ID_3065336_gDNA_ID_1620473_Annot_ID_158071 3000 nt of promoter + ATG
tgtgtagctcaagtgcctgaggtacgacccaccatggatgatgttgttagaatgattgaagagatacgagtttcagactctgagaccactcggccatcttcagatgacaatagcaaacccaaggactccaacgtccaagtttaaatcaccccttggatctcattccctttttatctatgtttttgagtttgtatgtcttataaggctttatgttgattgtttgaacaccactcgcctgagtaataccgcagttggaggcgcggtaacatttacatagcaattattattgtaggctcctttttctgtatctcataatatatatgaatatgattcagttttatgcaagctaagtaagtatccaaaagatggatttaaaagagttccagagagacataaatatcagggagaaagagatgaggctgcttgaaggaggaattgatagagttcttgaggttgggagaaaaaagcagagtggtcactgtccggaagaaggaaggtgtgagcaggaggccacagggccaacattacctcttgaagaactggttcgaacaaatggtccttgcctgtcttcacgtacactcttgggattttgtcagtctctggagctcccggaatatccattatgcctatgaatgccatgacaggggccggacgcagaagtgtggttgccagtgtgtaatcctgatcagaatgaataaatgaatgatgatgattctctacaaaaaaaattgaggcagagatgagaacagagttggtaataaaggacacacctccatggggctctcgttgtaaaacttgtcccgaacatactcaggtttcatcatgatgcttgttgggagattttgtggtccatttccgaaagtaaagtcccatatcttctcagtttcctcctctatcaatcctgaacatatcttcattacatttttgagtctttcaggaatcaaggtaccaggtttgaccatggctgctgcgacgtaaaccgccaaggaaactttggaaggaaagaggcacatggcagccgtcatgctccctcctccaacgctgtggctcacaagaatgaccttttgatcgttgggaagttgggagaggaaggcatagagaggctcgtcgtagtcatccaaagaagagacagtgtttggatcagttgggttgataccagcacccttgaggtctatacatgtagccttatgtccattatccctcagtgaattagccagcttgtaccaacaccatcctccatgccctgcaccatgcacaaacacaaaatgatgctcactcatctttaatcctcttctcgtacatcacattccttgcactatcttttgtagttagtgtgatatttctgtatggctgtaatgttttcatgatcatgatcatgttctttaaatgaacgatgtaaacggcagctttgtccaaaactcacaaagattacatctaaaagactgccattaccagtctttgatgtgtactgggtcaactttgaaggcccaaacacatattctatagtgaggcccaaatcaagatagataccgtcttcttctttttttaatttcttaagaaaatatgtaccgtacatgttttttgtttttttgaattgagatttactccttcaactaatgagtccacaccactgacacttcttattttctacgctataagttttttttattgagatttctagttttcaaaaattacataagaagaatagacagtgaaactgaaataaagactcttacatgttgcatctatagatttccttttaaatataaaatatagattttaatatgaaaacttgatagttacaaatctacttaattttaattatatgattctaactagaagatattgagatttgcaagataatattctctatttgtgtgtatgaaataaaacagatttttaattatatttattcaaaaagtctaatagctctaataacatttgttgaacaatgtctgtttggtgaaaaagaaattaaaatcaggtgttgacaacttcatgaaaaagaaatgtaatctaaaatctagtcgcttacacattggcagaataattttctttgtgtttacatcatcttcatatatcttagagatatctctttataaaaagttatagtatatatattttgtttggtcaacatacgtaattttatatcaataattaatgatatagaatgacattttaaatgcattaaatttgaaatgaaatgaaaaagctagagaagtggagcgccacaaattgaaaaggtgatagaaagtgttggcctctcgagactaattaataacgtggattactccaaaacccttaaaagtattacatttaggaaggagaaaagccatttcaagttttcaatgactgtataaatctgatcttttgactgcatgagccttcaagtattcaaatggcaacagaattaaaacgagagagaaatagtcacgacggccattaatcttgtgaatggtcggttttgattagtggagaaggagaggtcaatgactctctataatacgattctctcaccacgtggacacagcggaattagtcccttaattacatattttaattacagagagacaacctaatcacttggccacgttgaaattgctaggtactagttaagacttgttccgcaatatctgtcttaaaggtaagtgtataaattcatttgactatattttattttcacggtttttcttcattctaaaaagtagtttcatcttcttccctcatccatcatcattcatcatcatatcttctacttcttcttcttctcaggttctcttttttgtcctcttttgtgtaaatacgttttgtcatgattctctgtgaacagtaccgatcgtttttttttgggattagcgaaaaataaaaataaccgacgttttttgtattatttgtctgacagacagaatctgtattattttgtcatcttttttcaatagtctcatgattgtctcttgtgtgtttccagctttcccatagggtccattgatttttgcagcc

SEQ ID NO: 1967 - DNA, 3000 bp, Unknown
  misc_feature (1)..( 3000): cDNA_ID_3065340_gDNA_ID_1620473_Annot_ID_158069 3000 nt of promoter + ATG
tgttacgagcacaagaagaggtcaaacgaattcaatccgtgcctttggtgataggtcagttcatggagatggtagatcagaacaacggcatcgtcggatctactactggctccaattactatgtcagaattctcagcacaatcaatagagaactcttaaagccttctgcttccgtcgctcttcaccgtcactccaacgcccttgttgatgttttgcctccggaggctgattctagcatctcccttctcagccaatctgagaagcctgacgtctcctacaatgtaatgtttccttttttccaaatctcgactctgttttctgaattaaagttagggtttttgaaacgatctttggtttcttatgtggtgctttatctttttgtgtaggatattggaggatgcgatattcagaaacaggaaattcgtgaggctgttgaattgcctcttacccaccacgagctttacaaacagattggtattgacccacctcgtggagtcttgctctatggacctcctggtactggaaagactatgttggctaaggctgttgccaatcacacaactgctgccttcattagggttgttggatccgagtttgtgcaaaagtatctcggcgaggtattaaaaatcatagctttattgaaggtttaggtcctattgagcgattctatttggtgactaactggttttttaattgcagggacctcgtatggttcgtgatgtcttccgtcttgccaaggaaaatgctccagctatcatcttcattgatgaggtagatgccatcgctactgctaggtttgatgctcaaacaggagccgatagggaagttcagcgtattctcatggagcttcttaatcaggtgagaacaaataatgaattttagttgtaattcagatcttatgttgtagaataatggattttagttgtgtccttaacttattgtgttgaattcgatgtagatggatggatttgaccagaccgtgaatgtcaaggtcataatggcaacaaacagggcagacactctagatcctgctctcttacgtcctggaagacttgatcgtaagattgagttcccccttcctgatagacgtcaaaagaggcttgttttccaggtaagttaattactacaagcacttaaataactagttaaagagatatgaaaccaaatgttttctcaaaagaaagttttgactgatatcttagtttctgtcttattgattggtttttccttgtgtaggtatgcacctccaaaatgaaccttagcgatgaggttgacttggaagactatgtttcacggcctgataaaattagcgctgctgaggttagtttattttgcttaccattctattcttcccgctatagtttacttttaccatgatatatcctccagtgtttctgggtcaccacctaatgatgttcttcaaaatatgcacttgagcataatcatactgtttcaagcattatgtatgaatgttagctgagtcgtttgttaatcattgtcctgaactgaattgttgagaaatcaattgttggcagtaatatggtttgattttatcatgtacatgggaattgttcctaaaaagattgcatgtaatgatgatagttattaatgacactattttgattttatgttgaacaatgcagatagcagcaatttgccaggaagctggtatgcatgcggtgcgaaagaacagatatgtgatactacctaaggatttcgagaagggctaccgcgcaaatgttaagaagccagacacggactttgagttttacaagtgaagagaaagcagaagtggaaccagattatggctgttgttaaaattccagtgtgttttgagaattattaaggacatggaatcaaatttgcagttaaattaagaactaagttgcatctcctaatttctgtaactcgagttcacatttgtttttagtctatcagctttttacagtttaatgtataagaaaaactggggatggtgtccttagaattgccagagcatggtaataattatgtctcctctgattaaaaagacaacaaaaatagtgatgatattaggagcacgctgcactgctcaatgttcatagaaaacttcagacttcaataatgcctaaatgtgttggatcttgttttggagttggtgatagatgatgaaatgaccagtattactattacatagtatccgcaaatcaagaatgatgcaaatcaagagaaaacagtagcaagagtggttggacaggtaagaactattaccatatctaaatgattactttaaaaataacaacttggatcaagatggtttttgttttcatgtatttgtcattttgctatctcataagaatcttaagcttggtcagtctctgggtctctctacattagcgtttgttgcggtgtttacacaccaatatgatttgatctaaagactccttttgaagactgtcttacccttaacgaatacgcctcttttgtttaacttcaccacactctctctctctttcttcttcttcttcttcttcttcttcttcttcttcttcttcttctccactagtccccacatacattgccttttcttctttcttctctttcaccatttcaagattgtgttatagtccgctcaatgcagtagagtgcagaggtctgagcgctccatctgcataagttcttcttcctctattgctgagttcttcagtgcccacaattttcttacttcgctagcttacctctctactcccaggttctctttctctcttcttcttctttttggtttttgtatttttccttttaactttctgtaattgtctgtctctcattgttgggaattatacttaaaaatcgccattttctccggctaggtgggtaggaaactttcaagactttagatacaggctagtgacgtggtatattagttccaattcgctggctacacgttgtttgttcaacaactccgataaaaatcagacactcaaaactcatctttatttacttagtgacattgtccacatg

SEQ ID NO: 1968 - DNA, 3000 bp, Unknown
  misc_feature (1)..( 3000): cDNA_ID_2148327_gDNA_ID_1620473_Annot_ID_158065 3000 nt of promoter + ATG
acatctgcagcaatcaaaacactcaaaaatcaatccttctaacttgtaaagtagagacaaaatgttggatcgtataaggaacttacctttctctgacaacgaatactagataagatcgtcttcccggttacttgcaggttcagcatctcagctccgcctccgtcgccatgaaagtcacagttaacgcctttcccttttctttcttacgggcttgaagaaacccataacaccttattgggccattactgaagcccaaataacattaaaatcaattaaaaattgagttgagaaagggagagagagagtgatgataataatggatgacccccggcaaaaaagataagatttttacagattctgcctcgatcaacagactctaatcagcagcaaatgtggagcgtcaccggagcattgactgtggcggtgccgcctaccgccgccgcttgccgtacgaaaccctttctcatctcctcttcctttcccaagcagacaaagaaactccatctctcttcgccttctctgtctctaccatcatcacatttctcctcctctttcaaaaccgcagctacctccatcgagcaacagtcttctgttaacaaggtttctcttttctttctctctctctcttttcctcttgaccaatcaaaccaaacagcttacgttttctggatgattgcagggagagagcaccaagtaccatttcctggtagcaaacgctaaattcatgcttgacgaagaggagcacttccaggagcaattgtttgaacgtctccgttacttcggtgagcgtgaattagtgcaagacttctggcttgtcattgagcctaaattccttgacaatttccccaaaattactcaaagacttcgtcgtcctgctgttgctcttgtttccaccaatggcacctggatcacgttagaaccctaatcccaatctctctcttttcaaaattacgttcctcactccctccttatctaacgcatttgtgttttgcaatttgttgttttatggcaggtttatgaagttaagattggatcgtgttctgtatgattcctttgaagctacctctcttgatgaagctttggcctccaatcctaccactcttgagttcgataagcctaaaaattgggtggcgccataccccaagtatgaacctggatggtgggataccttcttgcctaaagtaacccaagaatctgcagtatagaactttgctttttgtcttgtttttgcattctccaatctcagctttgtcttagtgcttcaaagttttgtactactgagctcattatccaagtctatatctttcctagtgtagcttctattactcaaagttgcctgtttgatacgtcactgactcaaggttaagcatagaactagacaacaaaaagcatcctcacatttagctccatcaaagtcttaagggtgaccatatttgttgatttctcacgagaatattggcaagaaccttcagttaaagctctaggtattaagttgtctagtcacaggagggcaatatgcctactcgctgaagaactttgcaaaagatctgaattttttggttttcaaaacgatttgtggactcggaacatgttgttactcgttaggtctagtgactggagttgatcaaagtaagttgcacatgtttctgctgaatcaagtgttctatgttgtacttctggattgctctgtagtctgtatctaagcgtgtcctatcaatcttactgattatacatacttttatttgtgacaaagcagagtcagaaattatctttaactactccatgggaatatactaccaagttacaaatacagattttaacttttactatgggatgagtattgctacacttgcgggagatgcattcatgaaaaactatacactggtagctccacttgtgccattaagttactcttgtgcagctagatttgcaatttctgctagaggcttccacacgaactttctcctgcaggggaattggtaatggtcatgcaaattgcaaacatagatgattagtgtgtatggtaaggaatgatatactcaccagttgccacattcagcaataaccctgacgttaggacgaagagagggaagtaaagcgagaaattgaagctccgattttgagaggacctgagtgaaatggaaatatgagaaagagcatgtgggagaacagatcaaatgagagaaactcaaacctttgcttcgaggacccatacaacaagacccttggcactagggggaagagcagcgagcctgtaatcaacttctggtggataataccatcttgctataggttgtttcccaagatgagcctaaaagaagagaagatacatggttcacacaaaattatattgaaacaagattaaagtagaagatggatgaaagtagacatacagggcaaacagggtagttcttgagaagggtagtctcagggtcaccaaggccacgagcagagatgtcaagaaagtagtagccctgcattttgagacggttaagataacgaccttcgtaaccaccctcatgaggagcgtaaatggcgattgccttgtgttcttccacgtcttgaagccattgtccgatgtccggcttcaccaagtcacctccgatgtagtcagctatgctgctacatttcacaccagtgcttcttcttctcttactcctagtattcaccaaaaaggaaccaactgttttgatcttcttcacttgcgaggcttcaaaacacggtggtgccacacgttgtatacatattgcacggcttcccatttctttactaacaatgacttcttgtggaagtagctcataataaacattgcttgacgacgatgatgatgaaagaatggtggagaaacgacgactcactccacaaagggatagacattaatgggcttaaaatgtattgggctttatttattaggcccattaagcaccgccgaacgtcgtgacattgttagctagctcgccggagcaaaattcagtctgtgaaactttcggagaagaaggg

SEQ ID NO: 1969 - DNA, 3000 bp, Unknown
  misc_feature (1)..( 3000): cDNA_ID_1032690_gDNA_ID_1620473_Annot_ID_158063 3000 nt of promoter + ATG
aggtacaaattatccagcagataaatcatgatggtgaggttaatcgagctcgctatatgcctcaaaaccctttcataattgctaccaagacagttaatgcggaggtctatgttttcgattacagtaagcatccatctaagcctcctcttgatggggcttgtaatcctgatttaaagcttagaggtcacagctctgagggatatggtctctcttggagtaagttcaagcagggtcatttgcttagtggctctgatgatgctcagatctgcttgtgggatattaacgctactcctaaaaacaaatctctggacgctcagcagatttttaaggtaatgctttggatttctattcgtttttagttttgttttgtatcatctagaaaggaaggaattgcacccacttaacggaatcagttacacttatgaaagctcatagatagatattcaggttggtttctgtgttttccttgctgatgattattttctgaacttaaggctcatgaaggggttgtggaagatgttgcatggcatctgagacatgagtacctgtttggatcagttggagatgaccaataccttctcatatgggatctgcgttctccatctgccagtaaaccagtacagtctgtggttgctcattcgatggaggtgagtttgcaatatattagctttagatacagataatacttctggtttttaagcttgctttccttaacactaaaaaccattgaatcatattgcctcgtatgtatttgctaattgttgagttgtttgaaatgccttaggttaactgcttagccttcaatccatttaatgagtgggttgtggcaacaggatcaactgacaagactgttaaattattcgatctacggaagctaagcaccgctcttcacacatttgatagccacaagtaagaatgatacgccataaatattgccgctttgagatggattttgtgttactaagaagtatttacaagttacagcaacatcactaaccttaattatgtgcttgatctccagagaggaggtttttcaagttggttggaacccaaagaacgagactattttagcttcatgttgccttggtagaagacttatggtttgggaccttagcaggtttgggccgtagactttagttctttagtttaatgttcatgtatggtcatggaggagcaatattgatatgtttgagggtgtcttatgataggatcgatgaggaacagacagtggaggacgcagaagacggcccacctgagctgctgtttattcacggtggtcacactagcaaaatttcagatttctcgtggaacccttgtgaagattgggttatttccagtgttgctgaggacaacatactccaaatatggcaaatggctgaaaacatctatcatgatgaggatgacgctccaggggaagaaccatcaaaagcttcttagcttgttatttagtatccaaagcgcactgatcttatgggacagtatttatttatacatctctgctattgtttagttcaagtatttagtgttcattgtgtaaaatgaggcatgagaggatggtagcaagtgggaatttttctttataacatgaaggagttgattctaatctcactaagtagtgtcaaccaaagctataactcttagtttatacccagattgggcgacattagaaagaaattacaaatttgaatcaaagtctctgacataaaatttcaaactgaaagtcacttgtcacaatggtccttattaaagctactggatagcttggtttgatttgatattgataaatgataactagcaatcgaaaagagatctgtattgggaagcctcgtcagccatctcctgaatgctcctatcaacccggtctttatctagatcaagcttctgcttcagttccttctccttctcatcaagctacaagaagataccaccataagatttgtataaaaccaaagctaggaatgtgatcaaaatgcaacaacttacagcatcatagatttcatcattcttctcaaagtcaccacctttacgaggcaagatatgaatgtgtacatggggaacagtctgtcccgcttgagggccatcctaagccattttcatgaaaccaaagttagatcgtttcaattccaatccattaagatttagacgcaagaaacaatgacgaaagaaaggagatgtttagtttacttggatggctaatgtgagagaagacgcattatggaaggtctcaagcttagagccaaccttctgagcagtaagccacaggtcactggtctcatcagctgtaagatcagtaaatcgtggcacaaggcgtctcgggcagacaagaacatgtgctcgtctggttaaagtcatccaatagaactcaatttacaaaacaaaaccgaaaaatgaagaacacacaaaaaaaagaaggatatgacctgcaaaaaatagatgaaaaagaaggtcagaagaaagttgaagaggttcgatgaataattagagaggaatgaggcataccaggaagaagcggacggagattaaccatggcataagagagaggcgttgcgtagaacacttcacggggatcgattttgtacggcccaaatgcgtacgaagaacaagtagacgacatctgcagcaatcaaaacactcaaaaatcaatccttctaacttgtaaagtagagacaaaatgttggatcgtataaggaacttacctttctctgacaacgaatactagataagatcgtcttcccggttacttgcaggttcagcatctcagctccgcctccgtcgccatgaaagtcacagttaacgcctttcccttttctttcttacgggcttgaagaaacccataacaccttattgggccattactgaagcccaaataacattaaaatcaattaaaaattgagttgagaaagggagagagagagtgatgataataatggatgacccccggcaaaaaagataagatttttacagattctgcctcgatcaacagactctaatcagcagcaa

SEQ ID NO: 1970 - DNA, 3000 bp, Unknown
  misc_feature (1)..( 3000): cDNA_ID_2148296_gDNA_ID_1620473_Annot_ID_158054 3000 nt of promoter + ATG
ctccaaggtgcagaatcatctccgttgttatggagtagactttgcaaattaaccatgtctaagtcctcgtagattgcaattctttgctctgtcgctatacagtatccacagagcgggaaaagatttgggtgattgatcctagcgagacgttcaaatgcaatcgagacttcagtatcagtcaatgtggttccacttgggataacttttagagctgctctgaatccaccgggtaagactgctccgtaagtaggaccagacttgccttcccacaacattgtgcctctgtcgaagttgaaagtcgcagcctttaggtctgcaagcgtcattttcattaatggcttgtcgatcattaccacagggatttgcgttgcttgcttgatatcagtggttgagtcgtgttggtctggggagttgggttctgtgttgtttatggctagctttgttgcccaagttcttgattttcttctaactctcaaggctacaagtatgagcagtagtcctataagtaagaacgccatggagattgctaaccccaaaccaatcttaagccctgtattcttcttgttgactttctttccttttgtaataattggctttgcagcgaaggggcagttgtttctaatattaatgaaggatctctggattgtttcttgggagaagttggggttgcaaaaggttagattgttgaaagagaagttaaacctttgcatcatggcgagtttctccaaaagcggccttgggatatctccgtctagcttattcaacgagagatcaagtacttcaatgttcttgacgctcagcataggcacgtggccagtgagattattggaggagagatcaagaaccttcagatgactcagccgcgagatttcacgcggaatgatattagtgagattggtccttgatagattcagataatgtagcgcagaaagcttgccgatttctgggaactcttgtgccctgaatcgattgcacgcgaggttaaggtgtcccagcttgtgagctgaactcaaaccattgaatatatggccgacaaagctattatcggacaagtcaagatgaatcagactagaccagttgtgtttgtggccgggtattaactgcaagatatgcccatcaaatcggttttcactgagatcaactgtttccacgttttcatgcaagactcctatcaatgaaccctgaaacagatttcgtgaaaggttcaagctttttagtagtgggaaagctgaaccaaaaccgacaggcagagactcgttgaggcggttggatgagaggtcgatggagagtagagatcggcaatggacaagttctggagggacgccaaactgaaagtcattgttgtggagcttgagagttgttagattgacaaggttgcttattgcggcagggattttgccagagatgctgttgaaagaaagatcaagggtgtgaagcgacatgaaattgccgatgttgctgggaagaggctcagaaatccggttggaggagagattgagactctcaagcaagctgagactccacaaatccgaggggagagacgtaatcttgtttccactgagatctaaagtttggagcttactcattttgccaatagtgttgtcggggatcgaaccagacaggtccaacccagaagccgaaatatgcaacacattctcactagagtcacagacgaccactcctggccatgaacacaaggaagaaaacgtatgagcttggggagaattgggtaatctcattgcggagaagaagctagagagatgataagcgtcggtgttgggatctaggctcgtcagatgcttgacgaagaaggagaagaacaggagagatccccatagagacaacctcataacttggtggtgtctgggactggagaaagttggatgggaaagctcagaaagaagacagactgtgtgaaaagaagaaaagacataatggaatcacggggcatagaggtgatgatagtttagaatacattgaaatccctttcacgtgcacagcttcaaaaaaaatcagaacttttagtcagaaagctatgaaatttcagaagaagaagataagagttgaatagtttgggggagttccggagttgagagttgagtttttggttgtatcgtatatggacactggagaaagtgggaagagaagagagagtcgttgaaagtcaaaaaaagggatatgtggagattataattaggtaaagtatttcgctagtgagttataagaaaaatatgataaatggaatctgtctcagaccttttgtgaatttttccaaatcccaaagttgtcaatggatttggtgagtggaggagtgggtggttgttgtggtttctcatttcagtagtgttttggttattaatgtaaaaattcacttttttaggggttttcacacttttttgactctgtcacagataccttggaaattgagaatcattcattcctctgattagcccctaaactggcgccttaatgtccgcaaataagagaaaataaaaacaagagccatcaatgtagtttaaaccaactcatcagattcatagctcattttctggataaaaatagccactcactattttaagcaatcttatgctaaaacagagctccaatagctatctgagtttcatcggattcaaagactgaaacttgcaattagagagaatgaagaaacaatgctagcaaaacagagtcgagatatcacaacttgtgcgccgaaaaggaaaagcccattaagaggaattaaatgggccgagagataaatgccggttcgtccgtagatgagaagacacgtgtcaggtcgggtagagagttggcggctgatcgtgggatccacgtcatacaacgcgccagctgaccttttcctctgttcgaagatcaatcaacatcaccttaacagattcataccaaaaaggagcatctttcgctacaaattctgtaatcaaacgaaaactcaaaagttgtcgatttttgaaattcgaagagaggttttaagactttgataaa

SEQ ID NO: 1971 - DNA, 3000 bp, Unknown
  misc_feature (1)..( 3000): cDNA_ID_3065366_gDNA_ID_1620473_Annot_ID_158055 3000 nt of promoter + ATG
gaaaatttgaatgtttagagtgtctgtactcgactatttgtcacgaaaatttgaatatttagactgtttagattttactagccgttacgaaaattagaatgttatagagtatctagattcgattataaaatcttgagtttgtattctttttcttttgtaacgcctaattcattgattgcatcgaaatgagagtcgatacaatcaatgtacattaaaagtatgcaatacatatacacatcaacatacatagttaaacttgaaagtaagccgtgaaaaattgaacttatataatgttttccgatacaatagctttactagttaacaaattattaattatgttaattttatttatataattttttatcccaatatgatgaaactgtcattcttagctaacatctcttggataaaaactacacattacagaaaaaaaaaaccaaaaaaaaaactacacattagtctaaatgatttatggtatattatctttcaccagtttgtttgtttttctgattccattatcgctaatgtggcatttattaatttgtcacactgcaagctctttccatgccttatacgatcacgaacattcataagctgtgggccaactttgagtgcaaaatgggacttcaaaggccctacactacttatagatgaaagtggccatttggtgaggactgtatgactttcgtgtttacccaattttcacattcgtgcttcaaatctatccttgtatgtgtgtgtgcgtcttctctattattccataaaatgcatgaccaaaatcattgatcttttttcccacataacaaaaaaaaaaaaaactaaaacctgacatggaacaacttattccttgagatatgttcataagttcatagaaagcagttcaagtagggtagactattctatagagggacattcaagagttgcattacagcttagagaagtgtacaacatgagtttgttttcttcgcttgcttgtaaaacatctgtttcatccaaacaccaaaacaaaccaatattctcatgtcagaaactatttcatctatctcccattaccctcagaatccactgaagaaacagtagtaagtaatactagggtggaatgttaccttcgatgccaggcttaactctgagctcttctccactaagctgtccagcttttcacctcgggctaggacaccatcaatggttttatgctgtagtataaaacaaaagtcagcataaaacgaccatgtttaagcgaccttggaaacaagaacttaatggagggaactggtatgtattggaatgtaaaaaggaagcaaagcatgcaggtcaacaatcaagaaccagggacggcacttacaaggataatcttggtctcatccaattccctctggattttcaacagcttatcagcttctgccgggtcctgaagatattccaaaaaaaagtaagaataattgacacagcaaatagttcctaaagtcttaaacaagattcatagatacaaaaaagttagtgcttctagaacccgaaatttgtctgaagcttcttttaagtatggccacggctgactagagttttcaaacctccatgtgtcaccataatccttctggtatacatctaatacctgtcaaaaacagaatgccaacgaaagaaaaaatattttccttcaaacaagaccgtaccagaagttagattttgttttgtacctgattgagaagagaaaaggcacttcgaacgggataatggtcgtccatgaatcctacggcgcagaggccatttatgttgtaagcgtgcactttatactctacatatcaacacagcgatgtcaattacaaaattataaacaggacacatatatatgacagatccaagagccaaaaaaaaagaagaagaaccttcgtgtttgacggattggcgctgacctggaggggttcttctggcaacagtacgggcaatgaatacaatgaactcttcgaagttagagcgataaaaagagaattttccgaattgtgagaggtcggaaacgttggccaggataacgggttcgcgtgtttcgggatcgcacttgagaacgagcaaggcagtgatcttcatgacaagggttctgaatcatgaaacagaaccaatgaagttccagtgagtttattttactatgagctaaaaacgtaaaaaaaacaaagtcacagttggtgagagactaattttgttactatacaatcataagacagaaactcgaaaaaaaacatagcttttgaaacaacaaggagagagtagacgagataaagagtgttcgagcagatatgttataagagacagagaagaagctaaagagagaagaagcaagatagagaggtgttaccggggcagagagtagacaagacagatgagacgagatcgacaatacgatgtatagatgcagagaggagagttgaatcgttgttgaattccagagacctttttagttaagggacctttcagggttaggccatatagaaaaaaaaaaattaaaattttatttattaatataacgaaattatttttaatatttgttcgtgttactaatttatatacgtaagtgaaaaatggaggatatattttagtatatatttttttgatacgtcaaggtctcaatgaacgacagaaacgcggtaagagagaaaggagagataaaaataggtgtggatgagttgtttgatccataaatgggatggccaagtttctttcttactattaattaactaacttgtttttcttcattccaattttgaaaccccttctttctttggccccaagcttccgtttttcttcatcttattctttcaaaatctcaaacccataagggaaaaagaagcataaagaggcagaagaggaaggtggtcatatgttcttgctttcgccttgtgagatctctttacttgtctctctcgcctctttcacattttcttaaattttaaagtttctatcttatgatagcttttcttttgtgttacaaacaggatcaatcatacagagatg

SEQ ID NO: 1972 - DNA, 3000 bp, Unknown
  misc_feature (1)..( 3000): cDNA_ID_2148203_gDNA_ID_1620474_Annot_ID_158100 3000 nt of promoter + ATG
gcttctctaaactacgaatgcatacaagtctacttaaacatttgatgatgacactaaaatgagagaatcaattttgtttttcgtttcgtgggacttttactttgaggagagaatggaggcaaatcggggccttctctcatttcttttgccttttccttgttcactttttataattcacacacagctatacttgatatatatgtatgaattttgatatataattctaatataattcataatattagtatacatggaaacgaaaaaatagactgaaagacattatcctaaccttttttttttgaatttaagttcattgatccaatagtttgatgttttataccatatttgcggtttgatttctagaaaatacaaattattagtgaaaaaaaaacttatgaaaatctcgaacgtacgtatgtagagtcctatataatattgttgatcatgaacaaaactattctacagaaaaaagtaacatcatagacccacacaaatcataaaaaaacataattttggaatttcaaacgggaaaattggaaaagtttacttttttgtgtgttaggaataattatggaaaatatgctctgaaataatatggtttatactttattttgtaggaatccaaattattttttctcgaagcaaaaagccaaaatgtatagaaagttagtgtcctttgatggctcatcaaaaatagaaagaaaagtgtgaaagctctttaatagttgcatgtggcatcgaaggcaaaatcaaaagaatcttatgtttgggcctagtgcttcggtcacaagcattaaatttatccctaataataaattacttttaataaattgtttatatcctgaacaatattaatgtcaatttggttattgttaggttattggtataatcataagaagtatgttctatgaaacataaatagtgtgatatatgttctatttctatatttcatttgtcggtagatttatacatgaagttatacggaggagtaatctttgttcataaattggctaataagtaaattatatacgaagaaagtatatgtttagtaaactagacaacacatatgaaatagataccattatcattgatcataacattgttggcatgtgtgatagcaggtttagccttcaaaacatttataacgtgcaaatcagtcatgatctctcttgataaacaactaattaaacattaactacttatatacgacaaagcgcatttatctcaattgcgtataatgtacattatcgaccgaatatcaacaatatatgaacgtctagccaaattgttctaacagtacggtcgcataatatcacataatagattttaacccgcggtataccgcggaacaatttttttttaaaagttagtatacataaaagtttgcaaattgtatctatctataaattaatgttgatcttatttatgatatgtttatgaattattgtctaaatatattgtaattttgtagtaattaaatgctatcaaatatctctgcgatttgatgattataatcgaattgttatagtcatggagaaaagcaatattaaaaatgataattttgtagtaattaaatgatattaaatattttagaagttttattttaataactaattgtgtagttaatgtggagagatttaggcaaggttgttaaatatcaaatatttaattcgaatatttttttctaattatcaaaaacaaacattaaaattcagtggcagccattgtaaataagttccaactacaagatttatttcataaaatggctgcaaaaatgtatatgtagatgctgaaatcacaatgttaccgacaataccctaaccatatgactataaaaactcagctggttacgaccaaaatctgtcttgagatcgagataatgtacaataagccaaaagaggtaaaaatttaactaaatcataataagccaacaaatttaggtttagtttagtaatcaaccccatcattaatatattacagtatatcgatgaacccacatctatcaaataaattaatgagtctaatgatgatataacaacacaaacaattccacaataaacaaatactccatagtccagacttaaacattagaaagaaacatattcaagttgtcccttcgggaacatgtatccgattttttttaaaaaaaaatcgggttaaaaactgtttacatatgtacaccatctgctttagctcctatacgtttacgcagaaaaaacgtttttcttaaaagtcaaaataagaatctaatctaaagtacaattcgagccctttatgtcaaaaaaactttgcttcctttgttggcaatccttattttttattttatccggtggtgatccgtttatactttatataaatttctttcgacttgattattgaaaataactcattcatacttaattaaatttaatcaagacaactagaaaactcaaattataactgaggagtaggcctcacagtgtctgcatgggcaacacgtgtctgtgtagaagaagacaatggccatgattctgtaataagccacacaggctctcactgagcagaaacttcagcttttagcattttaaccttttataacacaaaaccctaaaaaaatacactgggccactctcgtcttcagtgtgctaaaaacccacctataattattttttgtgagatcatttttcttgcaacttgttacacttatctcagttccccgacaaattttgtatgttttacgttccaaattattgtagtttaaattacactgtacatatgttgtttcggaaagaaattcacaaaagaagaaactgggtccacatcattaggtagtatattattatctattacttttgtaataaactaatggaaagtttctgcagccgtttctcattttaattgtgtgtattaacctcaccaattctcgatacaatattataagttataacacttcaacatcgtacaaacattcttagagagagactaagagagcgatagagatctagagagagagagaggatg

SEQ ID NO: 1973 - DNA, 3000 bp, Unknown
  misc_feature (1)..( 3000): cDNA_ID_3065378_gDNA_ID_1620474_Annot_ID_158106 3000 nt of promoter + ATG
ttggtggaagaagctggaatatgtcatagatctgaaaaaacccagaaaccagtgagattcaagttaaactataacgagaatggaattgaaacactgagaaatatttgcatacctggtccttgaaaccacgggagagcatttcatcagcttcatcgagaacaaacatcttgatgttgtcagcacgaagagactgcctcttcaacatgtcaaagacacgccctggagttccaacaacaacatggacaccagcttggaggatgcgctgatcctcacggacactggttccaccaacacaggcgtgaaccttgacaccaaggtaatcaccaagggccctcatgaccttctcaatttgctgagcaagctctctagttggagctagaaccaaagcctgacactggataagggagaagtccagctgctgcaagacaccagagcagaaagttgctgttttcccagtaccagactgagcctgttgaatcacatcaagacccttacagaaggggacgattcctctttgctgaatagcagaaggcttctcaaaacctaagaaaaaacagaagcacgcatgagataatgttctaatctaagacataaatcacaaaagatagctttttcaagttcctacacacataccataagcataaatacccctgagaaggttctcttgaagacccatggcatcaaagctctcatgaacatcatcataggatgtgaagaactcatcttgtccctcaagtctgtatcaatacagtacaattagcagctagagcatgcggagagaacacactcaagaatgaaaaaacagaagtaaaaagactcacacttcattgagtttctggtcaaactgacgtgcatcaaactgtgtgccttctggtgcagatcctgccatgctacataaaaagaacaaaaacaatcagatttcatatcaaaaggaagagagacaacacctattttgatatcgttaataatatgattgcaaaggaggaaatgtgacaagaaagccaaactcgaagtccataaagagaggaaaacaagcattaatatctgcctcagatgatgtgcggagaaaatgtataaaggcacatatggttatctattaaacatagacaccactcaacctatttctccaaattacaaaaaaaaacattcaatcagacaaaaccaagtgagtgttaagacaagaacatctgagctttgaagacgattcatttcattctattgagagactaacctagccgtaacaaaatctacaaacccatcaacaaatctacagatgtgtagatcctaaatttaataatcgtcatcatcagcagctcagaatctaataaagagaacaaaaacgaaagcacttccacagcaaaaaaaacgatcttgaagtaacgaaaaatcaaaacttccaaatcaactcaacaaagttgaaaccaaatctatcggaaaacacaaaaaaacaaatcagaacaatccaaaagtaaagaaacaatcatgaatcgtaaaagttacatcgagataatagatagacaatccgataggatgcgaacctggagcaaagttggtaagcgagagtaaagggcttttttcagggagcttgaatctcccaaactcggatctgaaccgcgttgagagagagagagcaaagagaagagcgaagattgcgagagactggtggaatatccgaaagaggctgagagaaaacgcgttaccttgtttatatactccgtctttagggttttctcctttggaaatcttctccttttctttttcggatttccggttttacccctttattccctttctttttactcttttggctcggacaaggttttccaacacttagctcattgtcttaacttgattttggcaaaaataaataaacaaatatctagtgggaaattaggaacataaattcttcatttattttgtgactagcaaagaaaatattcttcatttattttattttcttttccaaagctttctttctcctgcaacttttattgctttttgacgttacaaagcattttcccgattacaacgaggatattagaagaataaagtgactgataagaacgttttatctgaaaatgtctttacttattaacacatctatctctctatgttgaatgtttaatcatgtaattgttccacaagtgatatgaagaatccttgaaacgaagcaaaacacattgagtaagaagaaggtaactagctagtatgaagaagcagcaagttgctatctatcttcaacaaaaaatgctttgattttagcctcaagagactttcttagaatctgttgccattgaagaaaaagctggagagggcaaaacataatcatgatgcttaggataagcaaaaaatatgtatttagcttgtgtaggtagaggaagagctaggagttttttgtgtgacaggaatcgagggaaaacgatgggccaaagattaggcccattaataagtttgactaatccctgccgttcattagatgcctacgtaatcactaacgcacctgatgatctctgtcttttggtgagacgcaaaagctcagagaataataatagggcccaatataataaagtacaaaccgaaatttgtgaagcttaattagtcggtttaaatacttttatatcggttatggtagaattggtgttggtacgatacaatctggtacatgtaaggcagcattttgccatttctgaaaaacctaaacacaaaactatcttcatcatcatcatcaaatcccagctttcttccaagtgatccttcactctctatactgcgatttaccgttcttctgactcttggtgagttctagatcgaatcctatcttccatccacatatttactgtttcaaaattggattgagtacaagtcaaattcatcgatctcgatctctgatatagttgccgagggaaaaaggagaaaccccctaacaaacattcccaccattttttttgttatttgcagttgcgaattcggatcggctgacgcagctccgattgcacaaca

SEQ ID NO: 1974 - DNA, 3000 bp, Unknown
  misc_feature (1)..( 3000): cDNA_ID_2148231_gDNA_ID_1620474_Annot_ID_158108 3000 nt of promoter + ATG
agcaaaccgcgaaagtggtgcaagctaacataaaatattttgcatccaagaaaatagtcataattttaccttgatatctcgcaatctgtacaatctgttgcggacaaatacagggtaagcctcagttgctgcttcagtttcctgttgcagaagccagtaaatatcttcaagaaaactccaatcccccttttcaatgatcttttctaagggataagcttcatttgcagtcgttgcagcggtattgtaaggaggaatgttgcgtgcaacagtagaactggtgccttcaagagcagctgtgttaacacctaactcacttagtttcccatcaaggaccttctgagtcgcagcatcatctcccatatataaggcacgcttcttcttatcctgcatagagacacacattctcactcagacatataatcctcccaacgaatctcacgacaatcagttctctactagtctggataccaataagacagatactgtaggaaacagtagaattggtgttttcagatgctgtagtaacatacccgagtaacagctttttttgtattataacgatcgcgttctcctgtttttagttcttcaagttctttgacgacagcacttcctgaagcttcttcctcatttgtttcttgagctttaactctaggctccaatctgattatctacaagtaacacaaaaccaaactcaaactctcaaaaatcatttcttttctattcacaaccatacactcaaaacattccaactaattcaaaccaattaatcaccaaaatcaaaacaaggtaacagaatttaaaccttattgtgagcaacaggaagaatcctcaaagttttagcctctctattaaaaacaccaactctataagtattcgtctgcatagcagcttgctcgcctgtgtaattagttccgacgaactcaactcttgcgcctggaggacttacaacaacctgaatcctcttcttagaatcatccttatgcttgtaaacagtaaccttgggagtttcatgaactctcttgcctgtttttggatctactttacaaggatcgtatcctgtagagaaataggcgacgatcggagagattctatcgggtctctcggcgacttgcgtgactttgagagtaactctcttgtcttcttcgttttcatcctctgtttccgttgctatttttttccctttcctttgcttcttttgtagttgttgtggtgtattgaaatcttcttcctcgtttctataatcattcttctcttcgccttccatggctactgaggtttggattcttttagtctatcgaagaagcggcagcgattcagagaagggtttactggaaactcactaaatgcttaaaccctaatttggttatgtttcgggaatttattacataacagacccttgttgtttgtccgagtcgataaagaaatcttcacagtttttttttttgaccccaaacttttaatttgtttagaaagatctacaccgttataacgacgtctacggactacggaatctaaaccctggctttttctcttagctaaaacgacacgtagttcgcctgaaacttagaaaacaaacacacgctgtttgcaaagatcccaatttacattgatctacctccaaagtatctaaactcttctttaaagctttggccacataaccttcttttaagttttttttaactatggattctattatcttctaattttttcatcatttctagaccaagtttctatgctggaacaaatgtaaaattttgatccaagtacaccaaattcttagttcgtttttaatatagatatttcaggttaagtgtatattggactgatatcatcacaactagttttcacttttgacagtggactactatcggatcggttattctttgattagggttctttaacacgttctctctctttttttcgagtccaaaataaagtcttgtcgtccaactagctagcgtaggatttggtgaacttggatacatatatttttattcgtcgtcaaacttacctagcaacaaaacaagtaatgctgtactattttattttattttgataatcacctgatcaccttacccagatacatatttaagctgacgtatcaaatatttgtgtaatattatatgagtaacatttgcaggtatgtatatctaataaaaaatttaagaaaagagtaaatcgtggtgtgtgatgttgatgtacgaccacagttttcttatgccacttacaacttttgtaatagttgaacataaaagagctagcgttgtggatagatagatgaaaattaatctatacaatcgattaattaacattgccaatattcaaccactagatcatgactctgttacttgttagtagcttaatttatcattatgttgaagattttatatgtactaatgtcactgttcactgttgcgcaattaattaatgttctagtttttttctccgcaattaactaatgttcaacttcaacttaattttggtttgttgaatggtatgcaacgactgttctttatccgctatatatctttatctttttataccacaagtcgtataagtcattagatacaatgacaagatgacaaatgtagtactatgaaagaaaagacacgttgaaagaagagtgacacaaatgagagatatgatctcccagagtcaaatttgaggtcttgcgattctcctataaacctcaaaaactctatttagttagaaatatataaaaaataacgacgacgcttcttccctaatgtcgctatcgttgactgacttgatcagaatcatatagttctcaaagagtaggtttttaattcccgtacgtgatcaacaaacaaatggtttcaaattagacttttgctgatcaaaccagaaatttctatctccctttccttttttaaaaagactcgttcttttttttcctttataatctcgacaaagagagaagttacatatataaattttaagaattataactcttttgtaaagcattcatcgcttcaaatc

SEQ ID NO: 1975 - DNA, 3000 bp, Unknown
  misc_feature (1)..( 3000): cDNA_ID_3593911_gDNA_ID_1620474_Annot_ID_158115 3000 nt of promoter + ATG
attgaaactctttagtgagtgatagagatgctgacatgcatagcttgtacgaagcagctaaacaccaacaatggtggatctaagaaacaagaagaggatgaagaagaagaagacagagttattgaaacacccaggtctaagcagattaagtccctgacgtcacaggtagagataaacattcttcctctgtgtcactttcacgaaaaaaaaacacaaatgagaaaaggaccattttttgctcttgttggtttctgtttggaagctaagaacaaatcaatttaagtccgtgactttcagaatgtttttcactgtgtatttaattttgtgaataacatgtgattcttgtatgtgaatcttcagattaaagacatggcagtaaaagcatcaggtgcttacaaaagctgcaaaccgtgttctgggtcgtctaatcagaataagaaccgaagctacgctgattcggatgttgcttcgaattctgggaggtttcgttatgcgtacaagagagcggggagtggaagctcaacaccgaagattttggggaaggaaatggagtcaaggttgaaaggttttttgagtggagaaggaacacctgaatccatgagtggtaggacagagtctacagtgttcatggaggaagaagatgagctcaaggaatgggttgctcaagtggagcctggtgtcctcatcacatttgtatcattgcctgagggagggaatgatatgaagcggattcggttcaggtaatttttaactgttttgtaggatttacactaagtaaaagtttggatattggacttaatcaagatggtacaatatgtttccaatcaggaatattgaagatgatactcaaatgaactaatccatactgttttgaaattgtttaatttgattttggaagtagagatgtgtggttcttggagacaagcaatgtgagagtacagttgatatttaggatattattatgtgagatttctgtgttggaaactgttgctgctttcatttttcttgaatcgattgaagtggtcccaaaccatttcttataattatgagaacttgtacatcctttttgccaagaaaggtctttgagatgtgggttatatttcggtagttgaatccgatggagaacttaaatgaattccccaaggacaattgtgtggggaagtgtttgtgaatttcgtaaagttctttttgtatgtggaacatataatgagagcaagatgatctaactaactttcttcatggcaagaggaacacttcagctccctaggattgatatttctagattctagttttgacaatttactgcagatcccttgagttttgtgaacctaagactgttaacctggtagctctttggttctgtattgtatatggttaagtcagctcctaatttgttgatttcttcaaatttgtattacttgcagccgtgaaatgttcgataaatggcaagctcaaaagtggtgggcggagaatttcgacaaggtcatggaattatacaatgtacagcagttcaatcagcagagcgtcccacttccaactcctcctagatctgaagatggggtatatgcaccctcttcacttctgaacacatgaatctactcatcaaaacctgtctttgatactttgaggtctaactagttttaatttggtataccagagctcgcgaattcagtctaccaagaatggtcctgcaactccacctctgaacaaagaatgctctcgaggaaaaggctacgcttcttctggctcactcgctcaccaaccaacaacccaaacacaaagtcgacaccatgattcatctggtcttgctacaacaccaaaactctctagcataagtgggacaaaaaccgagacatcatctgttgatgagtctgcaagaagtagcttctcaagggaagaagaagaagcagatcattcaggggaggagctatctgtaagtaatgcaagtgacattgaaacagaatgggtggaacaggacgaagcaggtgtttacatcacaatcagagctttaccagatgggactcgcgagcttaggcgtgttcgcttcaggtaaagatacattactttctctgttccttagtaaaaccctttcaaaagcaagcactttaacaacattgtctttgtggttgtagccgagagaagtttggggaaacgaatgcaagattgtggtgggagcagaacagagctcggatacaacaacaatacttgtgatgaccgatgacggtcgaaggctctctagagaagaatctgacacacaccaaaacaaaacacttttcttttatatgttttacttggaaaaaagctacagagtgatggaaataacttgggattcagataatgaatgtgctttttagttggtggttgttagtacatctctttctcttctttctcatctacatctatctataaagaggaggtattagttttactggattttcttggtgttattttcttaaggtaatgtactgtatatagtttaatactaagaaaattcatattattggatttgaaaattacactttgtgcactttattactttttctctaattatattgaccatgattggtgctaataattatggcatgtacttaaatgttctgaataagaaatgtataaagtaaaaaccagttaaattgccagctaacttgtatctccttagaaatttccatttctcacttctcctttgactaatctttctattgagttatattaagggtaaaatagtcaattaggtttatccaattagtgaatttggaaccaattttttcgacgcgtgagaataaatcctaacttcttttttttttttgttctcttaaagccgttccctcttctctgtactcgaaaccctagtagttgctctatccgattttagggtttaagagtcgaatcattagcatctaccttgattacgctgatctcacttggtttcgctactcgatccttgaatttctttgttttttgtgtgtttcggtttattcgatacgtctttgatccgtaatg

SEQ ID NO: 1976 - DNA, 3000 bp, Unknown
  misc_feature (1)..( 3000): cDNA_ID_3065414_gDNA_ID_1620474_Annot_ID_158117 3000 nt of promoter + ATG
agagcaaaaaatggtccttttctcatttgtgtttttttttcgtgaaagtgacacagaggaagaatgtttatctctacctgtgacgtcagggacttaatctgcttagacctgggtgtttcaataactctgtcttcttcttcttcatcctcttcttgtttcttagatccaccattgttggtgtttagctgcttcgtacaagctatgcatgtcagcatctctatcactcactaaagagtttcaatttcgacctgagaatttagaagaatgaaacccaagtcacttcctccaccaaaaataatcaaatctaagaaatgagaacccaaaaaggctcataatttgtacctttttttgcaacagtagttacgcacttcaacttctaccttccaatatataaactcaacactcactaaagtcgattgcttttctctcaaccacagagattcagatgtaaaaccccaccggtgaaatgacggcgaagggaaggaggagaccgttgcggcaggggaaaattagggtaccaggatctgtagatcagacctagaaacgacttcgcattaaagactcttctttttttttaaactctctgggtcggtttacttgtggcttgaaagctcttatcagagagattgagtgagatacactcttaaatctcaacactttatgaaatccaaagccgaatgcagaagcaaaatgcaaaaaagctacgaatttttggggagagatagagagagagaagagctttgatatttgggctttgagatcgtcggacactgtgaaagtttgcgcacaagtgtggtgttgtgttcctcctccttcctaattcctatattaaacaaaaaagctctactcttttctttttcttcagagaaaaaaaaacagtaatggctattttcagattcgtctttaagtttgatacttatggattattatgaccaaaaccaaaaaaaaacaaaaacgtaacacagtttttactaacatagattaaccaattgaatagttctacagctttattgctattttttaatatccgcattttgtcaacttttgatttattatttatattaaattacttagttttgaatcgtcttgtatttcatttgctaacataactagtagtatattcttcaattttactgctttgagagtgaagaaatcggaccaagaaaatttcaaatgttattctcttctttatttcctagttttttttctttattctcttttcccttttcttgcttttttttaaaaaaaagaacaaataaaactattttcatagaaataatgaagccgtgcaaaatatccatggtgtggccacatattgacacgtgcatttttaaatgattttggctgtctaattttgcacccaaataaaggaaaagaaaaaggaaaccaaataactaatccattttgttatctgtcaattttctcaataacgagtatttcataatttaagacagtgactctgggaaatgtgacagaatgttactagttggtaattactcctaatttattcaaacatttagaggcaactagtcgtttaaattattttaaatcaactgcattcaaatatgaatgcaaaaacctaaaaaggaatatttacgagtctatataatgtcagatttggtcacaggagcgccgtgaagcaacgggcgagaattaactacactctgtggagtttcttaccatacactattttacaattcgtagttaatgtttttagttttttttttggcttgctttctctatttttttcactaatacagctgaaacatttttttaaattaggacaaaagaaaacagtttttatagcaatgaatgatcagatccgatactgcaaaatataaattaatttaatttttaccataccacgtgaatgatctgtgttttcttgtttgatattgttctttctctttccattttaatgttagctcgtatcttatagctataactatgacctatccgttacaaataatactttatgatgatctctctttcaccccatgttaaattgaacataatactcgtatagtcttaagatttctgtcttatctttttcaagtgtatgttccaaccaggtatcgtggtctggtggtaaaggaacctcgactgagacgtccgacacccggattcgatttctggtcaccagagaattaacatgcggatttgctctagcgcctcagaccaccagttccagggagccattaagtagatgtttaaaaattcctggtcgcgggcttaaacccagtggactagtcagatcactgtgtggtctggacactaagttgtcaaaaaaaaaaaaaaaaagtgtatgttccattgctaattagagaggtacaactttgaaaagtgtaatgtttcatacatgtaactcttatactttttattggccacaccagtttttttgtatttcatcattttaataatatttcagaattctccaactaatccatgtttaagtaattttggagtatttttctagtgatgcttttctgattatatatttaatttgatcaattatgatcattagtatttatgcctagctttatggtgacaaatagcatattgcaccttagaaactgaaaaaaggtataaagtgattttatcaaaaataaaaacaagtgatgatgagacatgcaaatgaagcatgtaatatttagattcaagcttgttattattaaataatcatttaaactttatagagttgtttttccaactaagcctattaatgctttttcccccaaccttttctgtctccttcaaggcttaagcactttcattataacccattttgaaagtcaagttaacattatccccatcattaagcaaaccatacccttttaaaagttcatttcgaatttgaagtatcctttgcttcaggttacttgcttttacaaaaactctttattcttgctgatttctttccacaaatgaaataaaggtaaattacaatcgaaggcttgatcctttatgttttatgtgtgttaaaagatttagaagttctta

SEQ ID NO: 1977 - DNA, 3000 bp, Unknown
  misc_feature (1)..( 3000): cDNA_ID_3000125_gDNA_ID_1620474_Annot_ID_158121 3000 nt of promoter + ATG
tcctttggttattctccggcgaaatttgtgaattcatttagacgagatcaccaaagccctatctctgtgcttcatggtccggtctcgtgtagttgtagccctccgatgagaatgtctcgtgatcggaatctagatggttcgtttcgtttaggagctagtggattgttcaatggtttcgttaggaaagctcttggatcatgtgttgattacgagttcggatcggattctgttctcgttgatgagctaacgtttcctatggaggttgatacgataaagccatatgctagggatttgctaagacgtgcacaattgagacacaagattttcaatgatgaatctgtgatcaaagctttttatgaagcagagaaagctcatagaggacaagtaagtaggaaaagatacaattctcaatcactagttttagattcttgtttggttttagtgtgactcaacttttcgtttcatgtgtgttttatcagatgagagctagtcgtgatccttaccttcagcattgtgttgagactgctatgttgttggctaatatcggagctaactcaactgttgttgttgctggccttcttcatgataccattgacgattctttcatgagctatgattatattctcagaaacttcggagcaggagttgctgatttggttgaaggggtaagaaatatgtactctcattgattaacttatgtcggagctatttgtttggttgcttggtcacttgtaaaggcagagtttttcagcattcattgacctttgtcttccatgtgtatgtttgttttgtataggtttcgaagcttagccaattgagcaaactcgctagagagaacaatacggcgtgtaaaactgttgaagcagatcgtttgcacacaatgtttcttgcaatggcagatgcaagagctgttcttataaaactggctgatcgattacacaacatgaagacgctttacgctttgtccccagtgaagcagcagaggtttgctaaagagacgttggaaatatttgcacctttggctaatcgtttgggaatctctacctggaaagttcagcttgaaaatctttgtttcaaacatctttacccaaaccagcataatgagatgtcaaccatgctcgaggattcattcgatgaagccatgattacttctgcaatagagaaattggagcaagctcttaagaaagcaggcatttcttatcatgttctttgtggccggcacaagagcttgtatagtatttacagcaagatgttaaagtaagttatatttcctcccttttacagaacaaaagatgtgagtgaaactagaagactaatgttgttgtctattcgattgtaccaggaaaaagctaacagtggatgaaattcatgacattcatgggttacgtttgattgttgacaacgaaggagattgttacaaggccttaggagtagttcatagtttatggtctgaagttcctggaaagctgaaggattacataactcatcccaaattcaacgggtaagttcatatctccatatctcatagtttaagttgtggttggttgtggcttgttaaaaggtaatgaatctgactttggtaatttggattttaggtatcaatctttgcacacggtagtgatggacaatggaacagttccacttgaagtccaaatacgtacacaggagatgcatttgcaagcagaatttgggtttgcagctcattggagatacaaggaaggtggctgcaaatactcttcgtttgtgcttcagatggttgaatgggctcggtgggtcgtaacctggcattgcgaagcaatgagcaaagaccgatcttccataagttcttcagattccatcaaacccccttgcaagtttccgtctcactctgaggactgcccagcttcttacaagcctaacagtagccaggatggaccagtctatgtcattgtaatcgaaaatgataaggtttgttataaacctatcttgtcgagtacaaaagagttgtacacttgattgttatactgaacaaatcggaatatgcagatgtctgtgcaagaatttccagcgagttcaacagtctcggatctgctgagccgggcggggccagggagctcgaggtggtccatgtatggcataccagcaaaggaagaactaaggccaagactgaaccaaatacctgtaagtgacctcaagtggaagctgaagatgggtgatgtggtggagctgactccaacaattcctgatgagtctctgactgaatacagagaagagattcaacgcatgtatgatcgaggactcgcgttttcccgccccggaaccatggtcggatggggaagctgatgggtcctcaaattgttaactagtccatgtatcatgtatgtatgtatatatatagtccccatatgattaatttgttgtacataacaatggctccgttggttcaatgtaagcttaataaaaagaaagcaaaaagttagtattagactatataaatttgtcaaaaaaaataaacgttatttcattaagagttctaaaattttattgagacactgacacagtgtgaaaatgttttgaagtatcaaaccttgtcttgatgaggccggttctttttcgccttctatttacccaaaactattgagacttaaacttcaaactagtagaataaagaggcagatttctctcatcaatgtattaatttgtagttgaattattcaccataccttatctttaatatatgattttggtcaaaaatctataaatatatcttgagtgatgccaaaaaaaagggatcggcctccatgaattggtcattcttctgccttgagcacaatcctcggaattatttttagctaatgcaagagtttgtggttttctatctccctttgctcctctataaaacggactttcgaatcatcagaacaaaacatcaataaacacaaaaacaaaagaagaagagaataaacaaaagaagaaaaaaaaagtattaaaacaaaatcaataaaaagagaataaaaaatg

SEQ ID NO: 1978 - DNA, 3000 bp, Unknown
  misc_feature (1)..( 3000): cDNA_ID_2105586_gDNA_ID_1620474_Annot_ID_158122 3000 nt of promoter + ATG
gggttttacgaatttgacaaaattctttgggttcccaattgtttttgtaaaaacactaaaaagagtgatataaatcattgggttttataaacccaaaatacttagttttcagcccagtccaggagctagagtaatgggctaatgaataagcttactcaaactaagccagagtaatatacacgagcgtgttattttctcggttaagagaaaaccggaacgaggatgcgtgtgtaaggaggctagttgcgtgaaggcaaacgcaacaattccacgtggttaaagacttaaagtcatagctgacataatcctcataatacgtttgcttcttacgcaaatcacattacccaattatttagggaccacatcttcttgtcataaaccgaaactaaccgatctgattccactaaatatctccaagtctgcatataaatccaatattctctaaccaactaaaattgaattatatgaatcttcttccgccgtcgacatacaaaaacgaaaatatcatattaatacactaacacacgtgacgcacgtgatacagaatgtatcagactttgaccagctgactatcaacaaccgtagaagtagatttacggctgtaactgagttcaagccgaagaagactcaaccgtagccgtttgatgtttaaaaagacaccgtgatccccacaagtcatggagttgatgctagggtatggacacgtgatatgagcgtgacacccattttttttctaatggccgccaaattagacgcgtgtcaagttcaattcttctttctaaagtttttctccggaacgcgtcggtgtgtccttatcaacactcccttcctatcttctagactatcgggcatattaacttacaatatatttgaagggttttatgaatccaacatcaatgcatcaaaatgtcactgttgcccttgccttgatatcattaaccatccatctttttttttcctcaataaaccaatcatgtttgactgtgttagttccatttgaaggaattgatttcactatacatgtagttttctttttttctgttgaataatctagtaatcaaccgagtctcaaattgcatatcgattccatgctatttataaatagatttatatttacctttgtagatataaactttatcaccctttattagtatcatcaagctaatactatttgagtagacggcttcgaagagttattaaccaagccagcaatgtgggttcgattcagattcctcttattgatgcaaaaaataaccaatgacgagacctcgcgaaataaacgaaataaaacgatagaaagtaaaaacgaaaagtagtagacaaacataaatctcatggtggaccctttttgtacaatttgctgatattttgttcatgtttaaagtaacaaattccatttgccaaaaagtaaaacaactatgttaaatagtaataaagagattgtttttttggtaaacagtcgccataatccatattgagactagttaaaagtggatcaagtgattcaagttgacgctgatacagatggcatgactcagctgccgttgacactgtgctataagcctatcttcattttaaaaaaaaaaaaaaatcccaagtggataatgaagatactaaaataaatctgattaattcaataacttacaaaaataaaaatggcggtgtcatcatgcattggcgtgaagctagagaaagcatatgtgaataatagtgattacgaatatcttatttgaaacaggaataaaattatagaaagttgtcgttgagttttatatgtattcgtttggttaaagaatgatatgcttattggagtactcattagtgtgaaattctattataaaacctaaacattcaattcatatagaaaacctacatgctaaatatttagatttatcagagtcttattaggatttgagttttactaagttttcaaaatttacatacaaaaatattcgaagaagaaatattagatctaagtatgagacttgtagtttatcacacaagttaggttaaagtacaattaacttaaaatgtctttaatcagcacacaaaagccatttagtgactagtactccataaactatgcttttaaatattttatagccaaattggagttgagatatcgatgtcatctgataggatatattcttaatcattttagtgtgtcatcatttttttaatgacacaagtctctttaatcacacaacgaattagctttgattattcttttagcattaatctatatgtgttttgagtttggaggacaagttgatttaaccacaaatttagatataatatcacggaagatttcataaatcttggctcgtggataaagcattagaaaaattagattatatattctatacccaatacaaagattttaataattatttacgaacagcaatggataacgacataacaagattagactgtaataaacccacttaactcagtaattaattaccgattacgtaaaagggtatttcggtaatagtagtattgatcggtttagttttggtcggccgaacttaaacagacgaataagaacagaggaaaaagagagagagtagtagtttctaatttcgaagagaaaaatcaaagattaattttcgtccttaaagcaaagcgtctaactttcttcttctccttcttcctcctcacacaccctcttgtctccattagactcgtttctacgatttttccccttcttcaatttctttccaaactcgtataaattgtacatactttaggctttgttctgttcttcctctgtattaaagttccttgtacaactcaaaatccatctgggtttcgtgttagaatttgtgggttttgtgttaatctgtttgtttcaatagaaaaacggtgactttaaattcccgggaaatttgacgatttttgggagctaattctgggaattggataattttaattctttgatttctgagagagaaaaaactgaactttaggattataaagcagaaccaacgagctccaatg

SEQ ID NO: 1979 - DNA, 3000 bp, Unknown
  misc_feature (1)..( 3000): cDNA_ID_3065410_gDNA_ID_1620474_Annot_ID_158118 3000 nt of promoter + ATG
gtgtgtgtttttactaattatgggtcgttgggtctgatcaggaattcaaactcaatccaaaggctaagagtttcaaaccattgcagtcagctgctgcaccacctcaatctccaatcgcagatgcctcattctactaccctggtcctagtcatgttcctgttcagcagatgcctggaatgccgcctgttaattacggagtaagttccgtttgttatatattatataaacccaaccgagttatgttttcaaaactcaccatgtgaaaattggcagctcccgccatatcctggcaaccaaccacagatgatgtatcatcctcaagcctattatcatccaaatggacaacctcaggtttgacagtaacacacaagccctattgaattactattcccacacacatacacaaaaaaaaaaaaaaaacatcaaaagtctaatggtgattggaattggaattgtgatgtagtacccacagcagcaaatgatacctggtcagcagcagcagcaaatgatacctggtcagcagcatcctaggccagtttattacatgcatcctcctccttacccgcaggttattatttttgctaatagtagattccctctttttgttctttttttatttttcttttacatagtcgaagagttaaaacttttggatgctgaaatctcatctctgtatgtgtgtgttttgcaggacatgccatatcataataaaggacgagagtaataactactactacccgatggtgatgatgttttttttttttgtgaaggaagtgtacgaacccctctctggttttatccactctcccttacccaatcactgaaaccattttcttctcttttttagattcgcctactgattttggtatttcgtgttgaaaacaaaaagaaagaaaaaaagaaagaaaaaaaacgatctatctgaagtctgtagtactgagtgcactctctccttttttttggctgtatcagagatataaaatttagagtgtaggttgctctcatgcgtcttttacttcgtcgtctgcatatttttttgtgtgtgttgtgctaaatttctgggtgattttgttatctaaaatccaaaaaggatgcggtttagatgaaaagaatagaagagtaacaacgatttcaaagcaggcagaactagtcatttttggtgttgttgtagggcatgcttttttcaataagtcgttaaacgttactataagtagttgtctcgcgattattatcatgatgatcgatatgactcggtgtatatgatttggtgggcaacacattcatgttttaagattccacaagaaaaaaataaaatggaatcaaacctagttttaccagtcgcatatattattaggttaggtgactgcattgagttgtttattttttacttttttacgagtctctctcaacatttattgtttttgctttaaagtggagattttaaccgtggcttgagcttgacacttacgaatgatgttgggtcaccaatcttcatctagaatttaccttataatcacttagttcaattgcgaatcatgttttcgatgtattttcaacaacttttcacgaaaccaactaacatattttacggtcatccgctatgatagaaaaaccgatgaatttgctaagtttgtttctttcttttcagtatggataccgaaatgagacaagaaaacaacgaatattcaactacaataccttacttgtaattgtaatgctctttaagaatctatcaaaactcatcgttatgcaattactgatttatttcatgcgagaaaaaccaaaagtccggtcaaacaaaaaggcaagtgtgtccttatgttgtgacgacgtggtttcatcatccaaacaccggacgtgaatatcacgcgcgcgtggatttcggaacagcgatgtggcggctgtgaatacaaagatatcaagcaaggtacacagaatgtgtgtctctgtttgtttctttaatgggacattttcacttcatcagaatctgatctcaccgtaagcctttatacatagttgtacccactttttctgttttaatcttaaagtttactattttttctagttgataaaatggagtactcattatttgttactagtagtaattaataaggacagaaaaaaaaaaaggaagaagacaagagtggttcacaatcataatgtaaacaacgaataataataattaatgtccaggtaaaaaggtagtgttcatggtgaattagtggtggcaaaaaagttggtactactgggagaaaaaaaaaaaaaggttaggtgaagctttttagccatagccaataatactactcaattttgcagagacagtgaaatgctgaaattgataaagagagaaaaaaagaagaagaaagaagccatgttttgaggaaggagacatgcatcatctcatccttttatgatttttttctacatcttcaccaaatccatagattctctctccctctgattttttggtaaatttggtcgctatatttgactacttgtactctgctttgagaagaaaaataaaaccatttttgggtgataggtgagaaaaaaatctaaatactttttttgtttcttcttttttagttatgttctgttttctcgcttgttgtttggatcaatactgttccaaggttggttttattttcccttctcaagttagtggaattgcatgtttgtgctttctctgttttttttatatctaatttgtaatcaaatccgttaattctcaaagtctgaatctttactttctattttagtatggtaataattggatctgctctatggtttctttctcttagatctgttgtttgttgctttttctttgtggatcaagaatggtttttgattccttccaagtgaataatgcaatatcaatatatcatgactggtttttttacttgattggaattacaggtgactgaataaacatctcttgtctcttgatggatctactatggtctggagattagttcgtttattgaactaatgttttagaca

SEQ ID NO: 1980 - DNA, 3000 bp, Unknown
  misc_feature (1)..( 3000): cDNA_ID_2148250_gDNA_ID_1620474_Annot_ID_158116 3000 nt of promoter + ATG
gctagctacacgaaacagatcgttgtgtagagtaccaatcacctacgggcaagtgcatggtacaactatatttgggccttaatgggctcaacatgggctataaactgagtttgagaaactttataggcctcaacttttgaatgtcaagcttttatgttttctttttctgtcttttctttcttttctttgatcgatcattttaccttagccattaagaacttctaaatcttttaacacacataaaacataaaggatcaagccttcgattgtaatttacctttatttcatttgtggaaagaaatcagcaagaataaagagtttttgtaaaagcaagtaacctgaagcaaaggatacttcaaattcgaaatgaacttttaaaagggtatggtttgcttaatgatggggataatgttaacttgactttcaaaatgggttataatgaaagtgcttaagccttgaaggagacagaaaaggttgggggaaaaagcattaataggcttagttggaaaaacaactctataaagtttaaatgattatttaataataacaagcttgaatctaaatattacatgcttcatttgcatgtctcatcatcacttgtttttatttttgataaaatcactttataccttttttcagtttctaaggtgcaatatgctatttgtcaccataaagctaggcataaatactaatgatcataattgatcaaattaaatatataatcagaaaagcatcactagaaaaatactccaaaattacttaaacatggattagttggagaattctgaaatattattaaaatgatgaaatacaaaaaaactggtgtggccaataaaaagtataagagttacatgtatgaaacattacacttttcaaagttgtacctctctaattagcaatggaacatacactttttttttttttttttgacaacttagtgtccagaccacacagtgatctgactagtccactgggtttaagcccgcgaccaggaatttttaaacatctacttaatggctccctggaactggtggtctgaggcgctagagcaaatccgcatgttaattctctggtgaccagaaatcgaatccgggtgtcggacgtctcagtcgaggttcctttaccaccagaccacgatacctggttggaacatacacttgaaaaagataagacagaaatcttaagactatacgagtattatgttcaatttaacatggggtgaaagagagatcatcataaagtattatttgtaacggataggtcatagttatagctataagatacgagctaacattaaaatggaaagagaaagaacaatatcaaacaagaaaacacagatcattcacgtggtatggtaaaaattaaattaatttatattttgcagtatcggatctgatcattcattgctataaaaactgttttcttttgtcctaatttaaaaaaatgtttcagctgtattagtgaaaaaaatagagaaagcaagccaaaaaaaaaactaaaaacattaactacgaattgtaaaatagtgtatggtaagaaactccacagagtgtagttaattctcgcccgttgcttcacggcgctcctgtgaccaaatctgacattatatagactcgtaaatattcctttttaggtttttgcattcatatttgaatgcagttgatttaaaataatttaaacgactagttgcctctaaatgtttgaataaattaggagtaattaccaactagtaacattctgtcacatttcccagagtcactgtcttaaattatgaaatactcgttattgagaaaattgacagataacaaaatggattagttatttggtttcctttttcttttcctttatttgggtgcaaaattagacagccaaaatcatttaaaaatgcacgtgtcaatatgtggccacaccatggatattttgcacggcttcattatttctatgaaaatagttttatttgttcttttttttaaaaaaaagcaagaaaagggaaaagagaataaagaaaaaaaactaggaaataaagaagagaataacatttgaaattttcttggtccgatttcttcactctcaaagcagtaaaattgaagaatatactactagttatgttagcaaatgaaatacaagacgattcaaaactaagtaatttaatataaataataaatcaaaagttgacaaaatgcggatattaaaaaatagcaataaagctgtagaactattcaattggttaatctatgttagtaaaaactgtgttacgtttttgtttttttttggttttggtcataataatccataagtatcaaacttaaagacgaatctgaaaatagccattactgtttttttttctctgaagaaaaagaaaagagtagagcttttttgtttaatataggaattaggaaggaggaggaacacaacaccacacttgtgcgcaaactttcacagtgtccgacgatctcaaagcccaaatatcaaagctcttctctctctctatctctccccaaaaattcgtagcttttttgcattttgcttctgcattcggctttggatttcataaagtgttgagatttaagagtgtatctcactcaatctctctgataagagctttcaagccacaagtaaaccgacccagagagtttaaaaaaaaagaagagtctttaatgcgaagtcgtttctaggtctgatctacagatcctggtaccctaattttcccctgccgcaacggtctcctccttcccttcgccgtcatttcaccggtggggttttacatctgaatctctgtggttgagagaaaagcaatcgactttagtgagtgttgagtttatatattggaaggtagaagttgaagtgcgtaactactgttgcaaaaaaaggtacaaattatgagcctttttgggttctcatttcttagatttgattatttttggtggaggaagtgacttgggtttcattcttctaaattctcaggtcgaaattgaaactctttagtgagtgatagagatg

SEQ ID NO: 1981 - DNA, 3000 bp, Unknown
  misc_feature (1)..( 3000): cDNA_ID_2148235_gDNA_ID_1620474_Annot_ID_158109 3000 nt of promoter + ATG
tttttttttttgccaatagttattcttaccatgatcttagtccaaatcgctcgtataacacagtaataaataaatacaaaaaaaaagaacaaagaaaacaaactagaatgcggtgcacactagaatgaaacattacaaaaaacgattgtgagcatctcgttaatgggagagattaatatatccggaacaaagcaataaatattttctcaaaaaaaagaagatataatcatctcaaaaaaaaaacaagataattcttttgacgtagaatatatagtaaataaaaaaacgtggaatatagcaatgtttcatatatatattcgtaaatcgttgatttttatgtgattggatggatgatgaagcaaaagtattatattcccttatataaaacgaagaatatcgtaaagaaccctcgaggcctaaaagatggttagggtatagactataggctatagtattaacatgtcaattgtaaatgtcatgaaactgaaaaaagaaatagggaaaagtgagtcaaagggagaaaaggaggtaggtctcttgccctataatatctgcatttacccacccatcatctcctataatataacccatttataactctccattttcttctttttttggtaaaagtttgaattaactcttcattttcattttaattaattcgctaaaaacataataaaaacaagaagagaatagatgatgatgatacagatgagtgactaaaatggaaatttatgcactaaaatggaaatatcccttggtccaaaggtctttccaccttcttcttcatagcttaatcaccatgattatgatcatatatatctttgaccaaccaacaagagtggagctctaactaatatgtgtaggtaccatcttacatatctccatatacgcatgcatatcattttcgaaccaatttagaaggtgatgtatataatcaaaagtatttaggatgatggtttatcgcgtgaacaccattttgtttaagtacgtggtcatcgcaaggtaaccatctttattttcttgggttgatcttcactagctatatattaaccaattacatatgtattattttgtactgaagaaaggatataatttgtaatcgccaaatgattgaattagtatttgctaattacaaaaatttgtagaaatcgcgataattatcaacttttttactatatcccatcattctactattacgcaatgttatcaattgtactagtttgtttcatccactatgtaaaatcattcaaaccctaaagtcgatgctcatcagctcatgtatatgtatgtatcatgtatatgtacataagatataaaacctttatagatgtgcatgtaaaagaatggtagatagtagtagtaggtgtgtaaggagaaagatctagggggcttcaaaaaaaggagagaaaaggacagagcatgtgaaaagagacagagaaacaaacagaggagtgaacagtcttactcttttttttttctatgcacttaatgaacccaaccctctctgtatatttctgattcttcacatgtcttcctcttcttttttattccgaaaacttttcttcagtaaaaaccaatgccgaaaaaaatacataataaaaacgacaaaatatctaacattttttatataaaaaggacaaaagtactttcacttcacttgcaaccaaacaaacctagtccccttctttatccaatggtctctcccctgctctctatttctcatctaaacacccttttctttctttcttatttaccattttgccaacttatgtaaaagatgttaagaagaaaatgtgaaaatttagtaaaaatctctcttttgtattgtcgtcagaaactgtaaaataatcttactctttttcaagtcagcatataagtttggtttcttctcccgagtcagagattcgtgcagtgatgatacaagaagcttattccgaattcttttcataaatactcgtatttccttcttctttttttttttcttttttttaacatctatctgttcttcttgcatctatctgattttcctctgtcttttagacagtaataacagagctcactaaatgtaataaataaaaaaatgagctcaataaaaaggtaaatggcactcatttttaggccatcaagtgttgggatacagctgaaattaaaaaggcgtcagctcaaaggaaaaaataaataaaaaagattcccaaaaatcaatgcacttttatagaaaaaaatacacataatttcaaaaaatacttaaattttgaaaaataagatgaagaaaggattgagaagagaggaaagagtagtcagagagacaggagcatcaagtgctgcagaagaagcaacaggaacactgggcctgagtctcttcagatttgccagtctttataggaccacactcttcttcttcatcccccttacatacattttatctatttttacattttacaatattggatattttaatgttgttttgattttacactacatggcaaaactccttaaaagctcttgtcctgatgtgattcttttttcttttcaacactgtctaaatatctctctcttctttgtgatcactctttgatttattaactttctgattaccattccccccaaaataaaccctactagagtgtgactaattgtatagtaatctctattgtgtaataatcttttatctttcctcaatacaaaaaagtagggtatatatataaaagagggagtggcctcgtgtagagaaagaacctagctagtgttcatgcaatttgcatctgaggaatatatgcttagaaagagagagagagagagagagagagagagagagagagagagagatatcaaaccagaggaaaagagtgacagagaaagtggtcatctttgtctgtctctgtccgaaactcaggagccctaatctctgaatccatcaagaaagctctttctcttccttcttttatgcttctgaatttgctacatatataaactatctgaagaaagctagagaataag

SEQ ID NO: 1982 - DNA, 3000 bp, Unknown
  misc_feature (1)..( 3000): cDNA_ID_2148215_gDNA_ID_1620474_Annot_ID_158103 3000 nt of promoter + ATG
ttctgatgaatggaccatctcgtacatagattctttatttactagactgatctctctctctctctctctcgtgttcttatctgttttcttctgattttctgattcgaatatttactttcatgtactgagacatgtcagaaaatatattcattaattaatgagctgtaaaatcccaaaatattcaaatttcttaaaagagaaacttgctcataggttaatcagtttgctttttgatcaaaagaaaaaggcaaaacttcatagattggtaagaaaattactacttcacttgtcccataagcaacacccttcctatatcttattaggcattaggccttaaaccccacaagcttcttctttcttctccttcttcttctttttctcttcttcaagcctcgatatacatcattgcagccaccatcatgagagtgaaagaaacaggaaagggttttgtggttatattaatggtgatgataccaatagtgagctgggttgatgcaacaagcaggcctattgcttccagtcacgtttctttttatccaggtttaatttcttatttcttcagagtctaatatattagaccattactatgtctgtatctatatatattgaaagggagacgtgtagatttgtaagtatgaacaaaaagacttctctgtttagtttctgtttgcaaagaaggttaggttcaatttcttacttgtttatactaattttatgagcaaatcaatgacttgtaatagtggctattttagactctaaaccgtggtcccaaatatttgcatgattaacggttaaacccaaacaaactatggttttagaaattactgttatagattagtcagtaaaaagaatcatagaaaatggaatacatgttcttattaatgtctaaattctttttcgttttcccaataataatttatattgggcctgcagagataataaagccgcaggctgcagaagaaaactctaggagacgcattttgaaccccaatgagaataaagaagagatagtgaaaagaagaagaagaataggatcaaagccaccaagttgtgagaaaaaatgctatggatgtgagccatgtgaagcaatccaattccctaccatttcttcaatccctcacctatctcctcattatgctaattaccaacctgagggttggagatgccattgtcctcctccttaactaatcattctctctttttgtattccttacttagacacagtaacatattatatgttcacaacatgtatctgtttttaaactattatcatcactcatatcagtaatgtagacttgtagtaaactataacgtcaaagattttttatcaaactcaagtaattttttcacagtgaaatagttttttttttctttttcttttgggtaaggtttggtatactagaaggggcgggccatttgtttgtagccataagggcgagtaatatttattttattgggccgggcctgacttttttgcgcttttactctcccggctcgtgtacttgtgtacggaatagtacataatataatatgttgttatattatttcataaaaattgtggaaaataaatttccaacaatttgtattccacaaatgttatcactcatctatatatacatttttgcatccactttgtaaaataatcctcaagttggatttatttacagtggctgccattggcatttaataattattttttataattagaaagtaaatcttcgaattaaatatttgacatttaactatcttcccaaaatctcttcacattaactacacaattagttactaaaataaaacttccaaaatatttaatatcatctaaacactacaaaattatcatttttgatattgcttttttcatgactataacaattcgattataagcatcaaaccgtagaaatatttgatagcagttaattactacaaaattacaaaatatttatacaatgatttataaacatatcataaataaaatcaacattaataaaataaataggtttttttacgggacgggtttgacaggatgttacttaataacaattgtaaactttaaaataaaaatattttatatatagatacaatttgcaaacttttttatatattaaaaaattaattgtcccgcggtgtaccgcaggttaaaatctagtggttctgaattttgatgaaaaaaataaaattaaaaatcgctataaattgttgtgtgatctttaatagtgatagtctgatagatagattgttagtaattataaacttgtgtgatagacaaagacaaagaaaatgaaagaaagtaacaaaaccattaaaacattgtggcagttaacaagaaaaaaacttggtgccaactaataataataccatttgttagtcaatacaaatcagtaattaaatagtttaatttctgatttggttttaagttttaactaaaaacacactaataatgagaaagaaaatcgctaataattaattaaaaggaatataaaaataggagtcagctgaaggagtagacagagagaacggaaattgctgcgttgggtttgagagttgcagtcggagagagtgtggaagacagacaaagagagagagaaagaaagagatccagagatattattttcccttttgatctttcttgtccaaagggaagacacagagagagaaaaagcgagcccttttctccttcttcctcaaattctcatctattcgaattttgcattcattagctttctttgtctgattgatctccgtcggaatcggtgttctttatgaacgaccctcccgattctaggtttttctcgctttctcccccttttttgttgattgggattttcgtcacattctagggattttaccttgtcttgtgccgcaagtttttgggttttctggggaatgttggtgattttgatgccaccaatctttcaaggagtctttgaatcaccggagctgatctcacatcgttgtcgaaaggatatctttctgtttcttgagctgaaactttgagagatt

SEQ ID NO: 1983 - DNA, 3000 bp, Unknown
  misc_feature (1)..( 3000): cDNA_ID_3409273_gDNA_ID_1620474_Annot_ID_158105 3000 nt of promoter + ATG
caaagacgagaaaggaaactgaacagcagggacttacattgccagtaccacattttgaaattctctctacagaggaataattcaggcgggccttgaagatatctgaagaccaaataaaaatagaaaaataaatgcttaagcgagaagcataatatatactcaaaacataccaactttcaattaattaaagttggaacgttgttatgttcttcatgttgaaaacgatgtgaaagtcaaacttggactattcatcccagagtactgtgtggtgcttgttaccgtatcaaataaaagaaaccaccacacatttctacataaaatgaacttaaggatagcaatgaagaggacactaagaaagctgactggattaccttctcttccaacgagagaggggtgggtactgttggagaaacagcggactgccacagcatggtcacgccgcagtaaagcggaaacatgtttcaactggtcagataacacaacaatcgtcaaaatagtgtttacaaagagcaacatacaattactctgctgtaaaagtagagtcttcttgtactaataaaatgaatagctaataccacaattgaatcataaagcgaagctactacattaatcacaattcagattacaaggaggttactaaagctctcaatagcaaaatgcagaattgcccatgatcaaattaaaaataccaaattcatgattagattaagtcaaacccggaaaacgaacctcagttcagaaaaaaatgattggcagagcaaaacacataagaacgaatgcataaactcagttttacaagatcaaaaatggtagtcaaaccacagaaaaaaatgaaaaatagagaaagagaaacctttttggaatgattgatgatacgagaagccattgttgtgcaatcggagctgcgtcagccgatccgaattcgcaactgcaaataacaaaaaaaatggtgggaatgtttgttagggggtttctcctttttccctcggcaactatatcagagatcgagatcgatgaatttgacttgtactcaatccaattttgaaacagtaaatatgtggatggaagataggattcgatctagaactcaccaagagtcagaagaacggtaaatcgcagtatagagagtgaaggatcacttggaagaaagctgggatttgatgatgatgatgaagatagttttgtgtttaggtttttcagaaatggcaaaatgctgccttacatgtaccagattgtatcgtaccaacaccaattctaccataaccgatataaaagtatttaaaccgactaattaagcttcacaaatttcggtttgtactttattatattgggccctattattattctctgagcttttgcgtctcaccaaaagacagagatcatcaggtgcgttagtgattacgtaggcatctaatgaacggcagggattagtcaaacttattaatgggcctaatctttggcccatcgttttccctcgattcctgtcacacaaaaaactcctagctcttcctctacctacacaagctaaatacatattttttgcttatcctaagcatcatgattatgttttgccctctccagctttttcttcaatggcaacagattctaagaaagtctcttgaggctaaaatcaaagcattttttgttgaagatagatagcaacttgctgcttcttcatactagctagttaccttcttcttactcaatgtgttttgcttcgtttcaaggattcttcatatcacttgtggaacaattacatgattaaacattcaacatagagagatagatgtgttaataagtaaagacattttcagataaaacgttcttatcagtcactttattcttctaatatcctcgttgtaatcgggaaaatgctttgtaacgtcaaaaagcaataaaagttgcaggagaaagaaagctttggaaaagaaaataaaataaatgaagaatattttctttgctagtcacaaaataaatgaagaatttatgttcctaatttcccactagatatttgtttatttatttttgccaaaatcaagttaagacaatgagctaagtgttggaaaaccttgtccgagccaaaagagtaaaaagaaagggaataaaggggtaaaaccggaaatccgaaaaagaaaaggagaagatttccaaaggagaaaaccctaaagacggagtatataaacaaggtaacgcgttttctctcagcctctttcggatattccaccagtctctcgcaatcttcgctcttctctttgctctctctctctcaacgcggttcagatccgagtttgggagattcaagctccctgaaaaaagccctttactctcgcttaccaactttgctccaggttcgcatcctatcggattgtctatctattatctcgatgtaacttttacgattcatgattgtttctttacttttggattgttctgatttgtttttttgtgttttccgatagatttggtttcaactttgttgagttgatttggaagttttgatttttcgttacttcaagatcgttttttttgctgtggaagtgctttcgtttttgttctctttattagattctgagctgctgatgatgacgattattaaatttaggatctacacatctgtagatttgttgatgggtttgtagattttgttacggctaggttagtctctcaatagaatgaaatgaatcgtcttcaaagctcagatgttcttgtcttaacactcacttggttttgtctgattgaatgtttttttttgtaatttggagaaataggttgagtggtgtctatgtttaatagataaccatatgtgcctttatacattttctccgcacatcatctgaggcagatattaatgcttgttttcctctctttatggacttcgagtttggctttcttgtcacatttcctcctttgcaatcatattattaacgatatcaaaataggtgttgtctctcttccttttgatatgaaatctgattgtttttgttctttttatgtagcatg

SEQ ID NO: 1984 - DNA, 3000 bp, Unknown
  misc_feature (1)..( 3000): cDNA_ID_2148671_gDNA_ID_1620475_Annot_ID_158136 3000 nt of promoter + ATG
agtgaggatagtgttgagtttagttacctgtacagtatttgatccaaggagaatgaattcagcggcatcatagccagtttcaactcctccaatacccgaaagcgagcgatcctcactaaactcagatttcatcattttggcaatgttcataacttttgccagtgcaattgggcgaacggccttataagagtatccccctggagtggagtaactgcaaaacactatcaacgttagctattcttgtaatgccattacaagatttgccaaaacgtttgacattataaaagtgctatctagctaacccttcaacgcatggctcaggacgcaacgtcttcatatcaattcccattacactcatgattgtattgatcgctgcaattccttcacatccggattttagtgacaccctagcaggctattcaaaagaaaaagcaaaacggacatggtcaaagcagagcaaaacagagtaacaataactcagctttaagtagggagcttttcaataaacttgcatcaaagtttttttttcattttctacaaggataggctttatacaaaatggttgaaaaaccaggaagcaaaaaggctgagagaattagatgtcacacctcagttatgtcagtaatattaggagtcatcttagcccatacaggaactgtagctttagcattaatccatccgcaaacctcgtcgagaagcgcacaatcttgtccaacagcggcacccattctgcgctctggcataccatgaggacacgagaagttgatttctaaagcatcctacacaacaatcatccagaactgtctcttcaacaatgtatactaatatcagacaaagtgaaagagaatctaaccacaaggaagaataagaatctgtgttttagggaaaactcacaacaccagtttgctcaacacggtcgataagctcttcccaagcagttttgttatattcctccatgactgaagcaatcagaatccgatcaggatactcttttttcaaccgctcaaactctttgagcatggtttcaagaggtctgtcactgatgagttctatgttctgccacccaattacatctgttttggctgagccattggatccggttcgtagccgagcatatctaggtgtcacgttgataactttggatgcatctaaagatacctaaatcatccaatcacagattcagacgaaactcaatatcatcatcatcatacacaaacacaaccaaatcctatgttccaacatagtcaacgcaaaacagactcaatcatcatctactctaaaattgaaaaagtcaaatctcaagagcttacggttttggcgatgacggccccccaaccttcatcaaaggctctcttcatgacggtgtagttggtacccggtggacccgacccgatcacgaaaggattgggcattttcaggccatttacagtgacactgagatcaggctccgattcggcggcggaagagatcttaagtccaactctagtcggcggtagaaaactccggcgagaggatggatcgaagtcagctgataaggtggttttagaggagagtccagagaagcgattcaaggcgaaactcatggaagccataattagagagatcaatctggaaaattggcagaagtgatcaaatcttgagacgtgaaactcaagaattatgagagagagaagacgacacgcaacaaagtgtgacgatttcgaaatatgtgagagttggtgatcaaatcgaagaacaaaggaaagaacttaagaagatagagatgtaagagaagagtgtgttgtaataattggtcggttcttcaacttcatgccacgtgaaaataattgacgtttttagttaaagttcataattagttaataatacattaatcacccaaataataatagacccatcttccctaatccataatatttaaaaatatattagtttagttttaatcaatgtatttaacagttattttcttctctatcttatctccttgagttatttttaatttttttttgtccaacggagtggatataacttaagattctctgtctctatcaactaatgcttgatttaccaacaaatttcggaaaatggatagttttagaattactcaatttatatgtcgactacgtggaaattgcgaacacgtaacgtaacggatccaccgtgaggttaaggttgttttctagtgtatacgattcttgagcccaagtggggtaaagagcccatgcgtcacaaaacaaacaaaacgtttcataaataatacgtgtaagtgggaatggacacaacatcagttggtggctctcaacgtttctcttccttcgttagtttgactctactttttctcgttagtttgcgtaaagtaggcttctaagattagttaaaaaaagttaaaaagttaaaaagttaaaaacctagagaccattctagattggtaaataactaaatatgatgtaaagttttagaccaaaatggcaaaatactatatacctaatcatccagtaatttctaaaaagtttttgattgaataagaaaacagaagagaaaagtatttggtttagactttagagttttaaggactgcaaggattttactatcgaactttctagttcaggtaattagatagtgatattattgtgttcgatatttcaatgacgctacaaaaagaataattcgtctttttttttttaaaatatcgttattgtacaaactacaaacgaaacgaagaacacacaacataaacacggcctcaaataatttccatggtctcaaaatatttaaacgaaaaatataattttctgagtcctttcatttattattataaataatcaaatccgactctcattatttctcaggaaaactaaaccaaagtctgtttaccagtaatatcaatcgatcgccattctcgacatttctctctctcaagctagtctaaagtttcttcttatctccttcctccgaccaaaacttcgacttctctcttattttcaccctcagagagtaaccatg

SEQ ID NO: 1985 - DNA, 3000 bp, Unknown
  misc_feature (1)..( 3000): cDNA_ID_2148461_gDNA_ID_1620475_Annot_ID_158147 3000 nt of promoter + ATG
ttttagaagctattcaatgtccgctctgcctccaaacactgcaccagttactggacccataaaaacacagagctctaaaccatcatttgatattgaagattgggacagttactcaggccaaacggtacgaaacggtcagaagtctgggactgaagagctcttgtcttttcggggtgtcgcattggagcgggataggttttctgttcgttgtggactcgaaggcatctgcatccctggtagaaggtggaggaggaaactcgagatcattcaacctattgagataaactcttttgcagctgactgcaatacagatgatcttctctgcgttcagataaaggtttgtctctgcatctctgttaatttttggtgttattgtggtcaattttttttctgggatgcatcctaacttaccttttttactggcagaatgtggctcctacccatgctccagatattgtaatatacatagacgccataacaattgtttttgaagaagcagggaaaaatgcttccccttcttcagtaccaatagcatgcattgaagctggaaacgagcacagtttgccaaatttaactctcaggttagctttttttcttaaattcctcgtaattattttattttgtattgaaattctcccatcaatcttcttgataaaaattgatagatttagatatcagcattttgctttagtccagtaagtctcagaagtcttcagtgatgtccaatacaaaataacccataatattaggtaatcttgggtagtgaccaagaaaccatagaacaagttattgaatctaacaagtctctgagagtaactattctcaacaagcaccgtggtttggaggctaaaacagctagaataccctttcaggaacattatagactgcagttacccacccttaggttttcttgcaatctttcaggaaaggtgaggagcactcattcatcgtaaagcctgcgttttctgttgggagtaatctgaagccctctgctgcacgaaataaactcaaatcatcgagtttgtctcttccaactgtaaattttgaaagaaaagggagcggtttaagtggtgatcagtatgcggttatggtgtcatgtcggtgcaactacacaggtagatccacattaccgtggtttgtagccatgtttttttcttttgtccattcatatctatagctgtttcatcaatgctgttttatgttggactcagaatcaagactgtttttcaaacaacggacaaaatggagaccacgagtttcgagagacctgatgatctctgttgcgtctgaaatgtcaggagagccttgtggtccccatgggagagcctctcaactacccgttcaggtcattctctctctttatctctctctgacattccctagataataaatgggacaatgcatgaactaatggaaggagttcgcatctgcaagtgacagtgactgctagtgtttacccaaatgactgaaggtttaattagatgttgttgctaaattgtggttgcaaaagttgctaaaaactatgcaactctggcttcgtatatatgaataagaaaccatgcaacagttacaaagccacctatttgcaatgtggtcatattcttcaaaattagccaatttctaaatctgcaaataccaatcccaatggcatcttttattctacctcatactttttctctactggtttcagattttaactcttcaggcatcgaatttgacttcagaagatctatctttgaccgttctcgctcctgcatccttcacatcacctccaactgtagtgtccctaaactctacgcctacgacccctataagcccattcctaggattctctgatttcaccgagagagtacaaaacgagaaacgcaacactacagtgcgtaaacagcaatcgttacccccaattccactggagacaaggacagagaacaacacaaatggtgaatcttccaatccttcagatgttgttccaaagagcggcttaggttgcacacatctctggctacaaagtcgagttcccttagggtaaacatctgataataatatccaatgagcttctggtatgggtttaccattataaattgataacgatattcctaaatgcatcagatgcgttccttcgaaatctacggcgacaatcaagctagagctactccctttgactgatggcataatcactctggatactcttcagatccatgcaaaggagaaaggttagctaaaaaaatctctagtctctcagcaaagagactataaacactttgctgcgtcttctttctttccgtgaaaacatcagtggttccatatgaagaatgcaaatctcgaagctttaatatgttttggagtgaatcataatcataaaatgttagatgctcgtgtttaatgactgaaacaccaatgaacttgtgtgtgtgacaggtcgtagatacattccagagcagtcactgaagataaacgcaacttcaagcatttcctctgggattttctagtcttttacccaatgccacttttgcctttttctttagagccaagaagagtcatcaaacacagagcagttctatcttcagcatctccatagagactcatccaaagattgtgtgttgaaaaatcgattttggtttccatgtttcgaaggtttgaagaaaagttgttgtaataccccacttgtgctgaaccatgtgtttgcgttctttagcttgctttttgtaattgattgattctgaaattcgcatagagacagaagacgcaaccattgttatcgaatttacatttgttatttgcttataaaatcagataattaaccaaaacttttcttcaacaaatccaagtatggctaacaaatgaaggacaaaaagttaggtgcaccggagcttaatggtgcacccgaatgcaggggataacagctctacaaatctgaagccattttcacggtgaccccaaagtcgtcgtggaggcaaaaaccctttacctccgggatcaaaatcttggggagagacgaag

SEQ ID NO: 1986 - DNA, 3000 bp, Unknown
  misc_feature (1)..( 3000): cDNA_ID_2148473_gDNA_ID_1620475_Annot_ID_158150 3000 nt of promoter + ATG
gagactcacacgtcggaaacggcaaaggttagaccggtgagaggatgaggagctttgggaggagcaggttgcggagggggaagaagcatgagtttatcgataaaagcgccgaaatcttcacggacggtcttcttcagctttttggtaagcataagaatcccagcgagacctaaacctagaagaacccagagattcgcagcttgagacgccatcggtgacgtttttgttctagctgctgctgctgctgcttaagataagagagatagaccctaaggagaaggacgccaaagagtttttgtttagtgtgttgcgttccctttgagtttttattctttttccttcttcctttttttaacatcactcgagggtttattttattttcgttttgtcaacagttttttattcacgttgtaaaacaaaaaattaattttattaattgtttcttgtttttacagtttattttattaattcaattggtataaaatatggatacacataacaaacattttgccgtattttcggtttcttgtgtgtgtccacttgttcgataattttgcttcgtcgttaggaatcttctcctcttatgttatgaggatgatttgtggttaattgttttactttcagaaatactagtggaaaattaaccacgaatgtggcacactcctggccagaatcatattgtgtttgcctcaaaatctgatttggtcaaattattgtccaaagactgactagtataaagacgtattgatgaaataatttgaagcaaaaactcaatatgatagaacaacgtttagcattttaaataaaaactctaatcaagtgaacaactccattttacaccaaaagctgtgcatgtgtgccattctatatgcttatcttttactattgccattgtaattaatctccttcataattctccttatcaatcattattatttctcaaataattactttgacaatgactacattcaacatgttatattttccacaaacaatgattccgattcgacgaacaaaatacaaaaatttaagtctaaatacaaataaaagacacacacatgaaccgacgtattcatcctccaccaccgctgcatataccggttaaagataccggaaatctacaaagggacgtggctaccggcgttccttctccggtaaccacttcagctgaagccggaggaagaacccttccgtcagcgaacaatgcccgctcccccatcaccggctgctgatcttggtaccgtgccaccaccgcatcctctagctctgcctcggcggagttgtaaacggcttcatctccaaacctccgttccacctctagatactccccgagcgatgaccgctttgaatctcctgttccacggtggattccatttccggcggcgtcgtcatcgtcatctcggcaaaaccgccaccatttacggcggcgatgcggctcaggctcagccgaatttgaaggaggacgctttctctggtggttgcgtcttgcattggagctagaagctcgtgagattgcgacggaaggtgacacgtggcggcgtgaagaggctctaaatggcatcggcatagttgcagtgaaactaaatcccataagcgttccaagtgtgatgcttctgtcatggaagaacgatcctgttgactaaatcctcacatcaccaataaaaaaaccaaatcaagttctaacaagtacatatatatgtttctgggcagttctgaaaacataacctttggaactttaaactagttttctaattaaaggttgatactttatagcataaagctttatgggtagcttagaaaacacatgaagagcttgatctttaattagattatctattaagtataagattgcaggaactgacctcagtatcaagatcggaggaagagacggaggagatagttggagaagatgggacatgaggatcttgcatctctgtaatcgctggtttcaaagggtttgaagatgtgggagattgtgtcactgaattaaaacgaacgacgtcggattagggagtttcttgatgagaggaaaaggaaagtgtttttgtggatggataggtgaagaagaagaaagtgacaaatgatttgctttttgaaatgattgtgcttctttaagctaaagtcctcttggccatctgttacactatttctttccatgtctcagagagctttgatatttttgataaatttgatttaattgtttctagttatgggaataatcaaaatcctttacagagacattttttttgtaaactttgggtaaaagctgagacatgttggatggtagcaaattaaaatttacgaaaagaggataaattacaacaaagtaagcttttataggtactattgattttttcataggatacctgaaaaagggtagagaaactacatctaaattcacgcgaatactctgttacgatcatgtatagagtttttttttggggtcaaactgaatatgtttagagtatattttatttattttcttgttatctgatgatatctttgtctttctcttattgtcaaaagcatataatccgacttatcaaattttttattttataactgactaatcaaatatttttttacttaaaatattattgataattagaaaattagatccaaattctacatttgttcttttctctaatctctatagttttggattttagttggtaacttttgaattcctgaaagtaaatttggtaacttttgggtagtaatttgattttcaaaaagtttagaaatgcattaaagtgtaaaaaacgaaaaacaaaaacccccaagataaatagttttttgtttggggggtaaaaatgataaatagtttgggatgtggatgacgtcaacattgatcagttacgagattacgattttataactcttttaaccaaagctaatcacttcaccctctgttttgtttctccccaatcaaaaatctcaatcccaatcacttcgcttctaatcttaaagcctttaatttagtcttcgagccctctaatg

SEQ ID NO: 1987 - DNA, 3000 bp, Unknown
  misc_feature (1)..( 3000): cDNA_ID_3065443_gDNA_ID_1620475_Annot_ID_158152 3000 nt of promoter + ATG
ttcccttcaaataagaaaaacaaagacgataatcagaggattaggatttggagacaaaacagagatcatcattgaaaggaggaagaagagaacaaaccgttcttgtcgggaacagacaaagaggtgatggtggtgccgtagtttgagatcttgacctgcatggtgccattgttgagctcgaagatctctggagtgtttttgctctgatccgccattagagggctcgaagactaaattaaaggctttaagattagaagcgaagtgattgggattgagatttttgattggggagaaacaaaacagagggtgaagtgattagctttggttaaaagagttataaaatcgtaatctcgtaactgatcaatgttgacgtcatccacatcccaaactatttatcatttttaccccccaaacaaaaaactatttatcttgggggtttttgtttttcgttttttacactttaatgcatttctaaactttttgaaaatcaaattactacccaaaagttaccaaatttactttcaggaattcaaaagttaccaactaaaatccaaaactatagagattagagaaaagaacaaatgtagaatttggatctaattttctaattatcaataatattttaagtaaaaaaatatttgattagtcagttataaaataaaaaatttgataagtcggattatatgcttttgacaataagagaaagacaaagatatcatcagataacaagaaaataaataaaatatactctaaacatattcagtttgaccccaaaaaaaaactctatacatgatcgtaacagagtattcgcgtgaatttagatgtagtttctctaccctttttcaggtatcctatgaaaaaatcaatagtacctataaaagcttactttgttgtaatttatcctcttttcgtaaattttaatttgctaccatccaacatgtctcagcttttacccaaagtttacaaaaaaaatgtctctgtaaaggattttgattattcccataactagaaacaattaaatcaaatttatcaaaaatatcaaagctctctgagacatggaaagaaatagtgtaacagatggccaagaggactttagcttaaagaagcacaatcatttcaaaaagcaaatcatttgtcactttcttcttcttcacctatccatccacaaaaacactttccttttcctctcatcaagaaactccctaatccgacgtcgttcgttttaattcagtgacacaatctcccacatcttcaaaccctttgaaaccagcgattacagagatgcaagatcctcatgtcccatcttctccaactatctcctccgtctcttcctccgatcttgatactgaggtcagttcctgcaatcttatacttaatagataatctaattaaagatcaagctcttcatgtgttttctaagctacccataaagctttatgctataaagtatcaacctttaattagaaaactagtttaaagttccaaaggttatgttttcagaactgcccagaaacatatatatgtacttgttagaacttgatttggtttttttattggtgatgtgaggatttagtcaacaggatcgttcttccatgacagaagcatcacacttggaacgcttatgggatttagtttcactgcaactatgccgatgccatttagagcctcttcacgccgccacgtgtcaccttccgtcgcaatctcacgagcttctagctccaatgcaagacgcaaccaccagagaaagcgtcctccttcaaattcggctgagcctgagccgcatcgccgccgtaaatggtggcggttttgccgagatgacgatgacgacgccgccggaaatggaatccaccgtggaacaggagattcaaagcggtcatcgctcggggagtatctagaggtggaacggaggtttggagatgaagccgtttacaactccgccgaggcagagctagaggatgcggtggtggcacggtaccaagatcagcagccggtgatgggggagcgggcattgttcgctgacggaagggttcttcctccggcttcagctgaagtggttaccggagaaggaacgccggtagccacgtccctttgtagatttccggtatctttaaccggtatatgcagcggtggtggaggatgaatacgtcggttcatgtgtgtgtcttttatttgtatttagacttaaatttttgtattttgttcgtcgaatcggaatcattgtttgtggaaaatataacatgttgaatgtagtcattgtcaaagtaattatttgagaaataataatgattgataaggagaattatgaaggagattaattacaatggcaatagtaaaagataagcatatagaatggcacacatgcacagcttttggtgtaaaatggagttgttcacttgattagagtttttatttaaaatgctaaacgttgttctatcatattgagtttttgcttcaaattatttcatcaatacgtctttatactagtcagtctttggacaataatttgaccaaatcagattttgaggcaaacacaatatgattctggccaggagtgtgccacattcgtggttaattttccactagtatttctgaaagtaaaacaattaaccacaaatcatcctcataacataagaggagaagattcctaacgacgaagcaaaattatcgaacaagtggacacacacaagaaaccgaaaatacggcaaaatgtttgttatgtgtatccatattttataccaattgaattaataaaataaactgtaaaaacaagaaacaattaataaaattaattttttgttttacaacgtgaataaaaaactgttgacaaaacgaaaataaaataaaccctcgagtgatgttaaaaaaaggaagaaggaaaaagaataaaaactcaaagggaacgcaacacactaaacaaaaactctttggcgtccttctccttagggtctatctctcttatcttaagcagcagcagcagcagctagaacaaaaacgtcaccg

SEQ ID NO: 1988 - DNA, 3000 bp, Unknown
  misc_feature (1)..( 3000): cDNA_ID_2148477_gDNA_ID_1620475_Annot_ID_158151 3000 nt of promoter + ATG
aagggaggacgaagagattacagagatggatggttgatattttttggggcccataggcttttgcttctttagtggcgcgtgtttctcaccgcccaaaagacatgcgtgtagacataattgccatcagaattactcaaatacactaattgctctttttttccaagttcatgtgaacaatgggagattcattcgctgcacaattcacaatttcacaaatgggccaaatgtttagaagatatgaaaaaataaagtaactttaatataatgtaaacagtttggttttattattctcccccaaagagataaaattaaaatcactctttttccagcccagtgaatcaaatgaaccggccctttattcccatcatctaacacctaaaacgtccatctataaactcaagctgaaaactcaaacagcatcgtgtgattgtacttctcaccagccttaaccacaacagacgggaaattcgactggttaatcgcgttcgggaatccctgcgtctcaaggcacacacccgcatgtttcccgtaaaccgcattccctttcccaaccactccattcacatagttcccggtataaaactgcattcccggcacattggtccacaagttcagtacccttgagctagcagcatcactgagcttcgctgcgtgtttcagcccctccttctcttgatcaggacagtccaacacgtagttatgatcgtatccgataccaacctctccaatagactcgcctatccgcttctcctcagtgaaatcgaaaggagttccctttacaggcaagatctctcctgtaggaactgtgtattcgtcaaccggcgtgatatgagacccccatatctgaatcttatggtctagaatgtttcctgagtcatgacctgctaagttccagtatgtatgttgagctaagttgatgggagtatctttgttctctggaacagcttccatgtcaagtctcattgtcgtggctgacgtgagagtgtatgtcgccgtgacagaaaccgcaccagggtaacctgtggaggggaaccgcaaaacattatatagctaatctaatcccacagaaatcaaatgctagagaaaggatatgtcattaccttcttctccatcggcactgtgatatttgaaagtgatgaaaggtttttcgccgtctctcttgtgccctgcaacttcccatatcttcttatcgaaacccttgttaccacctgtacagatagagtaacattttacggtccaaatcctatttagttcacagaaagttatagagaaagtatacagagaagagaattgtttatacagaccgtggagactattaggaggcttgttgataggcaaagtgtagttaactccattgagactgaattttccctccttgatccgatttgccacacgaccaacaatgcacccaaagtatggtgcaagccctttctgtaacaatcatattcatagataaaacacacatattcattaacattgttacaaagtccatcttattttgatagttcatcacaaagtcattcaacaaggtacatgaatgaccatatacatttcttaaattatgattcagactctattcatgagatccagaggcagtgattagagtttcgatcagattgattgaatctatgtcgagatcagttcaaggattaggtgaattcgagagaaattaccacatatggatccaccgagtcgaatccgagaactacatcccccagtttcccttcaaataagaaaaacaaagacgataatcagaggattaggatttggagacaaaacagagatcatcattgaaaggaggaagaagagaacaaaccgttcttgtcgggaacagacaaagaggtgatggtggtgccgtagtttgagatcttgacctgcatggtgccattgttgagctcgaagatctctggagtgtttttgctctgatccgccattagagggctcgaagactaaattaaaggctttaagattagaagcgaagtgattgggattgagatttttgattggggagaaacaaaacagagggtgaagtgattagctttggttaaaagagttataaaatcgtaatctcgtaactgatcaatgttgacgtcatccacatcccaaactatttatcatttttaccccccaaacaaaaaactatttatcttgggggtttttgtttttcgttttttacactttaatgcatttctaaactttttgaaaatcaaattactacccaaaagttaccaaatttactttcaggaattcaaaagttaccaactaaaatccaaaactatagagattagagaaaagaacaaatgtagaatttggatctaattttctaattatcaataatattttaagtaaaaaaatatttgattagtcagttataaaataaaaaatttgataagtcggattatatgcttttgacaataagagaaagacaaagatatcatcagataacaagaaaataaataaaatatactctaaacatattcagtttgaccccaaaaaaaaactctatacatgatcgtaacagagtattcgcgtgaatttagatgtagtttctctaccctttttcaggtatcctatgaaaaaatcaatagtacctataaaagcttactttgttgtaatttatcctcttttcgtaaattttaatttgctaccatccaacatgtctcagcttttacccaaagtttacaaaaaaaatgtctctgtaaaggattttgattattcccataactagaaacaattaaatcaaatttatcaaaaatatcaaagctctctgagacatggaaagaaatagtgtaacagatggccaagaggactttagcttaaagaagcacaatcatttcaaaaagcaaatcatttgtcactttcttcttcttcacctatccatccacaaaaacactttccttttcctctcatcaagaaactccctaatccgacgtcgttcgttttaattcagtgacacaatctcccacatcttcaaaccctttgaaaccagcgattacagag

SEQ ID NO: 1989 - DNA, 3000 bp, Unknown
  misc_feature (1)..( 3000): cDNA_ID_3065439_gDNA_ID_1620475_Annot_ID_158154 3000 nt of promoter + ATG
agcctatttacgaagaggaaccgcaagagaaatgttaggcgattgcaagggagccatagaaggtaagctttaaagaacataatctgattgttttttcgccttgtagaatctggcagaatataacataaactctgcagatttcagatacgcacttgtgctggaaccaaacaacaaacgagcgtctctctcagcagagagactgagaaaattccagtgagcttcttttgtccgtacctcaccgatcattgagaaaacgtttgttccttagaatttgtccaagagtataggccaattttgtcaacacttgtcttttgcgtctgatatttaggcattttatctagagataccttttgcaagtccgccgagaatggaaaattataatatccgatgtttattttaaacgttctctaaaattggatatcaaaaagtaatgttaatcttaaacaccggataccggcattcccggtcgacttctagtcagcgtagcgtcaaaaataaggtcatgtctttaactatcttgtctttatcattttcttttctcgcacgttatctcctccccacgactcaaaaaaaataaacagaaaaaaagaggagtagaaaccaaagagacctgccctaatatttagcgatgatagtttgaacggaacgaaatctgacgaaagaaactaaagagacctttgaattatcttcacgggtgagttggttcgtttaaccttttttctttatctcggttgtgcttttccccgagaattaaacgtgtgttggttgcagcgttaacaaaaaaaaagggttgtagaaagtgagtaaggaagaaataatcaggaacattaataaaggaaatgacaacggcgtgtccggcgaggacaagctcactaatggacgatctcttgggcctccttagaatccgtatcaaacgtggcgtcaatttagccgtccgtgacatcagtagcagcgatccttacgtcgtcgtcaagatgggcaaacaggttaatccattcatcattttacaacttcacatgcaatttcattacatcaaaaacattctcaaattatcatattaaatcttacagaaattgaagactcgtgtcattaacaaagatgttaatccagaatggaatgaagatttgactctctccgtcacagactccaatcttaccgtcctcttggtactttttacttactaaaacatacattaatttccttatcataagatgtttatattgataaaactataatgttatatgtagacggtgtatgatcacgacatgtttagcaaagacgacaagatgggcgatgctgagttcgagataaagccctatattgaggctttgaggatgcaactcgatggacttcctagtggaaccattgtgaccacggttaagccaagtcgtcgtaactgtctagccgaggagtcacgtgtcacctgggtcgacggcaagctcgtccaggatctcgttctcagattgcgacatgtggaatgcggagaggtcgaggctcagcttcaatggattgacctccctggctccaagggtctatgaatcttttttcttttcttatttaccgttactttgagttgttttctttcaaattgaactaaaccaagtaacagcatggaaaaaaacaagtaatttcaatcttgaaggatatagtgaactagaaacacgtattaatccatggaaatataaggattaagaacgttgagggaagttttgttcccatatggtgatcgagtccaagtcgagtcgtggtggtggatatgtaaatgtggtgtattgttgatgtgtatgtatatttgggctagctatgccttaaataaggcatttacacgaacaactaatacagatattttatttatttaattatcgttccatatacttatgaatggtagattgttttaacacatgtgatgtactaatgtttataggtaaaaagtgaaaaaaagaccagcatattaccatttaccatcgacatcgataggccttttttaaaccattgacattggaggttttatgtgtacgttactgaagcacaacttatgtaatttttgtgaacaagatttacttgtacattagcgctaattaaggtcataaagaataatgatgaagaaagaataaaatatcgaagggaaaaagccagaagccacaaaagggatggtaggtgaagagaatccagatgtacactaatgagtgaagcaccatggttttataacgacaaaacacgtgagccataattgtcctttactatgagtggcacggcgactttacaataatgtgtcaaacgaccgtgacaagagtgaagtgtagtactagtatgtgatatttttctctatttaataaagtaaaagattcgactgtagtatgatagtattgagatatattctaaattatgtataaagtttgatagatcccaagggacccaaatctcgttccccaatgagcgatctagagattcctcttccaccaactccccaaagtagtcaacatttttttaccaaaacaacgatttatttgtagaataaaatctgtcaacatatatattgcatataaatgcaattgcaaatgtagttaaaaatatatataaaccataacttaaaatgagtgacagcacaacattaactaaaatacgcttattattattaccggttttgaccaaaacaaaaaaaatggagatatttgtttaattaccgactgatttgattttacagtctgtaaaaaaggccgaagtcgaaggtaacgccaccgttttccacctataaaaaagggcgcgcaggcaacatcacactctcacactcttttcgctctcagatctgaaaccttatctgaattacatttccccgattcgacgttgtgcgaattgatgcagcagagaggacgatccgtcaaccgcagatcacgaagcttctctagatccagactcgccgtcgaaggccactgaattactctctcccctctcttggcagatcttcttcttcgttttttcccgacaaacgacatttccgaa

SEQ ID NO: 1990 - DNA, 3000 bp, Unknown
  misc_feature (1)..( 3000): cDNA_ID_2148485_gDNA_ID_1620475_Annot_ID_158153 3000 nt of promoter + ATG
tcctcctatcagtatctaaaatttcaactgtctactggttggttcggtttcaattgttttcagagtatagttttgattacttgcatctttgcaggcatcgacacagttggcggggtaagagtgcctgctggatactgtggcgttcttggattcaaatcttcttatggggctatttcaaacaccggaatcataccagtatcttcaagtcttgactctgttggtatggatatataaatctttgaattatactgtttgtggtggaatgatttggatcttatataggctaggtttcaattgttgtataatcacattgcaagatttagatgcctttgttcgtatgactaatttatatttaggaccattaaatgagcattacgttgattctgatcaatagattttggcttcaggatggtttgcccgcgatccaaacaccctacgtcgtgttggccatgtactcttgcaacttccatttgccactcaacggaatccaaggcaaatcatactagctgatgactgttttcagctgttaaagatccctgtggatcggattacccaggtggtgaccaaatcagctgaaaagctttttggaagtatgccctttactctccctgaagatcctccagtctctgttagaaattctgattataatagcattatcttgttttatatttaggacaattgctaaagcatcagaacttggagacctattttgaaactaaagttcctagcttgaaagagttcgctaggacaaaagccattgctaacacgaaggtctcaacatcgagactactggcgaatgtgatgcagctccttcaaaggtgtgcctattgtttattcacctacagaggatgaaaatatcttagttttgaacactctataacaatattggcattgtaggcacgagttccttcaaaatcatggggattggatcaacacagtgaagccagccattgatcctgtgattttatcacaagtgtgtgagaacccagaactaaccaatgaagagactgagaacctgaatgctatcagaaacgagactcgagtggctattggttcacttctcaaggtattcctgctcttccatgacatgtccacaacttgagcgagttagtttatatgtctcttgactaatctctaatggttcccaactctgtaacgttatgtatcaaggatgatggcattctggtaattccaacattgccagctgttcctccaaaacttggtagcaaggagataacatctgaagactatcaaaaccgagcttcaagtctgcttagcattgctagcatatcaggatgttgtcaggttaaatctctctctttctctctctcacctgccatgctagtaaagttcccctcacacatgttaaaagcaaccactgaccagtcagtgttagcaaaaccaatccacagtatatgtgtcttacatttatcgtgctgatgattcaggtgactgtgccactcggacatcatgagaaatgccctatttcagtttctttcataggaagacacggtggtgaccgctttttactagatacagtgcagacaatgtatccatctttgcaagagtactcgagtattgttaccgatcccaaatcttctaaaaaggctatcaccaaagaagagtcagccgagattgccaaagagaaggtcaattaatatccattgcatgtctcattttcttaatggcattatcatccataatctaatgtggttattatatctttgtgtcccgtgattatgtaaaccagggtaaccaagcgttcaaagagaaactatggcagaaagctattggtctatactcagaagctataaagctaagtgacaacaatgctacctattacagtaacagagctgctgcatatcttgaacttggagggtaaatgtttctcagatccttaaaaatactttttagtgagcaaatctttctatgtggcattgccttgacaaatcatttacatacagctttcttcaagccgaagaagactgtaccaaagccatcaccctcgacaagaaggtaactttcattaaaacacagaaacaggtttctcttgaaaaaaaaacactctttactttgtaagaacacacaacacaaagatcgtttttgatttctttcagaatgttaaagcctatttacgaagaggaaccgcaagagaaatgttaggcgattgcaagggagccatagaaggtaagctttaaagaacataatctgattgttttttcgccttgtagaatctggcagaatataacataaactctgcagatttcagatacgcacttgtgctggaaccaaacaacaaacgagcgtctctctcagcagagagactgagaaaattccagtgagcttcttttgtccgtacctcaccgatcattgagaaaacgtttgttccttagaatttgtccaagagtataggccaattttgtcaacacttgtcttttgcgtctgatatttaggcattttatctagagataccttttgcaagtccgccgagaatggaaaattataatatccgatgtttattttaaacgttctctaaaattggatatcaaaaagtaatgttaatcttaaacaccggataccggcattcccggtcgacttctagtcagcgtagcgtcaaaaataaggtcatgtctttaactatcttgtctttatcattttcttttctcgcacgttatctcctccccacgactcaaaaaaaataaacagaaaaaaagaggagtagaaaccaaagagacctgccctaatatttagcgatgatagtttgaacggaacgaaatctgacgaaagaaactaaagagacctttgaattatcttcacgggtgagttggttcgtttaaccttttttctttatctcggttgtgcttttccccgagaattaaacgtgtgttggttgcagcgttaacaaaaaaaaagggttgtagaaagtgagtaaggaagaaataatcaggaacattaataaaggaaatgacaacggcgtgtccggcgaggacaagctcacta

SEQ ID NO: 1991 - DNA, 3000 bp, Unknown
  misc_feature (1)..( 3000): cDNA_ID_3065447_gDNA_ID_1620475_Annot_ID_158148 3000 nt of promoter + ATG
gtaattctttcatataagtgatctggcgacactcttattgattgtaaatgcatgctgagtactggctaccatgcccatgtcttggttgagatttctcttattccattacctgatttcctatctttttctcttccaaatggttgctgaagctgagacatttaatattaattggttgcttttcactgagcagacccctaaagctttattcattacttgttaccgcagttcaaaacactggagtatcaacagcaacggttgaacatggaaccaataaagctaaatatagaccatcctcttgataagaatctcaatgctttagaatttagacgggttagttgcaagggtgtctttgacgagcaaaggtctatctatttgggtccacggtctaggtccatatcgggaattactgaaaatggattctttgtcatcacacctctaatgccaatccccggtgacctggataggtgagggtaatgatcctttctccttgcttttaagtctctctagtaccctttacctatacaattgtgaaaattactctttttctgtcagctgcatcgaagtaaaactagggatataataggccattgggttacctacctttctgttttcaattattgttgtgaaattattatagctctttctcgggatataataggccattggttttctaatcctctctaaacacttgaccatacttgtcttatactattgccatattctgattggctgcgattaaaatactaaaatctcgtggttaataacttttatactgtaactaactagtgagtagttcgagattttattagacagaatggtctgcggcagtgtcacttaagccttaaatggtcttggctttgtcatagtttttggctgccggttttagctgtagctgttaactgtttgtactttctgaagtcagattgttcttttcctttgtccactagcatgcaatcgcctattctggtgaatcgtggatgggttcctcgaagttggagagagaagtcacaagaatccgcagaggctgagttcattgcaaaccagtcaacaaaagctaaatcaccgtccaatgaaccaaagtcctggtggaaattttggtctaagacgccagtgattaccaaggttggtcttgttcagaaactttttcctttgtcataaggttggcttctcatatatttggtttagctcgaaactgtaattttatgggatacatctgaatagaaatgtcggatctatgcagagacagattaaattcagctatctgcaaagtttcacttctttgtttattgtctttaacaaatctcttgcatacattgtgactcgtgaaaactgaaatcttgtaggaacatatatctgcggttaagcctgtagaagtagttggcgtaatcaggggaggggagaacccgagcatatttgttccatccaatgatccaagtaccgggcagtggttctatgtagatgttcctgcgatggctcgagccgttggccttcctgaaaacacaatctacgtagaggacgtccatgaacatgtagatcggagtagaccgtatcctgttccgaaggacatcaacaccttgatccgtagtaaagtcatgccacaggaccatctgaactactcaataacatggtaaactccatacagatacatgaggtgttcttggcattgtctggtcttaactgttatggtcaatgagtgacattatgtttgtgtctgtttattgatgaacaggtattctctctcggcggctgtcactttcatggcatacaagagactgaaggcaaagcctgtccgcagataagcactcgctgatcaaaatcaaatcgtattctttttgtcacttgtctgctgaagtaataattgcagtggataattggttttaggttataaactttcataagaaaaagggacacaattaaatccttaatgttgtggtaacttaatagaaatttgtagttttctttttctacgatggaaggaaagttcgaaatggaagccatttgtaggtaaagaaggttgcaacgaatgcttgtaatcaccattgttctttctggtagactttcagcagaatttgtcggtgtgaattatgtattacctagaaaaagtcaatttacggttcaagagagtttgtttgagtatatggtatatattttgaaacctttttgaaatttatatccgagactcgaaagacagcataaactatgaactgctatcaagtaaagaaagaaaaagagacatgaactcaaaacctcattttacaaaaaaaatagtgttaagtcatcttattcagctaaaatctcattattccactgcttttcaccaaaaaaaaaaatctcattattccactgccgacaggatctttgccgcctttgacacctttgttgcagagttttaatttattcatcgatctggtgtacctttaatattttacacgaaaggtcaaagactagctttctcttacaaattaaacaatagtcaaccattgtaaacgaaagtagcacataaagtgaaggaattaaaatgaaacgaaataatctgagtgaggtggaaatatccaatttcaaatgtgtctttgaagtctctatggataatttgtcaaaacgatagtatttgataaaagaaatggaatgaaatgaaattagtagttatcagtaaatctttttcttacttaattcatcaaatgtttttcatgtgagtgtgttttaaaattacgtaatcaatgattacaaagtaagtaataatctaaagcaaattgtatatatatagtaattagtataataagattagatttaacgcatgaattaggccaggtgttaatatcagtcttgtcccagattgttcgccagagagaatagaatcatcctcgctgtttcctatttaccatttgtttccaccaatcatcatcttctcgcatcagagccaatccatggcgctttctttctttagctccgtgtaatttctctattctgacaagtcaaatccctaaaaactcctcgattctc

SEQ ID NO: 1992 - DNA, 3000 bp, Unknown
  misc_feature (1)..( 3000): cDNA_ID_3065451_gDNA_ID_1620475_Annot_ID_158146 3000 nt of promoter + ATG
ttagatgacagatcagatcagttgaataagaagagttaagagagcagagatactttaagtggtagtttgctacgctatcggttggatataacaggatgaaccaagtaaaaaaaacagaggccatgttgagaaactaacaattgtcgagacacaaattaaaaactgaaaatgggaaaagataaaacagtaaataaacgacaaatacaagttgatagagggtggtgcagcttgcttgatttgtacagagcttggaacaatctacgtctatagactcgccaagatccacttttttgaagtatcccttctttccaatgataaaagctatgttgcgagtagggcgaggtatatacctgtctttatcaagtaccacagcgaccttcttcttctcgtcaacgaagaaactcccacctctaaccagaaactgaaaaccaagaccggtgattggtttcatatcaacctttaagaacaacttgttccacgataccgcattgggctcaatcctgctactaatccatatcttcaccgtataaccaccacattgttgaaatagcaccgcaagatgcttttctctaacactagaaagagtcacaggcagaggcagacgcggtccaaatctctctgttttagaatcaaaacatagtaagaaatcagggatatctcccacttggaaacaataatatttttgccagaactaaagctaactgatttgtccattaacctaattgatttacggccttataatgatgtaaatgggctcaacatttggcccaacaaaagagcagtttcctaatttcatctgattttggcagcaaactgatcgtaacttggattctgtctgtgattaagtaggtagtcattcataaatctggagcttcgaaaatctctctggtttaggtaattactgtcgcatataatgatttattgctctaaatccaacttttgaaattttccaattacgaccaattctctataaatttctcagcaaaaatcacggcgggaatatgaggcggctaccaccgtggatgctcggtggcgcgtcaaccggtgaagcagctgcacgcaatggttcacaacccgaagctcccaaaacaaaggctgaaaaacgaccaaaaagagtccaaaaaaccaaagagaaagacttaaatctcaagtcagatgaacctaaacgagttcccaggaagattagggaagaagctaagcgtagcccggaggtgattcaatcagtgactgttcctgaagatgatgatctcacagttgatgacttattaagctttgctaatgaggtaatgtaatacttcagttccacagtttttactattaaggatttgtgaatttacttaacaatgaatctcagtatgtccaacgtgatgaggaaggaacaagaaaggagcgtgaaagaagcttgtcagtgtctgaaactacgctagttctcgatgaaaccaatatgactacatcatctcaaggaggaaccaaagattcaacagcagaagacatgttacaattgctaatgggtcctttttacaagaaacgttagaattgaagcacaactgagttttcaagtgcttcaacatttcttttttacttttgttactgttttgaattctgttccagagatccaacatctttataaagctttgtgtttttttctccaggaccaaaaatattatagaatgtaggagctactgagttcataagcccatagaaagagcaaacgaaagcattgtgctcgtgaaaattagatttccttgattttggcagctaaaaggaccgaaagcaccactttttcaagcgcatcagtgacgtgctgccttaactaactcaatcacaaacctaaagataaaaacttcaaagagcttaagaatcaaagacactgactaacttgaatattcccacagttacgatggctattattggttaagagtggggatgggtgtatatatagtgacggccacatgtagaaaaccctagttgatcacggactaatgggctgagtttgttatttcctttattgggcttgtaagaataaatcacttggtcttagtagtttgtaagttagtggttacctccactaaatgaatatctttgtaattgttggctaactttaatgaatgtgaagcatgcttaagaaaacaaggcaaaatgtaaaatgagaagaagagaatcaataaagacatttaccctcctaatcaatctttcataaactgtatatgaattttttttagggggttttctgaccccaacataatttaaagtaaaataaatttgatcatatgaaagtttaaggaataattaaacaggttgtatcgccggaggtgtttccgtttacctctctcacacctatttctcttcttctatctgacattcgaaagctctctctctctatctctcttttttaccgcgcttgctacacattgtggcagacatcaactcctacctaaatctggtagcagcccattttcagatcgaattgaccccaaggagatcacatcaggtataagaatctcaagttagctcgtatcgtcttctttagctttcactgcgtttcccgttgcttaaacatgttcaatttcgatttattcgagtgtgatctggatcggcttcgttatcattttcgtttttttcccttctctgagtttggatccagtcaagtgatttagatgcgataaagctgggattgttgagagagaagatcaattctggttaatattgactatatttggctcttctgtgatttgcagtttttgggggttttgaggaatgaatttcttgcttcgatctgcttcttccgctactcatcggcctccggtgatcgaaccaccagctacgccgcctcaacctccccctgaaacagcgaagcccggagttactttggaagggctgattgctgaagagcatttcccacaatatccatcagtagatgaagatctcgatcgtgtgggtgatggatctggagaccttgatggtaatggagagtcaaatgctaagtctggtggctctggt

SEQ ID NO: 1993 - DNA, 3000 bp, Unknown
  misc_feature (1)..( 3000): cDNA_ID_2106027_gDNA_ID_1620475_Annot_ID_158138 3000 nt of promoter + ATG
ctacaccgtcatgaagagagcctttgatgaaggttggggggccgtcatcgccaaaaccgtaagctcttgagatttgactttttcaattttagagtagatgatgattgagtctgttttgcgttgactatgttggaacataggatttggttgtgtttgtgtatgatgatgatgatattgagtttcgtctgaatctgtgattggatgatttaggtatctttagatgcatccaaagttatcaacgtgacacctagatatgctcggctacgaaccggatccaatggctcagccaaaacagatgtaattgggtggcagaacatagaactcatcagtgacagacctcttgaaaccatgctcaaagagtttgagcggttgaaaaaagagtatcctgatcggattctgattgcttcagtcatggaggaatataacaaaactgcttgggaagagcttatcgaccgtgttgagcaaactggtgttgtgagttttccctaaaacacagattcttattcttccttgtggttagattctctttcactttgtctgatattagtatacattgttgaagagacagttctggatgattgttgtgtaggatgctttagaaatcaacttctcgtgtcctcatggtatgccagagcgcagaatgggtgccgctgttggacaagattgtgcgcttctcgacgaggtttgcggatggattaatgctaaagctacagttcctgtatgggctaagatgactcctaatattactgacataactgaggtgtgacatctaattctctcagcctttttgcttcctggtttttcaaccattttgtataaagcctatccttgtagaaaatgaaaaaaaaactttgatgcaagtttattgaaaagctccctacttaaagctgagttattgttactctgttttgctctgctttgaccatgtccgttttgctttttcttttgaatagcctgctagggtgtcactaaaatccggatgtgaaggaattgcagcgatcaatacaatcatgagtgtaatgggaattgatatgaagacgttgcgtcctgagccatgcgttgaagggttagctagatagcacttttataatgtcaaacgttttggcaaatcttgtaatggcattacaagaatagctaacgttgatagtgttttgcagttactccactccagggggatactcttataaggccgttcgcccaattgcactggcaaaagttatgaacattgccaaaatgatgaaatctgagtttagtgaggatcgctcgctttcgggtattggaggagttgaaactggctatgatgccgctgaattcattctccttggatcaaatactgtacaggtaactaaactcaacactatcctcactcttttgttttagactttatgccttgagagaaacttagttttactgctttttgttggaaggtatgcaccggtgtgatgatgcacggctatggtcatgtgaaaaccctttgcgctgagctgaaagatttcatgaaacaacacaacttctctacaatagaagagttcagagggtatgaacaactttccttttagacttttatatcattcttttcgcttgcttggttgcttgctgagcaagttcttcgtgttgtttgttggcttaggcattcgctgcagtactttacaacacacacagatttagttaagagacagaaagaagcagttgagcagagaaaagctgagaagagaggcttgaaatctgataaagattggaccggggatgggttcgtgaaggagactgagagtatggtttctaactaagttagtagcctgatgaagttatgaccacccaaatatttcaataaaggttcagcaacttcattcacaactcacatgcaaattacgaaggctctttctttcaaatgtttaaaatcaacttcttaaatctcacttgaaaagaaataactaaattttatgtttcttaattttcttctcgttgtgtattattcatcttgtatccatccatagcaaccatttctttgttacttcaagttggcttaaattttggccaataataataccatagaccttctccatgaagcaagatgttgcggtagtaaccttttattaaggtgtgatttggctaaagaaacttggtcttatatcattaaaattagatattgaacaaaatcaagtatgagctgatagaaccaagattagtaggaagctaatcaaacaactctggatacatttactaggaaaatatggtcatgcttatttttatacgcatcatttgaatccgaagaggggaaaaaggcaacaaaacgggcttaatgagaaattgactatggaagaaatatcaaaaagccaaaagtggccacgactttctgcatcgcaatgatacctatattagaagctacttaaaaattttaacacaaaaaagaaaaacatttagtttcctcctaccttacctacctacgtttacgtgatcatcaacaattctatttttactaatttactcattaatatatcttctaaagtatacataaacaaacaaactgtacgaagaaattgaaatataaatatcaaggaaattggtagcagttgttgagttatttcaatgatgctgtgaagtggaaacatttattacgtaacgcatatccgttttgtatataaactcttatttttcggctgtatatataatctttttagagattttccgtgagaaatagattaaatattgttgccataataacctgtaatctcaggagaatcctaacggaaaagagaatattagacgatagtattatatggagtattaattacttattaacaattctaggagataatatcagcacacaacaataaaagaaattactaatttactggaatcatgtattcaccgtaattatttaaggagaggaaaaaaaaaatacaagctctttctctataaacacacactctcaggagagaagttgtattgatcgtcttctctttccctaaacacactgattattttctctccgacgccgcc

SEQ ID NO: 1994 - DNA, 3000 bp, Unknown
  misc_feature (1)..( 3000): cDNA_ID_2148433_gDNA_ID_1620475_Annot_ID_158139 3000 nt of promoter + ATG
ggttctattacagatacaaagcttcaaatttgctaatgataatcttctcttttgacagaggatcactgagatctctggtgtaattgtcagcttcgacccgaaaccagtcccggttagtttcttacttgccctccaatacttttatattcaataaccatatgtctaatgttgttgtaacattcttgaattggtttagggtgactggaatggagctggagctcactgcaactacagcactaagacaatgagaaacgatggaggattagaagtgatcaagaaagcgatagggaagcttcagctgaaacacaaagaacacattgctgcttacggtgaaggaaacgagcgtcgtctcactggaaagcacgaaaccgcagacatcaacacattctcttggggagtcgcgaaccgtggagcgtcagtgagagtgggacgtgacacagagaaggaaggtaaagggtacttcgaagacagaaggccagcttctaacatggatccttacgttgtcacctccatgatcgctgagacgaccatactcggttgatgacacatttcatgatttgatttctctccaatttggttttttttttttcccttttgattgcacttttcgataataaaaaaataattcttattatgggcgtattgttgtgacattttgtgttttgtttcgaataattaaataagcgcttcttaaggtgaaaataaataataattagtgatttttaatctttgatatgatagcaacgaagttaaggcgggtgtttcggacgttgaattgggataagatttgtgcaattaataattaggaattatataattattgtgtaagataatctcgaatattcattacaataatatacacatgtgacctacttacttaggaacaagaaaataaatagaagataaaattccgaagacgaaggggtggtggaatattaggtgagaacagcgtaatggtcgtcacgtgctctgttttcctagtctcatgcattgaagttcgcaaactatagcttttggtaggaaaagtcaaaattaactttgtgatatttattgtcatgagtggggaaattcgtgactctctttcccactcagaatttacttcatagattaagcataaaagagggtgacgaaaagtagtataaatattttcctaagttttggcaaagtcatacaaattcacaagtacatttttagtacttcagtgcatagtgtcacactttaattgttgctgccatttgtacacgtttcttttaaagtagattaatgtggaaaatcatgacaacctacccacttgatttcgcttttaaataaagaaattgaaaagatataaagccatgatcgttgttgtcgactaacacgaaaaagaaaagcttacgattggtgatctatggaatatacaaatttaaagaatacatggaatgttattattagtagttcaactaataccttagttttataatgcagattccgatttacattttccaaacggaaaaaagcaattgttaggaaactttactttttaatgaacggaatattaggtttaaatgatagataaattaattgaacatggactctttgcatttcaacatgcaaaaacttctagctatttaaatcaatcttcgtttttttcttcttatttggacaaaatataaccgaataatatatatataattaaaattcttgtaaatctttataaatttatttaatttttttgtaaattctttaaaataatcttaaaattataatgagtcttgttttattccgttagagctaaataaacattctcaaaattacacactcaaaattacttttcccctccaatagcggcgaaaaacatcagcaatatcgtcacgacggacgaagaagccaacgatacgcttgtagcctcaaccgtgatgaaatagtggcggtttatcgtcaacatacggctcaatatccaacatcctattagataacattgttaataatgttttgcatcgtttaaaagaaattcttcaattagcaaaaaggaaatctataatacaaaatgacaaatttaaatattgaaaattaacttaaaatatgttattgtctatgcatatttcactaaagttaaatctaagataatagatttatggtgattatgaatataatttaggaattatactcttttttttttgggcaaataatttagtgattagacaatatccaaatagattagattaagaaaagaagtgagtacaattgtaaattgaagtttaacttgtgaacagtttgtaccaaaaaaaatttaaaaattaatcttaataaatcactattaattaataatttttctggtctcgaattaggtttttgtagtattaaaattcgataaaaaaaataaaaaaaataataatttatttgaaaatcttatatagactatatagtccaatctagaatcttaaattaataacttatcaatatatatatatatatatatatatatccatatatataatatacaatacataccttttatttaaatataaatataaacttatcaaaaagttacaatgtcaaaaatacgacgtagccatgaaattgtatttttatatattgataaggttataaacttattaattttatgatatattcacattttataagatatatatattattcagtatatatatattgattttattaataagtttataaataggtgcactctcatgggccatggctacattgtatttcagagacagtacctttttctatgtaaagtattcaataaaataatttgtggaaaaaataataaaaaaatcatataatttgtggataaaataaaataacgaacttattgggtctttagctttaagcttctcggcccatagtattaatacccaccagccttaaatgatatcgttttgaaaacaacccttgaagattctatctagcccaatgttcgccgtgtaagaagatgaccactgagcaaaaaccacgttaaaaccctccgcctctgaaattccggagggggatgaa

SEQ ID NO: 1995 - DNA, 3000 bp, Unknown
  misc_feature (1)..( 3000): cDNA_ID_2148441_gDNA_ID_1620475_Annot_ID_158141 3000 nt of promoter + ATG
ttaaatacaacaaaataattgttgcggaaatttagttccacaactaaacattattaagctaaatctaaatcctcatgtgattatgtcatcactctaatattattttttttaatccaatttttaattattttttctgtcattgtacttttattaatatttttcgcgaattattaaagaatgttgcttgttgcttaaactatacttgtattaattaaggtaattattggtaccaaaaagaaaatattactttaatgtacatattactaaaatcactcgttgacatcgtttttgtgtatttataagatgcatgtggtccgggggaggaaattacgccatttcgtgcgtcactttcttcttaatttagtaaaaactaatactatactaaatttactaatgttttaaaacatatctaattatctcacaaatataataataaagttttcatttttttatgaaaatgaatatttaaaattcaaatctatagaaaaaatggaaaggagtcaatgatcacaacaacttgacgatctctaaacaaaaaaaaaattgacgatcatctcccacgataacatcgttatttcgagtctgggggatatgcagcacacgtcattttctccagcctagaatttagatattaatatcacattattaagaaaatactacactgcagtttattatatacacaacattccatatagataatagatcagatcagatcaaaagtggacctacaaagcgaagattatatcaaaagatgccataaacgcatctctcacgctatgatccacataaaacatccgaaatttaattctgtttttacatccgacatttaattcttgttttctgtttttacatcatttaattctggttaccacgacattttttttgttttaatggtattagactctatatagacatacaaaactcaaaacaaaagattcaatgatcaccccctaccaaaaaaagaacagattaaatgatcacgagttggcttaacaacgaaaacttttctccaaccaaaaccaaacttaactattctaaatcaaactcaacagcaacagcaacgtctgtttacaacaacaacttaaataattttgtattaaaatcgaatgagagtaaataatggcaaagagaaaatcaaatgacatatgtatatgcatgatatatagcgcagcatttaactatatttagactgacttgagtagttgcaatatttggctctcttttttttgagtttggtgctttagtggatcctttgatggctcatcctgcttctcgtcgacgtcgagccagatccagagaagagcctccctacttaatgatctggtcatttctcacctgttaatacttacattttagtttttattttgatatagacttatttgctagtaattatggacatccagaagcaattagtctttcgtgggctcttgacatcgtatgccgacttgtttgcctaatttcgacccttgtttacggcgccttcaccgtttacgcctccgcaataatttacgatggaggtgtacgtataaagctgagaagattcaggggccaaaatgtatctccacgtcttggaatttcatggaagttagagagggctgtgcatggtggagaagaacaaggggagtttagggaaagacgaagaagaagtttccccaatctgtctagaagatgtcaccataggttttggttatgttaggctaagagattacatgcacaaattccaccgtgattgcattgctaaatagcttttgaagagtgcacgttatcctatatgtcgtgcttttgcaaaattataaacaattacctttgccttcgattatctatatagagctgctaattattgttttagactttttcgtggaattgagctacgacataatttgtttttttccgagttctgacaatccaatatcgcagcgatggaagtcttttgatagtaatgacaaaaacaccatgttgatcaaaaatcacatgcaagaatacaatagtacactcatgatgcataccattatagtaatttatttcgtcataaaaaaatttggattcaatctattcgataattgaaaagcagaaagtaatgttattaattgagatatagacgtaacgtgaacacatcatttaatatttagctagcaaaattactgaaaaataaataaaaaatagttacaaaactgttgatctgaaaataaagagaagtagatcgaactcatcttgaaccatctttatctcttgtgacttgtatgatcgttttgcctgactcttctcccttgacatgtccattactaatataaaagtccgactaatatgggcccaaaatgtaataaggaatggcccaaatctaatagtcataataagtttgtatcgcaatgagccaatgaggatttgttgttttgccatggaccgcataaagttggatgcatgcactgtgttagtggaaacttttcggattcacataagctagatcacatcttgtagttgtagatcatcagcacttaaacaatattttcatttatttattttgcgagaaaacaaaagatcgttttctttgttatctaaaattacgaaaataacatttttgttaagtaatggaatagagatattgattaataatgtgttgttatttgtggatttatatgaaaaaattgagttgttttgttaagaaatgattgaataaaattaattttagtttaagtcaaaaaagtcaaaatttagtcttaacaaagaattgactgttttccatttcaagtaaattaaatgacaaaggcactgaatctaggctttcccactaacagttacgctttcgtcttcctcgtcgcttcctcaaaatccttaacctcgaaaactctgaagatcttccagagagtctcagcgagtgagagagaaagctatttgttctctcgtgaagtccgagtgttggaaattgacaactggatttatggttggatttggtgtgtaagtgtgtaagcgattaggttttgaatcagcggaatcgaaaaaatg

SEQ ID NO: 1996 - DNA, 3000 bp, Unknown
  misc_feature (1)..( 3000): cDNA_ID_2148429_gDNA_ID_1620475_Annot_ID_158137 3000 nt of promoter + ATG
acatggctctcaacatcccaaaggaacgacccgaaagtaactgcctccaagacgagcctcttcattccaccgaagctgatctttatctgttcgtccttcgatgaatcgactgtgccctccggtgttattacaatctcaggcttaccaaacaatgcctctgtgtgcttctcgatgattccaactgcttctcttgatcttatagtggcgtatctctgcagcgtctccgcatcaaatgacatcacatatgaccttaatcgggatggtttaatctcgctgccgaagcccttagcactaactccgcccgcaaatgcaccaacctctgggtgagacgatacagccgcctgatatgttgccgtcccctcggcttgctcaacgcttgttttactttcatccgacccacccggaagaatcttcatcgtcttctcaagctgaaacctttggtccaccctcttcaagaaatatccatacatcacagaagcagcgtaaacttggccaactctgagcttgcttatctgtgcaacagagttcagatcacccattctgcttccaagaatcaaggcaagatggttgtgaatcatctcgtacatctcgggcgagtgaagccgctcgagtttctccactttggtcggccaagtatcaacccgaccagacggatctgaagatgggcttactgaaggtacaagtgatacgttagcttccatgaacttttgaaccaccaatgcatacaaaatctcttccaatgttcttcttctctcgttttccttcaactccgcaattctcctaaacaccaacaaaacattactcattcagaatcaaactcatgtacaacttccaatctatcgtatatacaaacagataatgagtaatccttaaattttagttatcatttatctagacacagagaaaagttcacatcacgtctccttcacttaatatgtcaagcaagttttagtcttttagatcgaagatctatacctgtagagaacgatgtcggttccaggtacagacgctgaatctttgttctgtccctgagagtcccgatcagtttgaagctgctcaagctgctgttcaacagctgcaggcacaagatgaggatggctcaccaaaatctgagacagaaactgaccagcaggcgattgcagctggagcggagcgatcggtttgggggaagaaccagatgaagcatcattagacgctgaagaagctctaaccacaaaacttctccgagttttagcagtcgttgttaagctctgtaatgatcttgaggatctagcagacgcgttttgctgcaagtacataattttttttttagtttttgctgattacgaggaacttcctggtaaaatctgattgaacataaccggagcagaatatttggagaatgattcgattttgaattttgatcataaaagtaggttaattgaatcaagtacaagagatttgggacatacccttaaacgaagttgaagtcttgaagaaccagaacgcgtgaatccagggccactggcggtaaggaacatagatccagaaccgttgtcggaagttctcgatggtacgatgggagatcgaaccaaactcgaggtcaaggcatccatggttactctctgagggtgaaaataagagagaagtcgaagttttggtcggaggaaggagataagaagaaactttagactagcttgagagagagaaatgtcgagaatggcgatcgattgatattactggtaaacagactttggtttagttttcctgagaaataatgagagtcggatttgattatttataataataaatgaaaggactcagaaaattatatttttcgtttaaatattttgagaccatggaaattatttgaggccgtgtttatgttgtgtgttcttcgtttcgtttgtagtttgtacaataacgatattttaaaaaaaaaaagacgaattattctttttgtagcgtcattgaaatatcgaacacaataatatcactatctaattacctgaactagaaagttcgatagtaaaatccttgcagtccttaaaactctaaagtctaaaccaaatacttttctcttctgttttcttattcaatcaaaaactttttagaaattactggatgattaggtatatagtattttgccattttggtctaaaactttacatcatatttagttatttaccaatctagaatggtctctaggtttttaactttttaactttttaactttttttaactaatcttagaagcctactttacgcaaactaacgagaaaaagtagagtcaaactaacgaaggaagagaaacgttgagagccaccaactgatgttgtgtccattcccacttacacgtattatttatgaaacgttttgtttgttttgtgacgcatgggctctttaccccacttgggctcaagaatcgtatacactagaaaacaaccttaacctcacggtggatccgttacgttacgtgttcgcaatttccacgtagtcgacatataaattgagtaattctaaaactatccattttccgaaatttgttggtaaatcaagcattagttgatagagacagagaatcttaagttatatccactccgttggacaaaaaaaaattaaaaataactcaaggagataagatagagaagaaaataactgttaaatacattgattaaaactaaactaatatatttttaaatattatggattagggaagatgggtctattattatttgggtgattaatgtattattaactaattatgaactttaactaaaaacgtcaattattttcacgtggcatgaagttgaagaaccgaccaattattacaacacactcttctcttacatctctatcttcttaagttctttcctttgttcttcgatttgatcaccaactctcacatatttcgaaatcgtcacactttgttgcgtgtcgtcttctctctctcataattcttgagtttcacgtctcaagatttgatcacttctgccaattttccagattgatctctctaatt

SEQ ID NO: 1997 - DNA, 3000 bp, Unknown
  misc_feature (1)..( 3000): cDNA_ID_3065483_gDNA_ID_1620476_Annot_ID_158172 3000 nt of promoter + ATG
aacaaataagaaagaagataataacagaaccagatatagtcataacagaaaattggaataaaaacgtaaaccaaaaaatcattttgaagtaagattcaacaaaaatagagacaaacacattacagtacagaatgcataaattcacaaatataacagggacgcattgatgtaatagaaactccttgtaccatgtttttgggggatgaggtaggttgacttaaaattttatgaagagaagcattgcctagaatgatttgctttaatcgcgctgttaagtcgttttcattgctgcagcaagaaaatacattctttcaagaaaaattcagcagtagaaaatataattgacatgagaaagataaacaaaacgatagctaacctttgaataccaccaatcataacagacggtcggatggataaaggtggcacaagcatgcacgttatgataagattctcaggtctataggcaatataaagaagttcgcagtcctgttatcgatttccgaaagaaaaaggaaaaataataagaatcagcatgactgaattattagtaaataagaaaatccttttataccaatgcacatgttctgagagcaagagaacataacgcaggaagctatgtagaaaaagatgtgcattatagataaaaactcaaatataccttgtcactcattcttttaaaaagcccgagcaccaagttaggatcaagaacataggtaagaggatttattgctgcagtagactgctttgtgtgggatattgcagatttacattcatcaatctctccaccatggattttagatcggtcatgactgatgcctataccaaactgcgctgcaatcttttttaccatccctgaaattatcaatagattaaccattaccacgatatcaaaacgaattgggtgggaagaagaatataacataagttcagattaaccaataacaacagaggttaaaggattttggcattagatattagaattcccaaaaaccccaattttctgcttgtgctacttaagaaacttattagaatgttctacgagctaaattttgcacctaagatgaaacgcatgaggaatgagaaaaaaaatcaaggttataaattattaacttcaaaaaagcatcatcgaatctaaatagtttaagccaaaaaacagttcaaaattataccattcaggtagccacattttttgcacgttataattctctggctcgccatcgtactgcacttcttgacaacggcttttgccaattctgtcttcttcaatggctccattctgggattccgcatcttcctcaagtgatcttcatacaatttctcatctaaaagcatgttggaacagcgctgtgggaagaaaaaaacaatatttgtgaagtactattgatgctacaaagacatcaatataaccagccagtttttttttttgaaaggcatcttcccaagaaatattttttatgctgtatttttctccactttctccattcaacaaatgtaaaagggtcaacaaacagaacatagaacagaaactagagagacataatctgctaactctgttaccttacaaatgcacttcaaaatatcaaggataaaattaaagtatccaacgttgtaaactgggaggtcaagcttcagatatccatagtgtcccggacaattttggaagtttccttcacaggttgtgcatatagactttttgtttggaggaccctgcaaaatcataatgaacaaaccatttagtacttatcttcttacaatgaaaaaaatatcttggagtatagaatgtttagaatcacatatactgatgcaaataactgcaggaggcaaaaacatgacatacaatacttgccatggttattggcataagagaagttaaaccaaaagatagtaggtgtatataagaaaatcggataccattcgaggatccaacaagccgttttcatagggtttaaaactgtggtcgtataaaccgatgttccagacttgaacttcagcggctttcatgacctcaagatcagaaagcacagagaagtttatgctttttctgcagagataatagtagtgtcaaaaatcccaccaggaaaaacaacaaaaactgacaaacaagttttgctccacaatatcaaaatctcaaaaactataaaatcaaatcagagattcatgaacaacgccctaaggcacacaatatccattgtatcaagaaaatctacagacagacataaactaagactcttgaaagcatttagcagagaatatgtcatctagttgacaaaagagttcagacacccaaatccaaatttcagagcttggaacaaataaattatacattagcaaaaagaaacaaattttatgcacaatgagtatgatccagctgctaaaaggagcgtacttgagaaaaattatatcaatagaaccaatggtttaacttgagcagaaaaaactgaaagaacatacattttaagaggaccaacatcttcgatgtagggcttcttagtgaattcaatttccatcttcgtctccatctctacaaacaaaagctacaaaaaaaattacccagaaaaaaaaaaacgacttaagttttgaatcggcgtaagagaaacaaaaaaaacacagtaaaatcgagaccgatcgaagaatcaacttacggtgaaaaagacgacggtgaaggaaggtgggtttagggtttaagaagaagcagcagagctaagtaacaggcgggagatagagatggatgatccaaggagagagcaaaaacaaagaaaaaaaaacaaaaaacctagccttggtaatcgaactcgtgaccttaggctggttgacgtagaacactttgccacggagctatatattcttaacattaattaggtcacgagatattttatataactataatctcttgagtttttttatatttaatatcctttaaaaacaaaaggaaaacagggaagggctttgtttgtctgtttgggcttttttttatttttgggctttgttggcccatctatg

SEQ ID NO: 1998 - DNA, 3000 bp, Unknown
  misc_feature (1)..( 3000): cDNA_ID_2105356_gDNA_ID_1620476_Annot_ID_158175 3000 nt of promoter + ATG
taaaagaaagaatcacttagaaaatctgaggaacaaaaagattgtttcgcaaagtggcattgtctctctaacatgagattctcttcaatggcctttaatttggattcactggatatagctgttttagtaatttttcttttcatttatcttgataataaattctataaagattattgccatgagtattagtacgtaaaacttgtgtaagtgtcgtatttcttcagatataatattgtacttgctattttttttttcattttttgttgtcacattgtacttgctatatagtatttatgttctacaaacattcatttactctgaattttgattcgtttattaataattattcaaaattgttttttttccttcgaatctaatttgtgtattatataattttataataatacaaaaaatgacgcatagaagttagagcgcataaatatatatccttcggcgagttcttttcagtgttattctttcgactctctatctctcactctttctcgctctagttttctcggagatagtctctctctatctaattacattttccgggaaaaagtttctcgggaaaatccaaagaaaaaaagtctcacgaaagatttatcttcgttgattcgctgcgatgagtaatcgtttcttatgctgtttaggaggcggaggctcaagtaaagtaatgcaagatccatcggaactaccgcaacaacaacaaccatcggattcgtcggattcatcggatacaccgggacaacaaagtgaaggtgacgacgaagctgacgacgaaggtgaatttgggataatgcgtatctcaataatttttatggaaatgacgatcgtcaatttctcgttttttgatttcttgtttcacaagaaactctggttttagagaagtacaagcaaatctgtttgaagagtttacttcttttggaattacaagtagttttgatctggtttttatcgtcacattgctgcgagtgaaagtagtagagttcttcatgtttgtatatttgtgaaattgatttagggttcttgttcttcgtttatctttctttctttagatcttgtgaagttgatttagggttcttgttcgtggttatctttatttctttcttaacttttagtaattcatttacagatccgagttctatagttaaatttcgatggaatgatgtcgtagagggaaccgataacttcgcgataacacatttgatcggccaaggaacctacggcaaagtctatcgctgcaagttcccagaaggtcacaaggtataaacccaaaagtcttgttctttttagttaacatccgaaactcaattactaaatttagcaactttggtgtaattaggttggagctgcaaagattcatagtaatggtatcacagatggtcttagtgagaccgtagcagagactacaacgttatatgcagctgatcacccaaatgtgattaaacttgtcggcaaatattatgggatggaaaaaagtgtcctagtctacgaattcatgcctaatggctctcttgaccaccatctctttggtaatcaaaactctgttttagttctataccaattccagttatgttaactctttctctttctgtagctcacgcgaggcaggttcagggtcttactctgccaactagggttttggattggaacacgaggttgagaattgctgttggtgtagccgaaggtcttgtttatgtacaccaggggctttatgcgattcacagagatatcaaagtcgaaaacattttacttgacaaggattttgtgccgaagctgactgattttggatttgcgactaagatcgtttacaatagtgatggtgttgagaggctgagggagttcaatacgcgtggaactcaaggatacatagcaccggaagcagatgagttcgcgttggtttcgactaagtccgatatctatagctatggagttcttctgttagtgcttttaactggaaggaaagcctatgatctggcgagacctgttgcgaaagagaaactcactgattgggtaagactcaaactttgtatctaagttttgtttttatacgtttcgtgctctgtaagtaatgtattaatttagggtctcacgaaagtattttttttttgcagttaatgccagtatggactagattggagtatgcgcctatgatagttgatgttgcgctcggtaataagtattcaattgaaggtttaaacagactacttcaaactgcgaggatgtgtataaacccacaggcacttgaacggcctgccatggattttgtggaaacgatggttcgtgaagctgcagctttcccggtcccaaaggagcccctggtgaaagagaggatttcgacttcgaaataagaagtctaatcaggcggtttgatgtaggcttttttttggtgtttggtttttcagaaacatattttttgtaacggttggttttgttaatgcttctatgatttgagacaagcaacatcaaggtgtgaacgttttgagacaatgccatctgtgcaatagttgttaatcaacgactgagatcttttgtcttcatttctctgttactaaactttcttaaaataggagagaagatgagggagaggaaaaaacagaacagaaaagttcttacctttggaattttcttagatcctacgtctttcaaaaacaatctttctggtttcccgatgcattggcttggattcgagttccacgagaagccaccaaatcaaataggatcagatggatgattcttcaactttacaagacatcttgtgaaagatctttgactcttgatcatattataaacgaacaagaagctttaccttgttaggttatctttagatccacgtctctttaattgttttaagtagactattagcgttaacattcaaaaattcatgttgtttttgatcccatttgatataggagtcatttgttggtattgaatctatttgtaactacctgcgttgatataatggaggaagcatcaacatcgacaccagcaccaatg

SEQ ID NO: 1999 - DNA, 3000 bp, Unknown
  misc_feature (1)..( 3000): cDNA_ID_2148396_gDNA_ID_1620476_Annot_ID_158178 3000 nt of promoter + ATG
ggttatttttcgttaatgtgaaaaagtttctgctagaaccattagcaggaagatccgtttgtgatatctagagatttctgatggctatgagacatttgtatctatcttgataagattgttatctgagtataagctgtatgctcttcgtgattttcctgctaatggttctagcagaaactttgggcttgtgacaaggcagccatacaatggaatggaagggaagctgcttccttaactgagcaaggtgcgattttatctttagtgcaccaaatatgatttacttttctttcataaggtgttgatgaagtttgcaatgtgtattcgtttacagctctcgatttaggtttgttttgttttcagaaataagaacacaagaagaaatgtattagccaatttcgtttttcaaattgtgtaaactcttcttcataagaactccaactttacaaaacaaaatagtagtttatgacgaaacacttttcttaccagagttatgtaactacattgaacaccggaacaattaaactattgtaagctggtttgaaaaataaacacagagttataatcagcaacgaagcctaaatgagtccaagatgtttgcaatgttgcttccgtgagatctacgcaagagacggataaaaggcatgagcttctgcaccaaaccccaaaacagatccatcctagacatcttggtgaatctcagagccttgaccaccacgaaattcccaaactcattcctcgccagcctcatcaacctgtctccatcgcaacccaaaagctccacaaccaccacaaccattgactcctccacctccaaaagcttctccacgatgtagcttccatacttcttaaacgatagctcaatgcactgaccataaagattaacggcgatgttgtgaatgcaacgcgagtcatacagtgtaagcacatgttggaccacaaagttccctgaagcatcgttgcttagccggagagcgttggatgcgaccaattctagtagctgatctctgtagtaaggatcgtcagcgtcggttatgatatcattgagcgcgatgcagccgtgctggtcacacgctaggtcgagagcgtggtagagaatgcgctcgtacaatgcctttttcatcaccttgtcgaaaacgaccatggctcgtatcgtcacgtaggatgcgtatttgtcggtcgtgatgtggaggaagcggcgcaagatagcggcacagaagaaggcgtccacgtcatctgatttgccgaggagcttctgcacgcgtctcgagccgaacttggttgtgacgatcgacatgaagtaatcggagtcagacgtaagcaacgaggccatcctctgaagctctgttttgtctgaatttgagatcatctctttaaagtaagacacaccatcgccgtcagtcattaggttgaacagagctgcgtgcaagggcgtggcggaggcgcgtggggcgaatccaggaggaggaatggaaccggagattcctttagggtttggtaaagcattgaacatggtcgacattgaaaagggattatcagcgactgccattgataaatctcttgatgatctacagaaatttctctagaaaagggtttaatcagtttgtgtgatttgggagaagtatgagagacttgtgaatgagagatctgtggtgatgcgtagagtatttatagaaaagttagggcttttgtttttctagttacaattacacaactcggattactactaggaaaaggaaaaggaaacttatttggtggagtttcctttttgttttgtcaattttccttttttctttgcattttcgtaactgtcatgattttaatctatctttttttggtgtgtgaagataataataatctatctgaaacaaatggaaatatgtaatttgttttgttgtaaatcgacaataatttaacatgtcgataatctctaaagtctaaaccaacccctcgcagtccaagcttttgattttgtccacgtcactaatctcagcatgcgtaaatttatctggtcctacttgacacgtaggttagttctgccacgtcatcaaactccaaaataatatcttctctgacctttttgttctaccacctcccaaaaaatcccagtcttctcttcctctgattctctatcaagttttttaaattttctttctttttattctattttagtagcaatttggttctgtaaagttgttggtaaaagaaaaatagatacgaatcaaaacatttttgaatgattaggtgattaaatgctaagcaaatcagattaagcaaaaatctgttcttttttggttgtaatttggtttttcaagtcagatatggtgagagattctggtggtggtggtgttcatcaatggattatgtgaaaaaggtttgcttttgtttgtcttgtcgcttttacaatctgctgctgtttgaattttgtgcttatttcattaagtattatagcttagagccttagagtttgattttgtatctggttctgtagagtttataagaaatttgagaaagtaggagatctttacaatcatctaatgaataaaagaaactgtgttcaaagtttgttaactacttaccaagtactgtgataattttccattggaacattgatagcttttgattttagaaacaacaagtttcagattgttttctaaagctgagtgtgtgctactattgaaatttgatttggcttgtttagtttttctttggacaagtttgatgatttatccaaattcagttttttattttttggttctggtgtgagactgtgatcttcttacggaatgttgcttttttttttgtttctcgtttcttattgggctgaggttttggtgaagggattagaataagtttggggaaagaagaaatgtgcaagtgttatgtcagtgtagaggggaagtttctgcagaatcttagctgttacttgatgctgcttctattctatcttgttcatggaggctggtcttgacactttcatgagatattagtattctaaaaatg

SEQ ID NO: 2000 - DNA, 1316 bp, Unknown
  misc_feature (1)..( 1316): cDNA_ID_3065471_gDNA_ID_1620476_Annot_ID_158182 3000 nt of promoter + ATG
ctttacacactctccatttaacatctttggttatggattcttatgtgaataaattaataaggaatatctcaatctgttttatgatgtttgtttcttgatgcagcacataccggctcatgtcataagggactatgacttaaccttcccggagcgtataacagtcgtggacgaaatgggagcattggagaaagcaatcaagattcaaaagaatggttgcatctttgtcaagggatttggtagtttcatcagaaggaacaaaatgaagatgactgacaaaatgatatgcgagcttaagaggactggaggtaatctggttcacaccatcaaggtcaagattatcagcggatgatctcttcactaagcttttgtgagtcttatgtgtcttagctgtgagtggtttttattatgttactaatggtaaaatgtctatcttaggatttggtttataactaaggatttgggcgtgagagatgttttcatgttgaattaagactttctatatagagttcatgtctcattaaatctctctgttttctcttgcaacaaactcttgagttatgccgtctagacaaatcttgttgctttgttgcctgcagtaagtagggcaacgtcctccaacggattcatacaaatagtacttacattgttcggacaaaggtcgtcctttgtgttggagtaatctcaaaagacattatagtaaaatgacaaatgggtttgggtttgtgttttgttgttggcaccacttttgtatacaaacttacaaatcaaaataagaaagagaaccaaacaatatgttgcaaatagatttggaggaaatcactaggccttccactgactactataaaaccccatctcgaatgggaccaaaataatttaggtccattggttttcgcgggccttggttctttcacgaatcttcttttaaaacgaagtcgttctaagtagtcttttacggttttaccatttgaagcaacaagtatagaaacagagagaaacctctgttttcaagtttttgctacaaaagtcgaaagccactcaacggaaaccgtactatctgagaaatctggggtttgaagaactgtactcatcttaaaattagggttccaaatctcagctctacattgaagtaaatgtagttagtaaagttttttttttccatttgaaacaataagcgttcaagtctctgcttttagctacaaaaggaaaaaaacactaaatcaaacaataagatcggagaacgcatattaaccttcagttaaatcaaacaattagggtttcacagagatctagacaaagagcagacagaagtgaagatg

SEQ ID NO: 2001 - DNA, 3000 bp, Unknown
  misc_feature (1)..( 3000): cDNA_ID_2148406_gDNA_ID_1620476_Annot_ID_158181 3000 nt of promoter + ATG
aatatcgttccgtatagacgctttaatgtgcaagtatgtaactctaacaacctaattttcactttgacatttaggcaaaagtaaaattaaggttgtacttggtaaaatcttgataaagagattgaaagaaaggaatgtgggcatgaaaatgaaaaaaaaaaactagataaattgtgaaactgttaaattccctaaatttaaggaaagtaagaatggacatgggccgtccgatcagatatgtgacctaagatggctgagagagtagttgaatggctggggttcaatctctgttgtacacgtggctttatactactcgttaaaatccatgatcttcgagatttttctgacactcttaagttttggcaaccggctaaaaccagtcggaatgttcatttgacctaccccactcaataaacatttccaaagaaaaaagagattcgtatggacacaaagaatagatatttttaggtcattttcattttttcgcccgtaacctgtgttaagaacataatacgttgttacgtacattttatttctatttttaataaacaataatttcctttgattgtaaaagaatccccctttattggcttttgttctttcctatgtcttcttgtactcaaaatatattttgttttagactttcgaaattatccattttggaaacctatccatttctttgttgatctctttgtatcacattgctctcaagctatgtagtagtcttagagatttagacaatactaatgaatacaagataccataagatttgatacaatatgtttgtgttatcaacgtttgatcggatatgtgttttttttctacttatagctattcattcaatgaaaatctaaaagaaaattgagacacagttgatgcagagataattttctctagccttgatagatttttacaatgtgatattgtaggaactaggaaacacatgcttcatttttatttaggccatgaatgtttgtagtttttaaaatggtttttggattttggattttggtttttggtttttagtttttgattttcttggtttttgtttttggtgtagattttagtttcttaaaaaacttgaatggtaatttgtttagattttggtttttatgttaatggatagtattttttttacaaaacaaatctaaaaataaaataaaaaatgtgatcgattgtttttgagagagaaactcccaaaacatagattttggttttctttgaaaaattgttaaaacactcaaaaactagatttcctatattttaggaaaacttgttttctcaaaatcttgaatggctacaaaatagattttagaaaaaattaaaaccaaaaactagtttaaaaaccacactcattcaaggccttactaaaacttggctacaaacaaggcgaagataacatacatcattcaatttcaatagtaattaatgtgtcaaaaccttagaaattaaaacaaaatttcatcactatgtccagtaagaaaaactaaagctatcaaacctgatgttagtgatttttttccccatcatctttaactattttccatacacattcgtttttgtaataataacaacttcttaaaatgatataacttttgttactttatgcatgtaattgttgattatagctagcttctacacctttttctaacatgtgacacatttttttttacatgtgacacatttgttacgttggttggatacttgttatccatataaatcaataaaaagtcatattattctatctcactcttttaagtctttacagatttttgtttgtgaggaggacgtagctgcaaatataggacccgccattaaatgaaaacaaatgctttgtcttcaaagctatgaatatgtgacttcaaagtgttttttggtttttatgtgtcttcaaagttgtgaatataatagtgtagattcgcttttctttaccaatctttgtttgcagattaataataagatatactatataggatacaaaaacgaatttcgtttgattcattctataaatttgaattactaaatcactttagttgagtttgttcaaggataaaaagtgaaaccccaattaaatttgatgattttcagatgtgtttacaaaatgtttcgaagaacacgcttcaaattgatttaaccaagatgaacacatccattaaatcctcattccatgaacaaaatgcacctcattgtccctaggccttaacagatctatttagtactaatactgtatttaataacttatcttggtaaagaaatcacagaaaagcttaacacatacagtttaaaccgtaaatttatcatagtaaaactgtaaaagcactaatcataaatttaaaccaagctaataaaacaaaaacaagtagcacgtttttacttcaaaccggaaacaggcaaaaccggtatcaaattgccgagaaagatggaaggaataaataaatgttaaaatgttcctttgttgccactaacccacaggcttacgtcccatcatcattccccgttctctttttattttctctaatcgccgacgattatctctttcgtccggcgatagctattttgtctcttcaaatccccatagaccaatactcaactcttcatctccatgtctcctcaatctcatttctctccttagtgattgagctttttccttctttctctttggttattattccttctcctcctccgtcgtgtttttgattgatttcagaatctaaatctccgtttgatttctccatactcgtgctgattttcacctatgtaatgtgatttatgagctctgtttatttcaaatcgacggcgatcgttgaatttattgatcaatgtgtaagtaagagcttgaagaaatagtttttgttgttgttgtgaaagctcagagttttgtttgcttttttgttgacttttttgagattgatgctggatctcaatctcgacgtcgactcgaccgagtctactcagaacgaacgagattcgattactgttaaaggggtttctttgaatcag

SEQ ID NO: 2002 - DNA, 2734 bp, Unknown
  misc_feature (1)..( 2734): cDNA_ID_2148385_gDNA_ID_1620476_Annot_ID_158173 3000 nt of promoter + ATG
taatgtcttagtaagaaattggattatccttgacaccatttattagctgttcagggtccaacaactggtcaaaacacaaaagaccataatcacagagcttctctaacacttgctttgattttcataaactaataatactatctctggctcatgtttcaaacaaaaacctaccctcgtcttctctatatattccctagggatcaaaatatgcaagagaaagtagacgcaagtttcagtgaagcacctgccaaaccagattgtacaccagttaaccacatgactctttcaaaaattcatggggatgccggtttccacagagttcaaatttttccatgctgtgcgctccttagtcttcctcagcctgcatcaggatttacaagactctaataagctcagagtatggtgaacttacaaatagccttcttatcaataagtatgaatcatgcacagccacttgtcgggtttgaaaatggcttcacttttttggatggaaacaaaagtataagactgatcagtattccacaaaacctcgtaactccaccaacatcgttacctaaaagttgatatcctaatttcagtcctagtcttggtcaatagtttttctattcctctggtttcacactactttttatatctttggcgttctcgagaacttcacatgggataatgtctgtgcaatcaaaatgtttctgttagttcatgaaatagaccaaggaaccaacacattaacagagaaaatcgcatttaagatatacataccggacgatcgaggatcatatgtactcgcacaagttgagttgaacaggacgtggaaatccttcttccttgatacaggaaacgtccaatacgttcaagcaccagactttcaagtgcctacacaaatattgagcttacatataacatttctagtttattccgcaacttcggcgagtagattagagtgaatggtaacgcttcaagcactccaaaactttgcattcaatcatattcaaaatgtagtaaaggataaaaaaaagggttgcatcactctaccaaaacaacaaaaacttcaatgcaaataccataaaactttaacaagagagttccaaatatgaaatccttctcaatcttaattgtcaccaagtaacatcttcaactacacatacccaaaaatttgaaagatttcttagtttcaactacaaaaatttctcaaaccttcagctaaaaccccgaattaaccaacttcaatcatcaatctccttcagtttcctctttttcttgctcttcctctcctctgaacccatctcttcatcactctttctctttttcttactcttcctctcctctgaaacgatctcttcatcactcttcctcttcttcttcttctccttttttctctctccactcctttgctcgtcttccaacttctccttctccttctcatcaacaacatcttcgtctttgttcttctttttctcctttatctctgcgctcttttgctcgtcttctaacttctccttctcatcaacaacatcttcgtcgttgttcttcttgctcttcttcttctttcgctcctttctatctgcgctcttttgctcgtcttctaacttctccttcaccttctcatcaacaacatcttcgtctttgttgttcttcttcttcttcttctccttctttctctcccttcgctcttcgctcctttgctctgcttccaacttctcgttcaccttctcatcaacaacatctgcgtctttgctcttcttcatctttttctcatcacgttccctaccataaactgattccacactcacagcttcactattccggtaacgaatcttccgaccgtcgaattcgtcaatgacattccgctcactctttgcatcggagctttgcttcgtctccgttgatttagtctccctatcggagcttggcttcgtctcctttgatttaatctccctgtggaaactctttaattcagtgaaggcagcggaggctcgccggaggtacgcactaacgtcttgagaggcgccattatcagaggaagcgaatccagagagaagcttagccgcctttgagagggagattggttcagcactaacaactcttccggtgacagtcttcatcggaagaagctcgaaaggtcgtcgcgcctctctaactacacaaattagggcaatttcccctaaaagctgacaactttcgaaataagtagaaaacacaactacgaaagtaccccttgcttgtttttttttttctcacaagtgaacatatcatagatgggccaacaaagcccaaaaataaaaaaaagcccaaacagacaaacaaagcccttccctgttttccttttgtttttaaaggatattaaatataaaaaaactcaagagattatagttatataaaatatctcgtgacctaattaatgttaagaatatatagctccgtggcaaagtgttctacgtcaaccagcctaaggtcacgagttcgattaccaaggctaggttttttgtttttttttctttgtttttgctctctccttggatcatccatctctatctcccgcctgttacttagctctgctgcttcttcttaaaccctaaacccaccttccttcaccgtcgtctttttcaccgtaagttgattcttcgatcggtctcgattttactgtgttttttttgtttctcttacgccgattcaaaacttaagtcgtttttttttttctgggtaattttttttgtagcttttgtttgtagagatg

SEQ ID NO: 2003 - DNA, 3000 bp, Unknown
  misc_feature (1)..( 3000): cDNA_ID_2148389_gDNA_ID_1620476_Annot_ID_158174 3000 nt of promoter + ATG
gaaataaattttattgattgaaagaaaatcttatagcctcttgtcacattgctttaccatagacgtttaatgctttgggccactattgccttcccactcacaacatctacaacatctttttttgttatgttttttttccatatcatttagaaaattttcgaaaattgacattatgtagtcggtggtagaacaagtttgagcttcatattgaatatgtacgtaaattttattgaaaacttaccaatatagacgacaaacggacaaaattttttagttgattctcaagatccaagagataaaatccaagtgaatatgctttgatcaaacgcataattctaatgtacatgaacagatgatcctacttgggaagtacattaaaaataaaacattaatttttgtaagtaattacataggtatgccattaaaaataaaattttaaagagtaaattaatttatctctttaaggattaaaaagtcaaatattaatttaattaattaaatttaattaaaaaacgaaatacattattaattttcaaaaataataaccaatcaaaatcaacatattaagatttgctatctaaattttagttagtttaatttaattagaaaaacgaaatacattattaatttccaaaaaagtaatctattgaaatcaacaaattagattttatatctaaattattatattaagtttttattaattattatagttcacttctcactatgattctatttttgcgaaaaaataatatcatcactataaaaaaataattagagttttttcgcatatgccataatttgaatttttaaaaaacgaatataaactgttcaatacatgaaaaaatattataaagagtgaaaaatagatttaagaaaactttctactgagtaacgggtcataatttgaaatatttatattcaatttcatacatattatattgaaaatttataatcttatatactataataattaataatatattagatttttttatgtgtatgatgtgattcaatttttaatacaagctggaaaatcttagaattgacgggtttagatcgatattaatacaagatggtatactacaggtgaaacccttaaattaacaatcaaactacaagtgtataatcttaaacactaaacaatatagataatatcaacaaaacatatacaactcacagtttattatacatttaaaatcaaataaaataatatcatatatttttaaatcatctttacaataaaagtttttagtttaactaaaatataagcctacatgcggtatactgcatgttcatatctagattataggacttattggatctaaagacgggtcatcaaagatttcctaaacttaagcaaaatatacttaatactcaaatatctatctgttaccaaagtataaacaaataagttcgtaaaacaatttaatattttatatacaaaatcaattaatcttaatcacataaaaattagcacaaaaaagtattcaacaattaaaaaattatcaaatctctgtgttatataagttttgatactatattcgaataaagtgtaatataccttttcaatttgtattctttaactaatttaagctaactaatatatttgctaatcttatacctatcaaaaccgactatcgtttcttatctctatagtatttttgcaagacttttttggtggatttgggtaaaagtgcattcgggtcacatggtacatttctctattaaataaatatggtgtactcctatattattagctaaaatgtttagattatagttcagagtcatatcattaataaaattaatattaattaaataaatagctttttggcaagacggatttggagtgacgggtttttgaatcaacattaataaaaaataaatataattaatccaccgtttcaatacgggttaaatctttaatttattattttgtaagactactaatattaaacatatcaaatcatcctaatttagaaaagattatataaaaccaaaaatgttatatggtatgtataatgttactatatatgaaattaaactataaaatataaatgtattagagaatgatacaatttgcaaaacttttatatataaaaaataattcttaaattttaaaaattactactttaaaaaaaaatcacgggacggataaagaaattatagaacatgttttatttaggaattgggttatatggtggatgtatttgaatcaatatttataaaattttaaaatattattaatatgctgttttaataggggttacaacttcagttttttaacaattgtctcatggattcgtgttatagcgttacttaataacaattattaactgtaaaatataaatattttataaaaataaaatttgtaaattttaatatatattactttaaaaaaataaatcgtcccgcggtataccgcgggttaaaatctaatttatatatatttgtccatcagctttcaaatccatgtgtaccccactcaaatggaaatacttttaaaccggttcttgctcgggctagaccggactgatccgatcaacaaaaaatcaaaccggaaggaccaataagtctaatttctttgtgaaagtttagagaacctatggaggcaaaggcaatgatcaatctatctgtaaaggatatataaaaaaacaagtcttcatttttctctcactgtccattgcaattgtagttttatattcacagatccaaagtcctttcattttcttggattctgattctcccacagtttcatttcttcttgtgtggggaaatctgcatctttgtccactctcttttattttcccaagaaaggaaacaaattcccacaatttcttgtcttctcttaaagttcttcttaagttgaagcttcttgtctgtttttgagatttccagtaagaagaaacttcgctaattttcccgcggaaattctcttacaatcataaagttttctttttttttgctctcgagaaagttttgagaatttttacttcttcaatg

SEQ ID NO: 2004 - DNA, 3000 bp, Unknown
  misc_feature (1)..( 3000): cDNA_ID_3065548_gDNA_ID_1620477_Annot_ID_158187 3000 nt of promoter + ATG
gtaaagcattttggatgtttgatacatctcttgggacgctccgggaaattgaaagaagcttacagattggtaaaagaaatgcatgtgaaaccgaacgatacagtattgggagctttgcttggtgcatgtaaggttcatatggatacagaaatggctgaacaagtgatgaagatcatcgagactgctggaagcatcactaacagttacagcgagaaccatcttgcatcgatatcgaacttgtatgcacacaccgaaagatggcaaacagctgaagcgttgagagtagaaatggagaaaagaggtcttgagaaatccccagggcttagctcactagttttgacctgagtctataccacttagctttatttgaagaagtaaaatacttagtgattatgaaattgcctttataaacagtgtttatacaaaaaatcctaaaatgggatttgatgattgttatctgcttgatattgcaaagtgcagacatattcccattagtggttggagaaaaggcaaaaaaatatggtcatctcaagattcgaacttgttggtacccatttcaacctatacaaattacataccactggaccaaacgcaaacttattaaaagtttcatttctgcttctacctctagttggtatctttttcacggctttgttcatgtggtctccattctagttgtgttctactcttaggtgctatgtccttatataaaatctatgtgttcacaagcgatcatcttggtgtcagtcctgtcaaaattgttgataattttgtggtccacagataaaactaggaataccttactatctagctatatcttaagattttatgatcacaggaataccttactatctagctatatctaggcatatatttcttactagaaccatatttgttaaagaataaatattctttgtttttatatatcatttgttgattttttttaaaaaaaatttaccacatgatccgttagattgatattcactaaataagatgttggagaaaaaattatttctactgaaaagtaaaacaatctatacatttaaattagggtcaatttaacttttaggcacaatttggtaagaatattttttttttgtttgacctataaatagaatagactcgacaatcgatattgtttcgacgacaaaggttttgcactataaacatcaaattcactttggaatgtgtcgttcaacctatcattcctcccattctaggaggtggtatcaacatcgtgattcctccgaatgtagatatagacctgagtgtaactacggtggacaaagaaaacgcgtattgggatttcaacttggtttgataagaccgggaaaaacctttgtcaaagttgttatagaagttggaaaagaagtcattctaaacatacgcacaacgccaaaagacgcacgcttcccgaagacttacaaaaataagccacctacttcgtatcttgtgcttcaaccaaagagatctcaacattatccggatttttggaagataaattggtcaagtactcgtcaccaccccacactggccgcagagacagttctaggtcaagagatactgaagcaacaaatcctcaataggctgaggtatcttacatttaatgctgatggagagttagttggtttgtaataacaaatgttgctctttctcctttaagaaacttaacgtatgtgttgttatcagagtttgtgcttttcaatcagagcaacaaatataaatgtggttccaaggttatacatcgtgattcctccgaatgtagatatagacctgagtgtaactacggtggacaaagaaaacgtgtattgtgacatgtctggtatatgtattgagttagattgatattcattaaataagatgttggagaaaaattatttctactaaaaagtaaaacaatctatacatttaaattagggtcaatttaacttttaggcgcaatttggtaagaataatttttctttgtttgacctataaatagaatagactcgacaatagatattgttccgacgacaaaggttttgcaccataaacatcgaattcagtttggaatgtgtcgctcaacctatcattcctcccattctaggaggtggtatcaacatcgtgattcctccgaatgtagatatagacctgagtgtaactaccgtggacaaagaaaacgcgtagtggtgataatggtgaaatcgtgggaggtgaaagtctttttagttagggtttgttcttgtaaatcgtaaaatgtatgtggaatatgaatttcttatattaattttagagttgcttattgtgatcggtctggtctatgtattgaggtagagtcattatgtgcacttgtcatcatttaaatagtttgattgatgttaacttgtgtgttttgacctgagtatgtacaacttaaaaaaatgatcaaaataaacatgattaagcgagttctatgcttttttatacacaaatatcgataccatgtatattcaaatcaagaaaatattcaaactaactatttgaactacaaatttttagtggaaaaaaatatattgacctaaacggatggatgctggtacaaactaaaataatttattatgacgatgatgttagagtttgttaaacaaaatagttatattgaaggaatgggttttgatcccaataaacaattttaaaaaagaagaaggggcgttccgagaattgaactcgggacctctcgcaccctaagcgagaatcataccactagaccaaacgccctttttgttaaattgttacaacagtaactttatatattatctattgtttatttccctccagatattaggtagttcacgctccccgcgaaccctaacgagaccactttactgtcttttgcgcgcctaaaattccccgtgtcggctttcttcttcttcttcttcttcttcttcttcacttttggatctacattgaaatcgcctctagagaaatcaaacccggcgaattggactatcgttgtcggagtttgtcagtggatgaattgcc

SEQ ID NO: 2005 - DNA, 3000 bp, Unknown
  misc_feature (1)..( 3000): cDNA_ID_2047091_gDNA_ID_1620477_Annot_ID_158210 3000 nt of promoter + ATG
attaaggaaggaagaccatggaattaaaatatattaaagcgactaacacaaatttaaatcataaactaacaaaagaaatatgtctgtcattttgttaagtttttataataaagaaaatatattgacgtatatgtaattttaaaatgggccatgcagcatgatatgcattactaagcgaagaaacaaaaatagaggccgaaacgcggaaaagagctgacaaatcgtaaagagtgtcttccacatgggattaggtcaatttcaccataattttcatggcacttcagagcctattgcatgtggtggatacatataagaaaaataagtttatagttttaaaactaaaattgatttagtcaaaaacgcttaataaaaatttcttgtcaacacataaaaaataaatgctataatagattgtgtttttggatagtatggaaaatccaacaaaacaaaatttagatgatatacgattgttttttatatctgttggcaataaattgagatgtataattgaaggattaggtacctttttctgaagaattcgccataatatatacatgcataatgtcataaaacatggagaaaaatgcccataaaaatgtagattgatgatttatgctatttcagtccgcgttttagtccatatttgggccttgcgagtaatttctgcttttattttcgagaactctgtctctgtgtatagactatagagccaagatgggctttataataaaaagtagatatgtagagggactttttggagtaatcgataattatgaattataattacaaattaacaaaccagaaagtagcttgcatatgcttcacattttagatttccttcagttatcatggtaaatacttaagatgctacttgtccattccataaatgttccatgtcctcgtccatatcttacttagcaaagagtccaaaatgtgggatttttctgtcctttaaaaacttaactctgttttttatataccagaagtgggagaccaaggcaacaattggtaactaagtttcaacttttttgagtttttctctcctgactgaatggctttttaaactttataaactcgttctaatttgtcttttccgtttaaggctttttcgtacgttttgcaaatagctaaacttttgaaaggaaaaagtaacctcgcgtttttctcatttatattgcacagaatatagatacaagttgcagctattactgataaaacgtagctacttttttggttgggtttatttgagccaaataacttcattaaaagctgtagtaccaagtttgggtctatcatttacactgctattgtctttgctatatgactcgaatctgatacattcgatttctaaagattatatctaatttttaagcgaattaaacttttgcaagcttggttttgatctctactattctattgactagagaagatgtcatagttgggtgtagaataaggtattgaactgacttgcttttattgattcattaactatggtatttatacacaatgatctctatcaagagataaacataaatccctaaaatataggttagaaactctatcatcaaagatattgtactaatcctaatcggattacacatatctccaatagagttgatatctattaacggcaaaaggagctaagctgccatgatgacccatgaagtatatgcctgcatgctaatacgcagaaaaacattgaatgtgaaagtggcaattattcgaacactcaaatttttttatcttcctaaaatcgtgctcgtgaagatttttcaaaacaaccgatataaccattggtgtttagttgtttacctttctttttattgcatacgatagcccattcttaggaattaaaccatgggggcaactggcaagcatttataatcattgatgttactttaattttcatttaatatgaatattaaacgtagtagctatatcattgggttggaattaatgactgagaaagaatgaatgaaagagagaaacgtgtactcgcagtagaccatataaccattggtgaacaattttatttggaatcgtatccataaatatcatttttatactagtacgcttgcttttacgactactataccttgtgtgggcggaccaacaatttaagaagggggtgtgggtgtaactggcccggtaaaccataattttgttttggccatgtacaaaatgagtttttggcatacggtgttttgttgtatttgaagatcccactcaatatcatttttttttccccaatttgattaatcatttgctttcttgaaagattattttccttataaggataagaataaacagtttcctttttcatggaacaaatttttcatgtttcaaagatattttcattttgtctgaagtatcaaaacagttttacattattatttgtctttttctgttcaaaaaatttaagcaaattagtatataataaataaacagatttgtgtatagtattgaaacctatatccatgagcaaatgtgtggtatataaattagataacaattcttttttgacatcatataaattaaataacattgaatttgaaattaatcacatttttaaaatgtgattgtacgttatttattctttaaaattatgaatactaattaaccaatatatgtcatcgaaataactcaaaatattgtaaagaaaactatttgcattttacatatagatatcttgtaaagttaattacgatatccatagaaatgttatacaatctttgactaaaaacgaaagaaagaattctaataattaataacctttggtgtttttaatgagagacgtggactctctcggtagaaataatacaatgattaacatacaaatttgtaactatcattagccgtcactcgccaccctcgataggacctatatacacttatacacaacactagccacacacatcctcaagcgataacaccacaaacaaaacaacaaaccaaaaaaaaaaaaaagagagagagagagagcaaatctccatcatcatc

SEQ ID NO: 2006 - DNA, 3000 bp, Unknown
  misc_feature (1)..( 3000): cDNA_ID_3065519_gDNA_ID_1620477_Annot_ID_158207 3000 nt of promoter + ATG
tttgataactcattacattttgtaagaaagctgaaatttttaaattgagggactgtacatagaaggagtatggagtcagcaatgtttatcgtgagaaaacaagccagatttttgtatattcttaaaaatgaaaagatttttctatattgatgtataaccgaattcaccatgcatggagataaaaagggtggggcatatgtggtactaatatatcattcaagatttttcttatcgtcgcattattattgtggccttattattttcatcatggaatgacatgtgacacattcaaagttggcatagattccccaaaacaatcatacttttggtctgttttggttttctatctcatgttgatgatgaaatgactcagattctattttattatacagtataactttatctaaaatgccattttacgacatatttttgttttcgaatagtttaaagtgttttgttagtatgtaagtttggtttgttgtagatttctgtctagagtacggatctctactgatcacagccattttgatgtgatttacaaacaaatattttttgagtcatatatcaaatcatacatcttgacataatttgtatatatgattgaattcaggttggatacttgctcaaataatcaaaattttgttctcattttactacgtcgtgaagattcatgagttttcaactccaatcgattggattgaccaatatcttttatatagtattacattattttctatcatatgactaatatgaaattcccaacagacacctttttttttttgggcaaaatcctaacaagcatatcatatatttttctcacaaagaaaatataagaatctttagtatatcctttagagttaacataacaaattcgattctataatacgactacgtgttgaattggctatggttgggctatgagactagtgggattgtcccacataagcttaataatgcacattcatgtttatattaactaaatcttgattagaatcacttacccttttccaaaagttttgagaaaatatatcttttggggaagactgaacactaaataatctcaattacttcaccaacccaacaaaactagaatccgataccaatttactaaagagtacaatggttataaatcaataagaacattgaaaaaacagttcatgaaaagtatccattattcagtgtcagtgtagttcacttagttgaacaaatattgtttttactctacttttattctttttttttagttttggcaaactattctacatttatttggtcttttctttttccagtgtactaaaacaagtttccattgtttttatctgattggtgtgcaagaagatgaacccactctatttgtttattctaactttaaacacagactcttggtttctagaatataactcaccatgaaaactatagaaacaaatgtcctattttaatatgattttaacttataacaattagtattgacgtggatacattaattatatagtagggccgatgctaacgttcatgaatagagaatcccagtataatggtgaaactataatcatgacgtccacaaagaaagattgcaacttgtagtggtcggggaaccttaaacctcaactttaccttaaccattggaggaaaaattctataatgaactttaactttaatgtatttgctgctttcttgacttatattgctaacatcatttcaagtagagggatcaattcattaacatgtacagctttttaatcagtggatctctctaagtaaatatcttcctccatttcatggatttttttacatgtcatattcaccttgattacagtcactttcgaatattacttataacggaaataatatgttttttttttgctttacacatctctggttgaatacgcaattcgtaatttcctatgtgacacctgaaatcttgtatctttcttaaaagttatagactagcttcttgtggatctaacaaatccttttagctaaaaataatccattaaacctagttccaaatgattcaacattttggtatactaaattactaagtgtatgtcctagggatgttgtgaacaaaaaccagtctgatttaaacatactcttggtgatatatatatatagtcataattttcttaatcaagtacaaattggttcatgattttttgatccaccaaaacatttctaatgaaacgaaatactcattaaagaacaacactcacactaatgattgaacattaatatgaaccatgtgatattgaagtgaaagcactaactttaatgcttaacaagtcatcccaaaatattagagaccatgcatatttgtaccagtgagagttcagattaatcttgaaccttgtgtgtataactcagtaaaaactgtccacgtggtagatcaataaacaaccacaatctggcacacatgatataaagacaaagatttttgatatgtctccaattaatgtaaaatcttaacaataaaaaacaattctatagtatggatggtaagagatttgttgaaggagaagaggacgtgggaaaaatacaaagaagctaaaaaaaaactcattgcaaccacaaacaaaatggtataaagagacaaaagagagtaatggacatggggaattacaaagaagcagaaaaccttgcaaccacatgaaataaacaaatgtctttgtcataagataatgaaatcacactgttgtctcaatgtttgtttagatctatctgatcatatatcgctgaaacaaccacacaaaaagcaaagccacattttatataaagacccatcatatatcaatcaatccccatctctcttcacatgcccatttgaatcgtatctcctctcatttcttcttttgttttgttggagttagataaaatcaaaggtctaataaaagtgtcaaaacccttatcgctataacctccactaccatcttaaacttctccttataactcacgcttctctgctttcttctctcagagtctaactgctcaaataagaaaatg

SEQ ID NO: 2007 - DNA, 3000 bp, Unknown
  misc_feature (1)..( 3000): cDNA_ID_2047113_gDNA_ID_1620477_Annot_ID_158205 3000 nt of promoter + ATG
ggctcttccggttactctccgtcgcggttacagttacgaccaccgtggccgtcgttaaaacgtgcagcagctaatccattttctaggcagaataaacgccgtcaaggcgctgggaatgtccgtatcgatgatttctccggcggaactggaagcgattccgatgaagcggtggagcactacggcggagaagagaataggttagtccaaattgtgctgttcaaggatcttgtgtattacaggattgtgatggtttttgcaagtccttaaggtctcagttctgcaatattttgaatgtttgtgctagctttagtgattatttgtgcaagatcctcagatatgttgttgcaatttttgacagagctatagaaagacctgagcaatcatcaagatcaatgtctgaagaaactgtttcatctgagcttgaagaagagcctcaaaaagtgtttacgcacactgtaacaagctggagcaacggtttcactgtcgatgatagctcgttaaagacgttggatgacccggaaaatgcaacctttcttgaggttactaattcaataccttcttgccattttcaagttgtgttacatacaacatagtatagttacaacttacaagggtattggtctttctctgtattactttagataacattatgttccatgacaatgccagatcatatcaagtatggagtccccacgtgaactcggtcaagtccgtgttcaagtcaaaatcattagccgtgaagaagaaaactacactgtatatttgtctccttctctcttctctgattcaaataagccggtaaagtgaaagcccttattcttatatcttaacaacaggaatcacaagccggatcagactctgcctcaactaagccaccaccagctttagcaatgaggttatatgacaatgtgcttttctgaaggagatgaatcgttaatttctcaaaactctgaagaaatgtgctgttcaagaatccatgatactgcaaggatcttgtgtataggataaagatgttgatggtttttgcaagtcttgtagaagaaggtttttgaatgtatgttgtagctttaatgggatgcttgtgcgaaagctaaagatgtagatacgcttttcgacagagctaaggagtcagctatagaaagatctgagcaatcatcaaaggtattgtctggagaaactgattcagctgagcttcaagaacaacagcaagaagaccagccatatgaagtagtcacgtacactgtaactatttggaggaacggtttcactgtcgatgatgatccgtttaagagtttggatgatccagaaaatgcagcttttctcgaggttactaatatcaatatcttcttgtcattttcaattatgggtctttctctgtacttgtttcacttggataacataatgttccaagtatatgccagaggataacaagtttggagtccccacgactactcgatccacttcgtgttcaagtcaaactcatcaagtgtgaagaaaatttcagtgtatactgatctccttccctctctctctaatctttttctcttctctgattaaaatgagctaatatttttaacaacaggagttacaaactctagccggatcagagtctacctctactgagccaccattgacgactacacaaccaccatccatgagctcattagtggtggatcctgcagcgccaacaacctcgatccagcttatattagcagacagcacacgcattgtcacccagttcaatactcaccacaccattagagacattcgatgcttcatagacacgtctagaccagatggctccaaagactaccaattactcatcatggggtctcctcctacaccactgtcggactttgaccaaaccatcgagaaggctggcatcgccaactctgtcctcgtccaaaaattctagctcttttctaagcacattagagaccaattctatggttacaaaatagcatcataaactttttattgacttttcgctagtcttatgtttgactagcgaaattattattggtcaaacgctgtgtagtcgtctttgatcatgaaaaaagtacagtttacgtacttgttgagttttatactttttattctcacacaagtttctctccttaactatagaagttaattgatcaaattaggacgttgatggcgtcataatgaaatgggattggtgaattaaacgaaaattgacgacttactatttgacgaccatgtaaaacgtttacttttcagggttgttttgacttttttgactcacctgccattctgtcaaaccgtgcgtgtccatgtttattgatttttccttctgttctttccacctatgtgtgtgtgtctctgtgatgtttataaaaaaaaacaataaatttttttagaaaatatctggatgttccaggtttgttattcgattcagagcaaaacgattaagtgtttaaatggatttagatttacagtaaatatccagatagagagaaagaaggataaggagagaagaaaacgattactttcttctattcttgttcattacaaccttataatctcaacatttgttttttttcttttgttctctctttcttacatatttcttttggatttcgttgtcttttttttttctctcttttcttctcctctctctcgctcgatttcaatttgggcgagaaaggagcggtcttttgtctttcctgggtttatcagctagatccctcttgcctaaagtttgtaactttcttagggttttcttctgatttcctctctctcggggttaattctgctcaaaaatgtaagcccttctccttttatttcgtttgttagattttgttttgcttgatctgattctgttatgtaattttgggttcagggtttgattcagaggcaaatctggttttgtttagacaataaagttcgggactttttgacatactcacagctggtttttagctttggttcttatagagagtaatagtagtgaagggtttgtgccaatagttagaaatg

SEQ ID NO: 2008 - DNA, 3000 bp, Unknown
  misc_feature (1)..( 3000): cDNA_ID_2047149_gDNA_ID_1620477_Annot_ID_158194 3000 nt of promoter + ATG
tctttatactgcatataaacggacagcaacttcgcagacaattttgatgggtatggtctacggaataaccacgaagatcaaacttaaaaaatgttacaatgtttttaagaaaagcgaagctcaaatgtttcataaaagaaacaatttatcttaataatattttggcctcagacacatttaactacgataaatatgttgtacaagtaccgagactagtggatctatttgtttacaatttcacctcttcgagcatttgtggatgacgaaagagaatggtgtcataactattctgaagacaaatgaagtcacacatatcaaaacaggctgaagaatggccactcatgtcttgccacacaattttatattctctttattttgcttttttcactaggtcacatgtctcttgctcgaatcacctctcttttgaaccatttagtatgtaacacagttctgaacaatgggtacatgtgaatctctctggcaattagcactaaaaagctgccattttttccgttcacagtatcttttagcttcttttgactttttttttttgttttggacaaatgcaagtcctgatcaaacaatgaattacgttagattactaatccgacaagagcaaaacaatgatcagtcacgtgaacaaagatttttagtgtacggacggccccgttgcaactccaatttgggctcttgggcttttcgtgtcatctatattgaaagttttttgaaaagacaatgacccaaaagccagcgcatctctgtccaccccatctggacctgacttgtgtacgaatgtaatatgacgaattataattcgatgtatcaagatgaattaagacgagcgtcaaatcatgatgatcactaaggttgaatgaactgaatctatagtgtgtgacaaccaatgaaactccgagagcatattgattttcgcgacattcacacaaatgaaacggctgtgatactatcatactactttagaaatgttatgttatttatttttatttaaaaacagagtattcacaggttctacaaaacgttcataaacttaaccggttttaacaaactattaagtcgagtaaaccatatgtataaatcagtagtttcctatgtgtagtctctaaatacacaaaaatgtttttaacaagattcaaatatataaataaatttatacatgttccggtctacttgccaaacatattgtttcacactcgatacgttttggactaccagatctttcaacgaccgtatgacgatatgtgtgacaacaaatggaatggagcattaaaaatgacttcacacttctatgtatctaatacaaagagaaacataacgaatctaatcctccaagccacgttttctagtacaagcctaaaatactaaaaagggtaacctaaacaaataaaaaagttataattaaattttcccccaactttttctaaagagtataagcaacaccaaacccgtttttacgtagaagcaatgtctctctctcatcctataaacactcgacaaacaacacttttatgaattcacattcaagaacactataaacgacaactaaaaatataatttacaaaagaagaacaaaaaaatgtcgaaaacattcaaagccataagagaccggacatattcaggcgtaggagacctcatcaagctcctcccgaccggaaccgtcttcttgttccaatttttaaaccctgtcctaaccaacaatggacattgcctcctcatcaacaaatacttaaccggagttctcatcgttatttgtgccttctcttgttgcttcacttgcttcaccgatagttaccgaacaagagacggttacgttcattatggagttgccaccgtgaagggtctttggccagattcatcttcagtggatttgtcttcgaaaaggcttagagttggagatttcgttcacgctttcttctctcttatcgtgttcagtgttatttccttgttggatgcaaacaccgtgaattgtttctatcctggctttggctccgctgggaagatctttctcatggttttgcctccggtgatcggagttatctccggtgctgttttcacggtgttccctagtagacgtcacggaattgggaatccctcggaccacagtgaggatgatgcttccgagatgaaatgatagtatatgattttatactatttatatgcataaaacattaaaatgtaatggcatgtgtttattcgtggaatggtaaatacgaaagttttataattgtgatctttttttttgttatttttatttatgtatttgaatgctgatcatatgttgtgtgtttgttttttggtattttttccatatgtttgttgataaactcaaaagtaataacatatctctttttatgctcatagtgagtgaatcagcattattgaaatcactagatgttaaggagttgaaacttaagagacacttatatgaactaatgtatatacacacaaatatttctatatatccttttattttgaaagaaattagctaggaaaaattaatgtggatgggccctttaacaaaaaaaataaaaaaaattaatgtggatgttaaaaaggtaagcctagagtatgaataagataaaaagtgtacgttcttgattttctttagatgataatcattcaattattatacattgatttttaagaaaatgataaaaaattactaatattggtcatggatgtcgtgagccatttttctttttgtttgttctgtttcgttcttagtaccaatgattacacaacatagttgcaaattgagaaaacaaaagtttgggtccgaagagtaagggcttcaaatctattgaaataaagttaggggttaaatattgaatagacaaaaggtttaagactatatcgcaatttatcaaaagtaacattggatgttagaaccctgctgccttaaccactctaaaaccctaaatcccgccatcaaaagctagaagaagaagaagaagagaaaatcaaaaccaaagcttttggagaatg

SEQ ID NO: 2009 - DNA, 3000 bp, Unknown
  misc_feature (1)..( 3000): cDNA_ID_2990944_gDNA_ID_1620477_Annot_ID_158196 3000 nt of promoter + ATG
aaaaacgaacaaaagtaagtaccaagctagaagcagaggaggctatagaggtaacggcgagagatggtccaccgcgagaggaggaaggagttagggttttggagcagacaccttgccggacgtgccatattccgaccttctccaacgccggagcaagcacatacttccccgtcgaatcgtaagctatgttcgaatctacagatgaaatcacaccgaaagaggtcgctgcatcgtatctttggtaagccttcaccattctccaaaagctttggttttgattttctcttcttcttcttcttctagcttttgatggcgggatttagggttttagagtggttaaggcagcagggttctaacatccaatgttacttttgataaattgcgatatagtcttaaaccttttgtctattcaatatttaacccctaactttatttcaatagatttgaagcccttactcttcggacccaaacttttgttttctcaatttgcaactatgttgtgtaatcattggtactaagaacgaaacagaacaaacaaaaagaaaaatggctcacgacatccatgaccaatattagtaattttttatcattttcttaaaaatcaatgtataataattgaatgattatcatctaaagaaaatcaagaacgtacactttttatcttattcatactctaggcttacctttttaacatccacattaattttttttattttttttgttaaagggcccatccacattaatttttcctagctaatttctttcaaaataaaaggatatatagaaatatttgtgtgtatatacattagttcatataagtgtctcttaagtttcaactccttaacatctagtgatttcaataatgctgattcactcactatgagcataaaaagagatatgttattacttttgagtttatcaacaaacatatggaaaaaataccaaaaaacaaacacacaacatatgatcagcattcaaatacataaataaaaataacaaaaaaaaagatcacaattataaaactttcgtatttaccattccacgaataaacacatgccattacattttaatgttttatgcatataaatagtataaaatcatatactatcatttcatctcggaagcatcatcctcactgtggtccgagggattcccaattccgtgacgtctactagggaacaccgtgaaaacagcaccggagataactccgatcaccggaggcaaaaccatgagaaagatcttcccagcggagccaaagccaggatagaaacaattcacggtgtttgcatccaacaaggaaataacactgaacacgataagagagaagaaagcgtgaacgaaatctccaactctaagccttttcgaagacaaatccactgaagatgaatctggccaaagacccttcacggtggcaactccataatgaacgtaaccgtctcttgttcggtaactatcggtgaagcaagtgaagcaacaagagaaggcacaaataacgatgagaactccggttaagtatttgttgatgaggaggcaatgtccattgttggttaggacagggtttaaaaattggaacaagaagacggttccggtcgggaggagcttgatgaggtctcctacgcctgaatatgtccggtctcttatggctttgaatgttttcgacatttttttgttcttcttttgtaaattatatttttagttgtcgtttatagtgttcttgaatgtgaattcataaaagtgttgtttgtcgagtgtttataggatgagagagagacattgcttctacgtaaaaacgggtttggtgttgcttatactctttagaaaaagttgggggaaaatttaattataacttttttatttgtttaggttaccctttttagtattttaggcttgtactagaaaacgtggcttggaggattagattcgttatgtttctctttgtattagatacatagaagtgtgaagtcatttttaatgctccattccatttgttgtcacacatatcgtcatacggtcgttgaaagatctggtagtccaaaacgtatcgagtgtgaaacaatatgtttggcaagtagaccggaacatgtataaatttatttatatatttgaatcttgttaaaaacatttttgtgtatttagagactacacataggaaactactgatttatacatatggtttactcgacttaatagtttgttaaaaccggttaagtttatgaacgttttgtagaacctgtgaatactctgtttttaaataaaaataaataacataacatttctaaagtagtatgatagtatcacagccgtttcatttgtgtgaatgtcgcgaaaatcaatatgctctcggagtttcattggttgtcacacactatagattcagttcattcaaccttagtgatcatcatgatttgacgctcgtcttaattcatcttgatacatcgaattataattcgtcatattacattcgtacacaagtcaggtccagatggggtggacagagatgcgctggcttttgggtcattgtcttttcaaaaaactttcaatatagatgacacgaaaagcccaagagcccaaattggagttgcaacggggccgtccgtacactaaaaatctttgttcacgtgactgatcattgttttgctcttgtcggattagtaatctaacgtaattcattgtttgatcaggacttgcatttgtccaaaacaaaaaaaaaaagtcaaaagaagctaaaagatactgtgaacggaaaaaatggcagctttttagtgctaattgccagagagattcacatgtacccattgttcagaactgtgttacatactaaatggttcaaaagagaggtgattcgagcaagagacatgtgacctagtgaaaaaagcaaaataaagagaatataaaattgtgtggcaagacatgagtggccattcttcagcctgttttgatatgtgtgacttcatttgtcttcagaatagttatgacaccattctctttcgtcatccacaa

SEQ ID NO: 2010 - DNA, 3000 bp, Unknown
  misc_feature (1)..( 3000): cDNA_ID_2047125_gDNA_ID_1620477_Annot_ID_158201 3000 nt of promoter + ATG
gttaattggactaactcgacgttggatcagttaaagaatctaacttttagtgatattgataaactctctatatcgaatataccaactggatcatccaggttaagaaacttctttaatatttgtggctttagttgattctagtgatgaggaatattctgactagtatatgtaaacaggttttgggtgcatttgtgtatggcttatgttattaccttttggacttgctttgtcctacaacgagagtacaagcatattgcttccatgaggctacagtttcttgcttctgagcataggagacctgaccagtttactgtatgcagacattttaaatctcttggtccacttactttttgagttttctgaagaggaaatgtggtatgtgattctattttttgatgaatgtaggttcttgtaaggaacattcctccagatcctgatgaatcagtaagtgagctcgttgagcatttctttaaggtcaaccatccagactactacctcacttaccaggtactacaactttggttgtctaacttaggatgttccatgttttcggtgtattcatcttctcgtttaacaaaacaggcggtctacaacgcaaacaagctgtcggaactggtacagaagaggatgaaattgcagaattggcttgattactatcaaaacaaacactctaggaatccatctaaaaggcctttaataaaggtaagacaaatgtatgcaaccacattgctttcttgatcttctctttagttgaatcttgataatcttctatttacctgagcagattggtttccttggctgttggggtgaagaagttgatgcaattgatcactacatagaaaaaatcgagggtctaacgagaaaagtaaatgcatcagttcaatcttacatataatcttgtgctactaaacttgtttttgatcatcttgttgtttctttactttgatggtttcagataagtgaagagaaagagacagtaatgagcagcacaaaatcactcgtacctgcagcttttgtatccttcaaaaagcgttggggcgctgttgtttgctctcaaactcaacagtctcgaaacccgacagagtggctaaccgagtgggctccagagccgcgagacatatactgggacaatctagcattaccatatgttcagctcacaatccggagactagtaatagctgtagctttcttcttcctcactttcttcttcatgatccctatagctttcgtacagacactcgccaatatcgaaggcatcgaaaaggctgttccgttcttgaaaccgcttatcgaagtgtataatctctcaaccttaattctctgttccttaacttgtgatgatgtttctctgaaatctttgtgtatgtggacaggaaaactgtaaagtcatttatccaaggttttcttccgggtatcgcattgaagatattcctcattgtcctcccaagtatactaatgctaatgtcgaagttcgaaggcttcataagcaaatcttcactagaaagaaggtgtgcaagcagatactacatgttccagttcatcaacgttttcctctgtagcataatcgcgggaactgcgcttcaacaacttgacagcttcctaaaccaatctgcaaccgaaataccgaagacaattggtgtctcgataccaatgaaagccactttctttatcacctacataatggtagacggatgggctggtgttgctggagagatactgaggttaaagccattgataatatatcatctcaagaacttcttccttgtgaaaacagagaaggacagagaagaagcaatggatcctggaaccataggtttcaatactggtgaacctcagatacaactctacttcattcttggtctagtttacgccgctgttagccccattctccttccttttatcctcgtcttcttcgccttagcttacgtggtttaccgtcatcaggtttaaaacccaaatcacagaatcctctgcttctttctatattctattatatgcttaagaaactaagttctttttgttgcagattataaatgtgtataaccaagagtatgagagtgctgcagcgttctggccagatgttcatagacgtgtagtgattgcactgatcgtatctcagcttcttttgatgggattgcttagcacgaaaaaagctgctcgttcgactccattgcttttcatacttcctgtgttaaccattggattccacaaattctgtcaaggacgttaccaacctatatttgtcacataccctttacaggttttctactcttaccaagaaatgagtcttcttgtgtttttggtcttcttagtgagtttcttcttgttttcaggatgcaatggttaaagatacgttggaacgcatgagagaaccgaatttaaacttgaaaacgtttcttcaaaacgcgtatgcacatccggtgtttaaagctgcagataatctagctaatgagatggttgtggaggagccagcgcccgataagacgccggatttagtggcgactaaacgtggctcaaggaggtttaatagcggctctgctgaaacctttacttagtaatactaatacttagtgaaaagtggtgatgagatttttatgattttttacgaacgtttcttcttattaatagaaagaagttttccaaagtttactttggtttttgctatatcatatatatacaaaaaaaaaacaatatcaaatagaggtcatcaaatttatctaaaacaaatcaaataagttattagtcaacattcagcaatattgaaaaacaaaagtgcaaaaaaattaaaaaggtaaaattgatttccttttaacacaataattgatccttcccaaatacggaaccaacacaaaaagcctaaaagcttatcgaaaacaattcaatactctcttctcctgaatctctttacctttttacgttgacattgatcctcgcagtgtctgattttgatcgaagaagaagaagagatcgggattttttcgcggttgtatatcgcctatg

SEQ ID NO: 2011 - DNA, 3000 bp, Unknown
  misc_feature (1)..( 3000): cDNA_ID_2025094_gDNA_ID_1620477_Annot_ID_158203 3000 nt of promoter + ATG
acgccgttaaaactctcgttagttaacggctgactctgaagtgaaaactgaaaagtcgaagggtctctttatattttcagaatcaaaatctgaaatttatctctcggtcgatccagtcttcgtgagtgacttcgacgacgacgacgagtcacactactcttgagcttctcatacttcgtaagttcactctcctcttctctaaattgacaaactttttcttcgttttctgctattattgacgacgagacttgattttgttttgaaatgaaatggttcaagtagctgacttcgactatgttcttttgggtttttgtcattgaatcttacttgtctgatttggtcgatgtttaatcaattcaacacttaaagattcaatttttggattgacacttgcacatttttattcagacccaggttgatttgggaaataatggatgaatctctggagcatcaaactcaaacacatggtaagtaaattttcatagatttaatctctctgaatacatatatatgacttcaatatgtttgattggagtttttttgttgtcccatattcaattggatgctttgttaaaggataaatgtctatcaaattatgttgactgcgttattctttctaaatcatattgtgaatcttggaacaaagcatgtatacaacaaatttgttagacttgataactccttttctgtttgttaagaattgagaatgactattggggttgactaatgcatcttttgtggctccagaccaagagagcgaaatagttactgaaggaagtgccgttgtgcatagtgagccatctcaagagggtaatgttcctcctaaagttgatagtgaagctgaggtcttggatgagaaagtcagtaagcagattataaaggaaggtcacggttccaaaccatccaagtactctacatgcttttgtaagtaccctttagctttctgttgattggatgttgatttttcgattgcacttgttggcctattgctactgtttatttgaatctttctatctgaccaatttcatattggccatagtgcactacagggcatggaccaaaaactcgcagcacaaatttgaggatacatggcatgagcagcaacctattgaattggttcttggaaaaggtatgtggctgtcgaatatgtactctacacctccatttcgttagatgaatcgtcattggtaaatttgatgagttagcttgtgtattatatgaacccaatgagatggatatttgggaggaaaaaagattgagttttgtattttttttgcttcaatgctgattagcccattttaacgtcactatacaattttttttataaaaaagattgtgcactaagagtgaaatgttgtctgtgagacagagaaaaaagaactagccggtttagccatcggtgttgctagcatgaagtctggtgaacgtgcgcttgtgcatgttggctgggaattagcttatgggaaagaaggaaacttttcttttccgaatgttccacctatggcagacttgttatatgaggtggaagttattgggtttgatgaaacaaaggaggtaagttatttcctataccatcatcttgtttccttaccaagacgactccacatccaagctttatcccaacctccttgcttacctctctgacttagatgatgtattgaacagggaaaagctcgcagtgatatgactgtagaggaaaggattggtgcagcagacagaagaaaaatggatgggaattctctttttaaggaggagaaactggaggaagccatgcaacagtatgaaatggttatgcatctctctctatctctatctctctttccaacaattacggtcaaagtttaggttttcaggcatacttagtgagtctgctcgaggctcttgtgtcttctttcggcttttgattagtcatggttttgctgtttcaggccatagcatacatgggggacgattttatgtttcagctgtatgggaagtaccaggatatggctttagcagttaaaaacccatgccatcttaacatagcagcttgcctcatcaaactaaaacgatacgatgaagcaattggtcactgcaacattgtaagactcatcaaaccattcatttgaagaaaatcattaaagttcatactcggtttctcgaaatctaatcaaactcaaaaccttatcaggtgttgacagaagaagagaaaaacccaaaagcactgttcagaagagggaaagcaaaggcagagctaggacagatggactcagcacgtgatgatttccgaaaggcacaaaagtatgctcctgacgacaaggcgattagaagagagctacgagcacttgcagagcaagagaaagccttgtaccaaaagcagaaagaaatgtacaaaggaatattcaaagggaaagatgaaggtggtgctaagtcaaagagccttttttggttgatagtgttatggcaatggtttgtttcccttttctcccgtatctttcgacgccacagagttaaagcagattaatgtatgaagaagggtaacaattcaactctaaaagaccaacgtgaaagatctacccccatttcttattagtgagaattttgaaaaatattttatataagaaaaaaaaatagtctctattgttttcgattataaagtaactttatattttgatccaaaaaaataaatttttaacaaaaaacatacaaaattcgaacgtaaaatctacttccttcaacagaaatggcggtcttcatagtttttgtctttgaccaaagactttcaaattccagctgctagttgcattaaatgatcttagtattattaattaattaagaaacttctcaacaattaacaaacactaatcagtaatcatcattctctttagttgaaaaaaatagtcaacgtttgattaagtcaacctttttcgtctttgaatccatcttcttccccacagagcaacgacgaaacaaaaaaaacagagacccttcctctggggaatctaaggaagcttcaaaatg

SEQ ID NO: 2012 - DNA, 3000 bp, Unknown
  misc_feature (1)..( 3000): cDNA_ID_2047121_gDNA_ID_1620477_Annot_ID_158202 3000 nt of promoter + ATG
aagaagatggacatggaggcatcgaaacagttcttggcggaactaaaagtcttaacgcgtgtacatcatgtcaacctggtaaaccccttttgtgttctctcaagataatatctgagatcagatgaagatcaagtcttagccaaattttaacgaatttgttttttcttgcaggttcgcctgattggatattgtgttgagggatcacttttcttggtgtatgaatatgttgagaatggtaaccttggacaacatttacatgggtcaggtacgcaatataaagacctccaaaagtgaatcatttttcgagaaagttgtaaactaaaagagtttatgtgaaactaggacgagaaccattaccgtggactaagagagtgcagattgcactagactcagctagaggtttagaatatatccacgagcacacggttccagtttatgtccatagggacattaaatctgccaatattttgatagaccagaaattccgagcaaaggtacattctcgatttctcttttgtcaatcaaaagtgaaaaatactgaaaaggttagatttttcctttgtcaccgctctgagtcgtttacgtgttacaggtagcagatttcgggttaacaaaactgacagaagttggaggttcagcaactcggggtgcaatgggtacatttggttacatggcaccagagtaaagaatttgatctcgtttacacttatatactactttagagactacactatagtgatggtgtatatatgtatgtatgcaggactgtttatggagaagtgtctgcaaaagtagatgtatatgcatttggagttgtcctttacgaattgatttctgcgaaaggtgcggttgtcaaaatgacagaagccgttggtgaatttagaggccttgttggtgtggttagtattattgtttcttcgtaacatttagtctttctgatttaaaggcatgtatgtggatcacttaacaatatgctttgtttatttattattcagttcgaagaatcattcaaggaaaccgacaaagaagaagcactacgcaagattatagacccgaggctcggtgatagttacccgtttgattcggtatacaaggtaatatctcttcttgttccctattctattcatcattgatcattctaaaagagggtgtccaatccgttttttggtccgaaaaaccgattaaaagtgcgatttttaaaaaccggtattcactgaacaatgtgctattcgattagcttaaagtgtcgaaaaatcaaaccgaataccggattgcacatagctaattttaataacggggtaagccaatttggtgttttatgtgttgtggtatagatggcggaattagggaaagcatgtacacaagagaatgcgcagctacgtccgagtatgagatacattgtggttgctttatccactctcttttcgtctaccggaaattgggatgttggaaacttccaaaacgaagatttagtcagtcttatgtccggccggtagactcgttttccggtttgctgttgttatatagaaatgattgttttttggtatgctcacgtatattttgtctgtctatacgaactttacatgtcacaactcacaagttgacttttatatgattttctataacgctctatatgtcaattattcaacgtctccgatatcagcatctcacgtcaaagataataatgaaatgcattaaaattctcataaataaattttttgaaatcgagtttgccgacaaaaaaatcaaaacataaaaatataactttttgtgatggatactctcacgaagcttagaacaagtcttccataacaccaaagaaattcgaatgattttgtcacatggattccccaatacataaaatctatattccagcttagaacactaagtatgtttcttatttcacctagctagattttctttattagaaatagagtaatcgaatattcttttaccataaaccaatatatttcattttttgtttttttcttctgtcaacaacatacagatacggctacatatatctatgattttttttcgtttgtccattatttgtaacggaataattatttaaaacacacaaaaagttaccttaaactgactaatattaaatcaaaactttttcattccaaaagtcagatctcaaacctttttttttaacataatgtgtcctctaaactttcaaatcagggaataaataaatacattagaaaacgttaaaccaatataaaatacagccgttataatatgaacataaataacatgctaatacggcgagacctataaggctaataaaccattattgcttctctaaagaaactgaaaaggaacccagtaacggacgatgtcctaaacaacaaaacattcaattaaaatacaaattccttaattaacactattactttatttaacacaaattaatctcttttgccaggtgtccttcaccgtttaatcctcggttcgctaaattagttaattaattaattaaatggacttgtaacacccaaaacgtatgaatcagcagaaatctcacttcagttgaatctttggatcaatttccaaaataaacccaaacacacaaattaaaaatctcatttttatgaatgtttctgcttcttcttttgatccctaatactttcttcttcttcttcttcctctccttcattctctgctcaacgttgtttgacttcacagatagaaacaacaagacgagtttcatcgctgagctcttgagaaaggtaaaaacttaaactttatctctatctttcacattcatgtgaagaatcactcatttgtagagttgattcagtgtttaatggatttgacggaatctgaaaagactatgactaggatccaaaaattccgatttctgggtgaaacgagaaatttatggagaaaaactagctaaaaatattggcaatttggaagtccttggattgcaaggaaccctaatttttttcgtttgtttcaggaacattgtgtgtttctctctaaatcatg

SEQ ID NO: 2013 - DNA, 3000 bp, Unknown
  misc_feature (1)..( 3000): cDNA_ID_3065544_gDNA_ID_1620477_Annot_ID_158190 3000 nt of promoter + ATG
aagcaaataacagagaatatggatttggttcagaagcagaagagtttgcaagattacaccaaatcactcttcttagaagtaagtttttcacatttgaaaagatcaaataatcagaaaacttgttttaacgttcacaactttttctttctggttttaggacttgtagtaaaaatggttttaggacttatagtaaaaatgtgttaggcttttgtagtttctttggtaagataatcatgagtttaggttatgtaaaattagtttctgattatggaaagtcttttgttttgggtaaatacaaaaaaggggattttggacagccagttcttgcagctgcaacaactacaagatgaaagcaatccagattttgtttcacaagttgtcacactcttcttccaagactctgataggattctcaatgatctctcactttccctgtaatcttctttacacattctctctttaatctttttttttttgttcttttccaaaacttgtgtttctcactgtttttttatgcttcgggcagagatcaacaagttgtagactttaaaaaagttgatccccatgttcatcaactcaaaggtagcagctccaggtaacaacaaaaacaaaactggctatttctgattttaatccaatgataatgacattttcttgatcttgaaatgtgtaacaatatatattgccaaaaaataacagtataggagcacagagagttaagaatgcttgtgttgtcttccgcagcttctgcgagcagcaaaatgtcgaagcgtgagtttaatcgatatgttcgttggtccattcgttatttctttgttttaagatctgattaggaaaatacatcgttgaaaaatttcagatgtcatagatgtttgcaacaagtgaagcaagagtattatcttgtgaaaaacagattagagactctgttcaaggtaaaaagtcaaagagactttttttttttttataaaaccacccacataactcttatctagttatacaatattttgatcaacatttgaaacttatctgattcaattttggttttgatgatcgaatctatgcagctggagcaacagattgtagcttctggtggaatgatcccggccgtcgaactcggattttgagtgaatttcataaacatctctgtccattgttgtttcattttggactctctcttcttcctctctttatgtgactatcaaaaaaaggttcttatgtgaacttctttctttgtgccattggaagagtgagacatgctaaaacgtttcttaatccacatctaaatcccacatatgtaaaataagatctcaagcaaacatatagtcatgagtcatgactacaattatatagagtttgatcaagataatgtacgcatcaaggtaatgtgatccggacaacttggttaggtattaggttgttgttttactgtaactgttagaagtagttagaagtcttgtagtccttgaccaaagaacacagatgggccatatgaattttagtagcccaagatgataacaaagggcccgtactaaacatccatgatgatcttggaaatcttttttttattacgattgcacttcgacgaatctctaaagattttcagacatttatacaatgcaattaagaaaaaaataaagttatactatgtgagtgcacgttaaataatgtagctaaaaataaaataatgacaaaattcttaattacttacagatccgtgacctgtcgtcgactatatatggctccaatttataacctcatgttcgatttctagacttctagtttaccacttataactttgtattgctctatactcgtattaattagtgctccatcttttttatttgaacttttttgggtaaagaatgagcgttcccttcatcgtttgttcataactttactagttcctttaattgtaccttctgtttaattttgttttcaagtgacctttttgtcttttcaataataattaagatttccagttcgtaatttcgtatgtataatgaaccataccattaattatgcaatatgacaaaaatatgatgtttatatgttcttccaccttgttattatcgattacaaatttaaataaggatcatagggtaaataacacttttttttttttggttataatcaatatcttattcctattttattgtttcaaacatgcatagtatccaaagggaagcatgttttggtgaaaatatatgcatagaagaagaagactaatcagtaatcaagacaagagataggttgaataattccattaagttttctcctatctgtagtctaaatcactagttacaactttcaacacacatgaaacacattatacatgcatcattattcattaatgtgttaggttacgctacgtatattttgtgtagatttgaaagtacagatatgtaatgtaattatcatacaaacatctcttaattaaagtctcccacaaagccacaatatggtgtaagtgattcccgttggattagtacattagtcaatacactacttttttgacggctactgatttaagtttctatttgaactatccccaataatataaatatcacgtcgatgtgattgagacgagcaatagagccgtgcttaactacttttatagtgaaaattaaataaggcttatgtatccaaatacttgtggtcaacttttgtggtctgaattatttatcatttttctgtcacttaaattaaatcatataccttgaattataccaacatctaacttgggaataagaggtgtgtatcttgcggacaaatgaatttagaccgttgttaaagagcgtaaactttaataagacgttaacatgtgtgtgaacagaaagctattctctaaaattttgatattaaatttgtacaaaatacatttctacgtggatttaaggtgttaaaagagttcgattagtaagctttacattttattgatactaccactatatatacgttggaatgtcatatcaaacacagattaacaaattctctcaaatg

SEQ ID NO: 2014 - DNA, 3000 bp, Unknown
  misc_feature (1)..( 3000): cDNA_ID_2047167_gDNA_ID_1620477_Annot_ID_158189 3000 nt of promoter + ATG
tcaggaaagtaatacagaaatgtttgataggcatgaagaagcagaagcaggccctgatacacaaatggctgctgaagtgatgaatgctctgcactctggggacggcagggaaattgatcctgagccaaataatctaataggtaagaaattgttattggaaggaggcatttctaggtgtggagtcgttaccagaaagtccaagaggatcaaggggattcaggctgtggacaatgatgttgaatcattgaaaccaaaaaacaagaaggctagatcaattcttgctaagtcttttgagaagaatatggataggtattcaaaaaatgacaaagttgatacgccagatgaagctgttgcgtcaaccacagaaaagaggcaaggagaattatcaaacaaacattgtatgtctaagttacttaagcaatcacatagaggtgaagctgaggtgttgaattatcccaagcggagaagatcagctcgtatttcacaagatcaggttaatgaggctgggaggagttcagatcccgcgtttgatactccagctaagtctaagacgccgtcaacaaatgtatcgcctatatgcatgggtgacgagtatcatagactttcttgcaaagattcatttacatcacacactacaagggaatttcgtagcttaaccgtaccagtagcggaacctatctccgagacaaagagtactagaaagagaagagatttgggtagtatatgtgtcttgttcagccagcatcttgatgaagatgtgaccaagcatcagaagaaggtatagttgggtttctaactgtaactttagttaccttcgatcatgtgaccttattccttgctttttcttttacaattggtagtgaattttcagttttgcattaaccaagtcttctagacaaaagtaaacctcttaacaatctggcatatgatatgtttaacagattttggcaaggtttgatatctcggaagcttcctccatgaaggaggcaacacacttcatagctgataactttacgcgcacaaggaacatgctagaggcaatcgcttcaggcaagccagtggtcacaacacaatggcttgaaagcatcgatcaagtaaacatatacgttgatgaggatatgtatatactcagagattcaaagaaggagaaggagttctgtttcaacatgggggtttctttggctcgtgcacgccagtttccgctactacaggtatctaatactcttttggtttcaattctttttttacctcgtttattctcccttttcggctcattatatttacatatttcagggaagaagagtttttatcactccaaatacaaagcctgctttaaacacaatcactactttggttaaagcagttcatggactggtaatcatttcttcacctttttacactttcatgtgcatgttttcaaaactttttctccccgaaactgatccataatgaaaacaaatgccagcctgtagaaagactcggaagatcttccctaagcgaagataaggtcccagagaatcttctggtcttatcatgtgaagaggatcgcgctatctgtataccctttctggaaagaggtgagttttatagtttggtctatataacttctgcttttgtatgtggtagatttcacggggaaatcacagtttttcttttccttcttctcaggggccgaggtatatagctcggagttactactaaatgggatagttacccaaaggcttgagtatgagaggtgggtattgttattagacaataaattcttatatttgtcgaacaaagctttgtctcatctcattcatggcttcttacttgggaatcttgaactgtgttaggtaccgtctcttcacagaccatgtgagaagaacgcggtcaacgatatggatcaaagacgggaaaggtaagttccaacgtcgtagcgggtaaaagagtaaatgtgatcaaactcctatatgatagttcagttttagattagtttagaaagtggctgtatatgtaacatgtttggcttaactcgtgtaactataatctgttgggttttgagtcattatgaacaaattgaaaagaggaacaacgatagagattctttaacctttctatttcatcattgaatggtagctaaattatttaaaaaatcgatggaaacacccaaactcaaaaccaaaggcaaacattcgcctccgcttccatcaccagcagtgaaatctcctccacagaacatttgattaggttcaagacggtggaagattgatcccttgtagtggagtggcttaccaagcttccccatccctttctccctgtgtacatagggcccggaaattctccgccgctcgtggtgtcgtgtctgcaaagagctccatcacaatccgaccacactctgctgtccacgctcaaataaaaaaaaaactttaggattagcttttactacttgttcaacgccaccacgctccaccagccggaggaagaacattaacgtttaatccaccaccacctccaccagcgggtggtacgagttcggcaacaggtttaaacgttaattgtaaaaccaacattagccggaacgttaattgaacaggtgcattggcttcattaaagctcaaacttacatagtagggtttaccggagatttaccgtagatttttacgtatttctctaatatataatggattatcctaacgatatctaaattattaaatctaatgatatctaagtcacaacattacactattttttttttaaaaacgaaccgttatcacaattcacattacaatgagattcaattaagtattcacacttgcatttcacacttgcatctattaaactcgaacagaataattaaggaacggtattaaccgtcaataactcccatcctaaatctaaactgccattgcatcacaaaattcaaaaactatccgactcttttgagtttttgtcatctcttgtcgcttcagacataaactacagtctgaacttcataaactaattgtcgtcgattcaaca

SEQ ID NO: 2015 - DNA, 3000 bp, Unknown
  misc_feature (1)..( 3000): cDNA_ID_3065595_gDNA_ID_1620478_Annot_ID_158225 3000 nt of promoter + ATG
atcttatcctagaaatatataattattatatgtagatgatagttgacaaaaaaaagaagatataaatcgtaaaagctgcacaaaaattctgattgtacagccaatttaggttgtctgtccaatcgcaatgcgtgcaactctaagcggtgtgcgcccgccactgtgtatctcgatcgtcaacttttagtattatttgattcttcagtctatgtgtgtaaaaacatggtgtatatatattttaattttattttgataagaacatgctgtatatgaaataaattgtcttagaaaatccgtgtaacttgataattgagatatacaaaatctaaatcagatcacctttggtgatgcacgatgtttcactcttataacacacgatgtgaactagatcattttcaaccacgcacgatgcttcactctaaattaacatataatctatgacactatttccaactctatagaatagatatgaataatattatagaaaaaattgggtaagatttatagaatcttttaattaagcggttggatttgttcgttgtaaaaaatgttggttacgttgaactgtcgacaactgtatgtagtgtaaattattcaaccattagaaaataactaaactagattcctgcatatgtatagtaaataatccgtatttttgaccatttctcttgcgttgcttctatatatcccacaagaaaacgattaaaaaagtctttagaaactaaatatgagtttgttttcggaatacttttgacgtccaaaaccaaaataggtaaatatgattagataaaatatatattttttaagaaaataagaaatggtgctaatgcttttggatttgatcgtgagttagtgtgactagattgttttgttagcgtaatctaaaataattgaaataatttatgtccaaatttattttatttttagccaaataaagtaatacaaaataaatgtttcagctatactactttagcaaagagtaaactgtaaaagcaatacaatttttcatccacatttctgtttcttcgagcttctcattttctaccattttgttttcatttctcatcaattacatacttttgatgatattaagagagaaacattaacagtaacagtcacattatgtaatcaatttcttatggaataaatcgaatataaaattaattatttaagttttagcgaataatcaaacgttgaatattcagataattgtagaatacatatcgataaaataaaaagccaagagcaagacgaatacaaaatgtcaaaatatctaaagatagataaatggaacgaggagaggtagtagagttgacccgccatcttaagtcggcttttctggtccaaattggagcgtttatttctttctattataagttaggtttcgtaagcatgccccaattcatttcaatggaccttactggtaaagtctttgcttgattcaattatttctgagaaaatcactctctcttattgtttggcggcacggtcaaatcagtcatattattttctaagctaaattttacacacgatacaaaatttgcatatgaattttttaactctgaaccaaattataaagtgcccttttacatttattatcatttattttgtacctaaaattcctataaataagaataaaatatttctgacgaggttggtagtaattttgtgagattagactgtttgactaacaaatctaagaaaatgtgtgatggtcaggaaaacggtagacatattattgactcgtatcatttctgtatctatccgtattttatgggaatatcccatttattgataatttgatatggtcactactcactacagatatcaaaagaatttctgtctattgcctgtaaaagttcctcatatatgcatctatccatattttatgaaaatatccctagttattgaaaattactgatcaaacttttttttctctttttccttacttatattttgcagtattttttccttctaattcttgtcatactagtgccaataatcatgctgacatatttaacattagacccaaaaaaaaaaaatcatgctgacatattgatcaagattgaagactttgcatcaagatcttttctactctttgcttggtcaaaatgccagtttcaaatgtttatttctttataagacatgttaaaagatactaaaatctgcatatcgaaacctatccgtcgcgttatagaaagcgtttaagatattagatccattaaaaacaggatttacattctactaatttttgtccattgaacggtgagctagtctgtggactataatatttttaccgagttgataaagtatgttttatcaaacatttggcaatttgatgagtttttgatgcataaaattataatatttatagaagaataacatacaagtggatgttgtcaataatttgtaacgcgttatagtaacaaaaatcatgcctcatatatatatgtttatgtaaagtatgaagagtgactgaccctcttttaaaaaagaggcataatgagaggagaaaaaatagacttacacatttctctcacgtcgagtttgatactttactttgagtgattcattcttttggatttttgtcttcttgttcaaaaatgatcctcggattctcttcattttagaagaatctattgaagaaaaacaaaattcaacaataacaatagtggcacagaaaaaataacagtaataattttcactgttctatcttattttttgatgaaaaaagatgaagcttgagaatgaaactacgtcgttttggaaaacatgaagtcatgaaccattcttgtctccaagccaatcacagattctcagcctcatgaaaaaaaaaatgaatacaatttttgattcgatttttgtcgaaagaaaaagtgacaaaagtttttagcataattttatgttttctcataaacaaaaagtaaacccaaattgttttttcgaaacaagaatcgatttggcacgaaatcgaagatttgatgaattgtgtaaaacatg

SEQ ID NO: 2016 - DNA, 3000 bp, Unknown
  misc_feature (1)..( 3000): cDNA_ID_3065576_gDNA_ID_1620478_Annot_ID_158235 3000 nt of promoter + ATG
aaccactgaattgaaaaattttagactctgtatcaagaataaaaacgtcttcgtggttgagagtcgatcgaacaaacggaacctgtgaataagaaaatcaatgcaaaccaagatgaaacataaagaaccagttgagagaaaagacatttcaagatatgctaattaacttgcctctttaacacggacgacatgtttgcctttgcagatatacagacgcgtctgatgctcctcgggctttacatggttgaaccctgaagcaactccaccttcttgaggtattatgcaaggtttgaagtaggaaagaaacttctcggtttcgtgaccctgtacttctcggtactgaacagcacgtccacctaatgctgaatctaattcaacagtcatgacggctacagcacctgcttcatcctattttcatcaacacaacaccatggttcttatttgtcgaagaatatacaaaaaagaaaacaaaagactagagaatatgaagagactgtacctggctggaatctttaccgagccagtagtgaatatcatgatgcaaagaaccgcttcttgacgctgtggtctggcatgagatagttagataagaaggtataagacactattaagaactatatatcaataaaccaaagaaggaacatgaaaaaactactgacctttaagactatataggaatccccggtgaaaaatttcccatgagactcttgtggaacagtgacaggtttgaagttctcgatgcgccatatttcaatcccgctgtgtaaacaatttgccaaaaataaagtccagatgaatcacaagctacgcagcaaggactacaataaaaacaataaaaacaataaaaagtgaaagaaggttacgatttctggccagctccttgaagagcctgatctaaatctctcatggaaaacgtcattctggtttttgcaaatctttaaactctccccaagcttcttaaatttcaagaaacaaaccaaacctgcaaagattattaacaagtatcaattgacactttaccagaaactcaggaggaaggtgtaaatgaagattttttaaaaagaaacaagaggttcttctcaatatctcaatgagcgtaacaagcacataatatattatataatctacacaatgtacttgaaacaaaagaaccgatgtttggttacaatgtaggtactaaaatcgcagaaacttccattgtaattgaaatatgaatcttctatcgattcatattttttctgaaacaccaacattttactcaaccaaaacataaaaaaggaaatcgtgatcctcaaaaaaagatgcgaatttcagacaagaacagaggagattcaccagaaaaaaccaacaaaagcaagaacaaaaatcctcacaaacccgttaggataattcaatatagaacaagtagattcataccagagaaattcaaccaggttggaaagaaaagtaaattgttttaaggcaaaaccacatgcaagctctaatgggaggaatcagaggcaggggagaaatcacaaatgcaaacaaagtttcttgtgaaaaccatcggagaaaaaacgaatgagctctacgattataagaaaatacacaaacacacatgcatgacgctgatacataataatgggacttttgaaaaaaaaaaacaggaacaaaggaaataccttttacagatttttgtcaagaataataacgtataatgctgcgttcatagttgtaaaattctcttgggggaaaaaactggtaaaagggaaaagaaaaatgtgatgatccgagaaaattataaacgaactttgtggtaattgaagacttcccgctttttcaggtttacacttcgaaaataacgggaatagaagagagaagaagatgataaaaaaaaaatggctaatccaatttttagttataattaaatgaaatgaaatgtataatcccaatataattacttctcttttcagtcaaaataaaaataaaaataaaaatcgtcagctcaattaacaaaacggactaacgagttcgtctcctcgacgcaccgcacaataacctccgtcgcattcgcaggtaattttgtttctctttctcctccatctttcctccaacgaattcgtcttactcagtcgtggatccaaacaattccggtcataatcgtagccttgaacggcggttttcgcggcagtggaatccgagtctcgctctctcattcctaagatgtatcgattactctcttcaaacatcgaattagggttttgtttatgttatctgatcagacatcagagtttaggatcctttggattctaattttttccgatcatcacaatttgtcaatttctactttcccgatgagttttaaaattggacccactcaaaattcaatttatcggataagcaaaccaacccaaaattaatatgaaccgggatcataacataatgggccttttcagcactgaattaaaagcccaattcgtactatgtggagagaggagagaacaataacaaaaaaactcaccgttccttcgtcctccgtcaaactttttggtcggttcccggcaccgacgtgtctggcaagaacaacacgtgtgatacatcactcgatctcagagctgtgagtcgataaaatttgggttttaaaactatactattcctcattgttatggctttcgttaattctggagtttactacttcattcttcgagcttaagttttaagggtagattaaattagggtctcggtttcctttccggtgagtcggtggattcatagaacagctcaaaagattcttcttcagtttcatgattcctgtagttagaaaaaaaaaaactttgaatctcaacgaaataatttttattttctgaaaattttgatgtgattggaacattttttgtcttctctgttttaatctttagtaggtgatgaagtggtctaaccatctaaaatttgtggggatttggttgtaggaacagagtttggagtagacgactataatttctgtttctattgagagctatg

SEQ ID NO: 2017 - DNA, 3000 bp, Unknown
  misc_feature (1)..( 3000): cDNA_ID_2990493_gDNA_ID_1620478_Annot_ID_158237 3000 nt of promoter + ATG
atacagatagaagcggtatgtgtattataaaccgtaatcaaatagctttcttgttcatcagtttatacttggtaattcaaataagtatctggttccaacaggcttccgcaggactaaattcttcgcactgttatatattacacggtgattctactgttttcacttggtgtggcaatcttacttcctcggaagatcaagaacttatggaaagaatgttggatttgattaaggtaatctgttaattatatttgtttctacatttcggaacttacctctcatttctcacatatggtggaacctctgattcttggtttttctgttttgttcagccaaatgaacccactaaggcacaaaaggaaggctcagagtctgaacagttttgggaattattaggaggcaaatcagaatatccgagccaaaagatcaaaagggatggagagagtgatcctcatctcttttcttgcacatatacaaacggtaaaaccattttgcaacatccgttcccgggatttacacttcaacttttctcatttcaataactgttctgaacttttatttgatggtttttgctggtttggttgtccggtgatactctgtggatatcttaccagaaagtctgaaggtagagtatggatttcataatagtcataagccacattcatgttatgatcccacttctcaggttctaaaattgagactcttctttctttctttctttctattaccatataggctacagagatcttcaacttcactcaagatgatttgatgactgaagatatcttcatacttgattgtcacactgaggtctttgtctgggtgggacaacaagttgacccaaagaagaaacctcaagctttggacattggagaggtacttaaagatccattcaactagattaactaactaaactgaaaactgttcttataaacactctgctttattgtcttcatcaacagaactttcttaagcatgatttcctcctagagaatctagcaagtgaaacaccgatatacattgtaacagagggaaacgaacctccatttttcactcggttcttcacctgggactcttctaaatctggagttggacttctctctctcttcacatttgcttttgaaaatcacacctcatggagctaactcgtactaagcgataaagctgcttcttgcagatgcatggagactctttccagagaaagcttgcgatcctgacaaataaaggaaagccgcttctagatgtaaaagcttgtactcatttggttacatttgtctaaaatcaatctcgatctgtcttgatcttgtgtccttttgttgctcagaaacctaaaaggagagtccctgcatacagtagcaggtccaccgttccagacaaatcgcagcctcggtccagaagtatgacttttagtccagacagggcccgcgtgaggggacggtctccagctttcaacgcacttgcagcaaactttgagaaactaaatataagaaaccaatcaactccaccacctatggttagtccaatggtccggaagctttacccgaaatctcatgccccagacctctcgaagatagctcctaaatccgctatagctgcccgtacagcgctttttgaaaaacctactcctacttctcaagaaccacctactagccccagttcttcagaaggtctgtagcaaaaacaaagctccacttttgaaccccaaactatcaatttggtgaataaagttgagatcttgagcttacccttttttgatcattttttatttatgaagctacaaaccaagcagaagcaccaaaatcgacatcagagacaaacgaggaagaagcaatgagcagcatcaatgaagactcaaaagaagaagaagcagaagaagagagcagcctccctactttcccatatgaacgccttaaaaccgactcagaggatcctgtttcagatgtcgacctcactagaagagaggtcagattcttcaaaactctcaacacatattataacattcgtttattaagtttgtgtttcatgagttcagcttggtattttgcaggcatacttgacttcagtagagttcaaggagaagtttgagatgacaaagaatgagttctacaaactgcctaaatggaaacaaaacaagctcaaaatgtctgtcaatctcttctaaacaacactcttcttcaagaactcagttttcttgttcttcatcttaacccaaagacccgtaagtttttcgccttctactctggtttgtttgatcactttggtgcaatcttacacctactgataggcaaggagtatcgctagacctatttaacatagtcttattgatctttgtttctattgcttttgcagctcaagaaacacacaaagagggcatcatacatttattcctttgagctgcttacaaataaataatcaagcacataaattttttgaaaaatcatatattctctttatataattataacatattcaagtttctgttttgataattaggatttttttgtttgtttgttttatgatctcacataatatgtctggctgtaagattctttctttcctggccttgaaattctctaattgcttttatgttattgaagaaccaatgtaaattaaatcttatctttatcatgtgttatattattctatggtcgtcagtaatcttcactaatccataactttatttctcttgtcactttatgatataaactttttgtcatttaaaagtctgtcagaggtaaaaacaaaaacaaaaacaaaaaatcatagtaaaccaaaacaaaatctagaataaacaaaacggagtcgtaagagagaaccggttcgaacaaaaacggcaaaaaaaaaaaaaggggagcagcaacctttttccaattttgcgtgaagcagcagtgaagaaaaaaaggaaaaaaagtgagtgagagaagaagattagaaacgacgatatatacggagaatctcaggatttcgatcctgtttttgttttttctacttttggtactctcc

SEQ ID NO: 2018 - DNA, 3000 bp, Unknown
  misc_feature (1)..( 3000): cDNA_ID_2148618_gDNA_ID_1620478_Annot_ID_158240 3000 nt of promoter + ATG
gatctctgtaacgcgagagctgatctgaggaagagagtccactctacaatcgataagtacgctgagcgtggacttaggtcattagctgtttcaagacaggtgagaagaaatcttacattttgtaacaagttataggaagaaggaaaaagagagagagagtttaatgtaaattttgtgtgtctatgtttcagactgtaccagagaaaacaaaagaaagctctggtagtccatgggaatttgttggtgtgttgcctctgtttgatcctccaagacatgatagtgccgaaaccattagaagagctctagacctcggtgtcaatgtcaagatgattactggtttatatctaaacattactcttcgctatagcgaaaacaccgaatttcttactaatgtttccaatggttttataggtgatcaacttgctattgcgaaagagacaggacgtagacttggaatgggatcaaacatgtacccatcctcttctttactcggtaaacacaaagacgaagccatggctcacattcctgttgaggatttgattgagaaagctgatggctttgctggagtcttcccaggtttgtttaagagccatttttgtttccacaaacacaaacttgctcttctctctgtaacatttggtctcttttttttctttaccaaattcattcagagcacaaatacgaaattgtgaagaagttgcaagaaaggaagcatatctgtggtatgactggagatggagtgaatgacgctccagcattgaagaaagcggatataggtatcgctgtggcggatgcaactgacgctgcacgaggtgcttctgatattgtcctcaccgagccaggtctcagtgtgatcatcagcgcggttctaaccagtagagccatcttccagagaatgaagaactacacagtgagtgttctcttaatcttaaaccataacctttttagaatctttacaccatgataacttgttctcatggtgtttttaaatgttcctttaaacagatatatgcagtctcaattaccattcgtatagtggtaagtaatcaatcttgtatgtattcttgaatatcatcaaataatctctttttctatatgatttctcactttgtgccttttcacagtttgggtttatgctcattgctctaatatggaagttcgacttttcaccattcatggttttgatcattgctatattaaacgatggtgagtttttttcttctctttaaaagctctctctaaattttggctctaatcgactaacacatcattaacttacgcaacaggaaccatcatgactatctcaaaggacagagtcaagccttctccaacaccagatagctggaaactcaaagaaatcttcgcaaccggcgttgttcttggaggctacatggctataatgactgttgttttcttctgggccgcatacaaaaccgatttcttcccggtatgtaacatataaacaacctctctttagattccttgtcacacaagcattaactttgtttgtttcctatagagaacattccacgtgagagacttgagaggcagtgaacatgagatgatgtctgctttatacttacaagtcagtattgtgagccaagctcttatattcgtcactcgatctagaagctggtcttttacagaacgacctggatatttcttgctaattgctttctgggtagcacaattggtaagcattgtatcttcttgattgattataaactctcttgaatgattgattcataaactttgaccttgtagattgcaacggctattgcggtttacggtaattgggaatttgcaagaatcaaaggaataggatggggatgggctggagtaatctggctttacagtattgtcttctactttccattagacataatgaaattcgcaatccgttacatactagccggaacagcctggaagaatatcattgacaacagggtacgttttgctttcttcttagttcttcttctgaaatgtgattttaagacttaaacaaaatctctctgtgtctttgaaaaaacagactgcgtttaccactaagcaaaactatggaatagaggagagggaagcacaatgggctcatgcacaaaggactttacacggtcttcagaacactgaaacagccaacgttgtcccggagagaggtggttacagagaactgtctgagattgcaaatcaagccaagagacgagctgagatcgcaaggtaaatgatttgtaaaaagtaatttcggtttcttgtgagagaagttaacgttagggtttttgtttacaggcttagggaacttcatacgcttaaaggacatgtagagtcagtggtgaagctaaagggactagacattgagacagctggtcactacaccgtttaataaagatttaacaagaagatgattaaggaagaagaagatccttttgtttaagagatgataatgatgatgattttataacaagagaataaggttttttttctgtgtatgttaagttcctctaaactcctggggtttttcttccttccttattcatggttttagactttaattataaccatgtgtttttgtttcccctctcttgaataaaaaagagaagatactaatatcataggtttaatacgtttatgttttataaaagttcaatagatattgtttttggatattatgtgaacataacaatatttataaattcacctttcaattttcttatgagatgatatcatctttactacttaaaatatcttctaattaaaccaaaagcagatttaggtccggttagatgaataaccggttcgattaatttcgtcagaccgatttgatccgtggatatcattaatccgtggaatacatgtgtgttcttgagtaggccactagttataatccacgtggcaagcattttatcacaaacccagagctacaaaaacaaaaccaagaagacgagaaggatctttaacagagaaaaaagagctttagaccaaatcaccagaaacaaaacaaaaatg

SEQ ID NO: 2019 - DNA, 3000 bp, Unknown
  misc_feature (1)..( 3000): cDNA_ID_2148614_gDNA_ID_1620478_Annot_ID_158239 3000 nt of promoter + ATG
tcaggtaaattcatttcaacactagactaacatatactatgaatctaggttttagaatctccgaaaatatcaaccaattaatgttacagaaaaattgaagacatgaaaaagaaaatttaataattgttaaaactgctaacaagtgatatgctataagaggatctatctcattaaacttggtgtcagataaaaatgataatcatgggatattttgggaatggttggataataccagtacggatgtcgatgatggagaatatgtacgttaaaatatacaaattgataaaagaatttatagaaaagggaatcatttgaatttctaaaagtaatacagaaaacaaatcgccatttttttcttacagacacaaaagatacaagctttgtcttcaattggtagttaatataatatttatttgtttttttatatggttacatgcatatcttgatcatgtccagtgaggacttgtcttgaatatattggctaaaaataacattttctgtattattttattgttcatcatttgtccaaatcctcttgatcttctcgatttaatattatatcaacacacccaattatttcaaacccccacttatatgtataaaccaaaaattatacataatatacaaaatctacttccataagacttaggattctatattttatcagtaacacttaatatgtaaattcttgaacatattaatatatcaatcttttgagttaatactacagcatggtaagatactaagatcttttcttttactatttcatatagtggcatttatattaatgatttttttttaaaaacatcaccttctcagagaataaaggactctcaagtaagagattaaaatattacatactagtaaatccacaagaattatataaaattagctattgttttgtctgtctgttagagagagaacaattagatggacatacaaagctaatttagcatatgaaaacctctcagctttttccttgcctccttccttcacaaatatcacagcctgtcaaaattagcctttaagaactatttaacttccatcactatatattatttgtttattaatcctttttaatttaagcatttccttagctgtgaataccccattatccctctctccttctctttcctttctctctgaatatctctctatctcttcttccacacagctttagtcctatatttgattgttgacaaaacaaagcctatagtaatctctcagctattggattatgctttgaagctaaattggtaaagaagcatatagtaaggtaagtgtgcgtcttgaagaatttctcttaagtgagttttgtggcatgagtatagaacatgtgatcaatgagcttctttggagaaaatcacagcttgaccactcttcttttcaggtaatttatatagaatttctttatatgtattcgtgtatatatgtccataaacagattccggatattgctggtgctttctatttagatagatatattttctatatatgtatgtgtgtgactgcgtataaggaaaaaagtcacaaatttggcttttttcagttgattgaaattttaatacctcaagtgtatagagagagctaaaataattttttgatagcgaaatagatattttgtctagaaatatacacacatacattaggaaaaaaaaaagaacgttttcttttaaccaattttattgtccttgtcttatcctattgggtatctaatttggttctctacaattatagctaaatagacatgatcttttcatgtctttgtgtacttgtgagcgtgtgtataatagatacgtaagtacatgtgtcacatatatttatatttatttatttatatgttttagaaaaaaagataggaaacaagtataagtggaaatttaggtgatatagtcctctccgcatgaatgcgaaaacataatgaacgatgtgaccaatttatatacattatgtaattaattccaattttaatagaaaagaaacttaggtgatacagtcttcctcgcatgatcatcaatttacactaaatagttaaaattcctatttgttgactttaaattgactgctcgaccagtgtttgttgttgcttttttccatgtctctatgactctatcttattatgttaatcattctcatatctttaactttaacccacaaaaaaaaaatcattctcaaattctaaataagtcatgcttatccatagaaaaggaaacaaaatcgacaacttgttttttttccaaccttcaccacatattttatatttcttgcaattttacaactcaaatcattctattttaaactttagtagagaaaatgatattattgtactataccgcatcaattatttcactgatttgaaaataaagtattatttccgaatgcttactgcagaagatatcctatctaagtatttttacatcaatattttactataacacaagagataatttagatattttgaattggttatgaatgtggataaattcaaatagaaaagctttgtaatgttatcttactaaaacaagccgtgtctagtgttgtcatgcttggctctacttcgatttgatctgactaattagctaattgaaaataattaatcatcttccatctctatgattaataacaataataaagaaataaaatcataaatccaacaatttgtggtctaactagttctatccattgatttagtgaacataaagacatttgattcgatttaaaaaaaaaaaaaatacttggctttaagacaaaacaccatgagatagagaatctaatcaaattcaaaagtgtgtcccactagtcaaccttcttttgtctataaacccctcacttcacgaactagtggcttctgacgattactccatcaatttcatactcacatgtatacatacacatacacacaacactcactcacatatacaatttaagtagagttagggttttctaatgtgtttcatcactcatcaaatggttatgaaactatatgactacgtttcaggc

SEQ ID NO: 2020 - DNA, 3000 bp, Unknown
  misc_feature (1)..( 3000): cDNA_ID_3065572_gDNA_ID_1620478_Annot_ID_158236 3000 nt of promoter + ATG
gaattatttacataaagagccctcatagcttttctccatgatatatgatgaaatgaaacgtatgtacttggaaagcaggtcctttctagtattgtgggtttgtgtttcagtttaatttgaattgagacaaataccccattttgattgttatacttatacatgtagtaatacaacaagtaatcagataaaatcaacaaaatttcctcaaaaatagtgggaatcaacagttaagtagtaagctcttaagcagagccttattttacctaccaacttttacagtttgggttttgaaacagctgaagcaaaagagaaggaaaaaaaaagtcagagctttatggcagagtgaatggcgacaactccaccaacaaggttctcgtactccaccttctcaaatcctgcatctgcgatcattgatgcaaatcgctcctgcactcatttcatgcatctagtgattacaaaacatgcttccgactaaaaaaacgtcttatagactagacatcacctgatcacacacacgatgctcatataatcatagctatcataacttaaaactgatcttcttacaggaatctaacacaaccttaagctatggtattgatcacggcaagttgttgttactaatggttttgacgaagtccacaagttaaaacttaaaagttatcttacatgaatctaacacaaccttcaattgaaagattcggccatgacatttattactaatggtcttgaagaagccatgcagcaaaatcacgaaaacacaggaaaactaatctaaaaattgtgtatattgtataccaaattttcaacaaaggtaacaaaaggttgaatgtttgaacctgagggggaaaccgacgaacgctctcaaccaagtactgataagattccctgtccccggcgattagttcccctaagtttggaatgacctggaaagaatacaaatcgtatctgcaacacaagaaacaaagtgagattatcatcgaaacaaaaaagacttagggacttacttccacaacatgtctaatcatcaaaacttacagatttttgaaaaccggaatttctacatggctgagctcaaggcacaaaaatcttcctccccgtttgagtaccctaacaatgggaagagttttagaatactatacacaaaacgctgacacatgaaaatatacccgaatagaagagggtgtaagtaatttgtaataggtacctataagcctcagctagagccttttcgatgtgtgtgacattccttattccaaatgcaatggtgtatccatccattgaattgtcatcgaaactcaaggcctctgcatctccttcgacccatacgagtgacttgttatctcttagacctattcaagatagtaaatgaagcctgagctcacacatacatagaaaaaaaacataaaggaataacagaggatacaaatttgttgcacaaacaaacatctgatctttcacctctctcagcagctcgttgtttcccaacgtttaacatgttaggattaatgtcacatacgtatatctgagtttcctcaagagaagcctcatcaactttctgcaatgctcttcgtttgacactgtaaacagcatcatagatcctaaaagcaacatcacctgcatattacaaccaatatctataacaaagagcctaaaacattttcaataataacatgtatggactcatgatcagagacagcaaaattccatgtttaaaattgatttgactaacctgttcctccggccacatcaagatgcttcatccctgcaaatggacttagcttcccaacgagtctgaaatcacaagaccaacaaaagtgtcaatttttacacaagagcaattcataacactagtgataaacgtgtcacggagtctaacctttccttccatagcctatgcaaaccaccactcatcacatcattcataatatcataactcgaagctacattggtgaatacattaccaaccaatttgcttttctcttcttcctttacttcttgaaaccctgaaattaaaacattgaagttaaactcacacagtagaaactcaagaagaagccatataatagaaaacaaagcatttcgtatagcatcaaaacagatgatcttgaattgtgaaagtcatccacaagaatgttaccgaaacttgtggcatgagagtgaagcgaagcaacaaaggaacgttgattcaaaattctgctcccgagcctcctgcttactgatcgtagtgccatagctctcaatagaaacagaaattatagtcgtctactccaaactctgttcctacaaccaaatccccacaaattttagatggttagaccacttcatcacctactaaagattaaaacagagaagacaaaaaatgttccaatcacatcaaaattttcagaaaataaaaattatttcgttgagattcaaagtttttttttttctaactacaggaatcatgaaactgaagaagaatcttttgagctgttctatgaatccaccgactcaccggaaaggaaaccgagaccctaatttaatctacccttaaaacttaagctcgaagaatgaagtagtaaactccagaattaacgaaagccataacaatgaggaatagtatagttttaaaacccaaattttatcgactcacagctctgagatcgagtgatgtatcacacgtgttgttcttgccagacacgtcggtgccgggaaccgaccaaaaagtttgacggaggacgaaggaacggtgagtttttttgttattgttctctcctctctccacatagtacgaattgggcttttaattcagtgctgaaaaggcccattatgttatgatcccggttcatattaattttgggttggtttgcttatccgataaattgaattttgagtgggtccaattttaaaactcatcgggaaagtagaaattgacaaattgtgatgatcggaaaaaattagaatccaaaggatcctaaactctgatgtctgatcagataacataaacaaaaccctaattcg

SEQ ID NO: 2021 - DNA, 3000 bp, Unknown
  misc_feature (1)..( 3000): cDNA_ID_2148592_gDNA_ID_1620478_Annot_ID_158233 3000 nt of promoter + ATG
tttaaggaacaaagatttcattaagggacaagaatcacagtgaaagcttttaaaagagagaaagttgttataatctcctcacatgaaagaatgttggcaggtaatgttcatccgcgatgcagttcttgtttgcttctactccaggctgaggattttcaaatcagaatcagagtaagacaaaactgaaacttttctcaagtttttgaaaaccctgaggactcttgatattagcaaaagagatatgcttgagatgaaccaaagcttggtgtctttatgaacaatttcttacaacggaactcagtcatatatggtaggctgtaacatgcaaacaaaaactttggtataaaggaataccgaacttactctgcaatactcccggaatttcgagtagtagagaccatcagccatcactattacagcgtgttgacgcttcattgtgaaccactaccaccagaagagaaaagtgggaattacacatttacgtaatttcaacaataccattaccaaacagacttagagaagcaacaacttaagaacaatccacaactgagagattaagttaacagtttttcacctgtgcaccctttctgaaatcttgccttgggatctcaggtaacatgtgatccatgtgtctgccagtcccatgaggaccaagatcctcaaaacttgagagagagaaacaagtattggtgaatattaatggagaagtcaaatttagcaatagaaagaatagatacacaaagtttctgagagtcatttatttacctatcaatgaagctgacatttgcgtgcatcaaatatcgataggtgtagtcaaatgtatgcaacggtatacaactgcaacattaaaagagatacatcaagtaaacagaacgtagctggaaattaaagtaatgactttgtgcaaattcaataagtttatgaaataacctttctgaaagaagaacaaagtgctggttatcaggatcttcaagagcatttgctagaagccgtctctcagcatcaaccatagaaatccttccccaagtgacatgatcactatgaatttcacggtctgaaaagtgacggctaatgtgaactggtcgtaacctggaagggtggatgtaaatagagaatcttccttcttgacccttcacaatacagagcaaaaccgtcaaataccataacacagcaatcaaataaaatcaagaaatgtctcggaacttgttccaacctggaaaaacttatcccaaagcttctcaaatggcaaagtaccaggagtcaaaaacataaaagcgattttcgatttagcggttagagcaggaggtagtctcagtatatctttgatcacaactcgagctgctacttcttcatcagtgaatttcctgacatgaacaggaagccatccagagagcgcagcttgacagcctctactagacaaacccgcacaagcagagctcttactgttgttgtgttgtggatacatgtaagtgatcaccaaaagcacacttgtgatacagactaacaaaacaatcaacaatggcttctttagagaagatcggtgtcgtggagacaaatgcagattctctcccattgtgaaaaaaaagtttgaatctttaacttctttacattgagcaaaacctgaaaaaattccaatcaaagaacattaaagcttgaatctttgtcacttaccaacactcttgagaaacaagggagtataattcgaagtctcccacacgtttggtgaatcaaaatcaacggatttaaagaaaagaaaacctaatttaaaggagaaaagaaattcacgttgttcttgtgattgagaaagatactcacccccacgtacgagagcaattatgcttcactgcaaaaccaaaatctgaattaataagcaaaactctatcagattcgatttttttacagaaattgtaatgaagagtggaccaaatgcatttaatcagtgaagagagttattattacagttacctgagaatttggagctggggagagaataaaaaaaaaagaatctttgtctgagcccagatctcaaaatgaaagctttgatgatccttctttatatcaaagagtgaagagaaagataacgagacagtgttggattttgtttgcttttggaataagtatattaatgtgttgtaatgaagaacatacaaaacaaagtaaagtgtttgacgattcagatcctcgatttgttttctctctctttgcttagaaataaagaaatcgatgaacgagtgtgtttacaccattttcttcttaaaaaagaaaaaggtctaaaactgttttaattatcttcttctgagatgtatataaacaaacccctcaacaccagtcgatttttccaatcatggtggaatcagaagaaactagagatagaaaggtatatgcacgcataatttttattttatttttgttgataataattactatgtagtaagaaaaaacaaatcttaaaatttttttcctatcttttatgctttggaggcttttcttctccgtaatttttttgtttttcacaaaaaaataataatctaaaagttaaatttggaaatgacgatttaattactaaccggatcacttgtctctatggacataatttcactcataaagcttaaattatagtgcacaaaaaaaaaaacagcttaaattattctgggactaactaaacaaataattgaatgccaaaaataagaaattcaatttttgtgcctaccaaaaaaaagaaattcaatttttgttagttattggcccgttgctttaagaagttttggctcagtttcactgttaagctaaggcccaagacagtaaggctagagcaacaaaccaaaccgaaaaatcggaaaaattcactgatcttgttggttaaccggtggaccacaaccggttaacaaacatcgtttttatttttgttttgggctctaaaccctaaaagaaaccttcaacgccgttcgtttcttcttcttcctcctctgctacagaatcgttttgctctagacgctaatt

SEQ ID NO: 2022 - DNA, 3000 bp, Unknown
  misc_feature (1)..( 3000): cDNA_ID_2148570_gDNA_ID_1620478_Annot_ID_158227 3000 nt of promoter + ATG
ataaatgggatattcccataaaatacggatagatacagaaatgatacgagtcaataatatgtctaccgttttcctgaccatcacacattttcttagatttgttagtcaaacagtctaatctcacaaaattactaccaacctcgtcagaaatattttattcttatttataggaattttaggtacaaaataaatgataataaatgtaaaagggcactttataatttggttcagagttaaaaaattcatatgcaaattttgtatcgtgtgtaaaatttagcttagaaaataatatgactgatttgaccgtgccgccaaacaataagagagagtgattttctcagaaataattgaatcaagcaaagactttaccagtaaggtccattgaaatgaattggggcatgcttacgaaacctaacttataatagaaagaaataaacgctccaatttggaccagaaaagccgacttaagatggcgggtcaactctactacctctcctcgttccatttatctatctttagatattttgacattttgtattcgtcttgctcttggctttttattttatcgatatgtattctacaattatctgaatattcaacgtttgattattcgctaaaacttaaataattaattttatattcgatttattccataagaaattgattacataatgtgactgttactgttaatgtttctctcttaatatcatcaaaagtatgtaattgatgagaaatgaaaacaaaatggtagaaaatgagaagctcgaagaaacagaaatgtggatgaaaaattgtattgcttttacagtttactctttgctaaagtagtatagctgaaacatttattttgtattactttatttggctaaaaataaaataaatttggacataaattatttcaattattttagattacgctaacaaaacaatctagtcacactaactcacgatcaaatccaaaagcattagcaccatttcttattttcttaaaaaatatatattttatctaatcatatttacctattttggttttggacgtcaaaagtattccgaaaacaaactcatatttagtttctaaagacttttttaatcgttttcttgtgggatatatagaagcaacgcaagagaaatggtcaaaaatacggattatttactatacatatgcaggaatctagtttagttattttctaatggttgaataatttacactacatacagttgtcgacagttcaacgtaaccaacattttttacaacgaacaaatccaaccgcttaattaaaagattctataaatcttacccaattttttctataatattattcatatctattctatagagttggaaatagtgtcatagattatatgttaatttagagtgaagcatcgtgcgtggttgaaaatgatctagttcacatcgtgtgttataagagtgaaacatcgtgcatcaccaaaggtgatctgatttagattttgtatatctcaattatcaagttacacggattttctaagacaatttatttcatatacagcatgttcttatcaaaataaaattaaaatatatatacaccatgtttttacacacatagactgaagaatcaaataatactaaaagttgacgatcgagatacacagtggcgggcgcacaccgcttagagttgcacgcattgcgattggacagacaacctaaattggctgtacaatcagaatttttgtgcagcttttacgatttatatcttcttttttttgtcaactatcatctacatataataattatatatttctaggataagatacgaactttcgtcgtcaccttcgatgaacaaatattataggttgatcaaaagcataaacttaacgagcagccatgtttgagaagtcgtaattggaatgttgtcattaatagcttgaaagaaacatgtaagtaacgcagtgagttcatgtttattcttgtcgaattccttattgagtctttacaaaagaaatgtcatggtggacctttttggaaaacaaggtgggtacatttgcctatattttttaatcaaagcagaatatttatcgaaagacaaagtaaaaacaagtggtattgtgtgaactaatgcaagttgatcagtgactatagttaaagacaattcgaatccgattcattctgtaattatctgaaaatcaattacttttatttactttgtgtgtcggtcgcggttattgaatcgtatatatttatatattttgtcggatattgaatcgtatataataaggtggatatcacatattttcttttaccatattaatagttatgttgcatctatttatcggacgggagatgcagaaaagtatatgatttgaaatctgttgaaattcaatataaagcatttatatatccaaatttcctatttctaaatagaatagttgtaagtgatcgaaaaaaaataaaaatagaatagttgtaagcttataacaaatcaaatcagttatttacacgaaagtactattttatatatatattttagatacaatatacatattttgggatatattcaattaattatttaattttaatcagtattggtaatatttttaaacaaaaattataacaactttagtttttgttaaaaatcatctaaacctaaaatcatttacagaaactgaactaaccctataatattttagcctagtgaccaatactaacatccaccttgcatcgaagtactgtatcaaaccaaatctaatattgaaatggtcaaggagaatccatttattagtggaccttcataatacaacaaagaaagaaagaaaacgaaactcaaagagacaaattaaaagagtcaaagttcaaaatatgtactctttattttattgtgtttaataactttgtatttattataaaccaatccatatatatatacacatagaccatccaccattttcactcaaaccttctcacaaaaaccaacccaaattctttctatatattaaaaaaaaatcaacacaaaggaaaaaaaa

SEQ ID NO: 2023 - DNA, 3000 bp, Unknown
  misc_feature (1)..( 3000): cDNA_ID_2148580_gDNA_ID_1620478_Annot_ID_158229 3000 nt of promoter + ATG
taatgcaaaaaatctcttattagtgattaagaattgataagttaccttcttgagtattttgtctgttttcacctaataagcaatggtattctcttgaatctgattcatttggtatatgctcagatgggagattcaacatttctcgatagaatgcttctccagcttcgctccacttgcaagtaatgagttcgtttcgttaattctataactgtgtagaaaaccaatcatgataatgggttgatctttctgttaaaatgaaggtattacagcggttaccctaaggatctcgggccatcgcgggttctccattttacatcagaaagagagtttgtccaactccttcaccagggctatcctgtggttgtcgcattcaccataaggtaacttagcatttcccaaaacctttcaaactacactatattcaatcacgtgcgtcttcttctataaaacaggagtaactacacacaacatcttgaccggatgcttgaggaagctgctgctgagttctatcccaacataaaatttatgcgtgtgagtcgatgtaaagctgtataaaagaatacaaagaaaatagctggtaaaccatgaagtgactgttgtgtttggattgtttcaggttgagtgtcccaagtatcccggattctgcataactcgccagaaaaatgaatatcctttcattgaaatattccatagcccacaacatgtatagttctaaagtcttgtatttccggtacttaacctgtttaaatcacgaaatctcctttgttgttgtatctcgttaaatgaaaatccatctgatgcaggccggtaatgaaggaaaagtacaggatccaaatatcactcggtattcagtgaaagttgtacctgtaagttgaagcatcacacattgtcttttatacatattcatctattgcagagtctaaaagacgatatttttccttgtttgtttcgcttggcagtacaattatgatatgagtccctacggattcagagaattctttaagcgccagggggttcgtacttcggatcccaaatgaagcaacttgaaggttggttcgtattcacaagcttttatgagtgtatcaatgacttctgtgatctaccaacgactgaactattgtattactaaatttcctttttgccttcagaagaagaataaaattcttatgatatatgtctgagaatgttccaagttctactatttccatgaatcaataatcagagcggtgtaaaatttaaatgttaaagtaaaaaaaaaggcattagatatgactcttatacatggtatgtgaatttcaaacttagtcttatatccagatttcacacttttaaccattcaaacatcgaaattcagcctcgtaatcagttctagaacatcctaaacatcatttcccactcctaaataagaggcgaaccttctgaaataataattttaaaacttaatacaattagtgactatatatatagttaatgattttagttggtaacgagcgatgttaggttaaaaactttagtgcgaatcgtgcgatcagtaactatatagagttaataaatttagttgataatgggtggtgattttagttggaatggggttgatgttagattttatttgatacttttttttttgtcatcgatttaatttaatacgataaaatggttttatatagttaggaattttagttgagaacggatggtgttgtgtcgagtcatcgtctctttatttcaaccattatctctttagctctatacttctatccatgccataaatgatttacgtaggaagatccattattttcttcaggtctatagtttttgttcttatattagtatggctgacaacaacaaaaaacgaatatgcatgaatctttgagagcaattccctaacagtctaaaatttaatacagccatgttcttatcgatgggatcacattaatgatacaaagaaaatgtcaaaaaaattggatctgcctactgctttgatctaaccactactgcttcttccccataacactatttactacgtactcgaataattgaatgttcccttgacctatatgtctttttcattttcaatgttttatggatttcgtggccaatacaatagtagaaagttatataattttaattttaaataaaaaaaattgtggaaaggaaaaacaacgaaactgtttgatagagcttaaaacaatgaaacctagaacttgtaaagttttatgttctacacatatatagttcgtgactacgtgtatataacaaagcgcattaaaaatgaaattgtagaatcaggtaaaaatgatttacgtatcgtattggtgagaatgatttagctataactatgatatattggtaccattattttgtgtcattcttcttatatattaaaacatgattatcttctaaatccgtttctgatatttttctgtttggcgttttcttctttcgatagacatccgtcttttaacttgtctttcacttacaagcaacttacttttgctttgctaatggatttaagatgattaaaaccccatacttcatagttatatactagtagtattaatttattttccggtgagtattataaggttgtgagactgtcaatttgtcatgctcctttaaaagtaaaaaaaattttacaaagtaatattttgtatacgacaaatcgtcattctcatactactatatatacaacacacacatcgaggcttgagcaaaatagtctacgcgtttccttttcccttgtaatatttgctttttaaaaagattttgctttatcaggtaaacctctttggatgttttcgttctatcaatagcacccaatgcctaattttaatatacctttctagtttcttttatttgttcatcattaaggttcgatttctctctacttacaatcaacaacatcaaaaaagacttgacaaaacgctttagatcactcttcttcttattttgtttcattggttttgtttctgtgtgcaaacgcgcagaaaaaaaggagaagaa

SEQ ID NO: 2024 - DNA, 3000 bp, Unknown
  misc_feature (1)..( 3000): cDNA_ID_2148532_gDNA_ID_1620479_Annot_ID_158261 3000 nt of promoter + ATG
tcaaattttgaagcaaacagttattataattagaaaaaataaaatccaataaaattaatttcctgattttaatcattccttttactatttcagtattccatttccgaactgattaatttccttttctttttataaagagttaattcaactaccatttcatttgtgaaaacaaaacccaaaaaacaccaaaaataaagtcaaggaaaaagaagaagaaaactaagttgtatcttctagagacacacaccatcacataagttcagtcaaacacaagctgacatgtctttgaaactctgtccaaaggctttaacttctttaacatgccattatattgtctgtttctacatcttgtcgagaatgtcgccatctttagaaaagtaacgcttgctagctagtatgtacgcagccatttgctctgtgccttcatatttctatccattccaagatctcgaggttctttgataaacaatcgggaacaattgttggttctttccagatgttcactggatcactggaatggatcatgtttctgacgataaaacgaaataaatattacctgtattagtgttacacatcgtttaaactaaaagcggaaacacagatgtttttattgtattgttcatctacatgcatactagtcaaagtacgtacctaaagtgaaaaataaaacaatagtatacgacataccaacgtaagcttgagagattgaagtcttgcagcgtctttgagtatacagttaagtagattacaccatcccacagaacatgtacatatggctctagatgttcaagaaagaattgaagaaactacctctaggatatggagtctgcaattgaagtatacattatttactgaagtgagaataacaaaacataagaagagaaatcttgacattattagagctagaaagttttttacctttgagatcaaattaagaacttattttctccgaaattatgacattttcataaaggccaaatcaaaggataagaatatactatagtcttgacatgagagatcctatctaaggagaataacatatggtggagatgagtcatgggcactcatgggtcctactccaaagacccattcaattatttatttattagaataaaagtcaaatgattattctatctggattaataaactaaccaaatacattgtgtaggttttgcaaaggatttttagcttttggaatgccccatccaattttttttaatgattcacgttgttccgattttcttcttgtaatgcatgaaataaaattgaatctttatttagtttcttaaatgtagtgttaactttaagcaaatgatgtgaacaaaactctgttttcacaaataatggtgctctaaattactacgacaaaaaaaaaatatatatatatatatatatactaaatgcggtgacgtttttatcgtacgagctcttgctagattgggccattttagatgggcttttaaaaagcccagatattcaatgaacacgcgctttattggctaaaatctgcgcatgtgatattttgttaaccatcttagatcaaccataacgaggataacgctcttttgttctttttgcacttttctctgataatttcatgcaagattggaacttcgaaataattaatttttcaaaattaaaagtgcatttttttttcatccgttgtgcatatcctcttagaaaaatctcaaaggagacttttagtatgtagtaatgtcaatattgattttaaagaattatgaaaaatatgtatgaataggaatattattctcctaacttaagcacttcaatttgaaatctgtatattcaagtatcatagatttttactttgaattgaattcagtgtgtgtcaatgctaaaaaaatcgtctgaaacttgataacttgatattatcctccatatttcaaagaaaaaagcagtctttttatttgtcgggaaaaagttgtttaaagagggacaagattcttggtttaaggatatagcgtaattattactatgcataaaatgtcaatataaaataacttaaggatatacgttgttatatttctatttaaattgattttgaggaaaagtcgttattattagtgatgggaactacaattttcggtccaattaacaaaatcagaattaaaaaaaggtgagcggatggatagtggtgacgaggacatgatacggatatgttttaagagaatgggtcttatcctcttttgcctagtaacagcaccatagggaattgaaaaaaaaaactccctaagaagcaaatctaaacaatagatactactattttaattacacaaaccgacctttatcaatatttttatcttctctgcaaaacctttagacctaatctcttttttttatatatagtaaatccctattcactggaacatctgtacatgacaagaaaacatatgttatcttatcaaactacaaaaatatactaattatagttagtttagaaatgaaatttttggtattatattgttgattgtgtattattttgtaatgttatggaaaacgaataagactcaaaataacaaagtaaatggaaaaagtgagttaagaaaaaccaaaaaaacaaaaaccaaaaagctgtgatatgataatgacgggccatagaatgagaaccgcatatgggaaaagaacacaataatagcaattaacatatgcgatgagataaacaacaataacaaaaaatttggagataaaacttgaaaagtgaaatttatttattttaaaagggtcaacgttatccacggcttgcacgtaagtaatacccacacatatatttatcctttttttccttctctttacgcttttttaaaatttaaaataaagaagaaaaaaaactcaaaaaactcttcacatatcccatatatatgtgtagatatctattctgcaaatagaactcacgtttctttgtttccaattgtagaataacacacaactttatttctcctgttcaagactcctttattttctcttatgttcaaagagatg

SEQ ID NO: 2025 - DNA, 3000 bp, Unknown
  misc_feature (1)..( 3000): cDNA_ID_2148540_gDNA_ID_1620479_Annot_ID_158263 3000 nt of promoter + ATG
gcaagccgtggataacgttgacccttttaaaataaataaatttcacttttcaagttttatctccaaattttttgttattgttgtttatctcatcgcatatgttaattgctattattgtgttcttttcccatatgcggttctcattctatggcccgtcattatcatatcacagctttttggtttttgtttttttggtttttcttaactcactttttccatttactttgttattttgagtcttattcgttttccataacattacaaaataatacacaatcaacaatataataccaaaaatttcatttctaaactaactataattagtatatttttgtagtttgataagataacatatgttttcttgtcatgtacagatgttccagtgaatagggatttactatatataaaaaaaagagattaggtctaaaggttttgcagagaagataaaaatattgataaaggtcggtttgtgtaattaaaatagtagtatctattgtttagatttgcttcttagggagttttttttttcaattccctatggtgctgttactaggcaaaagaggataagacccattctcttaaaacatatccgtatcatgtcctcgtcaccactatccatccgctcacctttttttaattctgattttgttaattggaccgaaaattgtagttcccatcactaataataacgacttttcctcaaaatcaatttaaatagaaatataacaacgtatatccttaagttattttatattgacattttatgcatagtaataattacgctatatccttaaaccaagaatcttgtccctctttaaacaactttttcccgacaaataaaaagactgcttttttctttgaaatatggaggataatatcaagttatcaagtttcagacgatttttttagcattgacacacactgaattcaattcaaagtaaaaatctatgatacttgaatatacagatttcaaattgaagtgcttaagttaggagaataatattcctattcatacatatttttcataattctttaaaatcaatattgacattactacatactaaaagtctcctttgagatttttctaagaggatatgcacaacggatgaaaaaaaaatgcacttttaattttgaaaaattaattatttcgaagttccaatcttgcatgaaattatcagagaaaagtgcaaaaagaacaaaagagcgttatcctcgttatggttgatctaagatggttaacaaaatatcacatgcgcagattttagccaataaagcgcgtgttcattgaatatctgggctttttaaaagcccatctaaaatggcccaatctagcaagagctcgtacgataaaaacgtcaccgcatttagtatatatatatatatatatattttttttttgtcgtagtaatttagagcaccattatttgtgaaaacagagttttgttcacatcatttgcttaaagttaacactacatttaagaaactaaataaagattcaattttatttcatgcattacaagaagaaaatcggaacaacgtgaatcattaaaaaaaattggatggggcattccaaaagctaaaaatcctttgcaaaacctacacaatgtatttggttagtttattaatccagatagaataatcatttgacttttattctaataaataaataattgaatgggtctttggagtaggacccatgagtgcccatgactcatctccaccatatgttattctccttagataggatctctcatgtcaagactatagtatattcttatcctttgatttggcctttatgaaaatgtcataatttcggagaaaataagttcttaatttgatctcaaaggtaaaaaactttctagctctaataatgtcaagatttctcttcttatgttttgttattctcacttcagtaaataatgtatacttcaattgcagactccatatcctagaggtagtttcttcaattctttcttgaacatctagagccatatgtacatgttctgtgggatggtgtaatctacttaactgtatactcaaagacgctgcaagacttcaatctctcaagcttacgttggtatgtcgtatactattgttttatttttcactttaggtacgtactttgactagtatgcatgtagatgaacaatacaataaaaacatctgtgtttccgcttttagtttaaacgatgtgtaacactaatacaggtaatatttatttcgttttatcgtcagaaacatgatccattccagtgatccagtgaacatctggaaagaaccaacaattgttcccgattgtttatcaaagaacctcgagatcttggaatggatagaaatatgaaggcacagagcaaatggctgcgtacatactagctagcaagcgttacttttctaaagatggcgacattctcgacaagatgtagaaacagacaatataatggcatgttaaagaagttaaagcctttggacagagtttcaaagacatgtcagcttgtgtttgactgaacttatgtgatggtgtgtgtctctagaagatacaacttagttttcttcttctttttccttgactttatttttggtgttttttgggttttgttttcacaaatgaaatggtagttgaattaactctttataaaaagaaaaggaaattaatcagttcggaaatggaatactgaaatagtaaaaggaatgattaaaatcaggaaattaattttattggattttattttttctaattataataactgtttgcttcaaaatttgataataatcgcatgagttaccccaccgtatctatatacgattaaatcaccaaaaaaaaaaactaaatttcaataattgctatttgctactacgtatttgtttcatatacatattaaaagtgattttattttattttttgtggcgaaaccctaactggactagggttcttttcttctttctttgcaaatttcggggcgagttttccaaagagcagaattcggcagaataaacaaaaat

SEQ ID NO: 2026 - DNA, 3000 bp, Unknown
  misc_feature (1)..( 3000): cDNA_ID_2148685_gDNA_ID_1620480_Annot_ID_158269 3000 nt of promoter + ATG
gtaacaaacggcacgacgtctataaaggaagtgttggaacggtatagcaaagaagatgtgaggaagatgagagaaagagtgattgatttgataccgaatttggtttacgctaagtctccgaatgggttagagactttcaaagacgcttttgatgtggcgatagatggagtttttaggagattcaaggagcaagagaaatggtacaaatggagatgatgattggataaaattatttatttatttaataaggatttttcaagtttttagctccagtaaagttatgattacacttgtaaatttatgatttttgttttgagagatgaataagttgtgttagttgaatttttggtagtagtcaagtaagtaagttgttctatgtgttgaattctcatttatatattctcttttggagacaatttatagttttctttctgattcctacttactttacagtctcgatgttgataggctaaatagtttttgagtgttttatatatctgtaatctcttgagctaatttggtaggtgggaagtgaaaaatcaaccagaggcccgcatctttgcacgtagaagggttattttattaagtaagttgtacgatgataaaaaggtggtaggtaggagaagtagaatttgattttgggggttaggtttgatcatcgtgtaatactcgtgacacgttgattactctaggtaaaattgagatatatgctcttgttttctttgggaaagtttaaatctgttactttccaataaatccaatatctgtaacaagtaaagaagctggatcagttttgtcatgtcttttgccaatatatgtagtaagtatataacaaaattggttacaatgaacgggagataagttcacctaactaacatggccttaagaaatgatagatacttggtgtaaattgaatatattctatgcttcgaaaataatactagtactcaaagtaatagtaacacagaaaaaaaatagtacacttcaaatactcgacaatcacttttcttcatgaaagatattttcgtagtctagtgcttctatatgcttgctatatcactatatgcttgtttgtggattgtgttgtgccaagtgtaactgagtaagtatgaaggtaagttaatataacaagggtaacttctcaagttctctatttaaccctcatctcccagatctcttttcaagaagacaacaatggagtgctctctctcatccatcctccttctccttgtactctgcttcactcatcccattccttctctaaccttcgagccactaatctcttctcttgatcttcatgaagaagaaagctgcccttacactgtaattgttaccacaagctgtttctctcctgattggtctagagatcaggtcactatcgctttgggtgacgccgacgataaccaggtttgatatacaaaaactctttggttgttttgttctatttgtgggtccaaatatttgttatgttcgtattatttcaaaccctgaagttatacatattccatcttgtttgatggattcacgtaagaagtttgttaaactccggataaaccaaagccattagaaccttaatgaaacttattttgaatataacagtcttattttgatggattttagtgacgatgcatgtgttatgtgtatcttattaataaatacgtatatcattgagttttggttttaatttattaggtggtcgcaccgagactagacaaaccgctaagtggaggaggtggttttgagaaatgttcatcggacacattccaagtcaaaggtaaatgtctcaacactatctgctccgtctacatctaccgttccggtaccgacggctggatcccggagaccgtcgagatatacaaggaaggttccaaatccgtgaaattcgatttcaacaagaacgtccctgaaaacatttggtacggaaacaactattgtaacaacaccgatttgccaccgccttccccggatttccctccgttttctccatccatcccaccgccttcaccaccttattttcctcctgaaccaccttcaatcccgccgccaccaccaccatcaccgccgtctgctgcctctggacgtggaagtggtcagagtttggttgttgcgtttgctgcgtttgtgtttgcgtttgcggctgtggttgtttgagttattttgttaagaattaagagttgtctcaataagtaacgagtatcgtgtaatccctctgttttgtctttgactctttgtagttgaacattgacaatttcatattgtggtaacattaattagttaactaatgtatgagttcgagtttttaacgtactattccttataaattctgcatcaatgttttgtatgtgataaatctatgaatattagattacacaactatacaaccacacaccatgaaaatacaatttgataatgacatttatgtacttcgaaataccaagtactcttaaaactctaaactttttacataaatctagagctatagagtaaacaaatgattctaaaatgttgactttagtttattatagaaattccagtatatcaagatgttgtaaatttacttagtgcatgatcacattcagtttctgtggatggtaaaatgatgatacatgacaaaaatttaatatcagtgtgcaagttttgtattgatttgtatacaacatttttttttcaaagcttaaagtggttacttgattaagaatcatctagaaaagcacataacctacagttacatgtcgaatctctaatcaatttcttctatacaaaacattaattacattttctcctctacctaaatattatgacactgacaagagatgtgtggcctgtaacttgggcgcgtcgccatttatttcagttcttataccgaaattgaatttgtttgaatttgacccggtctaatccggtttatcctcaactggttcgagactttatcttctcaattactctttcgttttctcttcgcttgtgtatctgcgagcgatttctcgaagcacgaaaatg

SEQ ID NO: 2027 - DNA, 3000 bp, Unknown
  misc_feature (1)..( 3000): cDNA_ID_2148717_gDNA_ID_1620480_Annot_ID_158278 3000 nt of promoter + ATG
ataaatcataagacacagtgttgttttaatagaatcatgatcttgtattagaattctctgttatgtttaagaaggttccttcatcgtttgaaacgaattgaaagatgatttagagaatcttgtcctaatttgttgtggtatgttaaaagttgtggtgcgtttggcaaagctaaaataaaagtatgtttgtttttgtctaggaagcattatatcaacggaggtgatgcgttactcgcccgcgaaccagaagcggaggtcgaagcggaaacagaagcggaaggagaggcgcatagcatgtctcaaagccggtaagcaaacgtgattccaaaaatgaggtgttttggaagcgtagtgaaaccacatgactctagtttggaaacgttggtggtgtggatcggaagcgtcgatggtgacttgcaattctaattttgggtttataatttgttttgtggcccaacttaccttggtcaccataagcatttaatgtttggtattttaggttatttcatttttgctaatatattcaaacaaacatataaaataaaaagacaaatcaccacccatgatattaaaaaaaaaacactaataaaagatgatgtctcctggaatggtcgacgcagaatctgtagccactcactgttctttatcgttgtctcctcctcaacattatcccaatcccacgttcgcttaattttttaatttttaggttggattttatttttcatcaaccatataaaatcattgaatagacccattcttttatcccaacctttgaattctttacctcctcccacttacaattattcgagatttagtttgaatacatgtatacttccggtgatttgatcttggtcggaaaaaacaatcttttacgacttttctgaagtatgtcgcgacgataaagactattgaggattcatgtctacgtctacggtttcaaaatgtcttataatgtctactgtgtagtacatgcatcgaactccaattatacctacacgtacgtatttaataaagttttgtgctatttaaatttgtatacgatctaaacatttctaatgtattttgaacgtcggaccagtaaaatatatgaaatcgatcgaatgtagtagaatttagaagttctctaaatatttgttttgctattttttgttatgtttttgtcaaacttttgatatttttctttcttatctctttgttcatgatctacaattatcaaatcaaccaataggaactgtttcgagttgcacttggaccacaatatcccacactaaattaaaacttgaaccagatcaaaatctcttcggacctttgccctttggaccagttcggtccaatttaacctttcaatacccttatcttgatagagtactataaagaaataataatgacagatgcatgaaactagttcaagtggaaaaagcatcgtgcactgatatatcttcatcaattgcaagaacatgtctcaataaacccaaaactattcaaacattttttctgaatcatatctatcagcatgggacactgtggctctttgtgcctttggattcaacgcatccttcacaatcttttttttgtaactgcatctcattatcgcattagtagcaatcaccacctatatgaaatacctctttatatgtatatgatatcgatttaaaagtatttagtaaaaatcgattaatgttttctacaataagattagtcagacgcgattgccaaatccataaatccaaaaagaattatatagcaattgatatactattactataggatatattatagagtggatatgtttcaccataagcttaacattaatttctcaatcttggtttgcacaatgattaatgcataattagattaagtgtatatgaagcttcatggaaacccgtacgtgagaggacggtcactagattgtacaatcaagaacgtaatatatatatatccattaatctaaaccgtacgttgtagctaattagttttgtgaaatcgagaatctaatcttgtaagaaaaactgtaggcttgttgtcagaacaaacatggacccatgttctctatgtccctaagatgtgtaccaatctcaattcacttcttttgttgcactattttttaaaaaataacttttattttatattttgagatctccattgcccctgctgcactagacattacagctcattttttccttataattcaatccctagctatttttctttcttattagtttaaactaatcatatttgggtaattagcgttgaaactatctatcatatcaattttaatgatacatatgcaatactttatgtgagtatatgcatgtatgcatgttccaacatccagattaatgactaacgtttaagccctgattttttcagagaaattttgtgttgtacctatgtttgtattacacacaatatttaccattgtttaacatgtacacatgtgtttataaatctccgtacactataatgcatatttgaaccatatatgacagaaagttttccactagttctaattacattttgttgccctttcctactcgtctattgcctatagaaatattattttagttatgattaagaattgggatgcacattccgaaattaattattaaatgccactatgaagaacccttgaacatagtctaattcaattttaagatcataaggaacattaacagtgacaatagctaaggtctctcgacaatgagacaatccgctttttaaatatatacatataagagataccatattgtatacatatgcagatacaattacaacttgaccaaatttattcaatttctccttctctttatatcaataagaaactattcatgatactggaccagcctgtttgaatcttgtcccatccacaaatctcccaatatataaataaagaaccttcacccgtaaaaccaaaaccatcaacaacttcaaagctttctaagcaagagattgagagaaatcggattttctttctaagactcaaaatatctaaaaacaata

SEQ ID NO: 2028 - DNA, 3000 bp, Unknown
  misc_feature (1)..( 3000): cDNA_ID_3065635_gDNA_ID_1620480_Annot_ID_158280 3000 nt of promoter + ATG
cttcaagtcacatctatcagcgattgtgcatattcgagagtgctcttctacatgtacaactggtatttcaacttcacagatacgacaaatcatagaattatcgtatgtcacacattgatggtccgcccagaaaccccacaaagcacttctgtctgcagatgcaggctggcctgacgggctatgcaagttttcagcgttttcatcaccataaacttttggttggattttgctctcccccttagccttgggagtgttattaagactacggtttttctcggcagcagatggaagcttcttccaagatgacatccgaaaattgctcgaagttgaatcagtacttctagcagtatttacttccactccatcagctccgctgttcgagttctgatcatcttgtttaccagctagattttgcttttcatttatcttttggatttccttctctcgaagaaggtcctgttgtcgcgagatttccaccatctgttcaggataaactccaagatcacttagctggtgcattcccagaatgtgttcttcaacataaccactctctttacgaaattgcacaagcctattgcaacgagtaagaatgaaaagaagacgattatgagcctgtttcagtcctcccatgggtagctcctgacgtttatcatcaagcttctgaacaataccttcacatttcaaccaaaactcactagctggcatggttgcacattgccgagcctcaactaacaaatcctctagacccactcttaattctttgttagattctggtgtgctctctagagttgtcactaaatagccagcaaaaactcctaaatcagcatcaacatcttccttttgcttatcaaacttcgttctgatcgccgccataatctcctgtaaaacgttccacagattgcatcaaccaaatgagcagaacttatcagaggtgagaagaagcatcaaccaacactaacctccatgtgaccaactgcgcgagatctccacacgggaaaaggtcgcacacctttagaattaagttcatgagagaagctcttaatgtcatgagctttcttcttccttccacttgtgacacgcaatatcgcctgaaaacgtggagattgtgtttccttggcaagacctacatgagtactctgcattcacaagaacaacaaaaaaaacgaatcagcaatataaaattttccaagaatttgaaaaacaaacatagaagaagacattcacctctacccctggatttgaatttgcaggcactcgttgagattttgattgactccactgaacttttttccctaaaagacaaaacaacaaacacctcctgatcattaagatcctctgaatcatcatcatctaagttgaattttcgaattcataaatcctaaatcgaatcaacgagaaatctaccttgatcgggttgatgtggaggaatcggccatctggcacgagcatcagcacgagcatcaacaacaccaaccctcggtttctccttggcgacgtctttatcatcttgacccggagatatcaaaggcgtggcagatgaaaatctcaaaggagacggcgcaggagacgatttcgttctgatatgattcaaacctaaggaagaaggagcaagaatttccggcgaatcgtgactcatcggaccttccccagctaattccgtagtaacctcgtccgtcttcgcttgttcatcttctccttccttatccgaatggcggaaaggaatcgcagggatcttcttcagaagcttcgcattggtggaagtcggagtagatatggtggtcggttgtggatcccgatcattctcaggcgacggttccgtcgtagacatttgttattaatagaaaaatttgtggagaattatttgaattttcatatttacactcttttaatttttgtttgtttgtttgttttgtgattttatcaaaacataacgattacagagaagcggttgcgagagagagagagagagactgaggttttcgcgggaagtgggggactccgtttttactacttgatgcaaaaattggctcattcgccattttttttgttcttcttgcagataaataaatttgactatttacatctaaattttatggtaatttgttatctttaattcaatatgactatagttatagtatgatacttctatttgatgttaacttaatatctttaaattataaagatttgctgtcaacaaaaaataattctaaattagttccaaattcaaaagtcagacagagattttattatggttgtgatttgtgattattcgttgtattcttatatccatagtgctaaagttataatttctgactttattattcttacaacaccttaagttattaatgaatggtgatattttatgatttgtatagttcttaaagaataatcatgtgggagagtgtccatatcgaaactacgtgcttccaacaaatgcatgtcttccccattttctagaaataacaaagaacttaatttttttttgtttaattttaaaaaatagccgttcgtgatgttttctctgggttgactaaaaaacacggtaccaagatatttttggttaaaacttctaaaaaatattaatttgttttttataataacacgtttattcattacaaaaatttatgtaattaaatcaaacatggtttgtattttttaataaaatgaattgttttccaagtaattgggtcaaaacacaaaagaaaaatacagagcaaatatttttgtagttattgggctgaatattgtttgggcccaacaagtccatataaattagggttttcatattaaatcaaccgtctcttaggttaaatcattcgactccttccttccttgcagcaaaaagcaatccgccgtcgagcttcgttcgtctctcaggttctcttcacttgatccaagttttaatatttttcatgtttacatgagtttatcggatcatttgttaatgtgatggattggttggtgtgtttgtgattgttttcagaagaagctgcaaatatg

SEQ ID NO: 2029 - DNA, 3000 bp, Unknown
  misc_feature (1)..( 3000): cDNA_ID_1009366_gDNA_ID_1620480_Annot_ID_158279 3000 nt of promoter + ATG
acacaatatttaccattgtttaacatgtacacatgtgtttataaatctccgtacactataatgcatatttgaaccatatatgacagaaagttttccactagttctaattacattttgttgccctttcctactcgtctattgcctatagaaatattattttagttatgattaagaattgggatgcacattccgaaattaattattaaatgccactatgaagaacccttgaacatagtctaattcaattttaagatcataaggaacattaacagtgacaatagctaaggtctctcgacaatgagacaatccgctttttaaatatatacatataagagataccatattgtatacatatgcagatacaattacaacttgaccaaatttattcaatttctccttctctttatatcaataagaaactattcatgatactggaccagcctgtttgaatcttgtcccatccacaaatctcccaatatataaataaagaaccttcacccgtaaaaccaaaaccatcaacaacttcaaagctttctaagcaagagattgagagaaatcggattttctttctaagactcaaaatatctaaaaacaataatggctttttggtctgctgagaatgctactaaagcctatcttagtacattgaaaacggtaagagtttattcttataaccaaaacatttacccgtgatattgtttcaaattacgataaaagattagttaatgtcacattttgacatatttctctatatgcattttcaggatcaaaggacaaaagaaccaaacgtcgccgaattcatatcagccctagccgccggaaatagcgctagaaagatagccgtggcttgcgccggagcagcaaacgccgacatactcgttgcactaatcgcagcggctaaccaaacgcgtggtcaagttgtatgcgttttacgtggtatcgaagaactaatcatatcccaaaaaatgttggaaccatcagagattcatcagatacaattcgtagtcggagaatctaacgacgacactctaatcaataatcatttcggagaagcagatttcgtcctcgtggattgtaacctcgaaaaccaccaagagatcgttggaaaaatccttaatcatcacgaagaaaacgcaagaaccgggggtggaagcggtgtggcggttgtggtgggttataacgcgttttcgagagggtcatggaggtttagcgatggaaggaaaacgcagtttttacctataggagaagggttacttgtgacgagggtcaatgataatcagaagatgatgatgaaaaatcaccatcgtgaccaagtgatgaggaagagtcgttgggtggtgaaggttgataagtgcactggagaggaacatgtgtttagggttagggttccccgaggagaagccattattgaagcttaaattcaaatcttatagattattgggtacgttagagcaaagatgatcacctctgtgatggttcagacgagtgaaagtagtaattaagaagatgattagttattttgtataagtaattatattaagagagttttgattggctttggagtattttgtgtggtgagaagagtgaaaaagtctatgtttttcgagtaaatgactttttttgtaagtgtaaatatgaaatgatgtgttttggtttaaacttctctctgattttggattttttttttttttttttttgtcttttcttgagcatatgtacacgcattgttattcttcagattttggatgtttagcaaataagatattcaaaaaatgcacatgcatgcatgagagatggcatctgaaactaatataatgaaacattaaagtaagcatatgtatttagctgtcttatacagattctcaaaatagatgtagacgtatattattgagaattgacaaaaaaaaacgtatattattgagttgttgagtctaattttttttgttgacactatttaaaaccgacaagcacgtcaaacagatattagtaatagtatatagggtcttcagacatgtattcgtttgccttaaaattgtattttaaaaagatcttcttctttttttcatcaccgttacctttattataaaaccaagaagattaatatatagtgaaatccgtaaagacgaaaaattaacgtagttcttatattgaagatgaactaccaaaatctaattaattcttatgtgattttgttaatcattgtcttggaattcactatataatgaagttcatcatctctaaggaatggttttactttggtccgattctttcgacttttggtcgttccatttctcattgaatcaaatctatgcccaaaggtaaaacataatcttctacagtacttttagatatatgatccaaattctcatcgacctaaacttataagtcattgaattcaactaggcttgtgcacatagctgggaggcaccaaataaactccttcttcgaagtagacaactcgtaatgaatgtatattatttttatcaaccgacatctccgttaagaaaatagataacaatttgaagagaagagtcgttgttgacaatgatccgttcattaatataaagcattgtcacaatctctatatgtcccataaccttcccctatccccatgaatgaccacccccatctcttccttatccatcatctcccacacctcatcactctcaaagacaacgacatttttcacccataaatatatttacataacaaaatttattcgaaacaacattaatcaacaaccaaacattacattcacacaaagtaacaaaaaaggttcaagggaaatggaccaccagagagacttatctgatctcaatagtttagtgggcttatgttttaatgtagtatgggcttttttaacgaagcccattttgtcaaaagccttgtagtgttcttcatcagtaaacgtaacaaatcattcctctgagaaaccctaagaaaaaccctgcctgaaaatctctgttttttttgacgattctttctttgtgatcggaaaaa

SEQ ID NO: 2030 - DNA, 3000 bp, Unknown
  misc_feature (1)..( 3000): cDNA_ID_2148752_gDNA_ID_1620480_Annot_ID_158290 3000 nt of promoter + ATG
ccaactccaagaacagcattgtctctaatcttctccgcttgaacatattcaaaggcaatacagaatctccttagtcgatctagctccgcgttaccattagcccactgcatgtactgtgatttttctttcctcaacttctcgagagccggcaatatttcatgatcaagaagcttattaatctcatcaaccttggtctgctttttttcaagcgttttcaatgcagcctctttcttgttttcatacatccttgttccagcagcttcttcaagcatggacaatatctccggaggcttcatattcaaaactttggtgatacgcccttgcatgatgagaaagtgtggattgttgacattaagctgcaccgagtgaaatagattctgaacttgacttggttgtgctagcttcccatttatcaaatacttgttccttccaccaactacaatctttttaacaccaaaagatacacaattccaagttaaagtctcaaattttgtcaagcacatgaattgatgagtacaacaaaagagaaacaaagaacatacttgtctagtcacagtaatctctggatgttcttcgtagccgagagggcttctgtgtctctcggaattgtcaaaggtaaccgagacagtcgccttagtaatcccagcttggccttgcttatagacgagttcctgaagattagcagctcgaacttgctgaagattggtgatacccagaacgaaacagatggaatcgaggatgttggattttcccgaaccattcagacccgttatcgcgttgaaatgtggatcgaaaccagaaaccaccgtcctcgtcgcgtatgatttaaaaccctccaagcatatctcctttatatgcatcttccttcttcttcttcccccaaatttccactcacactcgcagcatatgcgacaaaaccctagaaaaaagcgagaagagctcaatcgaaaccccagaaattcgaattcaaaattggaatctaaggtcgaaggcacatgaaattgaaacgttgcaagagaagaagaaggcgaatctgaagtcaattttggttttttagttgaagataattaggagtcgatttgggattttgaaaacaagggcatttcgatttgggaacacaaggagcgggaaagtgaactttgggaacagttctgaaaccttccacaccattcagaaggtttgatggtatcaaatacattctgtacaattttatacatgtatacttcatatgttaacaacgatatcccactctgcttcacacccacaaattaatggttcattccttgtttgaatatgactaatgaatggtgctatgtttgttaatgcacatatatcatgttcgacatgcatggcgcagatccacacaacggatatcgatatcgtcgagggagcaaaactataggatctaatttctataggccacgtaaccttggccttggacagttatatttatgatacgtgtagcttcacattaaccgtcgccatccgatcgactacgagaagttatttttaagagtttaaaacctttcgaaaatgggagaaataattgtttaagaaaaggatgaagacgacgaaggcgaaagcaaacacaatcttggggaagaaactcgaagaacttgagtattacctacaagaattcggttctggcaatggtgatcttaacgcataccgggaattcggaacccggtttgttttcacgcaaacccttttatgtgcggagatatcgtcggttaaggacgatgaagacgaagaagagatgttgaaacttcgtttcatggctaagaggttaaccgaacttgaagaggctttcaaggaaaagaccggtccaatcaaccaactggacttgcagagtttggaaagtggtggtggtgtagatgagaccactttggttcgctcgttggttgaatcgttacatgcagaatatcaagatgcgaattcattagaagagaagttggcgatgagaagaaccgagaagatgaagaagaagcggtttaggggtttggttagttttggtatagttggttttgttacgagtatggtaagtttctatggttatctttgtaatcaaatgaacgaggaaaccatttttctcactcctacttaactttggtgacaaattttcgttgttttcattgaacctactttgttttgattatgatgggatcatgtgaatgttaaattacaatgattatgatgtaattttcaataggttttggctttctattaatgttttacaatgattctgatgtaattttcaatagatctttgctttctatttatgttttttttgtttgtttcgattctcttggcattttttgtcttcgtgataaaacacattcaaaataacgtaagatttgtttggtgtggctcacgtgggagtaaccaggccccacgtgccatcttttacccggttgtaatcccaccgaaagattctcttgtcgacgtaatacctcacacgcttcaaggtcaaattcgtcatttccccactaaacacacggttatcttcaatatccgcctcatctgttcatcgaaccgggctggttatcatagataaaaccaatttatacgtcgaataaagaaattttcaaaccaacttatctcgccagtaatgaaaatactattcactagtaatatttaattgctaatacaataagctttagtaaacttttattagtttatatttgaaatggcatggaaatggccaaaccggataatccccatcgtaaatgtcaaacttaccctcaaggcccaccgtttttgaccattcttgctcttttgttcaatctcaacatcgttaaactcaagaatttgtcgtcttctccatcttctgtcttaaatctgatatcaaatttttggatcaaattctaaataaagctcatttattcgtaaagccattatcactaccaatccaaaagagcttttattaatacaccttactcgtgaccggattcgcagagttcacgagcttccgagtcaaaaacactctaaaacaaaaccatg

SEQ ID NO: 2031 - DNA, 3000 bp, Unknown
  misc_feature (1)..( 3000): cDNA_ID_2148748_gDNA_ID_1620480_Annot_ID_158289 3000 nt of promoter + ATG
gagtttattatagtatctctgtaattctatattagaatggtatgtaatatgaacaaaattaaaaatggaaccaaatggagaatttgtatgtaagtttggtgggggcaacaggaattgaaatggggccagcaccgaaggcgataaggagcttttttgccgcgatgatgttccctgtgttattacgtaaccactcatctcacgccacgttattttattactgtttttttaaaacaattatttactctgtagttcacttcttttttcctttacgatgttgttatgggttatccattaaaaaaaaaaatatttgtaaatcgtctatttaaggaaaataaaataaaacacttcatatcatgttatgtagtaccaaattaacaaagtattaacttcaaattaattcgccaaaaagatgttatgatgtgatgcattctttaatatagattaaactattggtgatttgtttttctatagttaatcactagcaagaacatttttcttttatgtttacagtttttagattataaaaaaatggtgtaataagaacatgtcaaatcaaatgtatttaatttgttaatatagatttgtgtataaacaattggtagttttgataattcaatttttcagcaatcatcataataatactttacaagaaaagctaaatcatctgaaaattttatatgaatacgtacggtttaattcccaatctacaacttttttagttggatttattataaccgtttttctaaaacaaaacacattaaaatttataagtgaagatccaatgggttcaaaccttttaattctcaataaatatacatagattctcgaagatatcctatcaacttgtaaaagttgtttaatcaatcttttgtttgatgaaatcttgttcaactgttgatttggttaagttttatagctgaaatgtgtataagtgtttctgaacctttttaattactgctaaatcaatttatgtcttacaaacttgccgatgtatcatgtatgttcattaggggtgtcaaaatgagccagctcgctcagctcagctcatgatgaacttaaatcttttatgagccagctcagctcaactcatttattatatgagcttcaaaatacaaactcggactcagatcatctagatcacgagctaaatgaggtagttcgcgagctaatgcaaataaatgaaaaaatttaaattttctaaaatttttatgtaaattatatatttttaaaaatatatttctatttttatagattatataaatatttatgttttgattgttgactttttgtgtttattactaatatttattttcagaaattattatgtaacttatatattttctaaaatatatttctattatttatagaaaaatatatatatactttgattgttagttttttgtatatattacttcaaaaaagccaaactcatgagctagctcatgttcattaaagctcgctcatataactcgtgagctaaataaagttcgatcactaaactcatttattaaatgatcctaaaaaatagaattcgcgctcatgaataactgagtcgagttgagccagctcatgagctatcagctcattttgacaccattaatgttcatataataatcgtaatccatcatgaccaattaggcaattaagacatactataacaaaacatttttttttttttcgtcaaacattgttttgttaaaggtttcaaaaagaacatgcgtatcaatttcaccaaacgaatctaataaatagcacgaccatcggatattatattgctatttgacgatcaacgtacgttcgattaaaaaaagtacggggattgtttagtttaatccaagtgtagtgttatttagacttcgagtaacatcaacgcgggagaagaaacgcatgggatgaatgtgtaaagtggttaactttcaacaatgtttcttaattgctaagatgtttaaaacgagtttacatgaattcttgtgttacttatcgaattatcttttatgagataattagtacactaccttattagggctccatttctttttctatctaggcctaggtcgatcagtactgtgtatgttacacatatgatattaaaaaaaaaattgattctataataatcttcataactaaaggcaagtatagtttatttgaaaacgtctcattcaatagttggtagagatagttctaaaagatcacattacttctctatcacacagagtgtagaaaagtgaaaacttatgcaacacttcaggtagaaagagaaaagacagtgatagcttagttataattaaagacccccaaaatccaaatagaatcttctcttaaataaactattgaaaaaatattcacaaaaaaataaaaagcacatttccttttgcttgcatcacgagagcttttgtctctctttacatttatgtgcctatatataagcctagagaatccaccatcatcggagtactcgttgtctttcatgatctcaacataaacaagacaaaacgcttttgtctcttgtctatctaaattaaatctacgaggaaacgaagagaagcaacaaaattcgatattttagaagtcttgcataaataagaagaaggtttcaagtaagtttctttcagtacatagagaaaccatgtatatgatttatgattgtcaagatgttacacagtcgtatatataattataagtatttcataaaagtaatttatgaaaccatgcacataactaacttttgtttttgattttgtaaattgagtagtttttgtttttattatcatttttatgtgtttatagttggttcagccgagatattatgagtaaccaaacgtaacctttttcataatgaaacggatcaaatatactttaatctttttcctacatatgcttagttacttgaaaacttgatttcacattacttctatgcatatcttttctatgtaccgcgcgatgataaagtatgtgttacaaattgccacattgcagaaaatataaaattaaaaagatcaa

SEQ ID NO: 2032 - DNA, 3000 bp, Unknown
  misc_feature (1)..( 3000): cDNA_ID_2148728_gDNA_ID_1620480_Annot_ID_158282 3000 nt of promoter + ATG
tgtggtcgaccgcatatattagaagaatttaaattccagttgtgacacatggacaatagtactaacatatctaagatccaactatagtatatgccagtcttatgaatcgattatttaagaagttgaaatcttgggctacgttacgtggctcgatgtgtatattggggactaataaggcccaaatcattgttacggcacaatataactcggcaaagcccgaggcaaaatatttcttgtttgcttatgtttgtctcgtgtctctctagtgcatgtgcaatatttgtatgtgttctggtaatctggttattgaacagatatttgataagttcgtacaattaatgatgagttgaaaggaggatctttttgataatttatcttcaacaatctcgaggtttacataagtgtaaggccagtttggtattcgagataagtgaaaagggactaaaaacatgtttaaaatctagatgtgtttttaagctagggttttttgtttagtcttcgataatcatttcgaaactcttttattcattttggactgatactacatgaataccatacaacaaaagaagtcaattcttactaattcttagcaaaagctatgaacaacatcttgacattgtttatttcatggtgcaacttagcgaactgggtatgaagtgactttcttaccgcatccgagactccgccccggactgacatctttaccggatccgcgaacgggctggagcaagaattctcgaccatatactcacccgcaatggcacagacttcagcattgtttgtgtgaaacaagcattcggtccaactgttacaattcaccacctcttggagttcttcgacagaacactgcgcatctgtagtgtatgtttcggttgttggtcggcagtctgcaagggtttggaactggctcttcctcaggtgtgagatgaagagcttcgtggacagcgcttgtttcagactcacggcgatagctgcatccacgaggcgtcgagggcttgtttggatcgtatttgcgtagaccgagagcgtgtccacgcacagggattggtacgttgtaactttgcaagaagattgaatgaagtttagtgcttttgtagaagttccggccgcggtgacggtggcagccgtgaggtctgaggagaagaggtaggagacggagaggagtagaaagagagcttgacattgttttgtcatgattgttgttttttcttgaggttgaaataattaagtgtgaatagaaaagagttggggttcaaatatttatagtacgggctacctttttagagtgcactattacttgatattgatactaatcagtaatcaccatgattaatttgatattttggttatttgtttcaaataaaaatcacgtatcttccactcactttcgttccaagtcttaattttatatatccatggtatttgtaaattactatctcgtaaccagatccgatcggattgttacacccaacacatgcagatatacattttgttgacagccaatttataattattttcccttataaatgtttatatactttttttttttttgttaattgttttaccaaaactaatatagaaaatgactcatcaaaataatatatgaacatgtagttgacttagtgaaaaatatatctgtagtttcgtttgaaagattagaaaaatgagaaataaccagatatcaactgattcatccaaatcgggaaaaacgaatttttcccaccataattgtctatacaagaaagtgggaactaactttcgtcttcatcgaagaggagcattctatcaattccgttagtacgaccaatatttatcaatagatttttttttttcttttcctaaattgttttatctttaccgacagaatcaagttgttgtcaaaattatttttcttgtaacaagtttataatgcatgatcatactacacattcatagcgaaatgcttaactttctgttttgtttttataaatgtgtttaaattttggtatatcattattatatttataagttgaaataatgtggataaaactgagattgtttcgaaaaatatgtgttagaaatagaaaacaacattttttgtgaagtcctatatatatactacgtgtcaaagatatttaataaattctcaattcgaaattaatatcatttcagtttgttaaacttcaaaggcaagtctcatgttctttttctctatttcaagattttatttataaatgaagtctcattttcttgtcatgatcaaaacgcaagcagcatgatcttttttccttaaaacatgtgaatgtacatacaaaattctaaagagccaagtttataaaagatttgaaattagataaacaagaagataaatacattgtttatttcacgtatatgcctatttatagttataatttttgttttgttttagccgtttgctaagagtagatgacaactttgttgtacgtgtaaactgtaaacgacatatcatcaaatcacgaataatccaacatgaattgtaaagtaatatgaaggtaaatacataattatacgaaatttatccgctaaacagtacgtcaaaagaatttaattatactttaatatgaaagtgtttaaaaataaaaatgaaagaagaaaaaggtttatatatcgaactataatatacacacaattacttatttaacaccgtattcaatggttttagcaaattccacaaaaacatcagaaaagattcaagaaacttttggatcatcgagttttcttaattatattgaatgaaaatgaaaataattattaatcttaattaagcatcacaaaaaatggccaagaaactccatacgtgtgtatatatagttagttagttgagataaacttggttaccacttttgtgttgtctttctttttctttttctccattttccatttatcgaccccttgggtgtagctaattactttcacgattttcaaatccaataaagttttaatttgatgaagctttttttaaaccatataatataaataatg

SEQ ID NO: 2033 - DNA, 3000 bp, Unknown
  misc_feature (1)..( 3000): cDNA_ID_2148724_gDNA_ID_1620480_Annot_ID_158281 3000 nt of promoter + ATG
attctgcgagtgtgctgagctgaatcctgaaccagttcaaggtaaaacatataattactggtttaatagtatcactaattgcattttttggttacctagccatttatatctttggtttcattgcatctttcagaagaagaagaagaaagcggacataattgggtgtttagtgctgatcagatggatgttcgtggaggaggtaattaatgttttcatatgacttagaccgaattaaagagtgtgttaatgtattcatcttgaatggtacgaatgaaatgtgatggttttctatgtgtttgcaacagatgatgatgcagagtggcaaatatctcagagtccgactagtgtaattggtcattccaatggagatgaaggtcttaatcagcctatgcttgaggtaatacaaagttacaaaactctgctttcaatttttcctctttttttgtttttaaaaaattgagcgtggtttcatctgccttttgtattcacactgcagctccaaatcaatgatcagaggtttgaggatgctgaagagatggttcatgaaagtgagaccaaagatcactagactcttcacaattgtactcgaaaacatagtagttgtgttattttaacgatgaaagagttgtattatgttcaacgataaagtattatgttcgtgatacttagcttttcaatttatggctgattaaactttaatctttctcgtaatagatctctcaatttgaaatgagatagcaagttggtaacttcatacagagttatgtcatcgagagggtcaaaagatctcaagttaagaataaaggacgaacttctaattaaaaaattcaaaatctattaaattaagaaaacataagaacttgggtttcactacaacaaaacatttgttttttttttaactcaaaaggaatgtcgttacgggaaaagaagattgtttcttaagagaatttgaaaagagataccaaagccacagaagggttgatctacgagtcagcgatggtgacctcaacttcaacaccaggttcaatggtgatggaggtgatctgcttgaccacatcaggagagctgaaaagatctataactcgcttgtgtaccctaagctcgaatctgtcccatgtgttggttcctgtttacaataccaatagttaagagagtttcagcaaatgtgaagacacttgcagtgacagagtataaaacagtattgagcacaatcacaaattctaagacctaaatcctaggtttaatagagcaaatgaactaagggagtggttccaacaacaagctctagtgattctgaaggcaatataaaagatgagatgagcataatcatcataccttcaccacaaggagctttacgggtagtgatcttgagaaccttggtgggcattctgactggacccttaactctcagtctcttgtccttagctccacgaaccaaatcagtacacactacatatcattttgtagaaacagaacaataacaataaatcagtatcaaaatgtccactctcaaaccattcgaatcatcactgaagcaaatcgaagtcaataaatctatcatcttctactgaaaaaactaaaccttcaaaattcactaaaactaggaaaacattgaatcctcaaacattctttacggttttgaaagcagctcaaaactaaattgctgaagcgaaatgataagataatcaaaataaaaggataaaaaagaaagacctttttccaagttcttgacattcttggaggagagagtaattctgatcttgtgaatctgctcgagtggctcttccaaaccagccttccctggtttcattggttgatacgctgtcgccatatttgcagcttcttctgaaaacaatcacaaacacaccaaccaatccatcacattaacaaatgatccgataaactcatgtaaacatgaaaaatattaaaacttggatcaagtgaagagaacctgagagacgaacgaagctcgacggcggattgctttttgctgcaaggaaggaaggagtcgaatgatttaacctaagagacggttgatttaatatgaaaaccctaatttatatggacttgttgggcccaaacaatattcagcccaataactacaaaaatatttgctctgtatttttcttttgtgttttgacccaattacttggaaaacaattcattttattaaaaaatacaaaccatgtttgatttaattacataaatttttgtaatgaataaacgtgttattataaaaaacaaattaatattttttagaagttttaaccaaaaatatcttggtaccgtgttttttagtcaacccagagaaaacatcacgaacggctattttttaaaattaaacaaaaaaaaattaagttctttgttatttctagaaaatggggaagacatgcatttgttggaagcacgtagtttcgatatggacactctcccacatgattattctttaagaactatacaaatcataaaatatcaccattcattaataacttaaggtgttgtaagaataataaagtcagaaattataactttagcactatggatataagaatacaacgaataatcacaaatcacaaccataataaaatctctgtctgacttttgaatttggaactaatttagaattattttttgttgacagcaaatctttataatttaaagatattaagttaacatcaaatagaagtatcatactataactatagtcatattgaattaaagataacaaattaccataaaatttagatgtaaatagtcaaatttatttatctgcaagaagaacaaaaaaaatggcgaatgagccaatttttgcatcaagtagtaaaaacggagtcccccacttcccgcgaaaacctcagtctctctctctctctctcgcaaccgcttctctgtaatcgttatgttttgataaaatcacaaaacaaacaaacaaacaaaaattaaaagagtgtaaatatgaaaattcaaataattctccacaaatttttctattaataacaa

SEQ ID NO: 2034 - DNA, 3000 bp, Unknown
  misc_feature (1)..( 3000): cDNA_ID_3065639_gDNA_ID_1620480_Annot_ID_158276 3000 nt of promoter + ATG
cttcttcttcatctgaaaaagctcattttttttttttttggaatcagagtttggtgaatttcaggagcagagtatttaagtaattttggggaattagtgagaaaatggaggagaaaggtgaaataagtccaagtggggtcgtcacagttaagggagatgaagctttggttccaagaacagagtttcaacaaaaccctagttttctccaattcgtgagtcccacaacggtagtgactcctctccctcctccaccagctccgtcttcggctccggtaccaaccaccgtgactcctggctcagccacagcatcaaccggatcagatccgacgaaaaagaagagaggaagaccgaggaagtacgcaccagacggaagcctgaaccctaggtttttgcgaccaactctgtctccaactccaatctcatcttcgattccattgtctggagattatcaatggaaacgaggcaaagctcagcagcagcatcagcctcttgagttcgtcaagaaatctcacaaattcgagtatggaagcccaggtaattaaaagttgagatatttgtgtttgaactgtttgcattggtttcagtgagacaagatctgatctgggtttcgagtgattttatgttgttgtgtggatttttgagatgttgggaagtgggaccaacataactggattttgctgggtacacttttgtctgaagaagctattacactcagaccagttagagacagagaaagggaatctgctgatgctgaccaaacaaaaacagaaataaaaagaagattttgtctttaaaaaaaaaaatacaaagacagaataatctctgtctcttcctttttatcttagaagataagtatgtctagttgtgattataagttgtttagcagatcttacgatttctcattatctgttttaattactgtgtgaataaaaagagatttagattattagttggtctttgttttgaatcatggagttagttgcttgaggattaggattaattaattagctgattagactaatgcaaactctgttttactatctcttgcagctcctactcctcctcttcctgggctctcatgctatgtgggtgcaaattttacgacccatcaatttactgtcaatggcggtgaggtaataaatttcccacagaggattcttttgttttctttcttcaacacggtgcttgtaactcaagctttggtattaaattctatcagtctttgtttgagaatttcttgttttgatcaggatgtgacaatgaaggttatgccgtattcgcaacaaggatctcgagctatctgcattctttctgcaactggttcgatctctaatgtcactcttggtcaacctaccaatgcaggtggcactcttacatatgaggtaacaaaacattgaatcaaatttcgttagtacctcgttttgaaatatatatcgagtaaaactgttatgtgttttttcttttctaagggtcggtttgagatactatcgctatctggttcctttatgcctactgaaaatggaggaacaaaaggtcgggctggtgggatgagcatttctttagccggaccaaatggcaatatatttggtggtggccttgccggtatgcttatagcagctggtcctgttcaggtgacacgatttgattacatgaatgaaacatatttacagattcaggagtatagaaaactctaaagtcttataatatgtgacaggtggtaatgggaagtttcattgtgatgcatcaagcagaacaaaatcagaagaagaaacctagagttatggaggcttttgctccaccacaaccacaagcaccaccacaactgcaacaacaacaacctcctacttttaccataacaaccgtgaattcaacttctccttcggtgaacaccgtagaggagcagaaaccacaagcttatggtggtggtatagtgagaccgatggctcaaatgccttcttctttccaaaacgacaattcaactatgaacaatttcacaccggcctatcatggatacgggaatatgaacactggtactactcacaaagaagaacatgaagacgaagatggtggtgatgatgatgatgattcaggcgatactaggagccaatctcatagtggttgagcaattctctgatcaaagtcagaaagttttcttgtgtagaaaggaagggagcttaaaggagtgcttttttttagagggttgttttagttgtgtgagggttttcttcttttgtgtgcttttctaatttctagggttattcttctttgtgatcggtttagatttaatcatgtcgaagtcatagactaaacgatgttcttattgttgaggtcattgggattcaaatttagtaagacttttgtgatatggttcatattcttgcaaagtccattcataagattcactacaaacaaatgtttttgatgtataatacaaagtaggagtactataaaatcctacctgtgattcatcattatttgtctatgtcattaaaacattcatcagtttaaaaattgcttcaagtctagatcgtgcgtaattgcaaaagtctatataatttctgttccacatacacagactcatcagtggattctgggtttaaattgtaacaaataaaaagtcaagatacaaaaggaagtgagcataactaaagcaaaacaactataaggtgatatttaaaataaataaagaaatataggggttaaaacataaatacaaactcttcgctaattctcaaaacccttccctttcctttatcgcagtcgtaactggcctccgttggtctctatcgtgactcccttcacgccattaattccgattaatcggagcttcgacttctcatcttccttgggtaactcgctctaccttatcttcatgtaatcaaaattcgaactttttgtctgtgtgttttagttgtttattgggtaagttactagatcttctctttcgattttgtttcagcgttcgtgcgattcaacgtttgatttgaagaatcagtagca

SEQ ID NO: 2035 - DNA, 3000 bp, Unknown
  misc_feature (1)..( 3000): cDNA_ID_2148694_gDNA_ID_1620480_Annot_ID_158272 3000 nt of promoter + ATG
ctggttcaatgatatgtaggaacaacccaatttgcaaagctttattaaaagactctttagttgtcgtcaaggtttaacttgtagtagttggtaagaaattctacgtgaaataggcaacattacaaaaacaaaaatcaattcgaaatcatacaaaacgaaaccaagtagtaaccaactacactattatgacattaatgattagacattcccaaatcatacaagttcctgtcatgaaggaaacaatggtccgtatttgcaaacgattacaaaaattcaaaccaaaaatgaaaaaacgagttaaattatttggtttataaaaatagtaatgtcaacagaagactagattgggaaacctgaagcgaacagagcttttaaaaacgagtttgaacggctgggatcatttggtacaatacccaccgtaagtttgtttaccctagggatgcaagccaaaggcccaaatcagttactacttactgctacaaccatcgtctcagctttttgtctcagctttttactaatgaagcatacaatttcttgggcatgtcacatctcgacacgtgtccactattctcttctcttattggctactcgttcgtaggcttctgttaatagatgatctctctataactctaacagtcttttctttctctttatttcgttttggtattttaagtttcaaattgaaaataataggaggaaaagtctagttttaaatattgtttttttacaagtgaacgtgaaccaatttacctctttttttttatatatcctatcggctaatctggttagtatcggtagaaatgcaccgaggtgctacagagattaatgctagggatagtcagaccgcttgtatttctgactatcaagtaaatctacgcccaactcacatatttcccaaacaaatgtgatttttttttttttttttttttttttttttttttttgtaacaaatgtgattttgttttcaaggaaaatagaacttacgtttgggaatttcacccttcactaaagcttccttctgccattagaccacaaaggcttgggcaatttaccatttttgtaaaagtagaaaacaaaatgcctaaaatgttcatacttcattacatcaacaaggttatgcccacgatatagaggcatgtaacatttatatatatagtggaagaagcctacgagctttattaataagtataaactctgattattaggtaaataaattacttaaaacgattactcaactgacaaaaccgtagttgaataataaggttactatgaataccgattgaatattgcaaagccggaattgaaaaatatataacagatcaaatgttcaagtgtggtcataattctcacataggtcatatagctgaacccatgcatctatttactagtctatagaaagtactagagacgcatacagctgaacctactctattcttttattaattttggttctcgtggatacaaaattcctccaacatttattagaacgaataaaaccaatatgatgatgattagttattggtaaacatataaacgttgagtaaacttcaaaatagattgaagtactattaagacttgcattttttccccttgggttatattcttgaatcgtttcgaagtattttaactttcaagaatagaaggttcctcaactataaacaattacattaatcaaaaccatttctatgtaaacaacataatttttgtatattttagtcttccccaaaagtttgaccgatagggcggtttagaccgtatagtacgactgtacaacaaaaaggactctggagacctaaagatccaaaactatgcaaaataaagatacggtcggaccaatttaatctaacaaaaccaaatccttatactaaactatttaccgatacatttccatataacacagtacacacaattaaatcaaacattattggaagaacaagatagaatattggcttaatctcgaacgattagagttatcctagagcctcggagcttttgtcacatataatataaactatggtatatataaacatgactctcatttgtatttatcgcaaggtacaattccaccaatttttttcgtcccactcatacagctttaattgtgaaatcaatccataaaaaaccaacatgtgacatggtctctataactataactataagatagtaaaaaattcacatcaacataaaagaaaaccaatcatattggctaaaaaaaactaacggtcgaaaaacgtataaccacaaaaccaaaccggtccaaccggtgtccccaatcactatcaaagcattaactaactttcacaaggaaaagcatagttcagtttctctacatcgcttcccatcctcttaaccctgtttactcgaatcatccaccgttggatcaaacacgcgctacaaatctagcgcgtgaccgaggtttttacacagtggaatattaccatgcattggaaagcggcgtctacaacaaacggcgggtcatgtcaccgtcaaaatcaacctttcttaattcctaacgccgttacttatctccgtttactaaaaatgttaatgcgtgtgagagtgaagatcatatactaattagaagtggctaatgttttaacgtgacattattatcatagttaatggttcgatcagagttttaagtagtaaatgatataagtgtgtgtatataattgcatacatatatactctcacactctgacagatttgtcgtggtcttagtattctctttcatggctagttatatagggctctagtacattatctctctctccccatttctctgtctctctcttctttaacatctctggctctgcatttcttgcagttcacgctaatcacctgttttggtacccttttctctctgcaacaatggcagaacaagcctgaagtttcgttcttttgtgttttggtttcctctgctttgttgttattgaatcaaaacttcaacgagcttcttggcttattaccccaaaaggaaagaagaataagaagaaaaaa

SEQ ID NO: 2036 - DNA, 3000 bp, Unknown
  misc_feature (1)..( 3000): cDNA_ID_2148698_gDNA_ID_1620480_Annot_ID_158273 3000 nt of promoter + ATG
tagctaagaagagtgaaaaagatttttagtaagataagcattcatcaatatgacaatgtgtacgttgggatcatttatatcaaacctggaagtttattaacaagtgcacgagctttctctgcgcgtttgaggattaaatgagatccttttccagcgttgtatcggttttcatcctatacaaaaaaacattaagtaacggcaaaatgtcagaactgaatctttaatgaataaaaaaaagacaaacctgattatactcttcaagccaattctcttcctcacaagcattcaaccatttatcagctttctcaagaatctcttttctgcttagagcttcctctttcactttcccagctcgatactcgatctgttctagtatattttcagggttcacatctcctgattcaatggctttgattacattctctaccgcgatatcttcttcttcaagaacaatgtgtgttcttctacatatctcttcaagctctgaccttttctttagaacaagttctttcattttgctccacttcaactcctccaaccgacatagctcagctttaacctatttaaaacattaagcaatccatcggcgaaaatagtctcagtaagtttacaaaaagatttgatgtaaagttgttgtgaagttacctcttctagcaaatctatagaaagactattgggtttggttatttcagaaacagtagcagctatattacatgatacatccatgaacttttgttgttcttctgctggtgtatccattaaattccaaaactcaagcatcgttgtcacgagatcttgaagctgtaatccataagatagcatatatatataagaaacaaagagcagagtttttaagatggtaaaatgtttaaaaacattctaactcacttcttgcattctttgaatctttgtctcatgccattgttgtactgatgaagctaacttgtcaagtgtttcattacttatacttcttgacccttcagtatctactaaacttgggtgaatcttggtaacagtttctcgaaaattcaaaccaagaaccgaacaaagcgattcaagagttcttatattatcttgaatctgtttcacccggttcctctgagccaaaataaacagtaaagtattagttaactttttgatcaagaaatgaaatcaaatttaaggtaaagtttagaaaaaaccttttgttcttgaagtgtgtaaagctctctatgtaactcttcaagctttctaagagataaatcagattcatcagcagaaaaatcagatgaacaagtctcatcatcagattctccattaatctcttctcttacacatcttatatcatcaattacttgaataaactgaatcttcctctctgattttctcttttccatttcttcaagtttctgaagaatctttactaactcatctttcaagcttctcccattaccactttgttgatcagattgatggtgtcttccaagaattggtggctcttccattacagaacatatatcaataactcttgcttcagaatcagcaatctcttgttttatccgaatcttttcttctttaaccttttcgatttttcgattgtagacttctctgcattcttcttcgatctcaatcaaaatcttctccctttctgtttcagtttctccaacctctttccatataatctgcatcagaaaacagaatccacatcaaaatggaaatgcctttttgtaattgaaaaaaaaaagcgttttcttggagttgaagcaatcgtcacaaacctcaagttcttgtagaagagatgaccaagttgattcgatttgagatttggacattatttatctccaaactctgcaaataaattcaaaattcttccacattcgttatcttattcaatcctatgaggatgttttttttcctcaataggttacttcataaaatttctcaaacgataacaaaatctttttagaaaacacaagaatttttttctttctaaatgataatcattttaattgctgaaacttttttcttttgaattttcctggaagaaatacgagattctttacctggattgaaggacacagccgttggtttttccttgaaaaaaattcggataaaatttaggaatcaaataaaaataatctagtcaaaaaaaaattacaggtaagttgttaattgtaaacaaaaaaattacaggcagagggaaaacgcttatttcgtatatttgtttgcttccccctaatcttttgaaatctctcctttctcccctaataaaactttgtagatattagtttccttttgcttcatgatacatagattttcttgttgtcatgtttttttaacaatagaaagatatatgatgcgccaaatatatctcatatttaagagcgttacgacaagttgaaattatagaagaaaaacaaattctaatttcctagatacgctttaactatctttaaccacgaaattaccataatttaattcacaaattaaaacactattttcatatatttaagatttgaatttacatctagtaaagtaactaaaattcttgccaataccaagaaccgaagtagaaaacatgtgcaaaatttaatatatagaaactaaagaacataaattattagatgaactggtgttgtggttcaaaaaaatataaattggggtctaatttgtgattttagaaaactgaagaaccaaattgagaatactaaaaatatgagctgttattgttatacatccgcgccaactgaattttagggccgttaccttctctctctctctctctcttcttgtccacaagaaaagttagagctcttctctcatctccaatttctctctctctctctccttcgctcttatcctctggcgattttttccagagattctccgattctcgaggaggaggaggaggaggaggaggagggagagaaggagaaggacattttcgattcgattgatgtgaaacgctcctacttgattcccgtcgtctgagatcggagttatcatcgaggattgataatg

SEQ ID NO: 2037 - DNA, 3000 bp, Unknown
  misc_feature (1)..( 3000): cDNA_ID_2148705_gDNA_ID_1620480_Annot_ID_158275 3000 nt of promoter + ATG
tcttagaaagcttgaagagttacatagagagctttacacacttcaagaacaaaaggttttttctaaactttaccttaaatttgatttcatttcttgatcaaaaagttaactaatactttactgtttattttggctcagaggaaccgggtgaaacagattcaagataatataagaactcttgaatcgctttgttcggttcttggtttgaattttcgagaaactgttaccaagattcacccaagtttagtagatactgaagggtcaagaagtataagtaatgaaacacttgacaagttagcttcatcagtacaacaatggcatgagacaaagattcaaagaatgcaagaagtgagttagaatgtttttaaacattttaccatcttaaaaactctgctctttgtttcttatatatatatgctatcttatggattacagcttcaagatctcgtgacaacgatgcttgagttttggaatttaatggatacaccagcagaagaacaacaaaagttcatggatgtatcatgtaatatagctgctactgtttctgaaataaccaaacccaatagtctttctatagatttgctagaagaggtaacttcacaacaactttacatcaaatctttttgtaaacttactgagactattttcgccgatggattgcttaatgttttaaataggttaaagctgagctatgtcggttggaggagttgaagtggagcaaaatgaaagaacttgttctaaagaaaaggtcagagcttgaagagatatgtagaagaacacacattgttcttgaagaagaagatatcgcggtagagaatgtaatcaaagccattgaatcaggagatgtgaaccctgaaaatatactagaacagatcgagtatcgagctgggaaagtgaaagaggaagctctaagcagaaaagagattcttgagaaagctgataaatggttgaatgcttgtgaggaagagaattggcttgaagagtataatcaggtttgtcttttttttattcattaaagattcagttctgacattttgccgttacttaatgtttttttgtataggatgaaaaccgatacaacgctggaaaaggatctcatttaatcctcaaacgcgcagagaaagctcgtgcacttgttaataaacttccaggtttgatataaatgatcccaacgtacacattgtcatattgatgaatgcttatcttactaaaaatctttttcactcttcttagctatggttgaagcattagcttccaagattacaatatgggaatcagagaaagaatatgagtttctctttgatggtgtatgatcttatcttcttctctcaaaaaaaaacccctcttcttctcttttctcctttttctcttttatatacttcatttgatctcttaatctgattttcttcattcagaatcgcctactttcaatgctcgaagagtatacggaactcagagaagagaaagaacaagaacgccgcagaaagagggtattagttttacatgcaaatcatatttttaatcaaattttctattgttccaagaatcaccaagaacaatgtttgtaggatctgaagaaacatcaaggtcaagtgacatcagagcaagacaaaggaagtgttacgaagccccaaagcgcgaaaaagggtcttaaagtgtcaactaacaagagatttgtctcatcacctcatactcctcaaactgattcgcctcactcagcaaaatcgaatcaatcgtttagtactcctctatcacgccatggctgaaaaagatagagctaagatttcaaaaacagtctttttatagatcaactagtaatagtttctttcttatatacacactgtcacacatgttatgtacaagtatagttctaatgcaaccatagaaacaagacatgctaattcaaatagagggtctcgaaactgatgattcttgatcatttgtaatctgtcaaactcaggatccaagtgtgtactatacactgattgttttgcggaaagattagtttgactttgaccaaccaatatacttgctgcaaaaaaaaatgtcaattgtttcctaacatttttttaaaaccaaggaatacttttagttggtcgattttgtaattaacatcatcggtatagattttgacgcatagttagtcttattacaattagtgaattagctgagaaataaatctaaatcttgagcttatctagaaaattaattggtcttagtaaggtattcaaagcaataatctttggtcaaccttatttcaaaagtgatttactggaaaaaagacaaaggagattgtcagaagttttggtattctttattttattttccttttcttttcgaaatttcactttaatttttcttcgtatttccgtttattttattacaaatattaaatttccaagacggacgtggatctttccctaaaccgaaatcaatactttgatttttgtaattattatatcgattttcaactaattaaatccttaatattcctattaaataatacaactgtctacatgacatttttttatatatattatcgtttcttttcctgaaattttccattttatttatttctttgcaaaaaccctaaaaattcattcgtctaagagagaaaaattatcttctttttcttgtgaatttttttttggggatattgcatgtaattttttggggatttttgaggtttaatctccattgaaagaagctctggcatttctctgctacagtgttggttttcagctgcagaattggtgaaaaagtaaatctagaaactgtaatcaaatttctctgctttgatctttggtccttttgagctactatttcatatctcttgttccttttattgttcttagttattattacaaagaagaagaagaaaaaaaagaaacctttacttcttcttcatctgaaaaagctcattttttttttttttggaatcagagtttggtgaatttcaggagcagagtatttaagtaattttggggaattagtgagaaa

SEQ ID NO: 2038 - DNA, 3000 bp, Unknown
  misc_feature (1)..( 3000): cDNA_ID_2148701_gDNA_ID_1620480_Annot_ID_158274 3000 nt of promoter + ATG
cttcaacgaggtcttctttgcttgatatctgtcaagaaaaggaagattttggagtaaaagtaggacttttccatggatttttagtcaaaaaaactgaattacctttgggtctagaggggaagatttagattcatacacttggcaatttatctttctgctgtgattttctttgactatcctagtttttaaggaatcaatgggcttttttagtctgcagaaaatgtgtgtgagaacgttttaggaaaagtagattcactgaaagtttcaaagcaattggcactaacgttctggacttagtagcatcattctcttgtacgacatcggttttagcctgcaatgtgagacacatcatttaactaaatgtaaacatggaggtgaagaatcgacaatgagattcgtgacttacatttgaagagcgttccttcgctctcagtgatgtccttaaacgaaatgcctgatgcagaaatttttgttaatggatgaggaacgattataacactttgagtttgtagctattggaagatacattatacctgaaaatgttgggaccgtggcgtattagttttagccaaagatgttgaaacaggttccagattaatctgcaagatccaaactcataagcttctgagaatgtggtggtaataaagaaactgagatgaaaatacaaaagaggatataaagtacatttttgttcctaatgtgtcttttagaatttgatgtcgcaatctgctctctctgtgtgttaaccttagacctgaaactctcaagagaaaacatgttatacgaaagccaacaaacaaacatttttaacacaaagtccttaattacctgtgtctttcagatctttctgcagttctaagattcggttcctttggaacagtgagtttggctctgctgctaacatgagccaccttaaaggaaaaaacaatgactcattgaaagctatcagtataattgtataaagataactagaatcagcaaattcaaaatccataagagaaacacacaccttagcttcctgtttttgcctattggtgtcttggttttgtaacttagagactaagaccggagctacattttcaccaaacttggctaatgatcgctgacatctgaaacatcaaatacaagttgttgaagccacaaaataaaattcacataaatggtttcgtcattggttttagtaccttgtcagaagttgaacagagtaaatatctaaaggtttgttctgccttgcaagcaaagaagccgtaggtcttgtcaaagtagagttacttgttttggttttagatttcgattttttcttggatacatctttaacggtttggttataatatatgaagcctgacaacaacaacaacaaaataaactaaaggtctcaaaactgcattgaagcatcattatgcataaacaaagatttcagaatcattaccgttgaatttatctttgcaattcaaaccggtctcggcttccgaggattcaataatctccacaggcttagactctgatatggtgtttgtaatttgcttaaatggctcaaatttccaattgaactttgggctaaaagctgagataaatcacacaaatacataaataatatgaatagtaaagagaatcgttgaagatgaatgtgtgttcttacgtgaaggaggatagtttccagaggattgaaaccagatttcgatttcttcagtctcggaataaagctcaggtctagagaaatcatagaacctcggtgcatcgaattcgaaatcaatatcgaattcgaaatcatcgccagaaaaactcattatcctcgatgatgattcgggaaccattatcaatcctcgatgataactccgatctcagacgacgggaatcaagtaggagcgtttcacatcaatcgaatcgaaaatgtccttctccttctctccctcctcctcctcctcctcctcctcctcgagaatcggagaatctctggaaaaaatcgccagaggataagagcgaaggagagagagagagagaaattggagatgagagaagagctctaacttttcttgtggacaagaagagagagagagagagagaaggtaacggccctaaaattcagttggcgcggatgtataacaataacagctcatatttttagtattctcaatttggttcttcagttttctaaaatcacaaattagaccccaatttatatttttttgaaccacaacaccagttcatctaataatttatgttctttagtttctatatattaaattttgcacatgttttctacttcggttcttggtattggcaagaattttagttactttactagatgtaaattcaaatcttaaatatatgaaaatagtgttttaatttgtgaattaaattatggtaatttcgtggttaaagatagttaaagcgtatctaggaaattagaatttgtttttcttctataatttcaacttgtcgtaacgctcttaaatatgagatatatttggcgcatcatatatctttctattgttaaaaaaacatgacaacaagaaaatctatgtatcatgaagcaaaaggaaactaatatctacaaagttttattaggggagaaaggagagatttcaaaagattagggggaagcaaacaaatatacgaaataagcgttttccctctgcctgtaatttttttgtttacaattaacaacttacctgtaatttttttttgactagattatttttatttgattcctaaattttatccgaatttttttcaaggaaaaaccaacggctgtgtccttcaatccaggtaaagaatctcgtatttcttccaggaaaattcaaaagaaaaaagtttcagcaattaaaatgattatcatttagaaagaaaaaaattcttgtgttttctaaaaagattttgttatcgtttgagaaattttatgaagtaacctattgaggaaaaaaaacatcctcataggattgaataagataacgaatgtggaagaattttgaatttatttgcagagtttggagataaata

SEQ ID NO: 2039 - DNA, 3000 bp, Unknown
  misc_feature (1)..( 3000): cDNA_ID_2148690_gDNA_ID_1620480_Annot_ID_158271 3000 nt of promoter + ATG
atagtgcttcgccactattcttggtacaaagagtaatcattaaaggttttgtaacttttcccaccaagttaattaatccactttttggttgttaagcactctttttgcgacttaataatcatatgtttacattattagtcgaaaaataatatagaactaactatactagcaaattagagattgcgtatgtcttaggttttaacaagccatgaatatggaattagattcgtcccggtaagagtgttatcagctgatcaatctccactaaaaccgccgcgtttaacacacacgctctaatgatcacattaatcaccgcatttacatacgccgacactttcatggttttatcaatactttatctcaatttgttgcatttttctcgacttatcgtaatttctttttgttttttacttatcgtaaattgtgttttccattaaatttacgatatgcattttttcggtctatgttactttttttttttcgtaaaaagttaagtcggtctatgttactgatgataagcacttagctaaattacactacatctacatgtcacaatgttcaaattttattcgcatagtttgttagatgatacaacttgctatactctattactatcttgtaatagataatacatattatatatatatatacgtagcgattttattgctgtgtatttttattggtgtataaaatactgcagtctattgaactatatatccccgcactaaataattagttttccgtactgcacgatgctgaaagtcaaatgcatcaaaaccctaatcatgcgaaacatgtattatgtataaacgaataatcactatattttcatattttaaagcattgactcataggtcgtccggtttgggataattgtagctttgctttttgagttggatgcatgtattttgacgatgatattttaaattttattcaggggttaatttcgtttttactagtcacaaggacgttattgatttatcgactatcatattttagtgtacgttgtttaatagaagtatcaacaaacaagttccttaaagaaatatccatttgctccattcttttatctaattaccgtctcagtttttctcatcttgggactatttttcaaactgtcattcgactatgaggtcaaactgtacggtatatgatattttccaatagaattaatcagaaccaaaaaagtttaggcgatatgctctttcctatttataatcaatgaataagtagtgatttgaccattaattaagaaaaaggggtagtgagtgacctagtgtaccataacgctacattaatattttagttttctctagttttgttaattatcacataccactatggcactatctatttttctaaactctataattaactttaatactagtcttcactttcgtgaaagcttgaccgacaaatcaataataaactactcatagactttgacccataaaattaacgcttgttgtgagttgttactaacttagttattattccaacgaactcttcgattaaaattcaatgtcattacagttgatatgcttgccactaaagatggtccagactccagtatcgaaccgaatcaagttagagttcactctgtgcttgggtagttgggctaatttataatcaaatcagactgaacacaaaccgatcaaaccaaaattagtctcaatatatccggttttctgcggttatgacataggtcatgaataaaacaaattttgtcggcaaaaacttggagaatgtgacacgtcatgcggcatgactcgtggattaaagaggcatggccacaaaactcacatggcgcttacttaagttctttcaacatcgaacacagttcactctaatctgtcaactacacgtaaacgtcaccgtttcggtgccatccccgtctttgtagtccgttaataaatttatgacccttgattttgccacttgccccatatgcacgatcttcttctttccatttcctaggttttttttgctcttttcccaagtttgtaacgcttatatttattgaacaactttcctaatttctacgatcactgaccatatgattacactaaaatccggtgattgtatctaaattttaagcaatctttaaaatcaatgattctaatgtgatattatttccttttcccagatattggatagaaatcgtgattgatatgcaaataatactagttagtttctgacacaaactctggtggaaaaaataatctagaataatagtttctgtttctacaaagacacgttgtcaattacactaacttccaagtgttcactcttcaccggctgctgtggtcttcccttgtcggttgccggcacagacggtcaatgccacaggcacgtgtccgtttctttccactccgtaatgtctccaacgccttgagaacaattaaaaaatcaggacctctatcttattaaactttatgtaacgttcccaaagtttcagcatgtgctatttgactccgaaaattttgaaaccgattttttagtccacaaaaattgtagttgaaaacagatttatcttttgttaattccttttattttctactgtgcatcacgtatatttgattaactacaatgaaattcgtttaattaaaatagttgaggggacaaatttaactataatataaaaaaatctagtgtaaatcactaatattacggctaattttcgaaatctaaaatagttaaggggacaaaaccgtaaactttccataaatagtttggtaagaaaaagcaaataaatatagtttcattttttgtaaataaaaaaaaagaaaaagaaacagaatctccccgtttctcgagcactcttaagttctctctctctcacagagttagctttacgccttcaacgagaaccacacaagaacacaactacccaaaacgctcattttctttttccccggagattttagctccgtcgtcgtaacggacccataattcccggcgacggattctaatctcattttcagctaattataaactatg

SEQ ID NO: 2040 - DNA, 68 bp, Unknown
  misc_feature (1)..( 68): cDNA_ID_3065731_gDNA_ID_1620481_Annot_ID_158304 3000 nt of promoter + ATG
gatcaaacaaaccctaattatcatccatcgtcgccttctcaatatatatggccggaagagcagcgatg

SEQ ID NO: 2041 - DNA, 3000 bp, Unknown
  misc_feature (1)..( 3000): cDNA_ID_3065711_gDNA_ID_1620481_Annot_ID_158315 3000 nt of promoter + ATG
agtggtatcatctaccatcctcgcagtttcatcgactggtcaatatattattcaataaacatgcagcttccgtatatgatacttttctgctaaaaagaggaatttgcagttcacagagaggtggtgaggaccactcttaaagatattccgatatgaggaacaaataattggagcatggtcccttgagccctgcctgatgcattacaaaaagtagcatcataataaagtggtaggtgttgttgaactatttatccgatggtgacagaatttatgtagatataataatatcattccttgattatccatctggaaggtacatccatctccacaattgcattcaactattgaagcaatcatgtgttgataatccccttctgtttattttagtagaccaccactaaacatgttatttatattagtgtatcaagagagaagaaaggtatcttcaacacgcaataataaatctgacatttgaaaaaggaaaaacacatccttatcgaaatcactagtcgaagtcgcatttgtcagatactattgttttaacttcaaactctaacttccaagttctataacataagaaaaagaaaacaaaccccaacagctaaaagtataattaaagaagcaacatttgagatctcaacctctgtgttgttgagcatgaagtgattgtttgggctcagcaccacgcaatgtaccaatccaagctggtggctgcatccctgtctgctcataaaccgtatcaagaaccggtggtaacatcttgtagagtccagcaatatcgttcatcgtagctttaccaccaccgttcatcccctgctcagcaccaccatggttccacacgctgatcttaggctgcaggtccctgatcgcaacagcattggtcttggcaatatcctgataaatgccattgttgatcatcaagaagtctctcatggctgagtaatcattgttaactgcgcctaagagggtcttgaggtaagtcccctgagcatcggccattgcgacaagtccctctgcatctttctgttttgaatagaaggcagcatcagctgcagctttcgtcgcttccgcttgcttctgcttctcgtaaagaacagcttctgcttgcttttgcttattgtacaactcccagttcgcttcttgcaccttagtttcatactcaacactggctttactgaggaactcagctttaagcttctctgtccgagtcaatgcattcatcttctctactttagtctgaagctcagcttccctcaaagcaacagccttggctgcttcaacctcagccacacgagagttttgggacaaagcagccttttgaatcgcaagtgctgcatcagccttagcaacaagagcctctttctcattctgaaacactttgacttcagtcttcaccttgatctcctcttttgtcccttctcctagcctttgagtagagatgatctttgactcagcgtcaatcttggctgcattctggattgtgagtccagtcctttctttggcaccaacctctcccttcatctttgcctctgctacatcgatcttggcttggtttgctgcttccatctgagtcttctggcccaagtaagagaagtactcatgtccaggcacatcaacaagctgcttcacattggcgttgtagatcacaagaccaaactggtttagctctagctgaaccttgtcaaacacttccttcttaaactcctttgttcctacaattccacaattcaaacacagttcaaacaattatattaaaacagaactcagaaataaagaagataatcaaaaagggtatgtttggttacctttgaagacctcttccatagtcatggaagcaacaagaacacgagtctctccttcgataacaccctgaacaagctcattgacgtgattcgagtgcttatcgtgttgagacataagcatggcatacaacaagagagcgtgaggatcatcaacgcgaggaccgattgtgaaaacagcaggaataacaaagggaagtttctcggaactcatagcttgaacctcgaacgtgtagttcaccggagaaacgtcgaagacggtgcaagactgccatggaaacacccaagacttctttgcaagcttgatgtctgtgatcccaccaccggtgatcgcaagatactgcgatgctttagcgactctgtaactcattctttcttcgtcttccttgaaattagggttttgttgagatttagggatttttctagtacaagtttgtttgtggagaggatcataagaaaggatttaacttatatacaagtttttaatacgcgtaaataaaaaataaaaaaaaataaaaaaaaaatattctcttgaattaagcttttatattcttttctactttctacgaaatttcattgaaacgcggttatttacaaaattctataactgttttggctaaatttgaatgttaaaagataatataattgataacaaaattatgtggaaatcttgtattttgatacatatctacataatttatttttttatgtaatgataaatacatgcatattttttatagtttagatgttgtttttatgtttatctttaactttatttatttgtaagctataatatatggtggatacacgtgaaacatccaagaaatttcgggcatgtatatacaacatagcatgtaaattcaatatggaaatttaatgcttccgaaaaaatattatagctatatttttaggttttttttattttaactactgaatttacctaaagaaaaaaaactactatatttacacatttatagctaattttatacgtttgtcgttgatttagaaatttaaatacatctggatttttttttttttttttgtctctatcataaacgaagaatacattagctaatttaatgaataaacagtaatgactaattaaaatataaataatttataaaaaatcgaattaaaatatttaataaacactataacaaattacataaatatcaagtgttttcacctatttaaccaatta

SEQ ID NO: 2042 - DNA, 3000 bp, Unknown
  misc_feature (1)..( 3000): cDNA_ID_2148847_gDNA_ID_1620481_Annot_ID_158325 3000 nt of promoter + ATG
tttgttatccagctatgctttggaattgttgcggtttcgggaagctggagtggaagttgtagtaaaggtacttgcaaggcttatctctactatatatatgatcttatcacatagctttatattcatattcaatcaaattaactattgtaggacctgagaaagagatgggacaggcaatcacaagcattctacaatctatttagacaagcggatagagttgaaaagctagctgtagtcattgaacgacttgtaagaaactaacactctcacccaccacaaactcccattctacatgaatttctttctaatgagtttactttcatcctcaggagcaaggtgatttgaagcttagggtccgagcgctagagtctgagagggcatttcaacgcgttgcagctgttcaaaaaacagtaggaagtgtaagtagagctttccattctcatgtcttttttacatcaaaatctcttcaagtcgttctttgaaagcatttcatgttttctgttttatgtgttaaagttggtttcttttcctctttttgttaaacccattgtgtttctctacaggctgttgctgcaggaagtttagtcaatctcgcaacaattttgtatctgaattctataaaagtaagttggtactcttgttctttttttttcacctataaacctctttgtctgctcaaattcaccaacgttcttgtttctttgtgttctcagacacctgcaactatagcatatacagtatgtgctttcttcagcctccaagttctaatcggaatcataaaggttaagaagttcgatcaacgggaaaaactaatcactggaacagcttaagaacttgcttggtatgtcatgatttatcacctcttgatgtttacaagttacattatcagactcaaattctcacactcattttttggcttaatttgtacagaagaaatgtattaaagcttcttcaatctccataaacccttttgtgcatttcacaggagtgttaacaatttcactggtctgcaaataaaattatcttatggaagcttgagaggcaagagatggtcaactagtcaaaccaccaccactctctcatctctgtcttcttaaagttcgataataatttttggagaggagactctggttgttcatcaacagagtggtcatgagccacatgtattgcttgtgtatagagagatttagaaattaggaactttttcgtataaatatactcattgtactcagctactcactagactcatctctgttttagtaatattttgaatactgtatctcaaataaattaatcttatcaaatagaaaccatagttgaaaagtcatgaatgattcttaactgtacaaaataataagctttggtaaaaccctaaactttcgtttccaagatgcaatttctagcttctctcgtttccaattccagaaagtttggtcggagatgggatcgagctctctcgttgcatcatttctcttcgaatgcgacaccagcttcgatatcaaatccagcgttcgtcgagtttctcagggacaatgggttccagaaacctctagcaattgccatcgcaatgcgttaccctaacctcaaatccctagaacaacctcggtcagtgattcaaatgcttaaaagttacagtttttccgatacccagatccagaaatcgatccgggtccatcctcgaatgatgttctacaacgtggagaaaattctagaacccaaacttcgattctttaaagatattggatttactggctctggtcttggtaagttcgtctctcaaaactcatcagtcgttggtgtaagtctagtgaagaaattgattcctaccgttgagattctgaaatcgattgttgccccaaaacatgaagaccttcctgtcattcttagtagatgtggttggcttcttctcagtagagaccctaacttgtttctcttaccaaacatctcataccttgaaacctgtggaattgttgggtctcagcttgcttctttacttagaagacagccaagaatcttcaatctctctgaggaaaaactcagaggatatgtctctcgtgctttggatcttggttttactttgaactcgaggatgcttgtgcacgctgttatctcgttaagttctttgagcgagaaaacgtttgatcgaaaggttaagttgtttatggctaatggattctctgaagatgagataacagatattatacgaagatctccaggtttgatccggtgctcagaagataagcttacactggggtttgagttttacttgaagagaatggggttagagagggaagctttggcgaaacgtccttgtgtgttgtcgtataatcttgagaagagggtgattcctaggcttaaagttttgcagatcttgagggaaaaagggttgttgttaaaagaggagaagaagaagaagaacatggttggcattgttgagatgactgaggaagcttttctagagaaatatgttgtgagatttggagatgagattgctgaggaactgctggttgcttacaagtgcgtgtgtttagtcgatgaaacgctacttgatcgtatcaagatctaattgtagatttcacaagtccaaacttgaaattttgtcattgtatccaaacttcgctcatccgtaactgtgttgaacattataatttggaagtaactcttaaatcaccctttattacgagcttgaagcttctcatataataatgggattcatatgaagcgattctttttctatttcagcacttgagcaaaaactcaagattgtcaaagcgtcttaaaaatttgactcatgaatttaaccggtttgattttggttcgttgtaataaccggtttaaaccagagattgattccggataaaaaagcttaggtttttccgcgaagccgacactgtaaggtagggctaaaaccttagaatagccggagagaagaaggcgagaagaggagcgacaagggcgaagctgcagaattcttcggtaattttcagattcggttgaata

SEQ ID NO: 2043 - DNA, 3000 bp, Unknown
  misc_feature (1)..( 3000): cDNA_ID_1020642_gDNA_ID_1620481_Annot_ID_158329 3000 nt of promoter + ATG
gccaggaggaaaagacataaactgttcacaatcatcactaagcgctttcatctccgaagcaaaccagacagaacctataagggatttaattaaacattagaaaagtaattgattacaaaagatagcataagcttagccttattgaagtgaattgcttaggaaaacgttagatcacataccatcaagaccccatccaatgtaaagtggagtgataccaatagcgtcccttgcagcaataaaacttttgtcgcgagtatcaagaaggacaaacgcgaacattccatccaacatgtcgataaattcctctccatgttcttcgtactgcaagacataagattcaacaacagagatatgctcagttacttcttcactaattggccaaattcagatctatgcaaaaaaaaaaagtccaaaagatggaaatccagaaacaaaaaatcagtcttttcccaataacggatacttacaagatgtgcaatcacttcacagtcactaccagtacggaactgatgagacttaagcttttcacgcaaaatcttgtggttgtatatctctccatttacctgacatcataagcaaatttaatttacccttcagatgaccagcaaggaacaaaggccaacactttgacacatttatttacacatgatactaattgacattgtttgaaagacaagagaaagtacagtgacagcgacggtcttgtcttcgttatagagaggttggtctcctgaagtagggtcaatgatggctaaacgctcatgggcaagataacaatcttcataacaatggagtccactccaatcaggacctctgtgcctcaatctacacaaaaaaaagtaaccaatctaaacatcaattcgggtctatctatgattcatcaattgagtaaacgcacacatttcctctaaaaaagttgaaacctttattccaaattataaacgattcttcagtaacattgggcaggcttcatgattgattcaatggaaacagaagagtacctgcgagagagttcgatgatacgagaacgtttagcttgagagttgtcgatgcaaccaagaacagcgagaatcccacacattgtgttagagtggcaacgaaaacaaataacaatggcttcactcagaaactgattattagaatttatagggtggctttcaatcacggccgttgattttgactatttatgatttttaaccctaatctttttagtgtttgtttgttactcatttttgtgattgggagagattcatatcatcattgtcacgaggtccatttgtttttttgtcaattactttggattggaacttaataacgttttggcctttcgcgttacgaaatcacggattgaacgaatgcaactatggctcattattcatctttatggcttgatcagttttgaaatcgcattattatctcgtatgattggtttgaaggcttttagtggatgctatattccaattccattgttgctttgaagaaaggaacaatcaagttatatatgatttgctatgttctgacattgtaacctccttacattctgcttttcatttccactaatcacatggtttcatatcaacatgttacatgttatgtcttcttaagaagtggatgtgattgagaaaacataacttgtagattttcttatgattttttttttttttttcaacttataactttatttagaacttaagagtaatcgttgtttacatatggactcagaaaataaggacaagaatgaaacagagaccattgggtattctctttgatggcttgtttggctaagaaatccgcacatccgttctgttctcgatgtttgaaagagaattctatcgattcaaaacttggtatccaactttggatggtatcgagaaagtgttgtagccttggattagatgactttgtgtttatcattcgggtgatggtttggttatctccctcaaaaataaccttcttatgcccgaagccataggaagcttgtatagcccaaataagtgttgaacactctgcctcctccgtcgtcatacgaccttgaaatttccccataccacactcgatcacagtaccttgagagttccgaaggatccaaccaagtcctgaaactgtgtttctttcatggtgcgatgcatcatagttgcattttaatttgtctcttcccggcggcgaccacttggtattacgagacggatctgcattcctgttcccattttgctgctcgtttgtcattgtattgtccaaccattccttggtgtcattgagagccatctccactgtagtttggaattttgttcgcgtgtggttaaagactaggtcgtttccgctcttccatattctccacattaaccaaaagggcataaatcttgtaactcgatccacccttgaatcattatgcatttgaaagatgatacgcaacttctcttccggtggtattccattgtcacataattgggaagtttgaaagcctgcagctctccatatcatttcaacccgaggacatgagaagattgtatggtcatttgtttccagctccgtgcaacatcgcgaacaatacgggtccacgtttatgttccgacgtcgtagattttcggcaataccaatagcccgggatgcatatcgccagagaaaatgttttaactttggtgttatgattttttaatgtctactagattgtagtaactatcaatacttcataatatttttacatttataattacaaaatttggtggggattttttttttttttttgtaatctagatttgacaaatttaatatggataaattcttgcaaaatttcccaaaaagtgtttacttagcaaggattattgtttttacacttgtcaaacaaatacgacggcgttttgtagttcatctcttgagaaaacgacgtccaatgtagaaaaagtgaaaaagcgttcttcaaagcacaaaccaattctcgaccaaaagatcagaacaaagcgaaggcggattttctggattctcgacggccggagattcatg

SEQ ID NO: 2044 - DNA, 3000 bp, Unknown
  misc_feature (1)..( 3000): cDNA_ID_3065692_gDNA_ID_1620481_Annot_ID_158332 3000 nt of promoter + ATG
taaagctggcagagaagttgctgactatcttggaacacgccaccacgagtttcagtttacagttcaggtataaaatttccttgatatagtcatacagatccattatcattcatggttttcaaaatagacgacttaacatcttcctctaatgataattccaggacgggatagacgcgatagaggaagtcatttaccatattgagacttatgacgttactacaataagagctagcaccccaatgtttcttatgtccagaaaaattaaatctttaggtgtaaagatggttctttctggggaaggttctgatgaaatactggggggatacttgtacttccataaggctcccaacaagaaagaatttcatgaagaaacatgccgaaaggtatttccttgtcaacttactttgctgatctgcttttgtcccctcactgaatcttgtttatgcttttctttacatacagatcaaagctctccaccaatttgattgtttgagagctaacaaatcaacttctgcgtggggtgtcgaagctcgtgtgcctttcctagataaagaatttttaaatgttgcaatgagcatcgatccagagtggaagttgatcaagcctgatctcggaaggatcgagaagtgggtgctacgcaatgcctttgatgatgaagaacgaccttatctaccaaaggtttgtttacaaataactaaagctgtttttgtgcctctctgcagtttttttcgataaactctgtaatttcactaataatgttctaacaaaatttctcatcttctggtgaattcagcacattctatatagacagaaagaacagtttagtgatggagttgggtatagctggatagatggtctgaaagatcatgcaaataaacatgtaagaaatgtcttttattaaggcaatttcccgataaatgttggaagttttttgacataaacttccatttttcttggtaaaggtctctgatactatgctgtcaaacgcaagctttgtcttcccggataacacacctctgacaaaagaagcgtactactacagaaccatcttcgagaagttcttcccgaaggtaataaaatgccataaattttcaaaatctcacataaacgtctctgctttgctgatttgttttgttgtatttcctgagcagagtgctgctagagcgactgtaccaggaggtccaagtatagcttgcagtaccgcgaaagctgtagaatgggatgcaacttggtcaaagaatcttgatccgtcaggccgtgcggctcttggagttcatgttgcagcttatgaagaggataaagcagctgctgctgctaaggctggatcggatttagtagatcctcttcctaagaatggaacataagagaacaacactacaggcattgaggatataagcaaatgttttattcttctacacagagagatcgttatcttctagagggatcaatgaataaaagcttcgtccatttctagctggagattccatggatctccagttagtgcaagtgatacacgttgtctacatttgtacctaagtttctgcattttttgtcgttcttttgtgttagacaagtcttggaccctagatgatacttcagtttcttagacgttaaatttgatgaatccgaacttgtttgatttcaaagcctggcctttctgcaatgtgtttttgtgcatgttctggcttgtttgttgttactcaacgcaggatttgttataatatgtacaatatatctagtacacacataagtcaagcaagtaagactccgtggcccaatggataaggcgctggtctacgaaaccagagattctgggttcgatccccagcggagtcgctcttcatctactatttttatttttcttacgcgcattgcttataaaagttttttaatgaacgtgggataaaagttttcagattcgtatttattatttcaaaaagacagatgacctaacctcattactcgtgtatggacttttttttccttcaaattatattttatgaaatttgagtagacgaagtaactgctccccttcagatttagctaaagagccaaccacgtgaagtcgtgaatcctctctgtcgttttcgtattaacaaacataagaaattaagaaatgaaaatctcgttttcttatgtataattgttttatatcgatcaccggtttctctaggtctaggtatagctgttccaatatcatgatttttaagtttagttttcaacatcattaagtaaaagtgtgaactcattatcatcatcgctttccctttagaatttttgcaaacacacgaaaataaataaattgtttggacatattattgagaaacatagtcaaatgagcccgttcacattctgaatcatataagttacagtcccaaacccacgttttattaaaaatgtactactagtcaataatttatgttgagtcatatttatttattttgacacagttggttttcgcagtttcttgtttattagtttcaaattgcacttattagttttaaaaacaatttaatttgatatttggtataatatctcttttgaattatttacaaactttattacagcctggttttgaaaaaaaaaaaatactttgcataattgctactttgctaggattactttataaactttttcagctttgattcatttaacattaaacccaattaaaatattttattcattttagcataaaaggggaaaaaaaagaaatatatatatatatatatatatatatttcctcttttcaattaaatcagctgttaaaagtggaaaaaatcaaagagatatcaaaatattgattagaagaatatgtccatattcaattattttatattatctttattaaatgctttaccttacaacaataacttaaataaatttttgggattcccgttacattacttaagtaggacgacgtgcgtctgcttcgtctcattacaaagcagaagaaacacaaacagaggcagagatcttaagagttaaagactaatcccaaca

SEQ ID NO: 2045 - DNA, 3000 bp, Unknown
  misc_feature (1)..( 3000): cDNA_ID_1557675_gDNA_ID_1620481_Annot_ID_158334 3000 nt of promoter + ATG
ttatgacataaaacaaacttattacattattctgtaaatttgtccaatgaatacaaaatttattattcaagtttcattctacatatttttattatacaatttatgtcgttatgcaattatacaatattatcaataataaccactaaatacaaatgctaatttgcaatgtatctcatttgaggagaatatactaaaagcaagtctaccagaacgaacatcattacacctatcttgtgaagttgtgataacatccttcttaagaactagttgtatggcaaactactacatatatggttcatgtgaaagaaccgataggtgaattactatcatcatatatattcatatacattaggtggtatttacttactatatgtgtattcgagtaacagtttttaataaaaaaatatcactctttaatactattttaaaatgatcaagctttctgttttaaaaactctttatcaaaattccagatacacatacttaaaacacccgaaaatatatgttgaaaacacagaactaagagcatccacttacttctttatttgatgtgtcgaagactagaaaattcttcttaaaaacatctcctccagagatactcaaaacgatcctaaccgtttttatgtgacgcatgttcatctactcagtactctccaacgttttttccaaaccaatttggaggaccttgcacataatagctttgatcaaagtcttttgctcccaactaattgcctctctaatggtgaaacctaaaattatgcacatatacattataaaaatttcgataattcaaaaaaaaatgcgttactcgaaaggtataatgatccgaattacaaaaccgtcgagtatttgtgttcggtcaaaaaaaaaaaggtttttgattaggtaaattgataagtagcttgctaccgtcttgcagagttgttaacctttcaattaatctcaccattagttgaccgagttgactcagcctcggccgcgactcgttctcaaaactcagttaggttccgcagtctcgatgtctgttccctaaaagaatcaatcagcctgcctacgaaccaaaccgaattaaactggatagcttcttctttctgacggcgtaaactttcggctctcccaaaacgacagcattagagaatcgtctcagttgggttttagggttaggcatcatctgagataggcccaacattacatatctaacaaggcccatataactgaataaacaatacacttgcaagtttgctttcaagtttcttgtcttagtgaagtgaatatgatcagtacttaagtgtcttttgtgaagattttcatgattaagccattcgatcacaacacgtggatattgtcctgtcaaatccatatgcattttttttactgcttttgataaaaatgttaaacgagtcaaaaatttacaatgtctggaaaatgtatgtacaacataagtgggtttctcttgaaaagttaaaatgatagaaagtgaaaaactaaagtgcagccacttgtctaggctttttctttcaagttggtaggaaacatcaattacttatttgattttttttttcaattaataatatgaataaaaggaatctattggtacaggaccaaacacttgctttgcttttcctttttttttcgtcatctttgtttaagggcccaaagattcatcgaaatataattggtttgggtcctttgatgcgttccattgttgatacctttgtccttttgtgctctcacaaaattagtttttctaaactttattgcttagctcatgtaccattcactgattcttcaatactttatcccactattttttttttcttttgatgtaacaaaagagttttacatttgtggggctgtgtggatttttgataatttaactttagaattgtactcaattatgtgcatcagatcaaagtaataaattttggtatctttggagtttctaactctttgacttataatatttcactaaaaacaaaaataaaaaggtgagaggcaatgaggaaatagtgagacaagacagtgcagctaaaaataagaaagaggctatgtgtccaaaagtttttggacagtttggtgacgcattcatccatttatacatgtccgcactaacttttgtcatgttcctaatgcttatgatatatcacaattttgttttatgaattgttttcttcttctatataagggatatatagtccgattcaatctaattcaaacttgagtttaaacccgtttagcttgactaatccagttcacaatgatctagatttatacacaaccggatcagactttacaatgacaatttttttcaaaagtggtaaatatcgatccacatgtttttggtccattataagatatttattatatatgtgataaaactttcgctatatagaagtgtttctgatttcgtttacccgtaagagatttttatatataaaggactgtctgactatcactagtatgagtacatctaatgataagactactaaaccgaaaactattcgtctagacaaaatttgtctttttttttgggtatataggtaacatttgaaaatttgaattcactggttgattacaaaaatacttgcaaactgtatccatcatatccaggataataacataatttcgggtaattcttctaatagattgaagcaataaatactttaaactataattttgggcattgattgaataaggggcaaaaatgggggtatgaaagtcgaactttgttacgcaatctcggattaaatgattgtcttaactcttaatctatttacagggttacaccaatatgattaccttatatataaaaaagaaaaagaattataattactaactaaagaagattataaaaataaaacaatattatctctataattagattctcccattctttttctttaaataactttgttcttcttctcttcttcctcccctttactacacacttcttcttttttcttcagaaagaaagaaagacagagagagagagagaagatg

SEQ ID NO: 2046 - DNA, 3000 bp, Unknown
  misc_feature (1)..( 3000): cDNA_ID_2990967_gDNA_ID_1620481_Annot_ID_158331 3000 nt of promoter + ATG
gttaccttagtattatgaaagtaaagaatgctgtgaaaaagattttcgtctgattcagaattgaaaatgtcaaggaatcaagactcctgtatgagatctgcagcaaactgttctgcagtgcatatatggctgcaggaagtcctgatgctgtcaaggatcccatcaacgtccactcttttgctaatcccttcaaactaccatttcttgccatgagaatcagagcacatatgacctataaaaaagaacatacagcagaagcatgaaacagtatttcataaatgcaaaattttcgaaagtagaaaggaaaaaaaaagatccagtaccttaacaatctcgcacgtcaaaacagatgaagttacaataacatcctttctgcaaaaacaataatgcggtaaagtgaccaaaccatgatagagacaatctattaactgtttaagaagaaacaaacaaatggactagtgaacacaagtctactagttctaaatatccatggcattttgccgcaaaattaggcaaagtgactcgatatcgagtactagataacgcgaaaggttacacggtaccctacaaaaccaagatgaacaactaaaacactatgatgaaaagctatattcaaggcatcaatgtagcaaactagtagattcaaattcatctctctaacactttagaaaatggcttagtttaacagtgaccatgtctttttccacaggaacaacgagaatacatcacaatcgtcgcatataacttcgaaattgtaagtttacaacactattctcaaccacaattcgcagaaagccaacaaaacagatgcccagaaatcgaactccatctctactcgctacataagactaattacaaccaaatctcgcaattcccgataaaagcgcacgaaatcagcgaatatgaacaaggctatcactaacatcagagatttaagaggcataggttgttgcaagagaccgtacctgatgcagcgtttggagatcagaggctgggctccgtactgaagtgtgagcaatatggaataaaacaaaaccttagggcccatactcgacggactctttgctccgttagccgtcgccatgaatctccggccgtcgagaatccagaaaatccgccttcgctttgttctgatcttttggtcgagaattggtttgtgctttgaagaacgctttttcactttttctacattggacgtcgttttctcaagagatgaactacaaaacgccgtcgtatttgtttgacaagtgtaaaaacaataatccttgctaagtaaacactttttgggaaattttgcaagaatttatccatattaaatttgtcaaatctagattacaaaaaaaaaaaaaaaatccccaccaaattttgtaattataaatgtaaaaatattatgaagtattgatagttactacaatctagtagacattaaaaaatcataacaccaaagttaaaacattttctctggcgatatgcatcccgggctattggtattgccgaaaatctacgacgtcggaacataaacgtggacccgtattgttcgcgatgttgcacggagctggaaacaaatgaccatacaatcttctcatgtcctcgggttgaaatgatatggagagctgcaggctttcaaacttcccaattatgtgacaatggaataccaccggaagagaagttgcgtatcatctttcaaatgcataatgattcaagggtggatcgagttacaagatttatgcccttttggttaatgtggagaatatggaagagcggaaacgacctagtctttaaccacacgcgaacaaaattccaaactacagtggagatggctctcaatgacaccaaggaatggttggacaatacaatgacaaacgagcagcaaaatgggaacaggaatgcagatccgtctcgtaataccaagtggtcgccgccgggaagagacaaattaaaatgcaactatgatgcatcgcaccatgaaagaaacacagtttcaggacttggttggatccttcggaactctcaaggtactgtgatcgagtgtggtatggggaaatttcaaggtcgtatgacgacggaggaggcagagtgttcaacacttatttgggctatacaagcttcctatggcttcgggcataagaaggttatttttgagggagataaccaaaccatcacccgaatgataaacacaaagtcatctaatccaaggctacaacactttctcgataccatccaaagttggataccaagttttgaatcgatagaattctctttcaaacatcgagaacagaacggatgtgcggatttcttagccaaacaagccatcaaagagaatacccaatggtctctgtttcattcttgtccttattttctgagtccatatgtaaacaacgattactcttaagttctaaataaagttataagttgaaaaaaaaaaaaaaaatcataagaaaatctacaagttatgttttctcaatcacatccacttcttaagaagacataacatgtaacatgttgatatgaaaccatgtgattagtggaaatgaaaagcagaatgtaaggaggttacaatgtcagaacatagcaaatcatatataacttgattgttcctttcttcaaagcaacaatggaattggaatatagcatccactaaaagccttcaaaccaatcatacgagataataatgcgatttcaaaactgatcaagccataaagatgaataatgagccatagttgcattcgttcaatccgtgatttcgtaacgcgaaaggccaaaacgttattaagttccaatccaaagtaattgacaaaaaaacaaatggacctcgtgacaatgatgatatgaatctctcccaatcacaaaaatgagtaacaaacaaacactaaaaagattagggttaaaaatcataaatagtcaaaatcaacggccgtgattgaaagccaccctataaattctaataatcagtttctgagtgaagccattgttatttgttttcgttgccactctaacaca

SEQ ID NO: 2047 - DNA, 3000 bp, Unknown
  misc_feature (1)..( 3000): cDNA_ID_3065696_gDNA_ID_1620481_Annot_ID_158328 3000 nt of promoter + ATG
tttgtttccagctccgtgcaacatcgcgaacaatacgggtccacgtttatgttccgacgtcgtagattttcggcaataccaatagcccgggatgcatatcgccagagaaaatgttttaactttggtgttatgattttttaatgtctactagattgtagtaactatcaatacttcataatatttttacatttataattacaaaatttggtggggattttttttttttttttgtaatctagatttgacaaatttaatatggataaattcttgcaaaatttcccaaaaagtgtttacttagcaaggattattgtttttacacttgtcaaacaaatacgacggcgttttgtagttcatctcttgagaaaacgacgtccaatgtagaaaaagtgaaaaagcgttcttcaaagcacaaaccaattctcgaccaaaagatcagaacaaagcgaaggcggattttctggattctcgacggccggagattcatggcgacggctaacggagcaaagagtccgtcgagtatgggccctaaggttttgttttattccatattgctcacacttcagtacggagcccagcctctgatctccaaacgctgcatcaggtacggtctcttgcaacaacctatgcctcttaaatctctgatgttagtgatagccttgttcatattcgctgatttcgtgcgcttttatcgggaattgcgagatttggttgtaattagtcttatgtagcgagtagagatggagttcgatttctgggcatctgttttgttggctttctgcgaattgtggttgagaatagtgttgtaaacttacaatttcgaagttatatgcgacgattgtgatgtattctcgttgttcctgtggaaaaagacatggtcactgttaaactaagccattttctaaagtgttagagagatgaatttgaatctactagtttgctacattgatgccttgaatatagcttttcatcatagtgttttagttgttcatcttggttttgtagggtaccgtgtaacctttcgcgttatctagtactcgatatcgagtcactttgcctaattttgcggcaaaatgccatggatatttagaactagtagacttgtgttcactagtccatttgtttgtttcttcttaaacagttaatagattgtctctatcatggtttggtcactttaccgcattattgtttttgcagaaaggatgttattgtaacttcatctgttttgacgtgcgagattgttaaggtactggatctttttttttcctttctactttcgaaaattttgcatttatgaaatactgtttcatgcttctgctgtatgttcttttttataggtcatatgtgctctgattctcatggcaagaaatggtagtttgaagggattagcaaaagagtggacgttgatgggatccttgacagcatcaggacttcctgcagccatatatgcactgcagaacagtttgctgcagatctcatacaggagtcttgattccttgacattttcaattctgaatcagacgaaaatctttttcacagcattctttactttcataatactaaggtaacctttatttttcttgttcttatggtcttgtttttgataggatgcttgaaattttgagtttgttggatttgtattttcctcagcgagtgcctacatcacatttttgaattagagatttgtagtgtgattgcctgaataactttatttgggctgcttctctgctccaacgtgatacctaccatgtcttaatagtgtgattgcctgaatatctattgcttgaaaagtgtttaacacatcatctcgaatgacatcttgtaggcagaagcaatcaattctacaaataggagccttgtgtctattgatcatggcagcagtccttctaagtgttggtgaaggctctaacaaagattcaagcggcattaatgcggatcaaaagctgttttatggaattatcccggtcttggcagcctctgtcctgtcgggtttagcctcttctctgtgtcaatgggcttctcaggtcatccagagtttacatatcatattccaataaaaaatctgtacttcaattcattcgtagcctaaactgtcttaccgtttacaggtcaagaagcattcatcatacttaatgacggttgaaatgtctatcgttggaagcctctgtttattagtaagtactcttaaatctccagatggtgaagcgattaaaaaatatggcttctttcatggttggactgctttaacactggtaataaactatctcttttttttatccacaaaacaattcttttgatagcaaaacagtgaattctgattgtttgtatgcactgtgactgttgttataggtcccagtaataagcaatgctcttggtgggattcttgttggcctagttacatcacatgccggtggtgtaagaaaggtaaaacaaaaaaaaaccctcccagactgatattacacaatcaaaagctgaaatatgtaatgtcgttatatcactttgcagggatttgtgattgtgtcggcattacttgtgacggcgctacttcaatttgcgtttgaaggaaaaccgccatcatcgtattgcctagttgctcttcctcttgtgatgagtagtatctcaatgtaccagaaatacccatacattgacaagaagaagaagaaggtgtaagaaaaaggttccattcagagaatagctgctagttacaacaatgagatatcttaatgccattattattaactaagtagatgatagtgtgattcttggagcattcaaaagactttgtagtatatttacattcaaagatggaatgagtccaattgagtttaagtaaggcctatattaggcccatagcatacgcaaatcaacccattgattacactattaacaaaaaaaaacacatgatgtatacagttttgaatagaattatataattggcggtacgaatataaacgcgattcaatagccaaaagggagaagaaaagagaaagagaggcgaggatg

SEQ ID NO: 2048 - DNA, 3000 bp, Unknown
  misc_feature (1)..( 3000): cDNA_ID_2148840_gDNA_ID_1620481_Annot_ID_158323 3000 nt of promoter + ATG
atttgcaacgaattgcaaaaggcaaaacacttcccaaactattagccagagtttgccatcaccgcccaatgtgtccacacacaatttacccgatacaccgcaaaatataccgaggaaaagaacgatgaaacttatcggcattgtctgcttcgtacctgatgatcgtttgtttagaaagtaagtgaagacaatgatcattaacacaccgaaaaatatctgcacccaaactcgaacccggcagatgaaggtgttgaagcctgagttaatcgatgaaacttgtttaggaacccaccacgacgaacttttctcctcggattggtcgcatactgaggtagcatcctcgattctctttattgaaaaattgtaaacgccaagtaccatagaagccaacatgctgaagacacttacgaggagccaatccatgattcttgtgaccatctcttcttttcttgtatcttctaattcggttttgaatttctccgctctgaatgcagctttcgaaacatccaactctagcgccgctttccccaggttgtttgattcaaattttaatcctagcgccgtctctttgcaccttaactctcttatttgaagaccaatctccacggtctttaggtcgtttgctcgtgtttgctcttttaaaaacctttcgtctgtggtcaaagccattgctgaacttctaggagggacacaagagagttgtagagtctcttcgaaaagggcaagctcattcatcaaagaggttgctgttgcactgccttgcatcacttcataagcagacgtagcagatgaagtctccctctcaaatagctcggtgtctgagcatccgtctatggtagagcgatctaaattacaactcccaccatcattattgtttgactgatgtggatttgcacattcattggtcaatttaaggatctttagagtactgctgaatgtttgctcaaagttggtcgcaaaggaaccaagcttattaccataaacctgtaaccacaacattatgaatcagaaagtctataaatataaaaatgcggaaaacatagagggggattttagcttacattggctaatgattcttcgacaagagtagcaaagatctggagagcataatcaatgaagttcttgtatcactaccaaaacgatggcaaaagaaagattgaacagaaactgagaagaaatcatttgaagttcatactacttacctcaacaagatcatcaacataaacattctgacctgcggcattctttctcgcaataacctagagaacaataaaacagagtagaaacagagtaagaactacagagcatatgcaagtcaatgactttggcggctaggtaggatgaaatttggtgaaatcacaatcagaactacaaatccgagtagaaactagaaaggctcaagctttaaggcaagtgagagagaagacaatataaatttgcaatgttacattgaagctcgatcatagagacccccaagaagaacttcagcttctattgattgactctgattataatttgaggagaagatcctctcttcgattcagggtgaagaattcacgcaagtactgagagaagaaaattcagattcaatccttttgactctgattcagatcctctcctctgtccagttttgaatcaacaaagcctaaattgaaagactttgtatttaatactatctaaagatcaaaactttcaacacaaccaaaacctagtattcacgcaaggtcaactataggaacaacccgtaccagcaaagccaatttcgtatcaaaacagttatgtgatgcaataaagatcaaagtttggaaattgatcgaaccatattagcaaaagcggcaagtgaaaagcccagaggcttcgccaatttttcagcttgtcgttcaccaacgcttcgtcgagccatacctaaccgcatagggtttcgtaatctatgaaccactctcgtaacccttttagtagaatttgaattagaggtagaagatgtagaacaataggacgaagaagcttcgtcgttgtccataatctctttcttctttcccttgagttttctcttttccaaattcgatggattcgtatccttcttcttcttcatcatcatcgtctcatctttatgtacgtcaccagattgatgatttggctttgaattcgccggattggtgatttgattttggggttccggcgaaggagggaggaggagggcttccatagccttaaaatataacttatggggtaaatttgcaactttgagaaaagtatttaagttgtaagactttggtcgcttcgtgactagtgaaaagtttcgaatttccaactttttcctctgatttaatttgtatttttaaaaattcgtcataattagcttaatataggaaaaatacttgaccaaatatctgaattaacttgtaagttcaacgaattcttcaaattatacaatgtatatgttaatgtcaattaaataggtaataatatgtttactcgatttttagcgataatttgatgtttctaggtgctttctgttcaatgaataggatcggttcagtacttaattgaactaaaagtcatacatatagcttaggaccagattaacataccaagtagtcgagtttaggaccgaaccaatcagtttggtttgaagatggaccataaaagtgtttggaaaaaggaacaataaaaaaaatcgcacaatgtttgtggctccgataaataacacgatgaggtgtcttaacacaaccaatcaaaacacaagaacatctccttcactaatctcatcttatgccacgtgtccttttcatatccaccccttttattttatcataatttttttttttaacattctctgtggttcgtcatgaacctcaaaaaacctctcactgcaaagtgccaacaaacaacaagtcttcaccttcttcttcttcttcttcttcaaaatctcttgtacgcaaataatccatgagaaactagggtttaacttgagatctctcttccgaagtattaccatca

SEQ ID NO: 2049 - DNA, 3000 bp, Unknown
  misc_feature (1)..( 3000): cDNA_ID_2148805_gDNA_ID_1620481_Annot_ID_158313 3000 nt of promoter + ATG
gttgtatatacatgcccgaaatttcttggatgtttcacgtgtatccaccatatattatagcttacaaataaataaagttaaagataaacataaaaacaacatctaaactataaaaaatatgcatgtatttatcattacataaaaaaataaattatgtagatatgtatcaaaatacaagatttccacataattttgttatcaattatattatcttttaacattcaaatttagccaaaacagttatagaattttgtaaataaccgcgtttcaatgaaatttcgtagaaagtagaaaagaatataaaagcttaattcaagagaatattttttttttatttttttttattttttatttacgcgtattaaaaacttgtatataagttaaatcctttcttatgatcctctccacaaacaaacttgtactagaaaaatccctaaatctcaacaaaaccctaatttcaaggaagacgaagaaagaatgagttacagagtcgctaaagcatcgcagtatcttgcgatcaccggtggtgggatcacagacatcaagcttgcaaagaagtcttgggtgtttccatggcagtcttgcaccgtcttcgacgtttctccggtgaactacacgttcgaggttcaagctatgagttccgagaaacttccctttgttattcctgctgttttcacaatcggtcctcgcgttgatgatcctcacgctctcttgttgtatgccatgcttatgtctcaacacgataagcactcgaatcacgtcaatgagcttgttcagggtgttatcgaaggagagactcgtgttcttgttgcttccatgactatggaagaggtcttcaaaggtaaccaaacataccctttttgattatcttctttatttctgagttctgttttaatataattgtttgaactgtgtttgaattgtggaattgtaggaacaaaggagtttaagaaggaagtgtttgacaaggttcagctagagctaaaccagtttggtcttgtgatctacaacgccaatgtgaagcagcttgttgatgtgcctggacatgagtacttctcttacttgggccagaagactcagatggaagcagcaaaccaagccaagatcgatgtagcagaggcaaagatgaagggagaggttggtgccaaagaaaggactggactcacaatccagaatgcagccaagattgacgctgagtcaaagatcatctctactcaaaggctaggagaagggacaaaagaggagatcaaggtgaagactgaagtcaaagtgtttcagaatgagaaagaggctcttgttgctaaggctgatgcagcacttgcgattcaaaaggctgctttgtcccaaaactctcgtgtggctgaggttgaagcagccaaggctgttgctttgagggaagctgagcttcagactaaagtagagaagatgaatgcattgactcggacagagaagcttaaagctgagttcctcagtaaagccagtgttgagtatgaaactaaggtgcaagaagcgaactgggagttgtacaataagcaaaagcaagcagaagctgttctttacgagaagcagaagcaagcggaagcgacgaaagctgcagctgatgctgccttctattcaaaacagaaagatgcagagggacttgtcgcaatggccgatgctcaggggacttacctcaagaccctcttaggcgcagttaacaatgattactcagccatgagagacttcttgatgatcaacaatggcatttatcaggatattgccaagaccaatgctgttgcgatcagggacctgcagcctaagatcagcgtgtggaaccatggtggtgctgagcaggggatgaacggtggtggtaaagctacgatgaacgatattgctggactctacaagatgttaccaccggttcttgatacggtttatgagcagacagggatgcagccaccagcttggattggtacattgcgtggtgctgagcccaaacaatcacttcatgctcaacaacacagaggttgagatctcaaatgttgcttctttaattatacttttagctgttggggtttgttttctttttcttatgttatagaacttggaagttagagtttgaagttaaaacaatagtatctgacaaatgcgacttcgactagtgatttcgataaggatgtgtttttcctttttcaaatgtcagatttattattgcgtgttgaagatacctttcttctctcttgatacactaatataaataacatgtttagtggtggtctactaaaataaacagaaggggattatcaacacatgattgcttcaatagttgaatgcaattgtggagatggatgtaccttccagatggataatcaaggaatgatattattatatctacataaattctgtcaccatcggataaatagttcaacaacacctaccactttattatgatgctactttttgtaatgcatcaggcagggctcaagggaccatgctccaattatttgttcctcatatcggaatatctttaagagtggtcctcaccacctctctgtgaactgcaaattcctctttttagcagaaaagtatcatatacggaagctgcatgtttattgaataatatattgaccagtcgatgaaactgcgaggatggtagatgataccactgcatttaaattatatatttataaaaatatattgactatagtaaaacataaaataaatagctgaaacagtttataattatttaatagtccattgaaccaatttattattctggatctcatgggtttttaacttttaagggatataggatccgatctcgacggcctaaaaaaggcccaaaatacggccttgaaaatggcgcccattcacgagagtttccttacaccgcacgtgatgatcacgtgatctcactctcacactctctcaagagcaacaaaatatctcgactgtttttgattttgtcatctggtggattagagtggagtggagctttgaattggatgatcattatccatg

SEQ ID NO: 2050 - DNA, 3000 bp, Unknown
  misc_feature (1)..( 3000): cDNA_ID_3065727_gDNA_ID_1620481_Annot_ID_158305 3000 nt of promoter + ATG
attattaatatgctgttttagtaagggttaaaacttcagttttttaacaattgtctcatggattcgttgtatagcgttacttaataacaattataaactgtaaaatataaatattttataaaaataaaatttgcaagttttaatatatattaactttaaaaaataaattataccgcagtataccgcgggttaaaatctagtttatatatatttcacttaattttgtctatgttcactatacatatgtaaactcaagagtcaagactattcaattatatcatcatttcgcaaacttataataacaaattatataatatagtgataagtgaagttttgcttactatttatcaaagatttcatcttattttcaacaattctttcaatttgtaatgttatcagtaaaaaaattgtagtatataatctgctagttaataatacgaaaatatttgttattattgtacgaaattatcaattatgataattgtgtagtcatatcaatgtaatgaatgctgctgaccattctatttcttctctccttattcccctttgctcctccttacttttactaaaattccctcaactcttacgataagagcagagagaagaagaagaagaagaaagtaatcgtgatttgagagagagattcaaacatacttttttcgatatctatgttaattttatcttcacgatatgcaatgaaacgagatgttttaatcattgtaatctttacagtgttagtattaatcattatctcccgttcaagttcgatccaagctggaagattcatgactacaggaagaaatcgtaatttgagcgttgctcgatcactatactacaagaatcatcacaaggttgtgatcacggagatgtcaaattttaataaagttagacgaagatcgtctagatttcggagaaagacggacggcgacgaggaagaagaagagaaacgatctatccccacaggtccaaatcctttgcacaacaagtagagtactgactactgagaaagatgcaacatacttcgacttcgtaaattgttcgtttggtgtatatatgtatcgttataagttagtttacttttcaagattaatagtctttaattaggttgggttggaaactctaaaatagtatgagataaatttcaattgtttctagcatttaaattttgtatgctcaaagttgctggaacgatatggcaaacagaaataatggaatcgaaaaaatatcgtgatatgttagaataaactgagtaaaagtacgtttttgtgaattttcttttgtcattgtaatttgttttaacaaaatacagtattattcttttttacgtactaataaggtatattgttgtatatataaaggtcagtaacttgtaactcatcttttttttttgtttttttttctgttttagctgataggtggttggtgttcattaataaatgtccatatatcactttcaaagcaattcactaaaatatagatatgtaattattttttattttttcagattttccccttgaaaaaggggttctttcaattagaaccccacactaacacactccttcacttttggccagccgcccttctttttcagtctttcagtttatattttagcctcttttttaaaaaatactatattttattgctttttcttcttcttaattactttagttaatcatagttaaaacacatttttttgtgcaaacgtttaagttttaacactatctgattttaaacttttaatcatttgcatgtaaaatcactcaaataggtaatatttatatgattccagtcatgtgtttcttaaaaacagagccacactacatgtttctgtgtttattctcagttaattagtttttatgtttgttttaacacaatacagagagaatattattgtagttacaaaaacaattaagagtggcaccaagaaatttcgtcttaccttttaagacaagattaaaagaccactttgaaattttgaatcgttgacttaagaatagacttagcaaaaaaacttggtcatacatatatgatatatgtgtgggtcaacgattcatatatgtatgatgatacattgcaatgtgccaaaacttctggaagaacaaaaaacgactaataagaaaaaataaaatatataaaatgttgccaacattaaaaaacgcatttgctgtttcccatcaatattggagtatagtttatataagatttttaacaatattataagctagttaattaatagagttaatctttggtaaaaaaacagacggaattttataactttcgaaatcatattgatctgcatatatatatatatatatatatatatatatatatgtggattcaccagaccagatgagataaccattttgaaggatttgctaaataaaagttaggccaaaaagaaatcaataaagtttgtgacaatatctttaatagtataatttacatttacataattcaataagtcaaatcttattgtgtcttggtgtgcactgtaaagtaaagtcctgtctgcttcaaacgcagcataagcaaacttacaacttaaatcctcagccgttgatccaaagaccaaaatccaattatcaacgttacctaatgtagacgataaaatctcttaaaatgggcccgtaaagcccaagcaaaaaaacaattactttaagtggaagctcacttttcgccacccttattaacgtctgtccatacgtcataacagatgacgtcatcatcatattccttttttcacacgtggcattgaagcaccttcctagtatctaccctgaaattgcttgacataagtagtagttgtttaataatctttatctcttaattatcctcttttcttaacaaaaacttgttacaataattttcatttttatataaataactgaccattataactctttctcttctcttcttcacttgctctagttcttggatgctttaaacctctctctctctctctctcaattatttttttttctatttcaaaaacaaaaaaaa

SEQ ID NO: 2051 - DNA, 3000 bp, Unknown
  misc_feature (1)..( 3000): cDNA_ID_2148790_gDNA_ID_1620481_Annot_ID_158309 3000 nt of promoter + ATG
aacttaaactcaaaatctgaagttgtgaagtttggtggggtatataaaattaatttcatgtgtagtcataaacagcaataagcaaccaacttgaccaaacattgaaggaccacattttacccaattgctagaagaatccatataatgcttacaatattagattctcaaacctaaccaacccaagaaggtccacatcaaatgaacaattcacaaacattatcatcctattcatcaagaaaatatgaatcttacaatggatattcaaagtgttaacatgtaaatgcaatcaaaaacataagtttcaaaagtttggtattggtatgagcatgaacaacgaactagggtaaacaatgtgtgacccaaacaaaatctacccattttgccagaaataaaccatataaggctaaaaagttggatttcatatcctaaccaagtcaaaacacctacctaccggtttcaatgaacgcaggagctaatacaaattcatatacaatggactgacattcaaaacaatgaatctttaagatagagcaacaagaatcttacagaaggagagtgtgggtgatggtgagagaactcattgcggttgttgttgtcactgtgaaccgtagttagcttcttaggcttggcagtatcaacaggaggctgatcatgaaaagggttaatgagttcttcctcgttgccaagactggctcgagaagcatctctcttgttgagtttcctcatctctctgatctttgagaaatccattgagtaatcaattgatcctcctttttgatcccaatctccaaactgtggtactgatagccatggcgagttcttgttctgccaaataaatctccatttcaattacttttattttcaagaaccattagaaagaaaaaaacacaatcctaaaaatcaatcacacaaaaaaagactttttcaccaagattcagagactaatttctcacatcaaaatcgaatattaatgcaagaagttgacatgaacatcccattttatttaatgtatcactttaactttaatattatgtaaggagaaaacacagaagacgaagggattagaccagaaaataaaaaataaaaacctcttttcgatcttccatgtgatcaaagcttctgtagctagcagtgaatcctgttttttttttttataataagttaaagatgatcttaggaggaagatgggtgatacagagcaatttataagcgaaagaaaaagtataccaaaatttaatacagcaaagtaacaggtcgattggtggtgatacaactatactgtacacaacatatcaaaaatatttttgttttattttgtttttttctgcttcgggaaaaggttagcttttgtgcattaattacgatactgccattcgttcggacacgcacacacgcttaatccgcgtcagctttgctctcatttcctgttaaatgacgtcgtttagtatactgtcgattaatggtctaacctttaagttatgatattaaaacataagtttattggtgaagatttgaaggccggcaactgattttattaaatttatagtgatatgtttttccaatagcttaagcaaaatttgtttggagttgattagttcattttcatttatcttttttgttcctagagcggttagtgaacactgaatgaatacacacactgactccactaagaacccaaaaaaaaaaactcacatcattttgtgtattttgttagataaaatcaaacctagccgacgttagtgaatctgtatccacttaaatatcatctacagcaacaaaaaagtccacaataagatataaataagtacgactttgcttcgtcaactgtatgactgctattaacaatcccgaactatttagtcatggaggcgattaacataaattcatgtttaatgatgcgagccgttacatgatatatatacatgttgattcttaattttcatttccaatttcactatttcagtcatatttgagaaaaaagatgtgtgctcgtacgttttaagttccatgaacagccaatttaaaattaacgggtgaataagttgacgcatattcatttaaaattgtaattacgaattcaacttactaaaaccatatacataacgaccaaaaacttaataaaactataaatttaaaaagaaatcaagttgcgtgacgatgtggcgtgaagagatccacagagaaactgacgtggttgatgatatagttagacacgtggcagagtatgagaagtgtctgtttttcaaaggagctatgtgaaccacaaaagaggtaacttcaccggatttgttatctcttcaagacttctaccctctcttctccttcttcctcaccacaaaattagattctttcgtttgttttttgtgtgtgttatatttgtctttatttcatatccatttattgactttgtaagaacattgcattgcatgtggcagagaactcaaagttagtaaaaatgaatactccgatttgtatcacttctttcctttggcattatatcaaaatatggtcttcaaaaactagaattatacaatcgtagaatgcatttacttgtcattcatagaaagttgcaatacaactaccattagtacttacaaacattgcaaccaaatacattttttattgtaaaatagtactccatacatatttcatgctccatacatatttcgatttttcactattttcattccaattttttgtgataactgaagataattttattgggtttttcttttttggtcgtcaataatattaatttattttctaagtattgattttatttattgataattgataatgatatattttcgaatatagagaaaaaaatacaaactaataaaaaaatcaaataaaatctggtggctcacgctcaaaacgatagagagaaactcttatcaaagcttttgatttctctctcgagggtttcttactctgctgcttcttcttcttcttcagtagagcgagattctctcgcgctctctatcgctacatataaccatg

SEQ ID NO: 2052 - DNA, 3000 bp, Unknown
  misc_feature (1)..( 3000): cDNA_ID_2149260_gDNA_ID_1620482_Annot_ID_158358 3000 nt of promoter + ATG
cctatgttgacaccaaaacatgctaaatcccacgaaacgttgacgtttcactgccctcactctctcaatcaagaaaccggttttagtccactttttcacttttgccctactcgctacaattaatactcatctgttgtgaaaactgtcttcacttatcgtcacatttaatactaatattataggtatcaatgtagcttattttcacattgttgttatgtgttactgattataagtttataactcacatcatttcgaattggaagcactttgtaattataatttttaagttagttaaattcaagggaaatgtatagtctacaaacttatgaaattcaaaaacgagaagataacatacgggtccatctcgattattacaaaattggaaatttttcacaactttgtttcatatagtcttgggactttattatgaccttcgatttgttgttctcttttttctctctcgaaagatctgtgaagaatctatgtgacagcacagtgggaacaaaggatgagtaaataaaaaagaaaaaaaaaacgttagaaggaccacagacatatatacatcgacatgtctataatatatgaatatgattggttaacctttgcatggtagtggccaagctgtctcttagtccattgtatgttgataattctgatattgaacgatattcgatgcaaatggttacagattcgattggtaaatgatagcgttgtaactagttatggtaacatcaatacaacttatatgagcacatcgcatgtctttgagaggcaaggtctagtagatacaaacattctagttaataagaaaaagttaaataaaatcgtgcgattattacatttagttggtagttgggtgatccaattaccaaaaagaaatatactgtataaaaaattgttgtttgatactaagttaaacgataattaagaataaacctttttgcatatatccaaatttgaatatcggaaacaaatagcatagtttaattgtttatttgtttaataatgtgtaatgtaccaaagctgagataggctgcctcccaaggcaaggtagcaatacaatcgtgttcatgtcccaagcatcatctatactcgttgctccactaacaacccactttatattaataatcaaattgaatcaatatcaaattatcaaaaaaataatcagtccaattattttcgcacaatctagcaaacaaataaaatattcaccccatagaattttacattgttgtttggttattgaaaataaaaaatcgtcccacgtgagatatcccacaaaggtcccaacatcaccacagagagtctctgatcattacaatatccttaagattagatttatatagacattttcttataatatcttcttgggcaagtgctctgtattcttctgacacatttctatcgtcttcttctttttttatttattcttttgttttctctttgaaatattgaagaaattttgatatttttcccctttcttgtattatcttttcttcaatgcctttttcctccttcctcttctctatctcttttttttttttgttccggataaattctcatgttctccgtgacaggataaagttcatgcattcttctctgttatcattggtgttattgtaatctaattatataatttcataccaaatgcatgtaaactaaaccatgccaatcaaaaatgggatcaaatagtattcgagatagtcaactttgatggcattataaggttaccatataatagtaggacaatttaactgcaaaatcgaaccaattatatgttttaaaaaaaattcctctgcaaaaaagtcaaaatctatatcttagaaggtagaaacgtcctaaaacgaaaacgtagacgtactcatttttatgtaatttgaaaggataaaagtagtagaattcggaaaagaatggggacaagcaaataggtgggatgataaagattttgattttattgaatataatatagtatgcttttaaaatgggtaggtattgttgggaatgcagatcccaattttatctattttggtttttgtatactttttttatatatatatcttattgatctttctattctttttgggttttgttgattttcggtattttggtgcattctttgactactcgcatctagtctcttgtgctatgttaaatgtactcatttataatttcccggtgcacctcacacgacatatgaaaaacaaaaccataatataagataatgttttcatttcgatgatatggatatcagaatatttcctcctttcgtttatagatttgtaatttgtaaagtatcacgtacaataccactaatatgcatccatatacgatcatatcagtatatatatatatatataatatgtatacattgttttggttcttggtaaacagacaaatatcaatgattcaacagatctagttgttagaattttaatcaacggatatatcatcagaaaagaaaaattatgttcaaactaacgtcttttgttaatttagtcctataggtttacataattatatatgtttagttatacattttgataaatgttgtaccatttttatttaaattatgatcaaattgttaatttgaaaatataatttttaaaatggtataattcacatggccttattgtgggaaaagaaaaagttgggttgaaagatcactattcaatgggcacataacctatattgtcagcccacaaataggcccactatattataggttaccgttggggatttttttttttgttagagatgaaaactctcagaaattttaaaattttccaaaacattaaacccacgtgaaaaattcatattccaaaaccaaatgtgtagatcactgttgcaaaaaaaaaacaaatctcgttttccacaactccaagtatattccaaatctacaatacggtccattctaacattataaatagagttatacgtacataaataattgcattcgtacaatattctagtactatactaacacaaaatcgaatcaacatg

SEQ ID NO: 2053 - DNA, 3000 bp, Unknown
  misc_feature (1)..( 3000): cDNA_ID_2149290_gDNA_ID_1620482_Annot_ID_158373 3000 nt of promoter + ATG
cagggacattactatcaacaggttctaaaacatcactaaccgaaacggatttagctgaagcgtggatgaatttgacacctgagccatcacaatcgacgtaaaacgacgccgttccagcatcttcgttctcgaccttgacaagacgaccagcgaatgggtagaagatcttcaaagcgacagagagagatgatttcaactgagagattatatgggtttccgggtcgggttgaggaaagagaagacctctttgtgggtattcggatcgaagaaagaagagatcccatggagtgagatggatcttaacccgatccgattcctcgttgtagctctctggtcgaacaatgctcttagagatcactactacttcatctgccattttcttttctcgagtagatagatgctgataaaattcactagtccactactagtggagtgtataatttctttatctttatattttctgtttttggaatcaaattcagacatgacataccaaactagtgaactacaacgtgtttcatgttatttatttggttatatagttaagcccattaattgtccctagcccctaggcccattatcaacctatcgtcgaagtttgatggaattttttacagagctcgacggaatgttgcaaccccagcggcgagtgtttccgattccgttcaggtacgttactatatatataagaatctctaaattcgttgaattatccgaatctgtttgttcatggtgatgttgtgaaccgaacacgaaagaattgcataggcttattattgtattaatttgaaaaacgagagagaattggtgtttggcttagttaaattcacattgctaaaccaaatcatctcatacaatgcttacatattcgttaaattcagcatctttgactaatttttccactacctgaggcagtaaacaagcctgaaaatcaagacttgcttctccaattcctttgaaaacaacgagtcttccattgagatacggtggtccagctcttgcagctatcggtttaccccaaccgaaatcattacagtacacatcgaaccggtgagagtttgtgacaactaaatctttgctaccaacagaaaccggaatcttgatatttttcacccaattctctgcaaatgctttggctttttcatcagtttgtgacagctccatgttgttgatttgcattgcagcccagcctagtccatggtccagcagctctccaaccgtgaccgtagctatcccggtttggcttacattcccaaaacactcttcttctagtggcggatttagccgttgcctcatgtttataggtaacctgcaatgagtctcttcctctcggctcatgccactgtgtttaaccattgaacgccatatatatgctaacaccgcttgaatagaagagatcttttgatcagcctcgtcgttggctttagcgtcaagtttcaaaacattctcttttgtaacatgaaacatcttctcttgtagattggttggtgttgttacataactagttggttttgtttcagggtctggaatatggattggataatcaatctcgtcaaagaaccaacctttaaggtgaagacgacgttggaaagtttgggatcctgaagaatctttcgagcaaatctctgaccatgcattgatgaacttccagattgaagtggcatcagccacggtagagttgtaaccaaaaccgatgaaaaccccgtccttcatctctgtcacttgaaccataagtagagatcttgagacaccgtggtagttcttgatccccgttgcagggaaaaaggaagcgaaaaacccggggacagaaccggataactcaaggacatcactgagctcgatgtttttagccactgcgtgaacaaactccacacctgaaccatcgcagctgatgaaaaacgagacagtatcgtcgtcgttctttagcttcacaagacgaccagctaaaggatagaaacgatcaagtgcaacagagagtgaagcttgtaattgtttgacttcaattttgtgaaagagaagacctctttgaagataaccaaaacgaaggcgagagagatcccatggagtcagctgaatcttcttcacagaagtcggtttcttaaggcttctgggattaactatgctcttcgagattaccaccaattcttcttccatcgttttacctttttcttaatcagtgaggttttgggttacgtgaggttttcaaatgagtacatatattgaaagcactaattaaaaaaagaccaagatccaagaaacaagttacatcacactttaataatgtttgtgactctgtgtggcctgagttgtttttcattatttgctttgtcattttgtgaaatttccacgtgtataacaacaaactttaagaatatgttaggaaagtgaataaagaatctctatgattggtcgtatttagcatgacttaatcttttttttttgttaaagtatgactatatcattaacaaaaaagaagaaaaaatgactttatctttcgttgatgtagacgtacgagtaataatgtatgtcaataaatttaacaattataaagcagtctttatttagtgtagaatacgaacagagcgatacatggatcattatcaaagtttaaagttaaactggtgttaccgacttaccgttaccatatatctcaatacatggatatatatttcttataatataaatagataagtgtgtgaaattattttcttaaaaagataaataatcataactacagtattataaatacacaaattaagaaatatgtaacgtgtttaatccttggtttgatcagaacttttaattatccgatgtgtataaattttgaagaagggcctatagttttgtttcttgatgggccaaatcaggcccaataatgtcgtacatggttgttcttcatgtaccggagattcggcggcgacgaaaccgtcctcattgcgccgccgcaactacccgacaaacaactagctttcgtattacttccttgtatctgatttgata

SEQ ID NO: 2054 - DNA, 3000 bp, Unknown
  misc_feature (1)..( 3000): cDNA_ID_2149310_gDNA_ID_1620482_Annot_ID_158379 3000 nt of promoter + ATG
tttcaggacctgaaactatctaaagaaaatcgatataataagcatctgttgtctttttctttcaggagaaaggtggtttggcacaaaaaatggttgcgtttaagctgagttcaggatcaggagcttgtttatacgttcgtaaaatggttcaagatgaatctgaggagaccaaagaggcaaatgcaaaccattgtgaggatgatcatttaaaagaaatggaagaactgaaggaaaaactcaaagctatggagttcgcaatcagctgcgaaggtcattcaaaagaaattgaagaactgaagcagaagctcaatgccaaggaacatcagatacaggctcaggataagattatagccaacctcaaaatgaaactggagaagaaacagtcaaagtctcggtcatgatttaacagaaatcaaccatggctcaagttagggagttcactgcacctgtttttgttgtctgaaatttttgctgttttaaggttaagagaagtcaggagactatgttgtcttccaagttttgttttagagctaagtatcgatttgaagaacttaaaacatctcatatgatttttgtactgtatacaatgaagctaatgcacacaaaacaattttccgatatttacggtgaaaaagaatatgaaatgaaactcgatctatctatagaagcttcttcagctagttgctgacactttgacaccatcgaaagctttaggttcttgtttctccttatagctcttgctcttcgacactcttggcttagagttgctttttgcctctttgatcgccgccgctgggagctctgaggaagagtctggccagggtgtccgctttgatggcactgtgatttctaaaggtgactttatgatccagctgcgttcatacaatacaagttagaagactgcaactcagcaagtgataatgtgatgagaaatttgctttccatcagagagaatgattaaagaaaactaacccaggtgggaatttgctatcagctcgagcttcaactcgaagccaccaaagcaagacacgacggccacagcttccaagtggctccaccatggaaggatccttcaccaaagacaaaggactctcaatttccgcataaccatcatccaacaagctgagatctttaacccatgctggtttatcatctaaagattccttccagagcaatctagaattcaacacaaaccctgaccattccatcttactaggcatcacaggcgctttctcatcgatatacactgcagtcttcttggcataaggctgtgtgttgaaaatgtgccaacccactaatttctcagaggaattacaactaggaccttggattggcattgaaggtttctctttgttcttcccttgttcattcttcaagatcgatgataattcatctgcattaccagaatgagcaagtataccaacagatagagcaccaaaccatttcacagtttgaatctcatcaaaaagctccatactatgcatattgctatcatcagcaaacataacaatcccatctaacttcttctctctcacaactctgatgagcaaacatcaacacaagaacaataaatttcaagtcaaataagaatcaatcaatcaaaacagcaaaacaaaatgtgaatcaaagatttaacctcaaggcgtgaagtctcattttggtctccaatttgtgacgatcttcccatgtattaggcattttctgatcgaatcctaagtgaatcgtctttaatcctgattttgcgataaacgaagcagtctcgttagtgattccaccagcttccacaacgatccaaaccaaatcgtacggaacaagcataagcgagtgcataactccggtcaaatgaagcgcctgaaaagtccgtacataagtcggcgtcaccacaatcacagtcctagggctcctcacaccgtacatcgatttctgctctttctgtactctcacaagcaactgatgagctctcaatacctcaatcggattcgggtgaggccatggacggatccggatcccgtgtcttccaaccaccactcgagagttcttcttcaccgtgctgttagtcgctgtttccagaggttttagccggagaagctggcttacaccgccgtttccggcaaagagaaatggcgttgtgtatagattggtgacggaagtcgagaaaaggaagaagagtactaaatggctgaatcggaaccctagaatcaagctgatcaagcagcagagaccatgaatcacgaaccaaaacacagacgacggagatttgccatcgaatgatggatccaacgacggcgatgatctgaaactacttcctcgacggttccaatagctcaatcgaaacacagagagcttcatcgtcttcttcttcttccttcttctcaacagtgagcgaacgaaaccataaaagagggaaaaaaatgtctgttaagataaattaattacttaacaattacggtttaataaataatttaatatggttaccacccttctgctggtacaacggacatattggaaatcgaaaagaaatagcgttaggagttacacgtggcgagatattagtgagaggttgaggcgtttattatgtcgtgaatttggactggagtgatgattaaggaggagatttgggtaaagcacgtgtataatagagtaagacgtgacattaactaatgattggtgcttatttacgtcagcagtcaacgcaagaataatagtcgtacgatttgggttaccatcttctctttatttctaagcaaaggctttaataagcaagcacacaactttatacaaatgcatataaagcccatcctttaacttaaatacattaagcccactaaagcccaaaaactgtcaaggaaaattacaaaactttgaagcgactcacttcgacccctaatttatggcggcggcgatgatttcgtcttccgtcgtcagctcatgaaactaaatctctcgaatctcagatttctacgtacccgaaaatcgttaatctcccagacgcgagcaatg

SEQ ID NO: 2055 - DNA, 3000 bp, Unknown
  misc_feature (1)..( 3000): cDNA_ID_2149314_gDNA_ID_1620482_Annot_ID_158380 3000 nt of promoter + ATG
tcgatgttcagtacacgaccaaagctcgtgaggcgcgtgagcttgtgtcggcggttaaagaagcggcgaggaacgagtgtcgtccagtgcagaatcttctcttttcagattgtaaattaggactcaatgatttgccgaatcatgtatacgatgttgattgggatgtgatcttagttgatggaccacgtggcgacggtggagatgtaccggggaggatgtcgtcgattttcacggcggcggttcttgctcggagtaaaaaaggcgggaatccgaagacgcatgtgtttgttcatgattattacagagatgttgagagactttgtggggatgagtttctttgccgggagaatcttgtggaatctaatgatctgcttgcgcactacgtgttggagaagatggataaaaacagcacgcagttctgtcgtggtcgtaagaagaaacgctctgtttcttctccatcggcttgagttaaatgtgcgctaaaatcttgtggactgtggagagtcaaaccaaccgacacgacggtggtcattgacaccgtcaatcgcggaaggagtttgtgtaaaataatacgtttttctacctttaaatattttttcctgctttttaaactatgtgaaaattcaatcagatcaattaaaatttcaaaatatctcttcgaggtacaacaattcgtttaaaataccactatagtatttggatactgatgatttggtgttacaacataaatgataaaacccaatgaatcaagaacgtatagtttcaactctctaaaccctttgtggagagtcttgtggagtcagagtatctatcttctttttcttgtagagtggaactcttcctccaagctctcttagctgatccacaagtccgtatagaaactcaaacgtcaatatgttttgagcattaagttgctctctaacttgtggatgaattctaaaccattctcccaacatcttatgaacgtgagatcgaatcatcctccatggaaccggatgcttctcacacagctttaaatactcaacaactaaatctccctggtctaaccctccatcgacgaatccctcttcttcgttatcttttgcccattcagctgttctaaacccagcaaaggccgccgggttttcaagaagcgtctccgcagagagaacaccttcaacacccgtctctttgatgcagttatcgacatcttcgatgcatcttacattcccattcgctaagacagggattctcatagcgtttttcacttccttgattgcgctccaatcagctctaaatttcttcccgtctttctcatctcttgttcgcccgtgaacagctaggagcgagcaaccagcatcttctagcatcttggcgtacttgagtgtatcttccaggttcgggaagatccggattttacaggagacaggaacattgaggttctgagctaacttttcaacaagtgatttcaccaaaggaagattatccatcaagaatgcaccataatttcctcgcctcgctatacgctgaggacacctgaaaccaaaatcccccaaacattcttactcaatcaccaaattacaagcggtcactgtgctcattcggtacccaaatcactaaatccaaactatgatttaatatgaatattatagcccatgtgtcaaactactaaagctcattgaactctatcgttcccagaaacttggaactcaaatcattgcattctatcttagttatcagagttcacgaacttaaaacagtgaagtcataaaggttcgatcttaattgaagaaccctaacatacaagatgtgaaaagagggaaatgtacttaccctaaattgatatcaacatagtcgcagtaaggttcgactctctttgcagcttccaataacgtatcaggatcattagcacagaactgcacaaacaatggcctgtcctcctacaatttcaaaatctaatcaaaaccttaaattcaaaactgataaatctctgagaaacgccaaaatcaaatgaaatcttaccttacaggtggtgaactcctgatttctatacttctcagtctcggtgaagatcctagaatgcaacatcggagtataagcagcctgagctccgtatttctggcagagcaatctaaacggaagctcagagttatcaaccattggagcaacgatatacttgggtctacccagttttttccagtgtgcccaagctctctctactctagtatcaatgcttaagacccgacttggagagcccaagctcgccggcgctgtgtcgactgtttcctcaatctgcccatcacgctgctccgaacagaggatatcgtctagaacctgcgatggatcaggttttggatccggattttgagtcattgctcgcgtctgggagattaacgattttcgggtacgtagaaatctgagattcgagagatttagtttcatgagctgacgacggaagacgaaatcatcgccgccgccataaattaggggtcgaagtgagtcgcttcaaagttttgtaattttccttgacagtttttgggctttagtgggcttaatgtatttaagttaaaggatgggctttatatgcatttgtataaagttgtgtgcttgcttattaaagcctttgcttagaaataaagagaagatggtaacccaaatcgtacgactattattcttgcgttgactgctgacgtaaataagcaccaatcattagttaatgtcacgtcttactctattatacacgtgctttacccaaatctcctccttaatcatcactccagtccaaattcacgacataataaacgcctcaacctctcactaatatctcgccacgtgtaactcctaacgctatttcttttcgatttccaatatgtccgttgtaccagcagaagggtggtaaccatattaaattatttattaaaccgtaattgttaagtaattaatttatcttaacagacatttttttccctcttttatggtttcgttcgctcactgttgagaagaaggaagaagaagaagacg

SEQ ID NO: 2056 - DNA, 3000 bp, Unknown
  misc_feature (1)..( 3000): cDNA_ID_3065750_gDNA_ID_1620482_Annot_ID_158381 3000 nt of promoter + ATG
agttaaaaattattaattattttcttaaagttctaagtttaaaaccttttagtgaaaattattattatttaaaaaaatgagtttaagtgtcaaatcttatattacgagaaaacattgcctaactccgaacaccgcaaaacttacagaacaattaaggatgggaagcctaggcgcgattagtttccaacgtttttaaattttaacatttgaactaattttaaaagtaataatgaaattaacatggttttagttaaaactaaataattattttcttaaagtttttagtgaaaatcattattatttttttaaatgagtttaagtgtcaaatctatattacgtgaaaacattgccaaacttcgaacaccgcaagacttacggaccaattaaggacgggatgcctaggcgcggttagtttccgacgtttttaaattttaacacttgaactaatttttaaaagtaataatgaaattaacatggtcttagttcaaaattattaattatgtacttaaagtttaagttttatttttttttgtgatttttattttattttttaaaatgagtttaagtgtcaaatctatattacgtgaaaatattgccaaacttcaaatactgtaagacttacaaaccaaataaaggacgggatgcccagacgcggttagtttccgacgtttttaaatttaaacacttgaactaatttttaaaagtaataatgaaattaacatggtcttagttcaaaattattaattatgtagttaaagtttaagttttaatttttttttgtgattttttattttattttttaaaatgagtttaagtgtcaaaactatattacgtgaaaatatttccaaactttaaatactgtaagacttacaaaccaaataaaggatgagatgcatattaaactaatttttaatagtaatagtgaaattaagatgattttagttaaaaattattaactattttctttaagttgaagttttaattatttttttagtgaaaatcattattatttcttcaaaatgagtttaagtgtcaaatcaatattacgtgaaaacattgccgaacttcgaacaccgcatgacttacggaccaattaaggacgggatgcctaggcacggttaatttccgacgttttaaaaatttaacacttaaactaatttttaataaataataatgaaattaacatggttttatatagtaagttttatttctctaaatgtattagtgaaagatttaaactatttaattatagttttactaaaaagattttttaaaaaaagaatgaataaagaaatacctggttggatttggtagcaaagaaagggcccatataaaaaagcccaccagcgtgagcccaccttgcgtcgttgttggaaactcgtctgaaattctccgtcttcttcattcgtaatctgagaagcttctttgtctttgatgattggtttcttcctccagcatcgtcgtcaatggaaacgagaatcctttgatctctcctctcagtcgtctctctctgtcgccatctccgccgtcgggctatggtcgtcgtcaatggaaacgagaattcgaagcccaccgtgtcgtactctgagaagtttcttttcgtctttgatcaaaagttgatcgtctctcatctctttgtctctcgtagttggattctttgattgggggttttctttctcgtagatggattctttgattgggatttcttcctcatgttagaagaagaagaagaagaagaagaagaagaagaagaagaagaagaagagcgtgatatatatttataagcaaacaaggttctcttgggttatttccttttttcttaaacagagtatctttgcttcactaaatgatgatttgatattaatctacccgttgggatttttcactatttctaataataagagatctaaattagatccgatttccatttactaatttcaatctaaccaataaggaaatttcgattggttgtttccttttttcgatgactttggtttgttttccattcgttgatataacgtttacaaagactcatcttttttttgctcacaaaatttaatatcaaaagataaggagaacttggtgaatgatgaccaattaataaggtggagatttttcaactccattactagttttattctaattggtttgtatacaaaacagatatgttgtggtggttacttcaagcaatcttggtttgtggagcagaagccagattctacaggacacttcgttgatatcatcaggctaccaatgctggcaaaagtgtttttggtaaaactgataatgcagtgcaaggattggcattgcttcttcttatatgagagattctgtgagcgtgtgtggcatttgatgtatcatgttgttaagagtgtttttgtttggttatgttcttttgttggtctatatgtaaatcacaaaaagaaacagatacatagttacaacttgtacaagtaagcaacagaaacaacaattaatgaggaggtcatcgaatgcatcgataccttgaacacataaatttttaggaacatatgatgagatctcagccaaaaggggtttcaatacactctaaaatatcatacattacaaattttacttaatattgaaccaacaaaataaacatttcagaattgagaaaaaatagtaaagacatagattttgttctagatgaatcagagataaatacactaggagtggtctcaaagacttcttcaatgtgttaaacggaccaatgaggaggcttatattagcaataaaccttcaaaccaaaaacattagtaaaattaaaaatctgaaattttatcaaacaaagtaagattaaataggaggacaaaacagtaattaaaacataagcttcccgaactaaaattattaaacaagaaataaaaaagaataaaaccctaaatttcgattgtccgtcttccccaactctcctttctccaactcgccgcctctttcaactcacagaaccaccgtccgtcaaaaaaactcttggtaatg

SEQ ID NO: 2057 - DNA, 3000 bp, Unknown
  misc_feature (1)..( 3000): cDNA_ID_1011058_gDNA_ID_1620482_Annot_ID_158374 3000 nt of promoter + ATG
attggtcgaatatataaaaaaacagtttatttatagaaagtttctcgaataagaatataaatatatcggctttagtgcacccatcagtttcttgaattccaattcgagacaaaaaaagttttttacaactactagctccgaatcatagcttctagtcagatgacgatgcccggagtcgtattttatttatttcagcgattaaggagattattaaaatatttatggttgaaaattatttgaaacgaaatttgttaaatcttataatcttgctcggagaattatgcaagtatactgtatacatatatacacaactatcaactacagtgatataaaaaagacattatgatgattcgaacagtggctgtgttagtacttgtaaatttgaaagaggtagatacgtagcatgtttttattcacgtgagtcacgtgagttgtggagagatcaagcttccgtgatcttaatgaaaagtggagcccataatttcaactgtctagattcaccgacagtacgaggatgattttatcgaccgtccgatgtttccaagctgtcatcgtatttttatttttttttacaaaacatcagtaataataataagattttctagtttgagatgattgtgccgacacacttttggtgttatgtgtctctcaatattttaaagtttgtacgcattcctaattatattcactagtcaaaagtttcatacagcccacgtttatcatgtacttaattttaaacagtctttaaaccagattagtttaattcatttaaatagtaattacgttgtttagtcagaaactggattatagatcatgataaggttgaataagatgtggacaagcacaaacctatttgaaaacgtcgttattcacattattacgcgtgttacttttgttaaaatgtgagtctttcgaagtttgaaattggattttgataatatatgtgaagaagtataaaatatatgaattctaaaaccaataatccatcataaatactgaacatacacatatatcctagatttgatttctatagattcgctattgaataaaaatatatggtacatgcatgctaatcactgattaatactttggtaacaatatatcttcttgtggcatcttcaaattggttggattccatgataggggaaaaaagctatctacaatcaaaaagaaaaacgccatccgatatgatttgttagcgagacaaatgtggggctaagattgccattatgggaaatgtggggctaagattgccattatgggagtcgatatatgcgtagagagaaagagggagagggagtttttgtaattactacttagggaaagaaacagagagcatcaaagcatcgtcatagttccattaggggaaggtttggctttttcctcccccacttgtaatattattctttcacgctttggatctccttttacccacacctattctttgctttagtaactactaaacacgtatttagaaatatgcgttttgaaattttttaaatacaaaaaattctgtgtgtcaatatagacaattttattcgttctttttttttttgggtcagcagacgctactaattaaacttgaacttgtctcaagagaaacatgcaagtataagtacgattctgaaaagaaaatgatccactacaaaaaaaataagtataactatatcagtatcaagattctgttaacatcattataaaaaaagtaaagtaaaacaatagttgcatacttgcatgatgaatgattaaccagagttatgattatctttttataaacgataaccaactgttgcaataatttttcattgctgatttcaaataaaacattactttaacgatatgggggaatttttaagaaacagtagagacgttaataaaaatcccatatgcgagaaatctcaaaaaggttatatgtcgaatacattttcaaattcatctattttttttctttctaattttcttaattttttaaataaaatgtcgatgtatatgaacataataaaaaatggagagacaggatgattattctttctgagttgatgtaaataccttaagtaaatgtgaaaacaatgattaaaaatcaaaatgtgaagggagagtgagtacacgcgcgtataacaagagagtgaaggtgtaatcaaagcaatggaaagagagaaaaagctgtttcccgtactcttggataggggcattttaggtattacttcgttttttttcttttcccatcacattatttccgtttccttttcttctcctacgaaactcttttacacggatttgttcatcctgttttttgtttttgtttttacacatttgtaattttctatattcaacaaatatacagggaattacatttttaaaaaagtttcgctccactaaacaaacataaaattttgtttgtagataacaacatgattatgttgttgatgttgaaaataatcatatgctgctgaattgatgtcccaatttgttttcggagaagaaagaaagatataaattatagtcctaaaatgataaattgtgagtagttggagtaggagaaattaaataggacaataaataaaaaataaagatactcccatctacatcctacattttagtccataataatttcagcaaacttttgaatttctgaatttacttgccctttttatataaaagaaaaatgtgatgtcaatactcaggagaccaaaaactaggagacagtctaatacacttgtattgggaaagaatcaattttcaaaatgaatttcttcataaatatttttttttcctttgactcctttcattgataaaaaaaaatcctgcacctctctaatgatgaatacttgaatagagtcagatatttattctattaaataatttagttatttatttagaacctacctttatttgctttgatggttattctcatctgagttttcttcttctctcttatttctctcccaagtttcttattttttttcctctttactttacacaaaggaacaacaaataatg

SEQ ID NO: 2058 - DNA, 3000 bp, Unknown
  misc_feature (1)..( 3000): cDNA_ID_2149274_gDNA_ID_1620482_Annot_ID_158364 3000 nt of promoter + ATG
tcgattatctttctccatgaatgtgaataaagatcgtatattcagacataatcacacggaataagagaataagtttaaccaaagaagaaaaaaaacaaatcttttgcaaagtaaagatcaagactcttggacaaggctcgtggccaccacagaacagctcacttcaaactcagcttcatcttcatcaacccaactcaccaatccataaaccacgttctcttgtaaccctcttggactctccaatctcacagtgtagcttagcttctcgtttttctcgctgaacattagtttctttggctctacgacgacgtttagacccttcaagcctctcactctcacgatgtagcttctctttgcttctcccacgtttgtcaatgtcctcttaaagatcttgggactgctttgatcagacgtgaagtaggcaatgattgaagggtaattgagatatggagatggctttttacaagcgtcggagatattcgatctcgtgatgatattgatcaattttcttgattgttttgcctcgtgacaaaggaagtttatgaaatcttgtggagttgtatcatagattaggccagggtttaagactttgttcgtactcacatgccctgctccaacggctaatgggttgtctaaagtcaaagccgttgtcataattgcagattttatagccgatggactccaatttggatggacttgctttataagcgcagcgactccagctacatgaggtgcagccattgatgtcccggttaagagattgaatccgctgaataacggtagtgctcgagttccggtgatttgctcaaccgacggccaagcagagagtataagtgtcccaggagctagaatgtctggtttcaggatttgagggaagcttgtgaatggaccccttgagctgtatgtgccaacttctggcgctggttttgtcccgattaccgttttacgaaactccagctttgcggtcgcgttgtttttgttgcttgatgcgtagctttcaatagtttctcggtgttttgagccgatgaatgctactggaaactggaattttattgtgtcttgctcctcaagtaacttatctgttattaaaactactgctgcagctccggtggatctgatttgatgaagtttgctaccgatgtttatgttttcgttacagacaacaattctgtttgcgagagtcttgttttcaacgctgccagattcgatgtaagttactggaaactgaaccgaagggaactctccaggaaacagagatggaaaactgaaactaactctgtttccaaacgttagggttccttgaaattgcctaccaattgttcccgctccaaccgtcataatccacggcgctccgttaatcaaactccagtaatatggcccgtcgttaccgccggaagtaaccacgaaaacgcctttttgaatcgctgcaaaagatgcgactgcgattggatcattttctagaccgaaaccatcattgtcgtcatcatcctcaaaactcaatcctagcgacagagatatcacatggactccatctcgaatcgcttgatcaatcgctgcgattacatctgatgagtaaatcccttcttcccacgcggctttgtagattgctagatgcgcgtgtggtgcgattcctgaggcggttccttgggcgtaagagaagtaagacgcgttcttaacatgattcccagctgcaatggctgcaacatgagtgccgtgtccgattgtatcgtacggtgaagagtattggccaatcttggtttctctcaaatcagggttgttggcgaacaaacccttgttgaataccttagcaccgattagtttcttgttgcacaaggaagaagaattgaattcacatgctcctttccatttagacggaaccgaaccaaccccatcgtcgtgaaagctgggactatcgggccaaattccggtatctataataccgattactataccagctccataattcgagaccggccatgtaccggatgtcgaatttaaaccgataaactttggagagaaagtggtatgaagcttaaccggtaaatctttggtgaacgagacatacccgggtttgtgtttaagacgttggagctcagagttggtgagaaccgcgctaaacccgtgaaccgaatcggtataagcgtagataatctttggttttctattggttataactgaagtaagagttgtggaaaaccagctccgatgatcggaaaatggcaacggtttagcggataagtccatgtggatgatgtaaggagaggtctccgccgttacaatcgctacgaaaaatgagaacaccagaataattacgacggtcatccccatgtctgagcaagtttttttctctggtctcttcaaagtgaaatgaattttggtgttagtaagaaacaattatagtgttgttgttaatagatgtttagtttttattatgacaaaaaagttgcagagaatgtaacctttacttggcttttgcttttgttaaagtggttttaggtggtcggcaacacatcatctctcatcattgtttttttttcttttctctttcaattgggctttatcatagagaacaatgattttggatatgaacttattagtagtttcagcaatagtttagactttcgaatcggtaaatatcagtaacttagaactcaggctgaaactttgattcttttactgtatttagctagattctacacttggtggactccatcagcaattacttcacagaccgaggtagctcctacaactctctgatgcttgatctcgttcaaatagatgtctcataattgcttcttttttgtttttgtttttgggctttattaaagaggagtaaggcccattaagagaacccgtttgtttgttggattcggatttggcaaatggatagcgccaaaatcgtgtcgattttcccgccatctccatttcttaatctgggttcttaaacctaaatcagttactcagcttcaccaaaccaccaaattgaccggatttgtaaaa

SEQ ID NO: 2059 - DNA, 3000 bp, Unknown
  misc_feature (1)..( 3000): cDNA_ID_3065785_gDNA_ID_1620483_Annot_ID_158394 3000 nt of promoter + ATG
ctgagcaaccagagagatcaagaactttgagaaattctaaattagccatgtttggcagacttcgcaaacaagatccatgtgcattcaagatttctagactttgaggaagttgtggcacttctcttattgcagtgccaccaagatataactgtttcagaaaacgagggaaaccctgaatagaattaagacttgagcaacccgagagatcaagaacattaagatctaaattagccatgtttggcagactctgcaaacaagagcaatctttcagctccaagcaaataagcttcccaagatcttgacaagatgagttagattccagcagacttgttaaacgctcaagttcctctgaaagacccggaatttctgttagaaaattcacaagctctctatggtttggcttaacagtggaaactggtaatgctaatatgccagttccctgtagatgtagtttctcaatatttggtggaatttctaggacacttttaatctttatgcaacctgagagatttacaactcgtagacgtagcaatcgacctgcggctgggaaattctgcagtctcgtacaaccttggagatcaattacctcaagattttcagcttttaagagatcatcgatatcaactagatggtgggaatggcaaagcctgatcgtcctcaacatctccaggttctgagaagacaaaaaaaaagcaagctaaatgaataacaacaaaatttgtcaagtaatgataagggtgaacgacgcatatcagagattgcttaccttggttccaccccaaagtttctgaagttgactatacggcatgttgatttcgacaaggtgccttggatcaaaattctgaggcaaagatttcagaggatagttctcccaatggaggagtcttagctcattaggaagagaatgcagagagcctgttgggaaattgattacaggatggacttcaggattggaacaataaattttgagcaatctaaggttcaacatattcttaaaggcagagggctgcagatcaaatcttaagtttgatgtgtctagaaacaggccttcgatctcttcagagccctgaaaatattggaagtggatatattaggccgttggctcataaagtagaaaaaatatgaaactatcaaaatataacaaacctgagcacgtttgaaggttgttttaggttctccatttgctttgtgttcattatattctaataaatatttgatgctccaaggttcccacagtcttctgcgcctctcgatctgtactgtttctccatttatgatttctcggccgatatcctgggtcagcttatgcaaccaaactcggttttctgaaatagttaccagacacttgtcaacaaggacatcaatttcaacatgtggaaagaaaccacaaccctcaagcagttgtatcacgtagttgacattttctccctggaagaaacaagctatgtccaaaaaaatgttcttttcgttgtcactgagtgtgtcataggtgcttttaaatgcatcgacaatcttaaatggaggacgtcgcttgagtttgaggaatgcagtctccatttctgagagttttttcttacctttcagctctcttccataaacactgatagctaacgggtttccattagcataatttattactctcactgacaactcctggagattctgctctcccatatcctcctttatagacgcagacagcaagaaaagttgacgagcctctttctcatttaaaccctggacctcatatatttgattgattccgcaaaggcaaaacacttgtttatctctagaggttatgatgatcaggcttccgggtcctagccagtcaaacccctcgagaaaggactccccaaccagagcattgcgcacgtcatcgagaacaacaagaactctcttactgttcaatctgtctctgagcgagctcagtttcataatggttgcatcattgcccggcaaaagttgttcctccagcaaacaataaagacccttctcatgaattgatttgtcatagtcttcgataaaacaagaagcatcaaaggcgctagacatttggtcaaagactgctttagcaagtgttgtctttcctatgccaggcataccccaaattccaacacaacggatgcctatcggttgcttgttaaccatgttttcaatctccagcagcttcgaatagattccaattcgtccaacataaaagtgcgtctcgtacacatctctcacaatctcttctacaagtatagagtcactacattccttcctgcaccatatttcatcaaatattgaaaacactacactagccatccaaaaagttttaccaattttcaacataaggaaaaaaaaagcagagagtagaataaagcgaaaacctggattggtgaattcgtgataagcctctgaaatccagctcgctaagccattggtcccgtaatagactgtcaccgtacaacactgaaaccaccgcctggtccttgttgttcctttggcactcgagaaccttggcgaacttgtcaagccatacctcggaaggatcacagtttccgggtaaaaccatcacagaaaccccagctttctcgatctttgcctgagactccttgaaaagcagatcatcgatatctacatctacgaccacattatttatgccttttcgacggagagcttcagagaggtggctcacgaaagagtaccgtacctcttctacgcagctgatgcacacgaattcctcatccttttcacaattggtcatgatttcgcgctttgatactttgaactaacctttgatttcgccggaatttttgtttatgccgacgatgctttttcattggacattcaaccactcaaatctcagttgtttttttacatttgatatttttccaacagcaaaaaataacaaaaaggtatttaaaaaaagagaaaagaatagtcaacaatacattcttgctactctaacgcacaccagtgaggaaaagtccaagtacaccgggaaaaagcttttgggccatg

SEQ ID NO: 2060 - DNA, 3000 bp, Unknown
  misc_feature (1)..( 3000): cDNA_ID_3065766_gDNA_ID_1620483_Annot_ID_158407 3000 nt of promoter + ATG
ccaaaaacctaatgaaaaagttgcattcaaatattctaataatttttttaattgtgtagttttaaaaaaataatataaatgcaacggaatatcaaaagctcatgtttactttctttctttctttctttctttgtgtaccttgcgctacaattgtttttgctcaaacacaaacaaagtattactttaaatgcaacgcaaattgtgctttgtcgtgaaacaaacacataagcgggttcccttacttttttacgacaacacacttgtaacacttacgtacaattaatgaagagaatactaaatgtcatcaatcatgttttcactttttaattttttatgtatatccaacatacataatactttttttttttttgggcacatccaacatacataatacatatagatttatatccggataaattctggatggaaaataaaacaaataattaaagtgtcattccaaagctgctagatcacaacatttggcttaaagcatgtacttgtattgtaatgtaccgtaaacaaattatattaattttatgaagtgtataatgtatcaactaaattgtcactttgaatatattctctatattaatacgatacaattaataataccagcatgattgcacatttgcacgccattcttgatagataaattccgtttgacaatcatataatataattaagtatctatatactataatacaaaatttaatttgatgaagaagtcgtaccacggcactgctacgtacaatgagcagcaagaggcgagatcttatgccgcgtaacgatgcaacttacatatttattcaaccgcgtatatatgtttcttgttgaaagacattaaatttggaatcgttctatgattaatttccccaactatatagtcactgaatacttttcaaatttaagatttttgtatttattaaattatggggagatgtggatgtttcttgaatatgaaaagtcacatatatattcttatcttcaaaaagatttatatggaggccacaaccttgataagacaaatgtcactaaactatgtgttgatcataagtttgtcgatctctgaccgattttgactgcctcaacattaattttcttgggtcaaagtgtatagttgtattgtgttcgtttgcgcttcgttaaagtgaaaatatgttatctttaacttctggatccattataaatattatcactattagattctagataaaagtagaattttctaattaagctataaaaaagttcaagatttacacaatccatgcatatcagattgttccacattaactttacgtactatagttcgtaaattatatgtaatcattttttggggtcaaacttaatatgtaatctatggtggggcacatgattctatatattttaggtgaaatagttgttaaaattaatatgtactacttaatgtattaattttacaagatgtttggtgatagttagacttctctaacttccaaaattaataaggacgtagacaaataagtattcaagtctttggtcctagatccctcaagaaattttatgtttttatttcacaggcagaaagtcaatttgtattatatagatacaaaacaaaagtcaatgaatattaaaactcttatcaaaactataatacttatttcatcaataatttttgtaagttaaacctacttctatgatttgaaaaatgaaagtcacgtttagcaaaagaagaaaaatgaaagtcaagttttatttttatatgtaatctgattaagttctaagcacatatataggttttgatttttgttggggtcaaccacataggttttgattaattcgtataagctactaataaagtaataatatatggctgtaatgcagggcgaacgtgggagagaaattagtatctatgaataattaagttagtataacaagtgggcttactattactgacatatataatcataagctactagatcataagtaattagtcctgaaaacttggattatctgtcttttgttttcaatgaccacacgtgggttttcccattaccgtttaatcactagtttcagtttttctttagtgcaaaagtaaaatttgttattcaaatgacttattacgcatagaattataccagagaataatttagtatgaaccaagtgaaaaacataagtccttttaacttaagacattttttcagtcaaacaattgtaatcatttgttaaaatgacaaatatatctaatgctatatagtaattatgaatatgtcaaattgtcttcctttagcaacaaaaaaagaaaaagaatgtcaaatagtcatttaaatattaattttaatctttgtaaattcttaaaacttattattaatctttttattttttaacaatggggttttaataatttaaaaactttttagaaaactatttcgttaaaaatacaactctaaatcttattttcaagatactcggacccaaatcatacatacacttatatcatcattcattaatcactattgaatcctaaacagagataaacacaagagtgttggacttggttttaaagaactaatagtataattccatgaagtgtatagcgttccattaacatggcaaaacatctaataaaaaaaaaccgcccattacctcctttcctttgtctatacttaagggccaaaattgcccctttccttgacttaatccataattaattaaagaggcataatttaattaacggtggctaaatttttggtcaaaatctcacacgctccttttttttttttgcatgctcttggacacgtgctctcgtcactctctctcaaattagctggctccaaaaaaggttccttttaggaaactcccttctccaatttgtttcctcatccttctctctcctccactgcctataaaaccaattcatctctcccacttgatttttcatctccaacacaaaaaccaatccattagagagagaactcacaaaacatacttcgaattcccattgtttaaaagacgaagataatg

SEQ ID NO: 2061 - DNA, 3000 bp, Unknown
  misc_feature (1)..( 3000): cDNA_ID_3065770_gDNA_ID_1620483_Annot_ID_158406 3000 nt of promoter + ATG
ttaagagctgctacaatcttatctttcacatttagagaagctgtcgaagatgtcgaatacgaaggtatgtacaaataaacgatatgttagatcaatatgttacatatgaaataagctaaagtcttaataattgtattttactatctttacaggatatttgataccaaagggatggaaagtactgccactattcagaaatattcatcacaatgctgatatattttcggatccggggaaattcgatccgtcgagattcgaagttgcgccgaaaccgaatacattcatgccttttggtagtgggattcattcttgtccaggcaatgagttagctaaacttgaaatctctgttctaatccatcatctcaccactaagtacaggttggtacaccttcaaaatgataatagtccttttgggaattgacattattttgagaagtgttttctgataaggggtgttttggtaatttgcagatggtcaatcgtagggcctagcgatggaattcagtatgggccgttcgctcttcctcagaatggattgcctattgccttggaacgaaaaccatagatgaattacgagaataccatttacctttcttaaattagaaagtgaggaattttttttcttatttaagaggaaaatctaattcttttttataatagaaatgaaaagaaagtagaagaaaaaaatcccaagtgggaccccccaagtgtatataagttttagtttataaaatgtagagaattaaattttcggagaaaaaagagaattagttatataaatgttccatgtgtatgtaacttggttcatgcctctatatctttatttttgtaattttctcaaattgtaaattcctttattacgaatgtaatgactgatggaatgctcatagagaatttcagaattaatcttttaacaaaaaaaaataaaaacaattcagcattagtcatcgttttaagtaacagaacgatatgtttactagactttaactaaaatcaaacgttgaaatttgcagtaatcagtaaattaactactcctgttatccttttttttttgggtcacactacaacaatattactaatctttttgtttatgctattttatgagaaatagttgtaaagtgaggtgctaaaatacgatatgatcgcataatttcccactacttccataactttattgttcttagttacacccttaatcaaatgttttaattttaactgcagtagcataaaaatatgttcgcgatttgatttcttttttagtgatcaggatcttaggttataatatgcagtatgacgtcgcctaatatatcatgtctaatagtttaccattcatttgatttctgatgtaacagtttgattcttacgtaacaaattatcatgagacaataaaaagatatgataactgtaaagaattaaataccttttgacattcaaaaaaagaaaattaaaacatatcgtgaaaagttaaaaaatatcaaatcaaagacaaattttttttgactaaaatatcaatatcaaatcaaagacatttggatctttgagtaaaccaattttgaaattattttataaaataacgtaagaattggtaaaagtcgattccatcttttctacggacgactttgaccatttagtcgtaaattatgtgcccattccgcctatattgattaattactggtgtatgaattttggatcttacatgaagttactgctacggatatgatcgtcagatgactactataattctaattaacattttgtttatttttctttcgagaatacatatttctagtctcctccattggttgctttcataatcatctttatttaccaattatatatttattttacccttttacttaaataaaccaaaaaacaaaatcagaatttgtaacatactgatttagtgaaactgttagattataaccctaattgaatgtcagttgggggttcgtaattagcttaacagatttttgttgtcatctataaatatttgtattctttgactcgaacaaagaactctatcccccagcaaaatcaatgtatttgactcctaaaaaatgttttttttcttccttatagtttctttagttaaagtatcttatcaaccaatattcaacctcatactttcgttattaggtaagaatagtatctttattttgacaaccggaagaatattatctaattcctaaggatagtatccttattaggtgatgagttattaaattttatggttatattgattgcgaagagaaaacagtgtcatagtgcagaagtgactgtacactacaatattaatttgattggttagctgtaatccacggtttaataaaaattagtcggataaattaattgtgattagcgaaggaagaattgaatgaagatacaaaatatccaaatcgagagttcacaagaagacatcaactagaattctataacgaaatcaattagataaacaggttcatcatagaaattcatacaattgcatgttcgaaaatatatttaaagagtaaactctctattataaatagtgtaggggaaaatatcatcaagagtcaagactcgatcgagagaatgttatatgttgttaattttgttttagttgattcaagaggtattactactttttaattattaacatgcatggcacatacatacgaaaataagaaaataaaagactcagaaatatatgtgcctatgtggtttgggcttgatcactatagaactgtatgtgaatttaagagcataggcctaattttggctaaaaaagaagaagaacatgggcctaataaaagcccaaatattatcaaagatggaccaacggcacacagatctccccgcctttatatatcacgacggagataaactcaagccacgacggttctccgagagagagattttttaaaaatcaaattgcaacagaagagagataaaaggaagaaccctaatcgatttcgcgctctgattcgttctactttttccactgattaatctcaaaaaatg

SEQ ID NO: 2062 - DNA, 3000 bp, Unknown
  misc_feature (1)..( 3000): cDNA_ID_3065774_gDNA_ID_1620483_Annot_ID_158400 3000 nt of promoter + ATG
agtaacaaaataaaatctaataaatgtctacacatttcggaaggttagtatgaaactcggattttgaaattctttagatttaaatattatagactacatgttatggtctatcacatattcaaaattttcagattatttaaatacaaacatcatgtgttcaaataaatgtaacaaagtcgtgactcaaaagtcaaagtcaaaacctatatgctctctctgtattatttagtacttgtattattaaacgcgttttggttttggaaatatataacataattctcattttttctgtttagagaaaaaacaaagaattttaaaaattggtaaattgtaatcgacagatcttccaggccactttccttatccctttctcctcctagtcccacggaccctaccttcctcttacatcatttggtaatgatctttcccaaattcatttatttttatagttagacatactacatcaagattcatactaattacagacttatcaactatacattaatcaatatgagataatttttctcttttcttgaagtagtccgctaaaattatagtaataaatactaatatacctatagacatagacagataattgtaatatccaaacaattttaaataagtttgatgttcttttgatcataaatctaccttcataatgaaacatcctccaccagcatatcataaatggttttttgacgtatattgaaaaattcaccatgttggtacgtaaatttccattttattttaattggttatgagatacacacaaccttctcaatgacaagaatatatggttcttctatatataaagaatctttttaattgaggataaagaacgccgattcaaggattatagtaagctacttaataatttgacttctgcaccgaaacaatatcaatcattttttacaaaaatataatgaagagatataaatctgtttaacttctaccctaatattcatttgtggagaaagaaggtaaaaaattaaagtaatgattcatttattcaagttattgaatacattatgaagacgaggaagacaaaaagtcagaataatgtaagtaaattagcattaggtcttaaactctcggcattccgcattaacttgattcggtgcatttggaggaggaccgacacaataccacacgtggcaaattaatttccttttgcagaaataattcaatgtcatgtaatttcaaattttaaaagttttgaagacaaaaatcatctcatgagccgaattgatatggacactagtacagcagcttccttagattccatccagacataacttttgatttcgatataggtcatcgctattgtaccaactactacgtataaaagaaatactgcatcctcataataaatcataaaactttataataaactaaacaaaaatagaattcatttttctgtttatttattgtaatattcttatgtgaaactattaataaattgaacaaaatacttaaaggaattagattatatacgatatgtgaatactggtcatattactacgaaggtagttttcttgagagtctttaacgttgaattctcgtgacctggcaaatacatgaaagtaacaataaaacttttatatttatttttattaaatgaagcaaaaaagaaaaagaaaaaaaaaaggttttctttcgacgtgtggtattctgtatccatctatataacagagaggacatcaatggctttctttgaacttgtaaaccttactctcgaagagtcctctgttactcatttttacattgtaaaaaaaaacttcttttcttctctacgtgaataagaatctgaagagtcattttctcaaggtaaatcttcttcgtctcttttcctaaaaatgaagtctctattagaatttgtttaaatgaagtttctgttattatttctttgatagtttccagttctttcatattgatctacgagttaaaactcagattttcttactcaaccatagcttattagatatgttttgaaaactagatatgttaattgtgagtcatttcttggatttaaccaagtaactattagtagagaaacaattacggtcatataatcgtgatggaaaagatcttgcaatgttttgatttcaatcctatttttggcattttttttcttccaagaagtggtttaattttattttcccccaattagttggcggtccaataatccacttacaacaaattgcaatgtttggtttcaacaaaattgtttttgaatttaaaatgatataagtcgtaatctcatcatatgcatggttctcattttggccctcccgacgccatgaattgcggtctgtttaagtttggtctagaagggtattttcggatacactcacattttaattcattcattgttcatagagctaccattgtaccatctaaatagcatttaatacaaatatatagggacgaaagattactaattgaatattgcaacttatccttctaatagttgttcgtgtcttcactgattataactatgagtaagtcgttgttcctaatatgattaatattgaagggaatttatttatatatttcgtatttatagtaataatattataaattatttttcggtggattacatcaatcgaggaaaatactaatgcacacacatggactggtcattttgtttccccaactttttgaatggaccaatggtgatattttcaatatagaatatattttctcaattcattaagttcttactttgatacagaaacaacaaaagataagctttatattaaaaccatgtgcaagttacacataacacatgtacgattacttgagatccgaacacatcgcttgatctcaaagctttttgttagagtcaatcctctacattatttgggagataattaacattctattcgattttgtcattatagccataataaattatgtttggttcggacaagttcatttttactaatttgtgagttataactttttttcttttgttatagaatgacgtggctaaaacaa

SEQ ID NO: 2063 - DNA, 3000 bp, Unknown
  misc_feature (1)..( 3000): cDNA_ID_2149406_gDNA_ID_1620483_Annot_ID_158401 3000 nt of promoter + ATG
ctacaagtaaaaatattcacacctgtagcttaagtttgaagtctctgataaggttaaagagctccctatagccagaccatacatatttctgagggttccatccttcaactattccccaccaacaatctattactactccatcgacatttaatgacttcatgtaacttaattcttgtcttacaccttcaggatcaaccaactggccaaagttgtctataatgccaacctgaaagacaaggtacagaactttagcacaggaaaactaaggatcgcggcaaaactggtaagaaatatatgtacactcttttttattgggcaacatccatatatatacacttaaaacacaaagttctctcatcagaagctcactggaagcatggcgtacacagggacataaaagctctctgtgaagtcattacattgctctgcggaatgaacatcttgtataagctgaaagaaaaacaaagtggttagatgaaacaacgtccagcttaaagtcaattctcctaataaggaaatgaatttatcattcacctgattggcttccaagcatccaacggaggtgataggactaacactagtataccttccattcccgggatgatcactctcggcaataccaatagaatcaagagacacaggagcaagtttctcatcgttcctaagaactgaatgctgctgagattcaattgcagccttagcacagttcttcaatgtactagaagaaagtggactctcaatagatctcgtcggaaactgtacctaatccaataatattaaacaatctatgttacattaataacagaacaaagcttataactttaagagcttcacacatatttgggatcaaatttatcatctttccactaaaccctaacttaaatagcttaatatgaaagtttgaattttgagagagagagtttcgaagtttgaaccacatgatttggttgctgtgattgccgataagtagtaccatcggcttcaacactccaaccagcttcacgagccaaagcagcgattacgtcattcatatcagcacgcgccggtaacggaaaattaccgtactgtcttaatccggcgagcattctactagtgattgctcgtctatgtctttctctaagcttcgttctctctttttccttctccctctctctcttccctttccctcctccacctcctccgccgccgctgcttccttctccaccgccgattccggcgatgtttccgttgtttacatcgttttccgttggagctatcgacgctgctgctgctgcagcggcgaatccgcgagggcggcgagattgtggttggttgcggttccggttgggaaattgatccgggtctggaattgggtcgagattcggatcttgcgaaccggtggtggtggtgatggtgttgttgagagtatgcatttttgtgcggtgaagttgctcgcttctgtgctgttcccacatttgagatttttttgtaactttatggatttacaaatcaacgtcggtaattattataaattacgttaaaagtctctcattatcaaaatcgtcaatattaacccctccttttttttttttttttttggtcaaaaacctctcttttttttttgttcaacaatagccaatgtgaccagttttgacaaagtgatactgaattactgatgggtttgttaggaatgacacgatgggttttacggttttgtttccaatcctttttttcatggttttattagtttagaaaagaaaaactgaataacataaatacataatttgtcttttgatttgattttggtttagtaaatcaaaccaaaatcatgttaaaattagtttacatattttgactcaggtttttattttaggtaggttttagtaaaattaacattataattataaataaaatgttaatgaatttccgtttatttgattcgattttatcatgttaaaattagtttttgtttggtctttaaatcgactttacagggccggtccaacaaaaatcttctgaagctagaatgccactatatctaaattgtaaaatactgaaaacaatcacttcataaaaaaaaatgatttgtatattttagtttattgtgatttacttttttcaactcattttttttttctatttttaatatatcttttttctttctttctttgaagttagtgtagttcaattatattttaatttttgagaatatagattcgattttggttcgattttggttcgattttgtatttctgcttcgcaatttataaaaccaaaaggctttgtcaacaaaatttcagttttgagtatagtttgaatattctagtttggtttggttacaactatttttcatctaagtgatcactgttcaatgaccatttcaaagcttttttctcaattatagtcctcaatgaagtccaattatgattgcaaaaaagattaaaaaatcgaacgaaaacaaaagaatgttataatagtttgaaaaagaaaagaaagaaaaataaagaaatggtgagtttggttttttgttccctctcgttcgaacatcaagacacactcttcccgtaaaagtctctctctctatcgcagataggtgctttgtctccttcttcgattactccgatcacctaaaaatctttccttttcttcaaagcatttctctttgattcaaagacaacacacatagcttagttcctacattaatttctcgcaataaaaaaagttcagatttcgaggtattcttgcaatctcgatcgagtttcagatctggggattcaataattagggcttttgattctgcattgtcaatgacgaattcgggtttcaatgtaaagatctgaggaaaaagtttcgatctttagattttgacttggaggtttcttcgattggtggatttgaagaagatggggaaaagacttgtgggtcttgtgtcaatgatgtaattttagcagaaagttgtttgcttttgagaagaagatgggatctggccggagcaaatcatgtctaggctcgtcggcgatg

SEQ ID NO: 2064 - DNA, 3000 bp, Unknown
  misc_feature (1)..( 3000): cDNA_ID_2149420_gDNA_ID_1620483_Annot_ID_158405 3000 nt of promoter + ATG
taccataataacaacaacaacaactactactcaaactcgggttatggttactactctggtgggagaggccgaggcagaaacacacatttctgacctgctgagtttctatcttccaaggctttattggtcactcgcgtacacacatttctactcttagcccttctttaaagttttaaattcagctttttgggtaaaaacagttgtatggttaccacatcgcgagatgtgtaggcatatcatattggcaagttcatgttcctttttttaatctgatgaactttagcctcaggagagaatgtttgttcatgtagagaaaacaaaaagtactacgaacctttttggtaaacgcaaatcattaagtatatatatgcatcatatgttctgatatttattatttgatttacatatgtacacattagcgaagttagtaagacttacaagttaagaattacgttagacattatgtacagaagaagaagattccttaaaatttagcaagtatacaactttatccaattatgtatgttacttgctaagcccattttgcctttaccccaaagtaaagaaagataccaagactttccccaccaagtagggttaagtaccaaatccttcaaattccattatcctctctcaaacattaccccaaaccaaccaaaaggccaagaacgttggtcccaaagcctgaatgctgtctcatcgaacccgaactaaaatccgatctggtaaaccccataataatgcccagattgacttctcgtcatggtaccagtcctttcatctggtgtgcagccatcatttgtgccataatctctattgttgtaatcgttggtggcattatagtcttcgttggttacctggtcattcatcctcgagttcccatcattagtgtcgcggatgctcacctcgacttcttaaagtacttgttatattttccgcaactcttccctttattgatcatgatgaatcttggctctcatttatgatcgatatctttttcttttctcggtttgattgatcaggtatgatatagttggagttttgcaaacgcagttaacgattgtgattcgcgtagagaatgataacgctaaggctcatgcgttgtttgatgaaactgagttcaagctaagctatgaaggcaaacctattgcgattttaaaagcgcctgagtttgaagttgttaaagagaaatcaatgttccttccttacttggttcagtcatatccaataccattgaatccaacaatgatgcaagctgtagactatgcggttaaaaaagatgttattactttcgagctcaaaggtggctcaagaactcggtggcgagtcggaccattaggatcggttaagtttgagtgtaaccttagctgtcagcttaggtttagaccttctgatcatagttacattccatctccttgcacctctgctcataagcattagaaactctatctctcatttgttttactttctctttcacttaattagtttttattttactttttgggattcatatatatttttctttctaaaataattgctgtaggtagtattacaatttattcataatgatatcaaatgaatatgaaagaaattcatgaaatttcgatattttcgcttacacgaaaatttgacttgaagtgtatttgattgtttggaataataatgaaagagtaatatatttttgtaagttttttaatttcaactaaaatcacaaatgatggatttattttaatgttttgtaattaagaaaaattaaattatagataaaattaataagttaggaaaagtggagggaatgaatgaaattgagcaaaaatggtgaatgggcacaaatgtttgttttaaaaaagaactttatgtatatttgtattttggtttaagcagtttaatgaccccatagcttttgtatataatgtcactttatttctacatggattctgtttaacaattcttttgtttttgtttaatgtgtaattcattgatcaaaatggggaaaaatatgtaaaactcaagtgtttttatcgacggcagtaaaacagagacttacaaagataggaaatagcttttaaaacagagcaaataagcaaaaaagctattatcgtcccattgtgatatgtttgaattttttacaagtagtatgtacatttacagatgtagacacttttgattttcttacaatagtatttgactatttggtattgctttttttattacaacaacaataacgtcagctcctattattcgatcatattggtgaattgttcaacattcacttattgcacatcattctgcaaatgtgcatcctctattttgtaagtggtattgtaattaatgctttgttgtttgtataacagtgaaacagcttgttagttatctgaattcaaacgatactagacttgtcctaaccaaaaagccttatttgtaaacaaaagcacatctttgataactaaagaaaaacgattgactgattatcaattccgacaaaacccataccattaatctaagttaatctttttgttatttttatattttatagttaattattcatttttattgtacttttttttataacagaaatgtattttaagttttgactttctctgataactagaagaatttcaaagctctgatctttatccaaatgacttgagaaatacactcatcactcaacgtgtcgtccattgctttcctctctctgccacctctctgtttttgtccctatcatttttcttctcttcacttcatactctgttacaacttctggctcttactcttaccttaaaaaaggtaagcttctaatttcttctattataagattctatcagagtttggatatcgcttcaataaaaactagaatcattttggttcattagctttattaagattggaaatttgaactttcaaaaatcttgaccttattttggaaattccattgagcagtgactcaaagtttgtgtgttcatatttttgtaggggaaaaaaatttggttaagacaaatg

SEQ ID NO: 2065 - DNA, 3000 bp, Unknown
  misc_feature (1)..( 3000): cDNA_ID_2149413_gDNA_ID_1620483_Annot_ID_158403 3000 nt of
gtagggagaccgaaaacatgtatttacctcgaagagagcttcagctagcaatactatccttgagatgctagctcttgcatttgtttcatcggttgttgctgttgtcgaaccacggttagtaactgcacggcatgtgcagcgacctgcttgatcttgacctgataagacacaagatctatcatgatggactgcgacattctcaaaccggcttcctaatctttgaagagcgcgaacctgtggaattagttatatcagttagttagatcttgagttgatcagacacatcaaggaagagagaatcaatgagtttcaaacctgagatcttattctcctccttctttcaaggaaatctgatctgtgttctaataaaccttgatacctcccttctctcacaagagcagctggtgtctcatgatcctgaatgccgaataaggtccttcgaatgctagaagcggaacgatttagtatagacgttgaagtcacaggagcatcctctgctgctgcggtttcagcagagaagagatcagtatcttcttctccctgatgtggcgagggacggaatgcgaaatcagagagtgaagatcggcgaagaactctatcacggagtcttccaacactcagagttctactaaatctaacattgcgctcaatagaaggttctcgtacaacatgtcttctatcaagaagtccagcataagtactatccataccattaactactctcggagaacgtaagctaccatcttccccaaatctcatggcatcaatatctctaactacattgtcaatcacaggaattctcggagactcaactctatcattgagcctaatagcagattctgaaggtgaagtaacaccatcttctctatgagaagaagagactggataagtcgtgttgaaggatcttgaacttgaagctctgctaagtctagagcttatgttaccaggaatgaatttgaaatgcgaaaaaactcgacctggagtagaagattcttgaatcgaaccgctaacatttctcatctgtacattgcttacactagcttcctcttcttcttcttcaacaccacactcatcatcaagctcaagctcatcacaatgtctttcgttttcagatttcttatcatctttcaattctttatcatagcaatctgatgcatctcttctcgattccattctacgccgtgtaacacttccatgactcttcctcatccatccattacacacctgaagaaatcaaaactcatgaacttgacctaatttcagatttgaccaaaataaattaaatatcaaaaccagacctgttcatcattatcatcatcactgtaatgagaagtagaagatgaagcaagacaagaagagtgaagaccacaaaaaagactctttgatcttcttctccttccaccaccactagaagacgacggaggaggttgagccacgtcagaagcttctctcgccatcgccgacgagcctagacatgatttgctccggccagatcccatcttcttctcaaaagcaaacaactttctgctaaaattacatcattgacacaagacccacaagtcttttccccatcttcttcaaatccaccaatcgaagaaacctccaagtcaaaatctaaagatcgaaactttttcctcagatctttacattgaaacccgaattcgtcattgacaatgcagaatcaaaagccctaattattgaatccccagatctgaaactcgatcgagattgcaagaatacctcgaaatctgaactttttttattgcgagaaattaatgtaggaactaagctatgtgtgttgtctttgaatcaaagagaaatgctttgaagaaaaggaaagatttttaggtgatcggagtaatcgaagaaggagacaaagcacctatctgcgatagagagagagacttttacgggaagagtgtgtcttgatgttcgaacgagagggaacaaaaaaccaaactcaccatttctttatttttctttcttttctttttcaaactattataacattcttttgttttcgttcgattttttaatcttttttgcaatcataattggacttcattgaggactataattgagaaaaaagctttgaaatggtcattgaacagtgatcacttagatgaaaaatagttgtaaccaaaccaaactagaatattcaaactatactcaaaactgaaattttgttgacaaagccttttggttttataaattgcgaagcagaaatacaaaatcgaaccaaaatcgaaccaaaatcgaatctatattctcaaaaattaaaatataattgaactacactaacttcaaagaaagaaagaaaaaagatatattaaaaatagaaaaaaaaaatgagttgaaaaaagtaaatcacaataaactaaaatatacaaatcatttttttttatgaagtgattgttttcagtattttacaatttagatatagtggcattctagcttcagaagatttttgttggaccggccctgtaaagtcgatttaaagaccaaacaaaaactaattttaacatgataaaatcgaatcaaataaacggaaattcattaacattttatttataattataatgttaattttactaaaacctacctaaaataaaaacctgagtcaaaatatgtaaactaattttaacatgattttggtttgatttactaaaccaaaatcaaatcaaaagacaaattatgtatttatgttattcagtttttcttttctaaactaataaaaccatgaaaaaaaggattggaaacaaaaccgtaaaacccatcgtgtcattcctaacaaacccatcagtaattcagtatcactttgtcaaaactggtcacattggctattgttgaacaaaaaaaaaagagaggtttttgaccaaaaaaaaaaaaaaaaaaggaggggttaatattgacgattttgataatgagagacttttaacgtaatttataataattaccgacgttgatttgtaaatccataaagttacaaaaaaatctcaa

SEQ ID NO: 2066 - DNA, 3000 bp, Unknown
  misc_feature (1)..( 3000): cDNA_ID_2149382_gDNA_ID_1620483_Annot_ID_158395 3000 nt of promoter + ATG
tcagttcttgaagagctttcagctcaccaacacggcctggaatttcctctagcattttgcagtctttcatattcaatacaacaagtctctgaagcttctccatgttcataggaagctgacttattgctgtgccatctaagtatagagtttctatattatctgaaatcaacggaaattccttaaaagttgagcagccgctgagagtaagtgttttcagagaaatcaaattcatctctggaagagattcgagacttgtacaccccttcagattcaagaaagcaagcattttcatttttttcatatcatgtggaaacgctttcagtgttgtgcaaccttcaaggttcaacctttgaagcttttcagcttttgataaccctgacaagctgcacaacttacttgagtgattgagatcgacccaccttaagcatggtgtgtcctattacagaaaaagaagaaaacaaagtttagccaccagtcaaacaaacctatccaggtaaattaaccattcacaaaagcaatcaacagattattcagagacacaccttgtcaccctcccaaagttgttccatttcactgtagggcagcttaaggtcgacaagattaattgggttgaaatcgtttggaagtgtctccaatgggaatttcagccagtggaggcatcgaacttctttcaatggtagcttaagtttatcagggatgttgattttattgttggttttacattcctgtggacaatgggaattgtagaacttgagataccggagatttcccatatttatgaagtggtcgcggtctaagctcgtttcgtcttccacttcagacaagtctaggaaaatacctctaacattggcagctttctaagcaccaataacaaacacgatcagtgaagagaaaaaaatgtaagttcttaccaataaaactctagaggaacttctggtctcaccattttattttgcaatacattgattatgcctcccttgattatgtgttgatggagccacagcctccgttgtctgctaccatcctgattagatgccttcagatcaacttcccttgaaaatttatataatagatcatgcatctccactcggccatcacaagtattaatcaggaacttatccgtgagagatttgactgcactcattgcttcagccgaaccaaggtcagatgaagccagtagactttctacataatccttgtcctgtgatctgaaacaggctatgtcgagaaatgcatctttctgcgctgtagtcaattcatcataactcacttggaagacactgacaatattagggctggggctctgtgcaagtttcttcattttcgaattccaatgatccatacttttcttattaagctctccacccaatactttgagggctagtggatggcctctggcgtaatgtacaaacccttctgacagcttcatgaaatctttcttttgaggattggcttgatcatcaataaaggcatgatagtgaaatagttgtaagctatctctgtggttcaaattttgaaccatgtaagtatcatcaaccaaaccatttgttaaggacatgtcgcttgttgcaatgacaaccctgcttccctccttaccctccttaatccagtctagtatctcacgaagagcatctatttgttcccttttactaacatcatcaagtacaacaagcactttgcgttcatgcagttgactgtatggatctttgagattgtctacgtgaggatggtttaacttggacaactcgcctaagagcatttgaggcaagcgatccaactccaagtgcttggactttacacggatttgatcgattagcgcatgcctcgaaaacttgccctgccacgtcttatatagctctttcaggagtgtggttttaccaattccgggcatcccaacaactccaatgatacgagttcccttgtatttatcacgatccaacttctcttccaaatcttttaaccgttgttcgtttccaaaagtctcatgctttttgtctcctgaggaagttccagcgttgctattacctaaagcacccacgacggcgttgtgacttccctccggtggtattccggtcaacgctgtcttcaccgccttcacaatttcattgactttctcactctccacactgcaatttcaaggctaatgagatcatgacctccctaagttccataaaaggttctagaagtattcatagatctgtctacaattgtaatctaatcactactgtgtctaggtttgtaactgagtcaaaaaaaataaaaaaaaatggtaccttttcttgtcaatgatgatgcccataatgttaggaatcaagttaaaagcttccttccatttctttttcctctcatcacccttagccatactcctaaatctatcaccgaactttcctttcaaatctctaacggtggatggctccagcttgtagaagattggaatcgcaacgagtgttccttcatccgtacaatctttgatcttctccagctctctcacgcaccagactgactcggtgtagttgccggagaagatagccaaaacgattttggactcctctatcctcttcagcagtacatctagaggttgacctctgtcttcatagtcgtcgataaagacgttgatgttgttcaatttcaaggccgttacgagatggctgacgaatctccggcgcaaatctgccccacggaaattgatgaacacctgatgctgcggtggcttgtcttccacagtggaaatagatgatgtctccatggcccaaaagctttttcccggtgtacttggacttttcctcactggtgtgcgttagagtagcaagaatgtattgttgactattcttttctctttttttaaatacctttttgttattttttgctgttggaaaaatatcaaatgtaaaaaaacaactgagatttgagtggttgaatgtccaatgaaaaagcatcgtcggcataaacaaaaattccggcgaaatcaaaggttagttcaaagtatcaaagcgcgaaatc

SEQ ID NO: 2067 - DNA, 3000 bp, Unknown
  misc_feature (1)..( 3000): cDNA_ID_2047242_gDNA_ID_1620484_Annot_ID_158411 3000 nt of promoter + ATG
atcttggatgatgtagagtccatgagtgaagcaactgaccgagtatcctccatcacaaaagagcctaaataaaacggaaatttaagtaatgattaaaaagtcccgaacaaataaaaacaaacatgagtacaacgacattagaggccagacacaatattgttaccaattcaaacaagtccaatctccaagctgcgaatagagagctccacgaaatctcgatccttgaacaacaaacaactacaaaaaaaaaaatcatcaagaacagataaacaaagatcagtcaaaactatccaatgacaatatcactcgttaaagataaaaacaaattagctctgtaacaagaccgtacaagtcatagtggacaactatgtaagaaaatggcctacaaggcaagtaaagacaaatgaacaagaaacccccaaaaaaatgaatccattcaagaaaaattcacactattttttagtcacaaagataattcaacctcaagaactaatcagacgtacttataaaaaaattagctgaaataatacaaatacagattaagagaagagtagatgacgaaatgagagtagaaacaagcaagctgattcagtgattctatgaaatcccagcttaatccatcacataaacaaacttcacgaccaaaattcaaggtcatagcagaaattttgagctatattgtggagaaatcaacaaaccctagctacagtgaagagaacacgaacatgaactcaaaacaaaaaaaaagtatatacctcaagagaagataaaaaaaaagcaactttaccaggaaaatcaaacgaagtaaaaacccgtaagaagaagagatcaaaaaacttcaagaaggaccacatgatcgtagatccatggtgaagagcgatcgagagaaatcgaggttaggcagagagagagagagagagaagaggaaagtgaaatccctaaaaaggaaagaggaaagtagaagagaggcaaaataaaaggaagcaaagcgatttataacagacactttattaagcacacccaattttacttagttggcacgtgagagagactggtgtggtttaatggctcgttcttcactatcatatctggttcggaccagacagcttatgtggctctagtcaaaccctttaaagtttgcgtcacgtgagtttgtctgaaactgccgggaacttgtaatttactctttcctcctttttttctattaattggtatattcaccatctatgtgtatcaatcactctttaaattccttaactttttttaccaaacacccaatctttttaacctgttgacgaagctttggcttcatgcttaaggctatgttataatggggaaaaaactagattgcacaatctttcatagactgatattcttcatcggatgtttcgatcatataaattgtctccaaggatgaaactatgtgtctaatttttttgaatgcaaaatttatatatgattgttttcttaataagagcaacaatgaaaatatagtttggttatacattggtatttgtcaaagaggaaagactaaaccaagagtaaataaatcttacaacttcccaaattgttggaattctacaattgtattatatatggtgaatgatttggtacaaaacattacaaatatcaaatgaatttcgaagttggttcaggtcacgaatggcggatttggcttgggagagactagaggttgtgattcgtggtttatctcctctctaaaatcgttatgttacaaactgactatcaaggataatcatatcaatcaagataatgaagagaatcaatatcgtcaatcacgttaattgctcataatcattgtatacaatattaagtttccttcagtagctttctagtctttgtatataaacactctgtaatcatcttgtttcatatattcgatatactcttagtctacatggtattagagtctctgtatataaacactctgtaaaatttctaaaatcgttatgttacaaactgacaatacataaacaacacgaattaacattttggggtgtttgctgaaccgtggttggcgggtacatctgctaaatgaacaagctttttatatatatatatatatatataactgtcaacccataatttaaagattccaacaacaacaaaataagtactactcctaataagtatttaaatatgtgacatgatattcaatttttgtgatacaaattattatgcattggtatttgtcaaaaactaataccaagaaaacatttcttgtaaatgtcatattccattctttgatttggtcaaaacaccaaaaccatttacaaaatatccagaattatctaaaaacgaatgaaaagcgaaaaataccaaatggaagaaaaatttgtccatctcctaacaaacaagataatatatatgatgatgttgaaaagtcaaaaagagaagaaagaaaaaaaaaacatttaacgcgcaaagaccgatttggtttttgttgggagtcattgcgttctcatcatcagtgtctctcttttctttgccccattcttcacgaactttcactagacgacgacgacgatccaaagtcccagtcaactcactcacaaagacgactcctttattaaattattcccaactcctttcttcatcatcatcatcatcatcattcataaccacttagccacagatgcgattttcttctccttcttcattgtgctcttcaacacttatgaacaagagcaccaccaccacgacaacgacgactacaaagaccaaagctttcgttttgtgtttctgattttgattcgtaagttgttgtaaatttttctaagtcaacttcaattttaaagatcgctttagtctttttgattcgctggcgataatccaattttcgttgttgctaataaagttttgatttttttttatttgcttacaggattttgatgctcatcgaagagaacccttgattttgttgctgtagttcatagagattttacacattttgtggaatttagtggatttatgatgatg

SEQ ID NO: 2068 - DNA, 3000 bp, Unknown
  misc_feature (1)..( 3000): cDNA_ID_2025303_gDNA_ID_1620484_Annot_ID_158427 3000 nt of promoter + ATG
atcatttggttcattcgcttcaaccttcaattttcaacacatactagatcataacccgtacaacacgggcattaatattttttataaattaaattgtatactttgttcgaattacacaagaaatagtatagtataaaaatgatgtcataatatttttcaatgtttgtactatttgcatataatgctgcattagattgactttgtttaaaaatgttatttttataataaatacaacatatgtagttttaagtaaatgtgtaaaatttgtatacaagttgttttggtaaaaaacatgttttctttgtaataaaggatataatttttggcgtaacttagaattagtctttgtatagtattttggttatatatgtgaacctaattggggcctatattagattatctttaatagggctaactaaagaacggacccgataaccaacctaatacccgaaccaaaaaaccgggttaaggcgggttaaaattttaggaaatttccttattgggtagagttttagtaaactcgtggatatccgattggtccgtaaattacccgttacccaaaaagattattcaaaaatccaaacattaatttaatatccaaagtattaattatatttaatcgtaatattatctaattatctaagattataattataaatctaaatatatcaattaattttggacctaaatatttaaaacaactaaactattcaaaaattatttgttatgtttgtcaaaatttagtaaaatatattcaaatataattaaatttattaaaacttaacaaatttaaaagtttttttttttttggagacccgctatctacatacaaatttctcgtttctatttttttttggtatttttagggtctgaaacattttgtgcaaactgacccaaacccaactggatccgacccgaaccagaaccgaatatttaaaattattctattaggtagtaaatcatatacccattaatcccaaatccgaacgggttctacccgaactcgaatgggttactcatatgcccaaccttattctctgatttaattatctaaaaactccccaaaaaaacgtatgttttgctgactactttttattcaaaaaaatttacatcctcttctgccaaaattatttcataagacatcccaaaacccttggaataatgattccatgaatgaagaatcctaatttgaatataccaagaggttttgaaaggttttaagtttttgataggtgtgtatgtgagaaggtacagacatcgtgatggtaatctgcttatttataattttaacttgcagtataccgcaggtaaggttatattttagttaaactaaaaacttttattgtaaagatgattataaatatatgatattattttatttaattttaaatgtatagtaaactgcgagttgtatatgttttgttgctattatttatattgtttagtgtttaaaattatacacttgtattttgattgttaattttttagagtttcacttgtagtataccatcttgtattagtatcgatttaaacccgtcaattctaggattttccagcttgtattaaaaattgaatcacatcatacacataaaaaaatataatatgttattaattattataatatataagattataaattttaaaataatatgtatgaaattgaatataaatattcaaattatgactcagtactcagtagaaaattttcttaaatctatttttgacccgttataatatttttcatgtattgaacagtttatattctttttaaaaattcaagttatgtcatatgcgaaaaaaatataattattcttttataacgatggtattattttttgcaaaaatagaatcatataaagatgagaggtgaactataataattaataaaaaattaatatgataatttagataatgtattttgttttaattaaatttaattaattaaattagtatttgactttttaatttttaaagagatgaattaatttactctttaaattttatttctaatggcatacctatgtaattacttacaaaaaataagattatatttaaaatgtacttcccaaataatatagcaggaagttttcatttttaattatatatgtgccttttcatttaacaaattttccaacatgaaaagaagatatgttggtaaatggtaatctacaaacccaaataaaaaagaatataaaaaaaattttagttaaagataaatataaattctttatcaatactatttccataccaacttgtaaatcttcaaattattttgattagtatctatctacaccaagtaccggaacaagtttttgtgcaatacggaatcttcacctcaaaccaagcctaacataggcattcatcaaggctgaaattgtgcacaataacacgtacaaaaaatcatcgtaaaataaatacgaacatctctcgaaacagagaagtggtcaatggtggttatattttttctttttttgtggtggtgatattatgtaatatgattagtcattgaagaccttttgtagagagaagtggtcgatgttgcgccactttagcgttaacgttgacgtttggaaataagaagcaataaataaatcgacggtcaataattcctgctccatatatgttgacctacacgtgatgccattttggaatcttccaacgaaaattatttagttttaattcaattcaatatattatccattttgtctttctacaatacacaaatgaaaaaaacaaagtaaaattgaccaactaatatttatttactgatttgattggtcacaaactcacaagattttggccacaatatagacttctcggtcaacaaaaatttgtatttgatcataaataaataaacaattatttcccacttgttgttatgcgttttgaccgacttctaaaaaaatcaacgttctagaatagataacgttttggtataaaatcagtctcttcttctagtgactcaaaacaaactgtaaagtttattaagaaataataatg

SEQ ID NO: 2069 - DNA, 3000 bp, Unknown
  misc_feature (1)..( 3000): cDNA_ID_3065801_gDNA_ID_1620484_Annot_ID_158430 3000 nt of promoter + ATG
gttgatcccactccctccaatgtggctccgccactgatttgacccatcaaaacagtgtcacgttttatggccattagaaaacactcaccctacaaaattagtcatgtggtaaaaacccgagtcacacgctaattataaaacaaaattaagttgaagcgaacacttggaggatgaacgaaacaattgttattgcaacttgcaagttagtaataaattcaatatttcttttgtgtgtttgtgtctgttactctcatttgacttcaaatccagtctccaaaactatcttagaagaggtgaatgttacagtttgttaccatcgcaaggttcttgaggaaatcgtggagtggtcattcacttctttgaaacaagttcattttaaccactaactcatacattacgaccaaccaacaccacacaataacatcatttcatgtactcattatgtgaatatgaccaaataaatatgtctcatttgagatttaatcataatcatacatccaatatccattcttcagttttaaaatgcagtggtggtcaccatgactcacctatgacagttagtgtatccaaactaaaccgaagactgaaccaatgtgcaagacggaattatcagtttaccactggaaccttaaccggcctattcaatcaaaccaaccacccaattaagtcaatcaatcaataattcatgaaccaattagaattctagttaaccggtctagcttacatgttctcgaatttgattcaaactttaaacagatttaatgaagcaatttaaacagatttggaaaaaaatctcaaaactattcaaaccacagtaaaatatatttataaaatcacaattaaaaatatagcattaatcaactaagctagctagcgccatgcacttataattttacagagtttctaaaatatcctgactcttttttaaaattaatactttgttaacaatgaccaagtctaaaacttatctaaaaacgtgtcaaataagaaaaaaaaattagcaatttgaataattcaagatccctttaactcggaactaaagaaggtaattatttttaaatagatatgttctgtgtgaaaaaatctaatatcttctatatatatacataacctttcttcttttcagttttaaaaccatcaattcattttaatcatcgatcggtgatgaagaaaatctttcaactgtcatttactgtttttattattttcatcagtcttgtgctaggttagtctatacatttagaattatattaatatattacatatactcgttctacaacaaactgattttggatatcatactattattgtataacatcagttacactaagttatgtaaaattatagcaagagttttcactataaaattacacaatatcatatttagcattcttatgtctgtttcacaaaaaaaaaaaaaaaagcattataatgtctaattcattttagatttagacaattgagttgctagacctaaaaaccaatttcgaaatgtatatgaaaaataaaacaaatttccacctattttggttaattattttaattattaaaaattcgtcctgatatattgtaagagttattgtagtataaatttatacggcatatttcccttgttttatttcatcttcgattctttatgttcgtggtgcaaagatagatatgtattttgcctcataaatgttatgctccatagtttttgatataaattcatatgatatccttgaataaattttacgtaatctgtttttagttacaatatacaaagaactctctaaacatttttctagattagaaatatttttctctagtttttattaccaaactgacattttatattttaaatattatgaaaacaggagtggtggggaatgtacaacaaaaaagaagtaatcgatgtatcgactttccagttaacccaaaaactggattgtgtgttctcaaagattgtgagtctgtgtgtaagaagacaagtaaagggttagagggtatttgctggaagtttaatgccaaaggaaaagatcctaagcaatgcaaatgttgtggtttatggcctccactttactaatgttgctacccatttatttttaataaatattcgtattacaaagtaataaaatatttttatgaggtttgggacctattattttttacttgtattcacttgaaaaaagtaacatgaagctcagaattgtgggtgtaaattgcggatcgaatctactccttctcgcctataaaaagaacacctcctcctctcattttcttcattagtttttgctcagagctaaacgaaattctctcctatttttctctttctttttaaagtaggtctcaagagtatatgatttatttaaaattcgaagattctactatcgagtattgcgataccgatcttattgtgattgtattctttctttttatttttaaatcaggatttcgtgattttaccgttgggtggataaaatcgaatagcggagcgaagttagataattttttttcatatgaagtaaatcgaggtttgaatacattagatgaggaaaaatcatattataagcatagtgtaaataccaaccatcactaaacacccacaaaccttaattcatttgttatccgtaattgcttagcacaagaaataatcaaatattatttaaatagaaaattaaaaaatggcaattttgtatagcaaaatatgttattcttttgaaaattccatctgttacacattcctctaattctatcgattggaaaaatagtattagttacaattcccttctaaagcatccaatggccataatttttttatgattgttaatgaagagaaaacagtggacagtgtcatcacatggaattggttgtggataaaacaaaacaccccactccatacatgatccactcttctcctctcaatcttcatcctcactaatgaattaataatacatttaaatataaaattattgaattcattatttgctcgattcggaaaatcgtaattgaattcagata

SEQ ID NO: 2070 - DNA, 3000 bp, Unknown
  misc_feature (1)..( 3000): cDNA_ID_3065806_gDNA_ID_1620484_Annot_ID_158426 3000 nt of promoter + ATG
aacatgtggaaacaattactctttcagagatgaaacatgaagagttagaagcttttgttgagtttatatgcagtgatggctcaatgctttctgccaacgtgaaacaacatgctcgctcactctatcttgcggctgataagtatgagattctgcatctacgagacctatgcagaaccgagcttatatcttctctgagtttgttgaattctcttgacctccttgtgctcgctcaaatcccttttgacaaagtcctcaacgatgaaagtttcagttatataaaaaataatataagtacgattgctagctctgatgagttcaagttgttcgtcgccggtaacccaaatcttgccgtggagataatgaaggtttctctcattactcttactttacgctgttcctcctgtggttcaaaccatagtcttcaaggtatgtactgttgtaattgttgtcgctacggtactcttcgtttgatctagagaatcacaatgtattttaatttctgtcgtatcacttcgataaatctcatgttcacattttaaaagaattggatttcttcgttttctaaaacttatatagcaaatctcatattaaaataattggcttgtatatctatttatatctaataatatcttcttactatgcaaaaacaagacaaatgttaagaaaacagatcgattttatataaaccaagcgtattgtgtaactttattaatcatctcaaaggtacccgcgcacttggactagcaagcctttattaaagtggaatgtgttgttgattgtttcgtgattcctaatgagagaattggtgattgatattgatcatacagttattctactatgaatgatgaaggttgtgaatgatgaagaatctctctgaaggacaaattcgaaaacgagttactcaacatattgaaagttctcttaacggcctcacactttaagatatttcctttttaagtatgatatctcggtttgtagtgaattcaatattttttgtggtttttgaacccaattcctgctatggagataaatgtaggctactctgactccaacgattaatccatatagttcctactagcaaatctgtctagtatatgaattctatctcaataccactcgatctctagaatccattcactgctttaacttagggccataatgcaagcttaatctcacttaccccgcggcagagcttatatgacaaaagcagacaatcactaggtgaaaacaagtcacaaccaaattcgttgagggaccaatattcagagcatgacacaatcttcttcaacttcttcattttctctcggcaagatcaagtcaacttgaactcaaaggccaaacttagattatttatattagaatgacatataaaacatggaaaaaaaatatagtaaattattataaaataatgtcttacaaaaaaataatgtcttacaaaaaaaataatgtcttacaaaatgttttccaatgtacaacgacaaatagaattttcacaatgaggtatattcttctttttctcaatacaatgaaatgcacattgttggcaaaagataattttcatgtcatcgggaaaatgtccaatatgttcgtatgctggatcaatagtagagcttaatgaagggatagaaaactgagtttttccttctaaaatagattttgtcatgatatttgatgtacctagaaatagtttttttgaaaactttttaaattaaaatataaatataaattgatcaagaatgaacttacatgatgaaaccaaaactgcaatagttagaaagaaaaaaagtgtcttcattttcgttaaaatgttcaatattttaacaaaaacaaaaatggaatatatttgtgttttgagttttggttgtgatgttttaaagtcaagatagtagcatatttatatgtgcttttactaatgttacatagtactagtagttaatgttttatcaaacatattttcttagaaatcatagtcaaagaaactataaactttaatttacagtttttaatttaaagtatttcacccgtttcacaaaaagtgttgtttaattttttttttttttttttatgttttaaatcaaatctctgtgatgtagtttttaaaatcaaatctctgttttatctatgtgttttcaacttattaattaaaaataaagtgtaaaagaaaaatttagatgtttttattaatttgtgtgaaaaatggtacagttgttaataggctagaaactatttacctgttgttacatgtatattggcggtctaagcattaggcttaagttggtcgttttgctcttttatatgaatcacaagttataggctagaaactatttagggttcttggtgtgagtgaatagagtgtttaacatatctattgttttggttgtggggttgagaagattaggaattggtgactgactaattgtattaatgttgtaaatctgattaaagagaaaaagttcaattaacgttgtaaatttgattaagtgatttttcaattgcgtctacatttacataataacataattttctatcgttcgatccaaaaagaagttgatctcttccctcaaaacattattctgcttcttgagggtcacgttctcttgtagcatcgattctttttccttctccaaatttatggcatcagtttggaaactagctatggtctggtcatatagtcttatactatttttctaaggtgaataatctctttttatcgtcaaaatcatgatttaggcccatcaaccatatatgcataattgcattcaaacaaaataaataaagaaatacttactttacatagtgaaatatagacgtcgtatggaaaatggaaacaacatcaacaaaaaaaaatcaaaaatcaaaactcttcacaacctatctattgaaaacgaatgcttattgttttttacataactttcaaaattgaattagaggcaataacgacagtgagaatttcaaatttcatttctgaggcaatcgcataattcccaccggcgatcggag

SEQ ID NO: 2071 - DNA, 3000 bp, Unknown
  misc_feature (1)..( 3000): cDNA_ID_2047228_gDNA_ID_1620484_Annot_ID_158415 3000 nt of promoter + ATG
aaaggcggcacttagagtggctcatcgggtgcttggtgagagtaggggaggtgataatggttcgagaattagggcgaacgttgtggctcagctcgtgtcagatgagagagttgttgctctctttgctagtgaagctgtgactaaggagaggaaggcaatacattctgttctctggaacaggtatgtttttgccattgaactttcatctcccttggttaacattggtgtgtcatatttattgcatcttagttaactgagtgattcagcttggttacagtgattgataggttttgttgttgttttcttgagtgtatgtcttggggatctaatctgggtattttctgctgtttacagtgcttcagatcatttccgtgctaaagattatgagacaagtgcagagatgtttgagaaatcaatgctctatattccacatgatatagaaaatagagttttcagggccaaaggcttcagggttttgtgtctttgctaccttgggctctctcagctggatcgagctcttgaatacatagaagaagctgaaaaggtatacatttatccatggaacttctattttcaacggtcctagttggatctttcaactcagaattgctaactagttttctgtctctgcagcttgagcccaatattgcttgctcctttcttaaggtagactgtcttttcccccacagtacatgcttattcaacatatggccttcggctacctcgccatatatatgtatctggagattgtttgagaaaaattgtttcagcaacttctctttgcttctgattcttgcagttcaagatctacctgcaaaagaaggaacacagttgtgccattggtcagatcgatgcaatgacgtcctgccttgatttttctccagattatctttccctttcagcgcatgaagctatttcttgccaagcgcttccagttgctgttgcttctctttccaagtttctcagtttctatatctcaggaaaaaaaatgccaaccacagaggttgtggtcttccgtaccttagtcactatattgactcaagacattggcagcgaaaccgaagctcttaactttatgttgcaagctcagagcagggcttctaagcttgggacagagtgtttctttggattaggagagactggaaagcgagaacagaattggtttgctgcgacttgctggaatcttgggtcaaggtgtgggaaggaaaagaagtatgagctctgtggtgaattcttgaggctggcatctgaattttatggctatatagatactgatgagtctggagaagacaaactgatgatttgcaggtccataatactaagtgtcaccgctatgattgctttggagaagcaaaccaagagcgcactgactgaaacccaagtgaaacttgctgcagaattgctcgtgagagcaggaaaggtcttatcctcctctttattaatattacctgcagagttttacctttcagtttcactgatgtttggttatatatttgcagattatgtcttcttcgctctcagatggtaaagattgtatcatggagccagaactcatctttatgtacactttacttgcgtatgacatacacggaaggctcaacaattcggcattccagttacttgtggtaaagacgtttgctggttccaagtcttgtcattacaactatcttctccaacttggaattttcgcctctcaaagccctcagtccaacccggacgtgtcaacatttgctcttaacgaatgcctatccgctctgatcgcatctgcttcaccagagtacccaaccatagctcttataatcaggaagctgatctccatagccagcgtccacaaaggcgatacagacgatgaagaagcaatcttaaagatgtacaaacaagcatacagaatcatggttgggttgaaggaaggggaatacccgactgaagaagggaaatggctcgcaatgacagcttggaaccgagcagcgttgcccgtgaggctaggacagtttgagaccgctaaaaaatggctgagcatcgggttggaaatcgctgataaggttacaggtatggatacttataaagcttgtatgcaggattacttggctggttttcagaccaaagtttcttctgcttagtttcattcatattaactgtctcattagtttaaatgtccatgaaataaatctgagatatagaattgttgaagatgtttagttcatatagtacacactaaatcccctagaaaaactaattaaaacatgtaaaactatatttctaatcgcttcttgcaaacagaatctgctctaagacatattcatctctcatgggaattatgcaaatcttactaagatcaaaattcatttgaccgtagatttttatgatggaaagagtttgtggtcgtgtagagttattaagaattcacttagttttaggtggaggcctaaacttaagaaaggacataagatactgactaagtttgatcatatgagatcgtttacttttgagatgaaacgactttcacaattttcctctgcttctagatttatatctgtgaccgtctgattatataatccttggtacttgttgattagttcttgtcggcaaaggataatactctccaaaagctatgggattgaaaggtgtttgttttcttttgcttaaaattgacctttgacaaattctgtccaatagaatcttcatttttcatattgttcttcttactttcgtaactaaaataataactttgagagaaagataagtagccaacctttagtactccacaacgaaatttctcttaaattgtaatcggttgactaatgtcatcctcctaaaaatttcgttaactttgaatttctctttttcttcttacgattttcttaaatatatgtgaatagaatagagaaaatgtaaaacacggcatgtgtaggctataactgtttatataaaataataataatgatgtgtaaagcaacaaacgtgaggtctctccttcctctttagttggaaagaatttta

SEQ ID NO: 2072 - DNA, 3000 bp, Unknown
  misc_feature (1)..( 3000): cDNA_ID_2047224_gDNA_ID_1620484_Annot_ID_158416 3000 nt of promoter + ATG
cggttgagtatctctggcgtatgggctcatgatgtcgcttggagtctggcgagtgcagctgaagtgacaaggatgccaactgtgacatcaactctccttgaggccataaaagaaagcaggtttaagggtctgagtggtaactttcagttggatgatatgaagttgttatcagacaagtttgagattgtgaatatgataggatcaggtgagagaagggtaggattctggaattctaatggtagtttcagcaatagaagacaattatcttctactcatgacaatctggagaccataatttggcccggtgggtctgctcaaagtccgaaagggagaagtctaagagagagcggtagaaaaaagcttagggttcttgttacatctagcaatagattcccaagactgatgaaagtggagactgatccaataacacatgagataacaattgtcgaagggttctgtatagaagtctttcaggcatccattgcacctttcaactatgaagtggagtacatacgttggctcaatggaactaactacaccaagcttgcatatgcacttcatagccaggtactaagcatggctcgattttacaattgcaagtacttttaaaatttgcgtagactgtgtgtgggaactgacttaattccattgataatttttgttgcatcccttagaaagacaaatatgatgctgctgtgggagatattacaattacttccgatagatcgatgtatgttgattttacgttgccatacactgaaatgggtcttggaattgtagcagcaaaggagagaagtatgtgggtgttcttccaacctctaacaccaaacctttggataacaagtgcagctttctttgtcttgacgggtattatagtttggttgatagaaagagctgagaacaaagagttccaaggatcttggcctcaacagattggagttgtgatttggtttggcttctctacccttgtttatgctcatcgtaagtaccttttcacattcttatataccaatttggccataagagaagagattgtagtgatgcttaccttttgttgcttactctgtgtgacaggggagaagctacaacacaacttatcaagatttgtagttacagtttgggtatttgcggtgctcatattggttacaagttacactgcaacattgacatcaatgatgacggtgcaacaaatacgattcaacgccaatgaagattatgtgggtcacctctcgggatccctcatcgcaaatgcggccctcaccaattccagcctcagagcaatgagattattgggtctcaatacttcagaagattatgctcaagctttgatgaataaaagtgtctcatatattgttagtgagttgccatacctgaaaatcctccttggcgagaatcctggacattttctcatggtcaagacacaatctaccaccaatggttttggcttcgtatgtatccttcttctgcatcatcagttgctttactcttgattttacttgttgaaaaagaaatgtttggtttgttatactatgttccagatgttccagaaggggtccgagttggcgcctaatgtgtcccgggagattgcgaagctgaggacaagcgagaggctaaacgagatggagagaagatggtttgataaacagcttccatacacaaccgatgatacatcaaatcctataaccctatatagattccgtggtttgtttatgatcaccggagtttcattcgctttcgctcttgcagtacttctcattctttggctccgagaaagatgggaaatccttgtgaattcggtcaatatatacttctcacaacgacttagacatttcaggatcctcttcacaagaactatccatcctagtcccctcggcctcgataaccccattggcgagaatgcggttcaaatggctcaacgtaacagacgataggaaatgagtaacatagagagaaaacaattgttgtgatgtggtacgtctctgactctgaccttggagcagcaaagaagatcctccagtgatccactagctcctgatccaagccggcttacgtctgaaagtataaatgattgttataccaattttgtaaattatagtgtgatcatattcgcaaccacttttgtaaatagcaaaaaggtattggtaatatattgagttaaaatttaacacatttagtttgagtattttttggagaatatgatacttttgcaaagaaaaaaatactttaattcttcattttataaaccttaaaaaatgtaccaaactttaatcagtatgtaaaagactcgtgcatttcgtttgttggtatttgtgtttaatttcttccatcaatttatttgagatgagacgactttcaccatttttctctgcttctagatttatatctttgactgtctaaattgtcaaatcccttacactaagtacttttgttgatttgttcttgtcaacacaagttaatacaaccccaacaaatatggagtttttaaccaaaaaaaaaacaaatatggagttctacgtgtaaaaatttcagattaaaacacatttgttcctacgaccgttgacaaatgtttttttttttttaagacaaatgatttttttcttttgctaaaattggttagttgacaaaattttatcctatagaatccttttcgaatttattccgtatttttacctttttactttcttcaccaaacattttgatagatttagtcagattctcttaaataatgaaatgatttgagagacaaaagagtagccaaactcgatagcccataccgaattttacgttgactaatgtaatttttcttaaaatcatgatgtcatcatcttaaactttgaatttttcttcaaatatagtacgtatgttaatttttaaaattggaataattagacagatgaaaaacaaaacacggcatgggtttatataacaacaaaataaaataatgactaaaagcagcaaacgtggggtttctcctttctctctagttggaaagttttttta

SEQ ID NO: 2073 - DNA, 3000 bp, Unknown
  misc_feature (1)..( 3000): cDNA_ID_2047218_gDNA_ID_1620484_Annot_ID_158418 3000 nt of promoter + ATG
gcctaacgccgttaagttgttcgacgaaaagcctagcttacaaaaaacaacactaaagcaagcccagatgaaaacataactctatggaaacgtagaaatacgtactaacgagtaagtaacgattacatgtaacataaagcttaatgcctataagttgttcgacgaaatgccaagcttagagaaacgaaacaaaagcaagttttgatgaaagataactcaaaatacatacgagggtaatcatttcttcaagaacggaagtcacttgttcgcctcctttaagcaaagcttcatactcagctggatctaatttatctttgacattagtttgattttgctgagttccgtatctttcgaacaattcttcatcggtgtatccacctccgacctcgtaaggagcgcaaaattgaaccagacgcttcagtttctgggtttgctttggacggaacgaagaagaggtgaaaggaaatgagcaaataaccgatggaattatgagagattctcttttagaaggtgatggtgtggaggaaaaacgaagatgaatggactgtaacatagtttgttttctcgtttcggattcaaaaagtttgaggttttgggtttatgcaaaggaaaaaaagataaagaatcgaagaagacgacggggataaattggaaaaaaataattcgacaaaaatttaggaaatatatgcgccgtctgtggggatcgaacccacgaccacgtggttaaaagccacgcgctctaccactgagctaagaaggcttggtgcttattatgtaaagtttaaaattttatctcaaaataatatacccaaattacaacaaaaacaaaccatttcaagaattctttacataataagtttgtaatgattgattggtttgtcaaataataccggttatcaatattggttatttttataacactacttaacttgcagctttaagctaggtaaatggcacaaaaggataaaacctattaagctttttttttttttgttaaaagttattaaactacagtttttatcattaatattcttagtttgatacacaaaatcaggtttcaattatggaaatcttcctagttgagatcagcaaccatgtggaggaagcatggaggggtccaaatgatataatggtgttttatgattcttattaagttcattgcctacttagacaaagttgagcgatcctatttataatgccatataaagatctcaatttatttatatcaatatttttatcaaatggtaaaatgagaaacaatgtataaatgtgtatatatataaacataatcgcttaattacaaatataatttaatttaattgaagtgaggaagctatagataaagtaggcatggcaaaggattgcttcatattttctcaattattacaaaatctctctttctttctcattcactatgtctggcacatgctttatttcctaatcctcttttaggagtagctttttagtacactattgctatcaaatattttgtccatgcttataacattatagacgttacctataacagtggtttatacatgattattaatagttatagacttaagagtagaataagatgagcaataaagttatattttgtagtataatcggatcaacctttaactacaactcatgcactttttgctgactcaattttctaaaacataatggagatttgtcaacgagttttatgtgtgtagatcaaagcattgcaattacttcagaatgctttgatcgaaaaatattgacacgaaaaatatttgtcaagtgaaatattttagatgaaaaatgttcgtttaatatgcgaacttttaaaatatagttatttaatacgtgaaattcgtatatgggtatttaatacatgtaaaaattattgatcggtcatttcatataaacttaattattaaccacactaaaatctacccgatgttatttggcgttaatagacccgataacaactattaactagtcttcgttagttcccaaacgacgtcgtttcaccataatcgaaatggaaaacatgtcatttaatactccaacttttaaattatagccgttttatacatcaacttcacatgtgaccattttatacatgaactaaacgttaatctgcggttcgaaatatgagaatgcgttgattaggccaaaaagacatacgactatctaggcctaaacattggaattacggtttggattcgattcatatttatttggattcagataattcggttaagagaatttattatttgttaggattttataaatctacagttcagataggctcgatttttgggagaaaacactaaaaaattgttcaatttaaataaaaattagtttaattttactaaattttggctaaactttgcaaaaatatgttaaattttaatgaaaataactaaatatctaggttatttaggatatgtctcttatttaaatgctatttttggctcttcttttttagttataaataagttttacatcaaattttgtttgggcttttcatataaaaactaattaacagaaaaatagtaagaaacaaatattgagaaaaactagtcatctttttttgttcaaaaactttaagtcaataaagtttgaacttttaaaatgaatccaccttataggatgaataaccaaattactcaaaacgaccgttacattcagctccaactagtttattagccgtaacttcataaataccctatttaccctctcgaatgtcacgagaagtcattaaaggtaaagggtagaatcggaaattcacaaaatctcaaacgacaatacggagtcatggacccctccacaggtcacagttttattgccaacactaataaaaaagttgattgcgaaatttaaaatcgaaaaagctaaaaggggtagtttcgtcataaatttgaattttttctttcactgccagctctgctttagagcttctctacttcttcttcttcttcaagttcgcttaagagatcgatcggagattcggagtagagaaaaatg

SEQ ID NO: 2074 - DNA, 3000 bp, Unknown
  misc_feature (1)..( 3000): cDNA_ID_3065820_gDNA_ID_1620484_Annot_ID_158417 3000 nt of promoter + ATG
ctaattctacgtctttaaaccagactttttctctagctttcgacatgcatgatctatttttaatacggttgattacaaatatgttccattcaaaatattctcaaacaataatttaaccatttatacgcatattagcaaagatatgtcattcgaatttgaccaaaaatgcgcacatggttatcatatcctagaaaactttcaaatcagtgattatcacattccatattcaaactattgctatttatttatttcaatatatctatatatataatattaattgtcaacaaacatataaaaccacaagtagtgatgctagttgaagttttttctttttcttattaacgtataagtcttttgagtctatgaccatctacatccatcagtagtttttaaatttatctatcaacttgacatacatataggactggctttgcctaaatggttggccctcctatgtcaacttgatatacatatagtaatcttttaaaatatatatatctagttgttctggtcggaccgtattattgtgtgtacaagttcgtacatattaacgtgtgtgatgtctatatgttaaaatgtcaactctaattagctatatatacgttcttaattctcctagtaattatatccatatcttaaaactttccaacaatcttaaacacaaacacgcaaaagatggaaaagagtcttcttgtcctctgtctcattttgttttttacttatagttacgtctcggctaattactatccacctaaagccttagtatcaaccgtctctaagaacacaatcttgcctatcttcaccttcacactcaacacaaaccaagagtttttcattcacatcggcggtccctatcttgtccgtaaatgcaacgatggtctccctcgtcccatcgtcccttgtggctcccccgtatgtgctctaactcgtagattcactcctcaccaatgctctcttcccagcaacaaaatcatcaatggagtatgtgcttgccaagcaaccgcttttgagccattccaacgtatatgtaactctgaccaattcacctatggagatttatccatctcttctctaaaacctatatctccttcggtcacgatcaacaacgtttattacctatgcatcccccaaccgttccttgtagacttccctcccggtgttttcggccttgcggggcttgcacctacggctctcgccacttggaaccagctgactcgacctagactcggactcgagaagaagtttgcgttgtgtcttccttctgatgaaaaccctttgaaaaaaggtgctatttactttggtggaggtccgtacaagctcagaaacattgatgcaagatctatgctctcttacactcgattgattacaaaccctagaaaactcaacaactatttcttgggactcaagggtatttccgttaacgggaataggatcttgtttgccccaaacgcttttgcttttgaccgcaacggtgatggaggcgttactctaagcaccatattccctttcactatgttacgaagcgacatatacagagtctttatcgaagcattctcacaagccacatcgggtattccacgtgtcagtagcacgacaccctttgagttttgtctttcgacgacgacaaatttccaagtgcctaggatcgatctagagctagctaatggtgtgatttggaaattgtctcccgcaaacgcgatgaagaaggtcagcgatgacgtggcttgcttggcttttgtcaacggaggagatgcggcggcgcaggcggtgatgataggaatacatcagatggaaaatactttggtggagtttgacgttggaagatctgcttttggatttagttcttctttgggtttggtcagcgcttcatgcggcgactttcaaacacggccatgagaatgtcaaaacaacttgatagttgacattatcttgtgattgaatatttatttgtcagtactctggcttcatttgttatgtaacattcatgtcaagtgtggttttaaaaaatttagtcaatgacgaatgtcaaagaatgtaataaaacactaaagttttatcttattattaatgaaccttaatatataagttgcgtcgacaagtcatttcactttatataatattaaagatgttacataagtttgataaaccatgtcaattattgctgatgatttttttcttacttcctttgttactattagtgatttatttggttatttttcgtcaaaccatgtcattatattaaaggggttatataagtttaaactactatgactactaaacgatatgtagttagtgaagtgacttcttgcagatttagcaaatacctcagctacttggttagctcctttttcacaaaactacaagtgggatgagctaactctagtacatctctaattacagtatgttggtatggcaagatattttcgaaaaaccaccagataaaattacctaattaaaaatcaagcatcttaatatataagactctcattcaaagtgctacgtatctaatcttaaaacttaaatggcttataaatggatttttttcagtggtgaaaaatcccaaattatgttcaatccaaggatcgttcatttttgcactttttaagtttctaattgagtacaacgatatatgtcaatgtcagtgtaataatacaaaaaagttgtaaactaaagtcggaattatttgattttcttgtgttaaacccataaatccgattctccaatccaaagcatatgaagaacaaacactacatgagaaggttttgctttctttaaactacattccgttatgcgattctacctacaaactacatgacgtttttgttcacgtagtacaaacagcacgcatgtctaacaagaagatacaaaacggccaatatctcttccttgtctatttttgcatgttgttgaactcgaaactataaattgtaacaaacttcttattcttcctctgtgagtgaaaaatcaaaaatcacaaaagaagcaagaaaacaaaaaatg

SEQ ID NO: 2075 - DNA, 3000 bp, Unknown
  misc_feature (1)..( 3000): cDNA_ID_3065827_gDNA_ID_1620484_Annot_ID_158413 3000 nt of promoter + ATG
agtagcagcaaacagagacaattatagagccagattacaaaaactaacctacccatcatcataaatccactaaattccacaaaatgtgtaaaatctctatgaactacagcaacaaaatcaagggttctcttcgatgagcatcaaaatcctgtaagcaaataaaaaaaaatcaaaactttattagcaacaacgaaaattggattatcgccagcgaatcaaaaagactaaagcgatctttaaaattgaagttgacttagaaaaatttacaacaacttacgaatcaaaatcagaaacacaaaacgaaagctttggtctttgtagtcgtcgttgtcgtggtggtggtgctcttgttcataagtgttgaagagcacaatgaagaaggagaagaaaatcgcatctgtggctaagtggttatgaatgatgatgatgatgatgatgaagaaaggagttgggaataatttaataaaggagtcgtctttgtgagtgagttgactgggactttggatcgtcgtcgtcgtctagtgaaagttcgtgaagaatggggcaaagaaaagagagacactgatgatgagaacgcaatgactcccaacaaaaaccaaatcggtctttgcgcgttaaatgttttttttttctttcttctctttttgacttttcaacatcatcatatatattatcttgtttgttaggagatggacaaatttttcttccatttggtatttttcgcttttcattcgtttttagataattctggatattttgtaaatggttttggtgttttgaccaaatcaaagaatggaatatgacatttacaagaaatgttttcttggtattagtttttgacaaataccaatgcataataatttgtatcacaaaaattgaatatcatgtcacatatttaaatacttattaggagtagtacttattttgttgttgttggaatctttaaattatgggttgacagttatatatatatatatatatataaaaagcttgttcatttagcagatgtacccgccaaccacggttcagcaaacaccccaaaatgttaattcgtgttgtttatgtattgtcagtttgtaacataacgattttagaaattttacagagtgtttatatacagagactctaataccatgtagactaagagtatatcgaatatatgaaacaagatgattacagagtgtttatatacaaagactagaaagctactgaaggaaacttaatattgtatacaatgattatgagcaattaacgtgattgacgatattgattctcttcattatcttgattgatatgattatccttgatagtcagtttgtaacataacgattttagagaggagataaaccacgaatcacaacctctagtctctcccaagccaaatccgccattcgtgacctgaaccaacttcgaaattcatttgatatttgtaatgttttgtaccaaatcattcaccatatataatacaattgtagaattccaacaatttgggaagttgtaagatttatttactcttggtttagtctttcctctttgacaaataccaatgtataaccaaactatattttcattgttgctcttattaagaaaacaatcatatataaattttgcattcaaaaaaattagacacatagtttcatccttggagacaatttatatgatcgaaacatccgatgaagaatatcagtctatgaaagattgtgcaatctagttttttccccattataacatagccttaagcatgaagccaaagcttcgtcaacaggttaaaaagattgggtgtttggtaaaaaaagttaaggaatttaaagagtgattgatacacatagatggtgaatataccaattaatagaaaaaaaggaggaaagagtaaattacaagttcccggcagtttcagacaaactcacgtgacgcaaactttaaagggtttgactagagccacataagctgtctggtccgaaccagatatgatagtgaagaacgagccattaaaccacaccagtctctctcacgtgccaactaagtaaaattgggtgtgcttaataaagtgtctgttataaatcgctttgcttccttttattttgcctctcttctactttcctctttcctttttagggatttcactttcctcttctctctctctctctctctgcctaacctcgatttctctcgatcgctcttcaccatggatctacgatcatgtggtccttcttgaagttttttgatctcttcttcttacgggtttttacttcgtttgattttcctggtaaagttgctttttttttatcttctcttgaggtatatactttttttttgttttgagttcatgttcgtgttctcttcactgtagctagggtttgttgatttctccacaatatagctcaaaatttctgctatgaccttgaattttggtcgtgaagtttgtttatgtgatggattaagctgggatttcatagaatcactgaatcagcttgcttgtttctactctcatttcgtcatctactcttctcttaatctgtatttgtattatttcagctaatttttttataagtacgtctgattagttcttgaggttgaattatctttgtgactaaaaaatagtgtgaatttttcttgaatggattcatttttttgggggtttcttgttcatttgtctttacttgccttgtaggccattttcttacatagttgtccactatgacttgtacggtcttgttacagagctaatttgtttttatctttaacgagtgatattgtcattggatagttttgactgatctttgtttatctgttcttgatgatttttttttttgtagttgtttgttgttcaaggatcgagatttcgtggagctctctattcgcagcttggagattggacttgtttgaattggtaacaatattgtgtctggcctctaatgtcgttgtactcatgtttgtttttatttgttcgggactttttaatcattacttaaatttccgttttatttaggctcttttgtg

SEQ ID NO: 2076 - DNA, 2400 bp, Unknown
  misc_feature (1)..( 2400): cDNA_ID_2047330_gDNA_ID_1620485_Annot_ID_158445 3000 nt of promoter + ATG
gatcactcattgactctctctctccgttacacttatgttctcgacgcgaccttccaaccataaaatactaatttcatttttattttcacttcatcgatatcttgtgacatgtaatatgattggcttatcaaaaatctttcatacgaattttcaagtttgttcacatctctctcccaagatatccgtttaggagcctaggaccgttacttcactttattattttcatgtggaggaactgtaatatatatcacaattttgttgttcttgttgattgtgtaaatagtagtactggatactaaagaacaatgagtatgtatctcaaatatttagctcaaccgttttataaaaatactatattattaccttaaaattgtttgttgctttatcagtattaggtaattatgagatgtcactgtttaatctatttaaacgttttatgagttacattaatgaaaaaaatctgaaaagttaaaattatacgaatacatacctgtctgactctacctactgaattttgtaaaacaatttgttatattttataagaaagttgatgttgtagtgtttactgtctcataaaaaacaatctctatttatttgatttgagacttgaaatttttaaagcttgttttaaactatactgtttttcttataaaaaaattgtattaattttttttataaatgaaactgttaaaaaaaattgaaaatttagagatcaaaactaaacctttataatcattgaaatatattggtacatctacccacaaaacaggtcaatcgtctaggtttaattataattaagcctaacatgttaatgagattcaaacgaaattaaagtccacaatgccaactcaactcaagtatcaaatctttttcttctttttttacttagcaggaataccaaactcaagtatcaaatcttttaaaatttattttttacttatgtcaatgtgggaatgaccgagttacttaagagttatgattaatattaattcttgtttctaaccaattcatatatcattgtcttggaagcttcttcatatcaatgactcaactcttaatttttttcgaaaatctgttcttacaaggtcacacaattcaattttttttttgtattgtaaatgtttatctcgttatatttacactaacgagatttaaacacctaaaatcaaattgtacgagactagtgttagttattcaatagtatgatgcattgatgcaacaaaattcgttgcgattatttatgatccttatcactaccatgatcatttccattaaggttatacttacttcctttttgatgcataataattactcaccaacattgaagcgtggtcgacattttcattggcaataagcataacattcatttatttatattaaaacacagaaacaaacaattattaaataaagagttctggcatttctctattttagtccacttaatttaatactatcatcttcaaacaagatttcatcattaataatttaaaaaattatacgttacatagtgtattaaatgaattatcgttgggatacactttcacatttttcaaaaacgtatgaatcataatgtgacacatggagatttcccacaaccgaggctcccatagtagatgcttatgcaattcatattcttgcagcttaaactcttgcaagttcagtaataacaccgtgatatgaaaaataaaacttagccctttttaatttttgaacttattcagattaattaaaagcatacgtagcatatttaagaatataaagcagagaatcaaaataacatattgtttcaatggcacccattttagctagtcgatcagtaactgcattcgcagatcttcgaacccaccaaaaatcgacagcttcaaatcctttgagccaatatgacgctaaaggtcaaaatattatgaccctaaatgtcagaaattgaccccataagtcataagttaaccgacaccaaagctgatattcgttagagtttagactctccttttcttaatgatcgttagttttagttgggaactcttgggctatcggttaaaattaaataattgtggtcctcttggcccattagtgctgtccaaactggcccaatatgacccagtggatggtcccaacaaacgccgcgacaaaactccgtcgctggctgaggcaatgttcaccggtggtggtagcttttcttctactccgacccggctgaaaatgcaaatccctaaccctagacacggccatggtttataaacctcatcaatttcttctacttatctcttctcaaagctaaaccctccaagatattcctctattaggtgcaaaaatcaggtaaatctctatctgtccgatttgaaaccctagatctgcctttcttctctcttcttttgcttttctgggttttgctcaaagatg

SEQ ID NO: 2077 - DNA, 3000 bp, Unknown
  misc_feature (1)..( 3000): cDNA_ID_3065846_gDNA_ID_1620485_Annot_ID_158466 3000 nt of promoter + ATG
ggttatatctagctgagctttcaaaatgctcaacctcaaatcattctatttcatcctcacaaaaagctctcaggtccttaaagttgatcccagccgctgcaagaaaaagccttcctgtcttggtcaatcactgtggattactactctgcataccagtatgtgaaatcaccattttaaatcatttgttttgtcggatttaactataagaccatacattgattctcgtctctgtgttttcaggctattggcttcagttattgttcatgccttgaggcatctgcagtgtttcttccaagaataccactcggaggcggtcatagctcatttctctagtctagccatatcatgttgcattcattcaatactaacagacatttattcacttgtactgaattctcgtgaaacgaaataatatttgattcaagaatctgtatcctaggcaacttccgttattgaaaatcgccaattacactcgtttttgttttcattcaaagtttatgacagggaaaacgatcatactccgccttggccacctcgttcttttaatggttgaaatgatgaagtaaaccattgcttccaagctgcgtccttctgttgctcgacccatgagaggaaggcactgtctactaggcaaaagatgttgacgtaaagcaactggtattgcacgggaacatatctgaagtttgcaatctgaagaagtggccatgctccgccttcaagagctagagccggaagaaaatctctcttgagtccttctttcacttcagctgtgttctttcctgtggcgaatcccatgtatgtgaagaacaccagtagatctacaggtccaaagataagaccatccattgcaacttttgcagctacaaaacgtgttgactttggtacatatcgaagcttcagttttatgaatttatccaagccttcgtacctgtgcaaccgcaaatagaacaatatcaggtttatcaatctaccatagacaattctttatcagtatctgattcagtgtcactagtttatgtgagcggtaacacgaggaaaagctataacgaaatgatctgagatcagaaggaaacaaaccagaagtggccaacaggtccgacaaaaccaaatccaaacatgctcgtgatagctactcgcttccagttgactttgaattctgcatcttgcttccacttgaccttaatttctgcatctgcgtcagcatctttatttgtttcctgttatattgaacatggttttagtgcttgagccaaggtaagtcaataaaatctcaatatatagcctaaactcagaaacaatataccatgacctctaaaggcaaatgaattttaaggattgtctcacagcagaagatgttataagtaaagaagtatcgcataatttcataaaaggtaagcagtagactagagctgctaatccataacggcatgaacatgtatcaccaatggaccaaagggcgatttatattgcaatgttaacatgaaaataccacaccaacaacatagagagtcacaaaacacattgtctccattagtatcttttacgtattggtatcaccataccatataagctctcttctgaactgttcaaactttgaaaagaactctgaagctgtagtagcccacagttctggcttaagcattaaaatgtcttcgattgttggaaaaaatagccattaggaaatcatggaatctcagcaaacaagtaaatggacgttatactacaagaaatttcacacagccatagagagagcctagaaaagaatccgagtgctattgctcaattacaacttaggcaacacaacctaaagttccagtatctatctaatagagaccataagctaacaagaaatcacagaaaactgtaaacggagaagacgaactcaaatccttgaaagatttagcagcaagaaggtgagaacaacgggaaaatattccaagtatcaaagaaaaactccagaaacagcatcaaggtctaaggaagaactacataaatcaacacattgatgaagcattaccacattcactgaaatgtcgcgaatatactgatgcacaagaaccaattgacgcagatatatcacgaaacccagagatacatagatgcaaattcaaaaacctaaaactaatttcatcaatccgcacgaatcggagagaaactccaatttgaaacttcaatcgaaggtgagagagagagaaggagatcggaaaatgactaacggtgagacgaagaagacgacgtttcgcagtggaatgagtgatgtattgagcggtgacatcgccaaatccccaaagaaatccagaactgatgacctgagttttcacaggatgaaccgtcaggcatcgctggtaccatctccaaagcttcaacattatgtaccagccgtattcgccgtcgccgcgagagagagagattgggacctgtcacctgtgacggagagccgccgtggaagaaggcgattgtgattggttagaagaaagaggttgatacagtgcttaagctttcttcttaaacgtcttcttctctttttaattttttaatcacttctttttttcgagtcaacagtcaacactacaaaaaggctgttgcaatatcattgggcttttaccaatcaacattttctttccggcccattaacatttaacattctaatttaatttgttttttgtgttgacgatgaagaaaattgggtcaaatgagaaacctctcattttaacctctctattttttaggattttaaacccccaaaatttccctatacactctatcttgcggcggaagaaatctgtaatcacaaaggaaaaggttaatagttttttttctttctcttttttaaatattttgttttgtcgtcatcgaatcttttcgtttagggttatctgatgttacatcaaggttaaagaaaaccgataatcacagaagcatatagaaatcgtttttgaaggtacatcgatcatcgttgagacttactacgttacaacgatcatcgttgagacttaaaca

SEQ ID NO: 2078 - DNA, 3000 bp, Unknown
  misc_feature (1)..( 3000): cDNA_ID_2047274_gDNA_ID_1620485_Annot_ID_158464 3000 nt of promoter + ATG
aacacaatggcttggacacttttatacagatactgacatgatcagagcaataagagaatcctagttgtggagagttaataatcttgttcaatcaacatgataaaagagaaaaaacaagggtataaatatgcaagaaacagattacaggttttgtagaatatactaatcaaaaatgcactaaacttggaacataagagcacacaagtgggtaaacaaatttgtctacagacattccaaggtccacttgttcccaggttccatccactccaacgatgtaagctttgttgcgagaggacgctaaataacgtttttctttatcaaaaacaacaacaactctcttctcctcgtcgataaagaaactcgaagctctaacttgaaactgaaacttaagtgagtgcatatccacagctaagaacaccttgctgttccacaacaccgcattgggctcaattttggttgttacccagatctgcatctccaatgtacttgagcactgaaataaaacagcaagctgctcttctctaacactagatagactcacggtatctaaaacacacggctgactcggcagaggtaaacgcgacctaaatctctctcttgtgaaatcaaaacagactaagaaagtatggccgtatccgtgcctctctctagcaatccagtatgtatttcccttgagagacacgccacgaatataagaatctatcttccagtctggagacacatcaagaaccttccatgaatcagagttgatattgtagattttgaactcagaacaagtgggagaaaaatcaataaatctcaagattttgtagctgcggcttgatttgctgctcttcttgtatccgagagcatacgtatacatgtccaatttgtggaaattatttgtagactcgatccaccgtgtttgcccccaatacgggttccaaagaacgaccttagcgttatcttcgttatcttccgtgatgcatagcaataaaccgtcgcagtgaaagacttgagatacatcgacttcatcgcccaagctaataagctcaccttcaggcttaatacacgactcaatgtcattgtgaacgttgactcgaatcaaataaaccctaaaatccatcatcaggaccatcataaactctttttccttcgctgctactattgcttgataaccaaggtgattctttgcaaagctctcacctttagataaagtattccaatctttacaagtaagtcggacgtttctcagagatgttaacgaaaccctagagagcacctcttccgccaaatcattagggagattagacatcttcgtcattgtttaagtctcaacgatgatcgttgtaacgtagtaagtctcaacgatgatcgatgtaccttcaaaaacgatttctatatgcttctgtgattatcggttttctttaaccttgatgtaacatcagataaccctaaacgaaaagattcgatgacgacaaaacaaaatatttaaaaaagagaaagaaaaaaaactattaaccttttcctttgtgattacagatttcttccgccgcaagatagagtgtatagggaaattttgggggtttaaaatcctaaaaaatagagaggttaaaatgagaggtttctcatttgacccaattttcttcatcgtcaacacaaaaaacaaattaaattagaatgttaaatgttaatgggccggaaagaaaatgttgattggtaaaagcccaatgatattgcaacagcctttttgtagtgttgactgttgactcgaaaaaaagaagtgattaaaaaattaaaaagagaagaagacgtttaagaagaaagcttaagcactgtatcaacctctttcttctaaccaatcacaatcgccttcttccacggcggctctccgtcacaggtgacaggtcccaatctctctctctcgcggcgacggcgaatacggctggtacataatgttgaagctttggagatggtaccagcgatgcctgacggttcatcctgtgaaaactcaggtcatcagttctggatttctttggggatttggcgatgtcaccgctcaatacatcactcattccactgcgaaacgtcgtcttcttcgtctcaccgttagtcattttccgatctccttctctctctctcaccttcgattgaagtttcaaattggagtttctctccgattcgtgcggattgatgaaattagttttaggtttttgaatttgcatctatgtatctctgggtttcgtgatatatctgcgtcaattggttcttgtgcatcagtatattcgcgacatttcagtgaatgtggtaatgcttcatcaatgtgttgatttatgtagttcttccttagaccttgatgctgtttctggagtttttctttgatacttggaatattttcccgttgttctcaccttcttgctgctaaatctttcaaggatttgagttcgtcttctccgtttacagttttctgtgatttcttgttagcttatggtctctattagatagatactggaactttaggttgtgttgcctaagttgtaattgagcaatagcactcggattcttttctaggctctctctatggctgtgtgaaatttcttgtagtataacgtccatttacttgtttgctgagattccatgatttcctaatggctattttttccaacaatcgaagacattttaatgcttaagccagaactgtgggctactacagcttcagagttcttttcaaagtttgaacagttcagaagagagcttatatggtatggtgataccaatacgtaaaagatactaatggagacaatgtgttttgtgactctctatgttgttggtgtggtattttcatgttaacattgcaatataaatcgccctttggtccattggtgatacatgttcatgccgttatggattagcagctctagtctactgcttaccttttatgaaattatgcgatacttctttacttataacatcttctgctgtgagacaatccttaaaattcatttgcctttagaggtcatg

SEQ ID NO: 2079 - DNA, 3000 bp, Unknown
  misc_feature (1)..( 3000): cDNA_ID_2047315_gDNA_ID_1620485_Annot_ID_158451 3000 nt of promoter + ATG
gctatttcgtcgttgtatttagcacatatttatccatatatgtaagttggaaagtccatgccaaagaaagatttgcagaattaattactaccaaatgttaggggtggaaaatctattaccattagaattgggatcacttttaaataaatttcagtgaaaatattaaaatatctacgatacgtcatcgactttttatggattttttttgtcttaaaatttactaaggatctaaatggtaaccaatgattttttctaaattcgtctgaattgttgattcaggctgaatttttagtgattttcagctgaatctgactaaatttttacattttcaaatggtaaccgatgaatctaccttaatttttgtttttgtgatttgtggtagaatctgtcaaaataattaagactttaactgaaaagtatcataaaatatttatgaatattgatagaacaattaagaaaatataaataaaatagacaaaaatatctaaaattagtactaatgtctaatgcaaataatatattggttagcaacattgaattattcttccatatttaatttttgaaacattaaaaagacgtaaaataattaacgaaaagctttgtcaaagcattattgaaaaattaatttcaaaagttaacatgaatatatagattatctaattattattttttaattattccctaatactttaatcaataatatgtattgtcttcaattggtgattaactcaaaaattttaacttgatcattagtggtttagccagtgagacagacaacttggagagtcacaaagtacgcgaaaataaggtacttctgcaaactgatatggaaccgtaaatgaataaagaaaagatgcgacaagttggggcttggaagaagcatcaatgaatccattattgttctagaaaatgatgactatggactgtggagaagaagaagaagaaacagtttctttgaggtcaagattatcattcattggcaaagagaatacgtttcaagtctataaactttaacaagtaaagatgttcctccctgcgctctctactccctcctttaggggttacagaatgattaacaattaaagcgagtatattgagtttttagatttgacttccgattatgattatcaatcttgaaatacataagagagtatatagtttgaagaattgatatataacttttattgataaacttagattataatgcgattgtaaatattattacaaacattcacatttttgaaggattaggttgcagaatcctcccctgcgacactgaaaagtacagtcgatgtccctcttgcaagatggggatttgttcaaagtgtcattctcatcgatgataccgtactgtggacttgcggcttcaccttcaacaattacgtcagcaactccggtcagctttcttgcttctgctccaagatcttctcatccatcatttgcataaacaaaatggctttaaggttagaaatttccatccactaataaaagttctaaaagttaatacgatcaagatcaaaccaaaattttgctcgttggtaaatgttattttccaccaaaaatgaatcaaaacctagaaatgaattatccactacgctcttaaaacttgtcaaattgcaaaacaatataattattacttaaaaagattcaggattgaatatgttttcacgatattttagatattcagttagtatgattttcatatgttttttacttcttgtttctgtcacttgtaacaaaaacaacttcctacaattgttgacaaacgaaaaaataaacttactagatgtgatgaccaaaatgaagatcaagagtgggagcttgagagaagcgttcttcattttcaaatttttagaatgggagctttggatttttcaatgtttagtctcgtgaaagtttgctatgtattcgtagtcttttagccataaatttataatgtggcaaatcaattgttcaggctgttgcctagtcctggtcaagattggagatgttatcttaccaaatatgaagggtaaacaatgtatcaaaaactattagtcagatcttattaattagtcaaaattcaaaacaatatttctgtaattggtcatgtgtatcttgaccagaaaagctagcagaccataacttttgtaacaaagtataaaaagatatttctatggtgcttgatattttgtaaatttagtagcaattaactatagcatattttcatgtggaatttcaaatatctttgttaacgattttggatttaacaaaactcgaaaaactgaaaataataataatttgtaaattataacatttacttggctgaaattgtggaatatgcggaatagtcttatgaatatataatgtacaaaaataatttatcataaaaactatatatagcgtgcataatctgatttcaatccttagattatagattcttataatctgattttagttttacatgtagtagcacttcttcaaaattttagtgcgtaatattattctttttttttaccgtatagataaataatgtatcattatatacatagttgatatttaagtttatgcagttagttataattttttttaataaaagaataaatcaagttaatgaagcatgttcgtttcgttaccgccggtggttgcggcagcggcagcggctgcggctgcgacaaacctaccgcaggttgttgttcgttttgctgccgcaaccgcagcttttaattatcgacgctaaaattagtcggcgtccaaaaattttcgccgcaaaacgctgcgttttaccgcagatagttgcggcaactaaacgaacataaatagctgcggcgacgaaacgaacaacctaaatcatccaaactccatatcttgtaagtttcgacataaaaactttgcagtcttataaactaaatagtgagttatgagttgtgtggaccgcatatttggaaaagagaatgaccgccagtgatttcagaccatttgtatgtataatcttggtgagtaaactggttgacattgatg

SEQ ID NO: 2080 - DNA, 3000 bp, Unknown
  misc_feature (1)..( 3000): cDNA_ID_2047299_gDNA_ID_1620485_Annot_ID_158456 3000 nt of promoter + ATG
accttacacccatcgttacccacctcctcggcgatgaacaactccagtttctccttctcgtgtcggcgagaacatcggccttggaaccttattcaacgtcatctcgtctcttgacagtgaccaatttgttgtccattgattcgttcgtggaagatccttcgactacccgtgacctcacatgtgccatcatgccttatagtttgtggctcaaagctctcatgaattttatgtcgtttcacattatctatcatatcttggttttggggaatgcctcttttaattatgttttaaactttgtgatctttgaatcactccttcttatatttgttttgatttgaataaatgaaaacaaatctttgcaaaaaaaaaaaaaaaagattatatcgacaatgatattgtttaaatatatcagtctacatttatcatcttctctgttagactcgtcgttaaatttctatttttttaatagtttacacagatgttttcatattctaactatttctttatataataaatttgtatatctagtagacggatcttcaaaaaaaaaaacaagttctccccacatattaatatcaaaaaaattcttaaataccttatcagcattttagatttaattatgagcaaaataaatgtttagagatatgaaacttaaataattgtatcttattctcaacaattaacgaataaccaatttggagacaaatctataaactaataaatcttgcttctctatagggtgcgcttttgtccctgttacgtatgaagtgacgtataatcgtctactaaactattttatccgtacgacatcagtttcctataatatttgtgtgacactataataaaaatgaaaaatcatgttcgtcgtatacctgaattaagcaacgtataatgaataaactttccataaatacaaaaatactcgattagtggagtgtgcatcgccaacaaaaaagattctacgcaacgtgtcgaatcagtacttgttcctgagttcctccgtcactaaccagtgcggaccatgtcagtatccaagcacccacacgctcgtcgtctcttgaaaacatctcacacaaatacacaacggctcggactaataacttgccatctaagaaaagctaattgacctaaggctttgtggcacctgcatgtaaaaagcaaacacgaatttgccacgttattacaaagcataccacgtcaccgtctcactgttacactatctcttgttctcctttatttcgctatggacaacaaaaattataaggtggggaagagatgtctcaaaatacttttttatcgtcctctcaatttatgtaactgataataatcgaaatagataaatttaattgtaggttgacaaagcgctaattttaataaaaacatatattagtttggaaaattttgtcgtagtaagtaattaaacctatcaatcttgactaataatttcaagtatcccataaaaatcaaaattgtccttaggttttgaaattgtactactgatagtacgtaattaaacaaacaaaagctatagcttgtggattatagctaatcccatttggcgatgagagtaatatatatattgttcaaataaagttgtaattaagattcgattgaaaaggtaaattatagtttaagaaaaacaaagagaggagacaacaattaaaaaaatgaaaagtggagaactgtactctcgcctatacgaggaggtcattatctccaaggctctcaaggattaaggaccatgctttgattctataaatgttgttttattcaaactatttatattattatatcatacgtaatatgtggttagcatttgacccacgtccccttaattaagtctagattaatcccattaatctatccaattaataattaggaaaattttatataagattgctattggatttctcggtggtggtttaaactataaaatagtaatgcctttgatgcgtgtgattttttattggaacttattggttttaattcttaacctagcaattatatttgtagtagtttatgttaatcattgtttaataatactcctataataactcttgcaagtagcaacacttgtgtggctatttattccagagtccatggatatgtatgtataagaaaataggagtgcttttgcagattgaagagtttgtctataaaatcatgtttacttggcatttagtgttattgtttgcaattttttattttaaattagtcggatattttaagttaaaatctgaatacacagcatgttccttctaacgttttttaacataattgtaaactaaagaaaaattataatataataaattaaattataccctctctattcattgtagaagatttgtttgtttcaccaaatgtgttttttttttataagttgctctcactcttgagagttttggagtattttgaagaggacgaggttcttttgtgaaaaagtgaaagaaacaaatcatgtcaagaattagaaagaaatcatgacaaataattttgtttgtgcagaaattacaaatgaatcatagatatccttctaattcgggatcggaaaccagttgaaaaatcgatggactaagctttctatattgggactagcttacccttagaattagtcaagcagcttaaatcatctatgacttaaaattataattaagaaaaaacaatgcctaaatatgcatatatttcaaatgtatcacataacttgtgacataagaaaatataaacaaaacaaaaagggcaaaaaagacctgaaagcttagaggcacacctgcataggtcccacagttcactcgtgacaccgtaaaaggcaaaacacgaacccgccacgttatcacaaaaagcaagccacgtcaatatagtctcactgtcaactacacttaacttactattttcacatctcattttcctatctttatataaaccctccaggctcctctttaatttctttaccaccaccaacaacaaacatataaaccataaggaaaacagagaaagagagag

SEQ ID NO: 2081 - DNA, 3000 bp, Unknown
  misc_feature (1)..( 3000): cDNA_ID_2047282_gDNA_ID_1620485_Annot_ID_158462 3000 nt of promoter + ATG
cctggttattgtttcagcgatttttttgagtttgactacagacccttactccttctcaacgtcattatgtcttgtgacaatgaccaattttccacttctcggatcgaccgaagttgtgtctccgatttaccttcttctcgtatgtggcattgtgttctacaacttttgtctccgagttagcatggttttatcatcggactattgtatttttatctttattgcttttatttttgttgtactaaagtctgagaatgatattttcttaagctttgtactaagtttgagtgattgaacgaaaacaaagtttattgacaaaaaaagaaaaggaaaacggatagctttcttggctgaactatagcaaatgcaatttgcaatgttttaagtcgttaaggtactaactactaatctcaaaagatgaaaaagattatataagtgaataaaatatcaccgcaaagtgtttatatgcatactttatctttcaaacataccagtttccgataaatatacaacaaaccttgtgtttacgatgtaatggtgttctcaattaaaaaagaaaagagagcacttttctatataacaaatacaagttgagaaaaaagccaaaattgactggaccgaagctgtaggagaatgggggcgataggaccaagggagagttacaattttatcacaagcttgtgtgtgtatgttttgtttcttttctttaaatttggatgttgacagctttaattttttcctaaaaatatacactagaaaattagagaatatttagaaggtgagaccagcgaatgtcatgccacaaatcatgttcataatgttataccaaataatcataatgtccccatgtgacgctttacttttctatattatctcgtaaccccactcatacgttttagaagaattttcacacaactaagataagttgatttttgaggcaaaatattgtttattttttctatcaataaatcttcgtaagactttccaataagagaacatttttcttattcctctcgtgacagaagcaaatcatcccatccacacaaagtcacaatccaagacacaagcccaccaatagagactccatctcctcactaaattcatctacaatagtaattcattattgctattatgttactataattgctttaaaattgtttcctatgaataattgaatatcataagcaatatgaacaaagaatgatgttcaaatcaaaattcgaagataaggatataaagttataatcgtgttgagtcatacacttcgagctaaagtttttctttaaacaattgatttagctaccacttaatctagttggtactgaacaagtaacaacataagtagaagataaagagaagagaatatcttactttgggactattagccatgatgtccacgaccaaatcggcctcctcaaaatcaatttttgtctaattttgtaatgtgagactttataacttttccataatatatagcggacgttattattttactcaaaattgtatgtggcttccatttgactactaaatgaacaatattatgaaacaaataaaatgaacaaaaaagttgaacaaaaaaaattatttgaatattttatttagaaaaaatctgttcaataatatgcaaaccaaaatatctccggcatgtgtaaactaaattgactatactaatttaacaaattatcaccgcaattacgccgcgttgaatttgtttttccttagatttggcgtgggtcatcgaatgtttaattaaattaacataaaaccaagataggccattgaccaaaatacaataatattttcataaaaccttatattattttctgaagagcaaaaacattatctgagaatctggagataaaattgacgtgacattaagaaccttaatcgaatttgattaacaaaatatttctttgttgcccgtttcaattttagtggattattttggtgtaacttgacattttagataattctattaataatagattaggggaaatgtcaatgtaataggtggcctcgaatttgtgttggtgcactccagctgtcttccttcgctttggagcaagtagaatcccaactattttctccacacttaaaaaaccttaaattactcattctcaatcttatattttctataaacgcaaatattttatgaaattttatactattaataatctaattccctaaatatatatatattttgcattttttacatcatatctttttttgcctaaaattttatacgagaaattttatactattaagaatcttattgcctaaaattaaccacttctttttttggtgttctatttcatgcaccgatattaaaaatcgtaggaatatcgatggccaaaataaaataaaatggaagaggatctaaactttgtattttatactggtcctagtcctagaaaatcgaattattcagtgttttcattaaatgcatagttcaacatattatttggcatgatagattgtctgcaaatgacacatcacttttcctttctgcaaaaataaaagactctataaagtaactttagaatttattcagttcctcaactcgatctagtccctttaattaagcaaacataattatttaaacaactcttttgagaaaacattttttctctttggtcaaataacaaaacaaattaattcttatttctacattcaattaaaaacataccaaaacatctattaacttcttaaatattttttctcaaatttgtagtccaaaaaaaacacgacgcgtatgttttttttgttgttgttgtgtaataagaagagaaagaacgtaaaagaattgacgcggacgaatcgtgttagacccaaaaagaacagctttcaattccattgtccaaattccttatcaaaaaaaaactctactctcggtggcaccagatcactcctcctctctcttctcctacctttttcacattctcttcttcttcttctcgtgagaaaaagaaagagagattctttattcattagatcgaagcaaaa

SEQ ID NO: 2082 - DNA, 3000 bp, Unknown
  misc_feature (1)..( 3000): cDNA_ID_3065850_gDNA_ID_1620485_Annot_ID_158463 3000 nt of promoter + ATG
gtcgccgccgtctgattcttccgatggattgtctaccggagttgtggtaggaatcgccattggaggagtcgctattcttgttatactgactctgatttgtcttctctgtaagaagaaacgaagaagaagacacgacgatgaagctgcttactatgttcctcctcctcctccatctggtcccaaaggtaaattcaaagatctcaacttcatgaaataaaaatcgaatatttaaccatagttgttcaattctgatacgaattgctcaaatctgatacttgattatgcattgttatctgttaaagagattacctttgtggaaaagtttcaaactttacagagatttgatgttgtttatcagctggaggaccttacggtggtcaacaacagtattggcaacaacaaaacgcgtcacggccgtcagataatcatgtagtgacgtcattgccaccacctaagcctccatctccaccacgaaaacctcctccgccacctccaccaccagcattcatgagtagcagtggtggttctgactattcggatcttccggttcttcctccaccatctccagggcttgtgttaggcttttctaaaagcactttcacttatgaggagttgtcgagagctactaatggcttctctgaggctaatttgttaggacaaggagggtttggttatgtgcataaaggtatattgcctagtgggaaagaagttgctgtgaaacagttgaaagctggtagtggtcagggagagagagagtttcaggctgaggttgagatcattagcagagttcatcacaggcatttggtttctcttattggttattgtatggccggtgttcaaagattacttgtctatgagtttgttccaaacaacaatcttgagtttcacctccatggttagaacaaaactaaactctttcttttgattttgttacattgctttgttgttttcagttagtgatgatttgtttgggaattgaatttgttataggtaagggacggcctacgatggaatggagtactagattgaagattgctcttggatctgctaaaggactttcatatcttcatgaagattgtaagtctaaaaccttaaaaattatgtacagatgtttgataaatactgtctttgtttgtcactgaggtatatatataaatatttgcaggcaatccgaaaatcattcaccgtgatattaaggcgtcaaacatattgattgatttcaaatttgaagctaaggtatgtttactcgatatgttttgtgaagtgtttttgtaatttgtgtcactaaagctcttctttctttcaggttgctgactttggtcttgccaagattgcttctgatacaaacactcatgtatctacacgcgtgatgggaacctttgggtaaaaatcatctttaatctactaaacatgtacatttatgcagtttgcttaatgcatgtgatccttgtgcaacaagttctgaaacttttggttttgggattttaggtatttggctccggaatatgctgcaagtggaaagctcacagaaaagtctgacgttttctcatttggcgttgtacttttggaacttattactgggaggcgccctgttgatgcgaacaatgtctatgtagatgacagcttagttgactgggtactttactatgactgcagataatctaaacttctgatttttctacaatttaactgttgactaaagcaaaagctatgtgtgattgatggtggaacaggcacgaccattgcttaaccgagcatctgaggaaggagattttgagggtttggctgattcaaagatgggtaatgagtatgacagagaggagatggctcgcatggttgcttgcgctgcggcttgtgttcgccattcagctcgccgcagacctcgcatgagccaggtaacttaatccttttctctagagaagagcatattggtttggttctgtttatttggtagaataatatgtttccgtatggttttaaagaaaggttttgatatggtttttgtgagaaagatcggttcagttatgttcttatgcctagccctactttttgttacccatcatcatactatctaaacaacaccgattgaatatgtcaaaagaattggctgcagtttcttttgttttcattttgccaaggattgtcattttaacatatgttaatgctaatggagtgagtgatttgctgtacaaaatgagcagatagtacgggcgttagaaggaaatgtatcgctgtctgatcttaacgaagggatgagaccgggtcacagcaacgtatacagctcatatggaggaagcacagactatgacacgagccaatacaacgacgacatgataaagtttaggaaaatggctcttggaactcaagaatacggcacaaccggcgagtacagtaatccaaccagtgactacggactgtacccgtctggttcaagcagtgaaggtcaagccacacgagaaatggagatgggaaagattaagaaaaccggtcaaggttatagtggaccctctctttaaaccataagagtggagaaattgcaggttttttttggattctttttcttattaactgtaaagatttgaggaaattgccttactctctaattgatttactacgatatatgatacgtttaaaattgttttgctttggtttcttctttagatgttgtgatgttgattgattctggtttgaatattattctttcattcttttttctatttttcttctgaagaatttgtttgttatgtcttttgagcttttggcctagtttggttaagttccaacaaactgttcattatacatctacaaagtagaaacaagcacttcacaatacacaacctctacttcttataatttgaccatagaaagaccaaaaaaatcgaatgtaattgtgttattggcagtggtgaaagtgaaattacaaattacaaaaaccaaaatttcaaagtaaaataagactaaactcgaagtgacacaactcgcgagttcgctcgttcgtaa

SEQ ID NO: 2083 - DNA, 3000 bp, Unknown
  misc_feature (1)..( 3000): cDNA_ID_3065858_gDNA_ID_1620485_Annot_ID_158455 3000 nt of promoter + ATG
aaaaaaaacaaaaaaaacagttttcatcacttatcaaggtctacatttgaggactctcctctttgccagtgataatcttgacctcgaagaagagactctttcttcttcttcttgtccactatcatcactgtctagaacaacaatggattcagccattgatgtttcttccaataccgaattctcaaactcacctcgcaaacttcttgcatcttcattttgattcatctccagtttcatatcagtttgcgcaagtacctcaggtttgctaacttcattcaactctccaagtggtgatctcagggacagttttcggcttagtctattgttgtcactcttcgcagcagaagttcgaaaactcgccaaagtatcattacatggctgcttcagccccagagaaagcttctttccattcaaatttggttttttgttttctttgcaagcagctgaaacaccacgtgtgagctcttcttcaccacacaagtctttcttttgagattgagaaggcaatgcaagagataacttcttcctactccttttaatcccatcgtttccaaacgaattcccctcgccaaaaccaaccactgcttttcttttcccattgccatcctcttgttcatctctccctgcagtctcacgtttcactgtatgtgctatgcttaaagaagattccactgtcaacttaagcttaacactatttccactttcaccagacttctcatctccatgattctaaagaaacaacatcaacatttacttaaaagctccactcaacacactatataagtataactaatttatgcaccttaatttgtaagctggtgctgcatccatcagctttaaccttagcatacttctcagtcatctctcgtgccttataatcaaaagtttgtctattgtatttatactccctgctctgtaaacaaacaccataacaaaaccttaaagaaacaaagtcaaaatctcaaaagaaaataagtctgtttccttcaagtagaaacttactacttcacacatcaatccatcatcaggatttggttcactaagcaacaatctcatactcgtcaaaactgtcgagatattcaacgatggttgccaagctccctatacattgttaaacatgattcatatattccatcactagtgttgaatatagctatcatgaagaatcaacaaaggcatggaggaagatgatgaagcaaagtctaaccttgggagggagatttagaatgtcaaggcaaatccggccactgttatcgatgtttgggtgataaatcggtgtagcgaacgacacaattggtggctgaaatggatatctaatagagccaaattcacattcagattcaaatcatcaaacaccagaatcgagtttgatagattacctctcagggatttgaatcttcaaattgaagattccattagcatatacagtatcttcaggaccttcgatttctggaaaaaaatcatgaatatcaaaacagatttgaatttgaaaattgaaaaaagaggatatgaagaaaagctgacgagcatcgatggtggagaaagtggagaaatcgccggagccattggcggcggaagagagatgtggaaacgaagcgccgtgaggtggatcggagaggagaagctttagctctttctgcattctcaggcttaatctcgctgcttgagccattgattcagaaacttcttcgtcttcacagctttctgaaaaacaattgggggcaaaagggattttgcagtgattggcactggcgggggaagatattttggatctaataaggtttaattttcacttttaacttatgggccctttgacaaaaaaaaacttatgggccctttgacaaaaaaaaacttatgggcccaaaaccaatttggcccaatatagtgtatacatgtgaaagtttcttaagaaacatttgtgttgaacatatataacaagtacagaaaaacaaaaaaaaacatccgttgatcttctatatttcttatgataataaagattataatcatagtcttgtaaaaactataataattgttataagtacaataaataaattatttgatttgcaatctttgaacaaagtttatactactaataatatgataatattattgaagattaattgtttatagctaaacaacatgaagatgtgaagatagaaaccacataaccttattattattagtatgaatttgatctaagaataataataactcaaatatattcgatctataacaattttgtgtcaaaagctttagattgattgttatttggaagcatcttctaatttttcaaaaggatgaaattttatcattttcactctctataaagtactataaactcaattaaacgacataatgaatcttggttcactttctattattgaatcttggatcaacttaattctaactagattacatacgtaaatctctttcttccatcacctatgtttctcaaaaaattcgacaactctttttaattttgattttgatttgaggatcatgaaatcttttagtagtattcctctacatatttgtcttcttgaaagattatatcgagaaacaaaattggtataagctttatatatttcactcaatttaaaacatgaaacgcttctagacactaatatcgagagacttcttctgccaacggtttccggtgccggaggagctctagctcaccggcgccgtcaattctccgattcgcatgttcagtttcttctttgtatgtctagcctcattgcttatctttctcttttcagtaatttttcccctcttttaaaactatctcgaatcctttcaaacctttggcttctggtgagaacttcaaccaacatcaaaaggaaaagatggtgtctggcgatacccatctatcaccttcatcatgcaacacctctgtggaagtcatctataacgatgctcttgcgttttcaatctatggtagaaccaccaacttatcgctttgagatctcgttatcccgagcatttatcttaacccaagca

SEQ ID NO: 2084 - DNA, 3000 bp, Unknown
  misc_feature (1)..( 3000): cDNA_ID_2025039_gDNA_ID_1620485_Annot_ID_158448 3000 nt of promoter + ATG
ccacaattaataaatagaatttggaacaaccagcactccagcagcccaacgtcttatcttccatgtcctcctttagtttcccagctatatctctttaatgttttttggacaaaaaattgggaagctttaatgttttatctacatttcatgcttaatgtagttcaaaattaactttaaaatagtattgcatggaacaaaatttataagatttttacgataagtgtccaaacgatcgaaggggcacgccatacctacacccactctacctccataattttagcatctctttgaaaaaactgatttgtttgcttgttttttttttcttttgttttaacatttcatgtttcaagcaaatatttttttttcttctgaattcgagaatttaattcccaaatacgtgtaagctgccaatttagtttgcactgaacggaatgagatgaccgccgtttacttctaaatttattagaaaatagtttatttcaaaaataaaattttacaatttgttattatctattcaaatgttgtaatatgcttacatgaataatggacggccaaaaataattaaaattgtaaaaaatatttttataaacaaaaacctgtgtttaacaatttttaattacgaaaataaattaaatgaaatgctcgtgtataacattagatataaattaatacataataaaaattatgtaagctttggcagcagatcttgtcacttttatagttttcaacatttgtccaaaaaaaaaaaagagtatatttttcaacaaaaacaaaatgacactatttgacacacacacaagacaatgtgactcgttttttgaacttttcaaataattttagaataatgccatcgatgaccgatgtagacggggaaccaaataccacatttaagtttttgtattcaacttgctggatatataaaatgacaattggagattcaactctaagaaacttaaatattttgttttgacttaatctataaaaataatatcagcattttcaccagtcttagtttattagattttttaataagcatgattttatggaaaaaatcatatcaatttatttatcgtcatgaaaacaatatgaaaatctaatttatttttttacttatctgtcattaaattataaatgaatgagaaaaatataaaaataataataataataattgacatagccacaaacaataacggtaaagacattaggaatttaggtgaatgtacaatgatatgggtttacactgcaaggggtaacaatattggttcacaatgatgatgataaggtttatgtgagtgaggatgatggtaagaccaaattttctgaaaagttggtgattcatgagaatagtttaacaacatatattaccaaagacgcatttatgttttctgtaaatcatcttcagaaaaccacaatgagttagaagaaaatttagatggttttaacaaaaaaaagaaaagaaaatttagatggaaatctccaaatttattttaagtattatatgagtgaaaacaaattacgaacgaatatctagtggtgatatgtagaatatatcgccaagttttgtggactctccaaatagcgcacttgctatcatatgagggtgggatccatgaaccatcagaagtgtgggagtcatgtggtggtaatggtcggtcttggtttcagttaaggatgatgtaccctataagtgtagcttattgtactccccctgatttccttccaaattatggtgcacaagaaaggcttacaattatttatttgactagttatcattgaaattcacttctcgtttaatgtaactctttctgtgaaaaaaatctataaataaccatagtttagttataaaagtttcatgtgggcgacccattggaagtgtttttaattgtgttaataagcatagttagtcaacaagtcttttgagtttaccaaagtagcaatttggcactcggacaaggatgaaaccaatagcccaaaagtgtttggtctagagatggtggcagtcgggtattaaaaatggtattggtttattatacatgataagaattaattcaaccaacgaaaacaaatactgaaaaatttgaatgggtataaattatcaaaaaaaaatataatttttgtctagaaggtaaaaaaaaacaaataatatgaaaaaaatgaaagtgtctaaacatcttataaaaagaaacggatgaaatataatcctttctttttgttttacatcagcaacataaaaatttgtatgccttaaatttttgatatctgtaaaaatatcaagaacaaaaacggtattcctgtgtttcaaaaaatatttgtatacattttgtttagtaaataatgataaattctaaacttcaacaatgaaaattgaaatattatttgcttagagatagaaaattgttaatcgcaaaagaaaaagcatttataatcatattttttatttgttcctttttaatatgtgaaaatcttgaaacttggattacttaggaatatacttatatgtaatttaataatttgtatttctgtaaattttatagtagaaaaatcatatacgtattagtaccagatttaaaattttcaacgacattaacacaatgaaaagttattatttaaattgaacatttttaaaatgataaaaaacgataaaagacatatacgtatgataggggataggcgggtcaatcccgttttttaagatgtagaattttcatacaaatcgatttttctcatacgttttaattttattttttacatttcgcaactttgatcaaacgtggcaagaaaactcggtttaattaaaaaagaaacaacaataagagatgtatcggagtagaacccgtaatctcttcacgtgcatgcacgctcctagctacttaacagaaaaatccactgcctttgctgacgtgtgaatcgagacacttcgatataaatacgtagataacctctctgtccttctacgagcatagagaaagagagagagagaaatacaaagaaaaataaatg

SEQ ID NO: 2085 - DNA, 3000 bp, Unknown
  misc_feature (1)..( 3000): cDNA_ID_2149470_gDNA_ID_1620486_Annot_ID_158485 3000 nt of promoter + ATG
caccatgcaatatgcgacttaaaatttgacttattaaaaaaaatttgaatattatttttgggacaacgacattcatcactattaaatgaatccatttttatatggtatgttacattaatcagcatgtttatctcactgtcacacagtaaccttcaataaaaagagatcatcttccatcctaaaaacggatcacatggaatctcatataatttcagcaccacgcattcgatatgagctttataattcaaatgacaattatattaatcatcaattatcattatactacacaatcttatataataatctttctagtttacaaccaatatttgaaaagttgtgctaatttttataaacgtaaatgatcttcaaacaagattcgagctcattttaacaacgttaaaacaataaaaataacctttgaatttggaaagtgatatgttataaaaaaaaaaattattatttcacaaaaaaattgtgtaatactaagaaaagtaaatatatgattaagaccattgacgtatagtctagcctaagtgtctgaaaatagaagccagaaataataatttcctttcacaaaatcgtggattatattggtttcgtgatcgagttagttaggtaactatcattttataacaagaataaaaataaacttctttttgagttttgtagataaacatcgtaattcattagttatcgaatataagatttggtagttgattatgacatcaaagattgaatattcgatgacgcaaattgaagttgaaaatatatatatttcttttcacgttgaaattgaaatatagacctcgacacttggggtcgtccatttatacataattatctaatttaggtaacaaaagattagtgacccatatatttatagaaaaaaaaaagagtaaacagaaccaacttgtgacccactaggacgaaacattgttgcgtgacgtggctaactaatctacttggctggaataactgaatgaaagacagtttatccatctggataataatgaggatcgaatcagaaaggcttgtgaggttataaattaaaagtagtaaaggctttccacacacataacacgcacggaggtttggtttctgtctgaaatcaaactgtagttattgtgggttccgatttaaattatgacgtggaatgatcgtataaatgttataataacatgttatttgttaaaaaaccagcacaaaatcattgatatatatatcattattaggatcgtgtacgtaagtgcaattccacattcaaccactagaggttattttacttaattaatagaaagtgtaaggttagttagtgcatatataccttttacatcaaccaaaaataaatgtatgtatttattattatgtgatatctttgctaatggttatatatctttcaatatagtatttgattggcagtattgtacagtagaatgaaaaatctgatgaatgctatattaagcattaacccactggtaacaagatttgagacagccatctcaattatcagaaagcaacaaaaagagtcaaccaattctgattattaatttgatttagcgatagatgcatggaaaatctgagatgcatgacttacattattagccttagttactttatttgaaaagaaagatataacttatttttcaagctaccgtttgttagcaactacgacatatatttttttataattattttgttgaacatactgaaaatataaaaagaccggtttcaaattatattaaaacgaagagaatatgttttccagtaaatttctatatcaattatatggactagctagacgtaagctattcttgtatgcaccccggtttaaataaattatatgtatgttcacccaccatattttccgtacatattcaagatgtttaaacttggtaaaacaaatgttattgtaactaaaaccaaaatgaaccttaatttgattaccatatagttagcttacaatttccggagattagtgtagattttcagctcagaatatagaggcgcatatgtctttgagtctttctaatttctttaggccaagtccggtggaaggtggagctttaattacgtaatgaatgcggcaacttgactttcgttctcaagagtcaagatgaaaccaaagatgtgaactaatatatctcatcacattactacaatcttacataatgaaaaaaaattcaacttaagaaagtatatccatacacaatggcttttcgcttacaaaggaaaagaaactttgttttgtactctaaactttttttatgaatcaaactaaagttaatacattttttttgcttgcaacaaagtttacacatacaagttctatcatattcaatttgatcttctgttttttattttgggtcaacaatagcattaaaacatacttaaacacagtttttttcaaccatcatttctatgtaatactattaatttccataaatttttgttttatcacatacttattcttactcttgattattatttaattttcatcatcatttcagaatatttttatttctaactttcatttttttttttaactcactttcacataaatttttactccattgaatatcctatttacaacttctgaaaattaaatattttctagattttattttattttttcctaatattgttaacgcccctcatctcatgggtgaactacctagtcaataacagaacaaaataaaaagttataggaaaatgagaaaaaaatactcaaaaaaaaaatcaaaatagtaggttgtgacgtttcaaagtcacccgcacaaagcaaagagattagaagactctcttctatctttaaatcccttctcagaatagataacagatatacactccatcaaatctatacctacatcaacctttatatagttatatgtatcaccctctctctttctctcccttatatatataactccaaaacaatcatttaatccaaacccaacatatccttttaacagaatcttctttatctgaaaatatctaaagaaa

SEQ ID NO: 2086 - DNA, 3000 bp, Unknown
  misc_feature (1)..( 3000): cDNA_ID_3065920_gDNA_ID_1620487_Annot_ID_158492 3000 nt of promoter + ATG
cctaaaggatgatgattggaggtgggaaaatgaggaaaaggggtgaactgaggaggatgatgaggatcaccaagagatggatccatggatgtgagatttttgcagagcaaagagaagagaagatacagtaaaaaaaaaaaaaagaacaaaaaaaaaaaagacagaggtggaaggtgagatttagatttagggtttttttttctttttttttgttttttgctctgagagctcttttgatttttttgtttttgtgaaaataaaatttttgtgagagaaataaataaagttaggttggggagagagaggcggaggagtagagacgaaaggatgagaagaaagattactattaaatctaaccgttgatttgttttctatcgacggttttgacgaggatcgatgacgtgtcatatcattttgtcttttattttaaggattttgtgtttctttactttgatttttttcatttttgcctcttagaattttgctacattttcgctccaatgtaataaaaaatcaccaaaattttaaaaatggaccgccaaaattttaaattatttttctgaaaagaactcctcgctttcagtgtaaaacaattttgttgattttagaataacatcgaatgaagtatatagcaaacactgttacattaagtaacccatgtaacaaactccattaaagagtgtatgataagtaagagatgtattgagatgagtatggcaaaacaaatgcaattactaacttctatgtcctctgtttaggatttgaaatcgatacatttacataaaatttagtttcaaatttatattttctgtgaattttgttagagtatatatctatttgcgaccctttaacttaatcacaaaatgatacatcaaatatgtttttcattaaggaaaaattacaagacattaaaatatttttaaacagtaatgtatgatatttacatttgaattaaattttaactttagttgcattttaacaaaatatttgatatatatatatatatatatctatatatatatatataaatgtacgacgtaaaacaaaaataacaaataaatgtaaacctcttattatagatgatgaaagataactttatgaaaaaaataaaatatggaaaaatatatttaccaagtgctaaatacatttttcttttgtcttgtatcacaaataagcgtgatatatttaaaagaataattgaaatattaaatgatgaaagataagttttaaaattttcaaaatatggaaaaacatgcaattagtaagtattgattgcaaattttaatttgttttgtacaaagaagcgttatttatttaaacattataataaaaatgataaatagtgaacgatgaatttaagaaaatttaaaatatgaaaaactagaatttataattgtttaatgcaaaatttataacaaacaagcatttttaacgggtaatgtaaaggatacaaagtgagcgataattttaaagatatttagtggttttacatatagttaatgttttttttttttttttagaagaactttttttttcatttgacattttaatattgtttaatgaacttttgtgtattatatgtgtggattcaaaagggtagttggatagatttcaccatttgaattttgaagtagcaaatctcaaataaaatcaatgggactaagaacaattgataaatctatgggggaacaagtgtcacacctatctccttggtaaagccagcccatacatcacggtacccaaaaagaatcatccaacaagagaattgttggtacatattactgacattacaatacgatattataaagagtacagtacgtttatgcttatgcattaagcgcaagtaaaacccgatatatgctcatcattcaaactccaagtatcacctgagtcgtgtcgttttcatacaacaatttatgtatgctcattcttttaatactaatatatctgtgttgtgatgtgtgcatgcgtgtgctcgaatactttcaagcaagggtcaaacaaagtgcggctggtaatagacgatcagaagacacaatcaccagacaccaagtaagcagatgacaaaagacgatcaccacaccagaattccaacaaaacaaaagattatgatatgttttgtcgcctctgatatgtcacactacacagtacacacaacctcttataaacaacacttttaacgggccgaattatcagccttcaatataatgtttacttatgtgatggacctcaacattacatgggcctatctgttgcataattaacagttttaagacccttttatttttctctcgaatttgaaatgatttgtttatgttttttatttaaatgtttttgcatatttggttgggtcctctcgagtcacacacgaccggagacgtgcattagaagagttacagagcagacatttgctggcatcttacaattatctcaaacataaccttcttttattattaggctattggccctacccaccaccaccatttttattttctttttctcaaacacgctttttgaatttcaatattatatactgtccttatcaaaaaatagttatacgatttgttaattttgttagcctaatttttcctaatctggttatgtcacggacgcaagttaaattcatctgcggtgtttttaggtgttataaagccatgtgaatgaagttaattaaaaaaaaagcaatgtaaatagtcaaacatgccctttaagaaaaagagaaacacacgcttcacgtgagtcgcacgtgccaaacccacctttcatcttcttcttcttcttcttcttctatcttccgcatccttcggacaagagaaccaaaccagccaacaaaaaataatagtaatggagagtcgaattagaaagagagaagcacgccatacctgagagattcgtgcgtcgacgacgtgaaaatcattattatttactaataataattgttattgtcaatcgatgataattaaattaaaattagtttaaaagtggtggtggaggtgtttg

SEQ ID NO: 2087 - DNA, 3000 bp, Unknown
  misc_feature (1)..( 3000): cDNA_ID_2149596_gDNA_ID_1620487_Annot_ID_158510 3000 nt of promoter + ATG
attcttccttgtactcatatgaaagaacaaaaaaaatcggacaacaatatgactccttgtagtacacaagtgaagttgagactagattctttcatgtacatattttatcaaagagtctgagaaacgataaacagagacccatataactcaaatgatttctacataggctcagttttaagtcagcttaaaacaggagcaattcttcagggcttgatctcaagttttaatgtcatccaatatatgttattgcttatcttactaatgtttcatcaattgctcatcttgctagtgttccatcaagcttgggtttgacgtggtttaaacaatttctgcaatagcaataaagagcatagaatcatcgaccattctagtaaacagagaactatataagcttgatcaatcacaggcttacctttcttagagcatcaatcgaccgcactttctcatctctcttttcacaaaagcactctccacaccagctggagaaatccttgtgatgagttttgagctctctaaatacagaactgcaaggaacaacacgaaagacaagcttaataagaaaccaaataaaaatggaaagtcaattgcaatgtaaaaaaagatgcatggcagtctagaggcaagttttagatgctatttaccttctgcaccatagaagcatattgacccgatgcccgcatgttgtggctctggcaccatggcggtggcggccacggtgaagcacagcttgtccaggtatatgacaataatcatatgtttcctgctttcgcagaaaaaaaagagttgtttatattagctatcagccatatacagaatgttagaagacaagaaagcaacagaaaagagtggcatacatctgcctttgttgctgtgttcacatgtttttcacaccgtgtgcctctgaaaaatagctcccctcccacaaattgattacccaaacaaacattcagcgttacttctgaatcatccacatgaaagcctgaaaatttatataacatctgataattttcagccagaataacgtgagtattggaatatatctgcatttaggacaactagtcaggtcatgggaaattatacaggatatgtcaaagggtctcacctaaatcaacatccctatctttcccatattcaacaacaaaaccatggtgagagtccagagttgctccacccacatcactgaagaatactgcaaaacaaaagattcgaagtagctttttagttttaacactgtgaacatattaaacagactttccaataatagactatgtaatggatttaaaaatatattgcctttagagatgggacgtataaacccctccatgagtttgtcaagcatggtgtctagaccaaagtcgtcaagcacagcaccgtatttattcatggtgtttggtctcattatccggaatttggtctcacccacccacctttcaaaattgtctatctgcatggtcaaacaagagcaaatgaacaaaatacgaaggataagagaaaaacaaaaaatggatgcacattacctcggctagcatcatctcacaaaagctaggctggagcatgtcaaagacgaaaacaccaggagacggttcagatattatatttctgaagctttcctctgtgttttcatttatcgccttaaggaaagcaggaacgaaacatactgtgggaactagagtatacaactccttgtgaagtggctgcagtagaaaaacacttcaaactactaacaaatgactggagcagagcaatacagaacacaagaaagctcaagaaaggattcacacctgataatttgttgtaatcttcagcctatagtcactgtgcctttgagcctgtagcatcagccaaacaaaactacttaataaaactcttgagctcatattgacattttcaaaccattcatgcaatatcttctaccaaccatcatctaaccagattgaaatttccataaccacttaactaaaagtgaaaccagttcatagtagcaattagcaaaagctcaaattttcataatgaagtgtagcttctaaagcaattcacagtcatcaatacaagtaaaaacaaaattcaagagagaaaggtccaaatctagtacttactctggaacgctctccatgaggaagatgcctaagcataatatcagtcatgaatttgattttctcatcacgattcgagacgagcatattcggaggcaagtacttctccagactagaatataccgagtttgggaaatcaagctgcagatcttcataactatcgggtctatgctcgttgttagggtttagccttagtctctggcaagaaaccatcgtagaggtagctctcaatgtcgtgggagccgccgaatgagaattctgacctgcaattgttccgttaccttccaccgtcgtcgtcgtcgtctcttgcgaaccttctcgctgctcacttgacattactaaagaaggcagagaattcaagtgagaaaaaactagggtttcttcttcacactacattccaaaagcaaaaaatcttaaaggggaattgaaatcgactttttaagctctcgatctggagattctgatttttgagttcccgttgaagttagggtttctgaatgttccctcgaagatttttttatcttttatttatttgttaatattacgcacgaaaccaccagtcatacgccttataagaagagttaaatgattttctagcccatctattaggcggcccattaaataattcgaaccggttatttggtttaaactgaaattaccggtataatcgtggaattgaaatcattcgactttgagttgtctgttagtgcgttattggttaacacgtgagagatatcgatagtctcctctggagtttgttaagttcacacgtgtgaatgaaagctttcgctctcaaagcttggtgctttttcgtctcttgcctctgccaaaatcttttggccgccatcgatctttccgatcacggaacaaccgtacgaattgaaagtatctctgcggcgaagtagaa

SEQ ID NO: 2088 - DNA, 3000 bp, Unknown
  misc_feature (1)..( 3000): cDNA_ID_2149588_gDNA_ID_1620487_Annot_ID_158508 3000 nt of promoter + ATG
acatatcctgtataatttcccatgacctgactagttgtcctaaatgcagatatattccaatactcacgttattctggctgaaaattatcagatgttatataaattttcaggctttcatgtggatgattcagaagtaacgctgaatgtttgtttgggtaatcaatttgtgggaggggagctatttttcagaggcacacggtgtgaaaaacatgtgaacacagcaacaaaggcagatgtatgccactcttttctgttgctttcttgtcttctaacattctgtatatggctgatagctaatataaacaactcttttttttctgcgaaagcaggaaacatatgattattgtcatatacctggacaagctgtgcttcaccgtggccgccaccgccatggtgccagagccacaacatgcgggcatcgggtcaatatgcttctatggtgcagaaggtaaatagcatctaaaacttgcctctagactgccatgcatctttttttacattgcaattgactttccatttttatttggtttcttattaagcttgtctttcgtgttgttccttgcagttctgtatttagagagctcaaaactcatcacaaggatttctccagctggtgtggagagtgcttttgtgaaaagagagatgagaaagtgcggtcgattgatgctctaagaaaggtaagcctgtgattgatcaagcttatatagttctctgtttactagaatggtcgatgattctatgctctttattgctattgcagaaattgtttaaaccacgtcaaacccaagcttgatggaacactagcaagatgagcaattgatgaaacattagtaagataagcaataacatatattggatgacattaaaacttgagatcaagccctgaagaattgctcctgttttaagctgacttaaaactgagcctatgtagaaatcatttgagttatatgggtctctgtttatcgtttctcagactctttgataaaatatgtacatgaaagaatctagtctcaacttcacttgtgtactacaaggagtcatattgttgtccgattttttttgttctttcatatgagtacaaggaagaattggtgttatctaattggatttggtgatgctgctctcttaaatctccatattcgcctcaaatcgttgctctactgagttgtgcacttgtgctcttcaccaatggctagagccacaaataatggattttgctcttatagaaacccaaatcgattgcttcggtaggctcttttgaatataaatgagcattagggccattgtgcacgttattctaaataatggaagagagaagaaagtgtagatggtgttttgttgctgtcttgttatttcatggcaagacaaatcgaaattgggtgtgaaacggtactaccaacccaattagttgactttaaggcttatcattgaatccttttatggatctgttatttatgtctcttttatatactcttccattcattcttctcaccaaattcattttatttttggggtttcttggtatctttttgacaatctatgttgatacgatgtttatatatatgatcacactaattagcaatgtagatgaaaacacaatccttcatcttcatgatacagtagtataagatcaataaggatcatttgggtctgttttaaatcttaaaagattttgatgtctaggtgtgtgctaagtcgttgaaaacacaactaagttaacttcattctgcagatattcttaatgttaaaatctgagctcaatagggattcttgactgaattttttaaaaagatttgatgtctaggttttttttttttgccagtttgtttttgatattttggtgatctgatgattgtgttgttagttttgtgtttcagttttgatccttaattttcttttggattctgaagctggaatattttgattatatataattcaaactgagaattttcatatcatgggctgaaaaaatggagaatcttgcatgtgtccctctttagggccactagaagaaaaagaaaagagagtacatagtacaaattacttaaatgattgctaaacattatttaaaacagaatagtttcttaatacattaggtcaagttatatgtttaacataactttttggaagatgtcatagttttaaaatccaacctaattggtacatttgattgtagccgttttttggaatctaatgacatgaaacaattacaagttaactgaataaacggtggttagtgctccttcgaagagatattagtaaacttatcaatcaaattattaatggttttccacattcaagacaagatgcctaattatgagctagaccacatgctattcgattccataaactcattattacataagaaacgaatatataaacataatagaaatcaaatgaatccccaaatgaagaattcactagaaacacaaacttaaaatcaaattaaacatatatgtatatgtcaacattcaacgtgaacattgataaaatagtggtttgtattactattgtcgccgttgcacaacccaaatacaaatttgtaaatgtaggtgtatgaattttagatgacataaaggacccaaagtggtgtcctctcattgaacatgagtgaaacttctaacaatacatatatatccctaaatcatttgaataaaaataaaaatacaaacatatcccccacattatctaagtcacgtaaaacattcaacctccgaatcgtattattacagtcaaataaccatcttttatcagcattattattcataatcattaattataaacaactatagtggcccacttgaagaaattatgtaacatttatttcttccttaatcatccattttctttattgtgtaattgataattattgttttgtatattaaatcacaagtcaccaccacacactttagtataaaagcaatcctgatgtgctatcaaacttcaaaaaaaaaaagaagaagtaggaaaagaagagctcaagaagaaaaagagaaaatg

SEQ ID NO: 2089 - DNA, 3000 bp, Unknown
  misc_feature (1)..( 3000): cDNA_ID_2149576_gDNA_ID_1620487_Annot_ID_158505 3000 nt of promoter + ATG
tatcttcatcttcttccttgcacttttctgtttggtttacggggtaatctaaaactttgttgtgtggccattatcagcaaaccacatcatacgagctcaatgctctatctcaagaatggagacagctctgtgttaagaatatggagattcagtctgcttgtgccatgcttgagacacagatcgattcgttcaagaaagaagctgctgaaaggtgaggaaaatgttgtcttacttctttatatcactcgtaagagttgaattttaagcgtaaaactgaaactcgtggggttgtgtgtttcaggggttggaacttagaagagaaactagagaacgtcgagccacttcaaatgcaatgaggcgcctcccttgctcttaagtaacataggttcagagcaaaacaactgttggtcagtttggtttgagttgtgggttaagagaatcaaagacgagacagtttcagttatttgccagttttgtgaaatcctctgctctcctgtcaagtggtgtgtgggacaagtaattgcttttgaaagtatcgaaactctttaatttatcgagcataacgtttacgatttgaaatacaatataaatttttgtatttagaaacatatattctctctctatattaagatgttgcatcccttattctcctataatcagaatgcagaaaagctcctccgtccatttttttcttcttggatagattcaaaccaatataatatggttcttccatgatattacttcttgtggtttcgtgtggtacaaattgaattttctactcaaatttgaatatatccatgcataatgcataatgcattgtattgtaaatgatccttgagcttccctttgtttaatgttaattagacgcacaaaaaaatgtatagataaaagttaaagtgacggagccattgctcataaacattatttttcttaatcttataccaattttcacaaaacataaaaattatgcatttcctaccgactaccaatcctttaaataaatatatttgtatatacgtatttgacataattttcaatttaaatattacaattaaaccaaaaaaaaaaatcacatattggaaggtgcacacgtacgtcgtcatgcgacccaccaacgaggctataagacacggaactcgttagaatgtctctttcctacttaacaaccttcttatattgccttttaacaaagaaaaaaaatccttcctatattgctattattattatgatgcatcttattatcacctaattaattaatggaaaccccatattctttctcaacacatttcaattggatgttgaggtagtcaccgcacgtttttggatgattataaagtaaaagcttctcttaagtagatttagtccttcatccatagtaagactcaagttatagcaaaacaagcaacaacaaaactaatcattactgattgaaaatatgcaccatgcattatgcaataattaattgtaaccagtagattggtgatgatacaatttcagaattagaccagtcacgatccgcatatgacattatgatcacaattcacaaaacatatttactaacaattatctaaaaagttttgacatgtatatgtaaattgtttgtcatccattgacataagattgggtaacgattgctatgtatgtcttaactactctataagttttttcaacggagttagtcctgataagatggggatgcttaaaacttcataagaccatatatacatcaattattgaattcaaatatacaaagaaaaagaaaaaaaaagaatgtaatgagagattgttggaaaaagtccaaagtcgacaatcgaacaaccaagtttcacataagtctagaaaaacttcaccaactgttagttgattcatagctatcaggccacatttgattctgcctcattcgttaataggtctcaaggaaacaaaactaaacaattagcaatcaatcatttagattttggttgtgtctgtcataacagtcaactacaaactttctttcattttcattattttattaaagaaaagtactagttatgaacttctaatcaatttccatatgttcaatatttttatttaaatatatgtttctaactacaatctatatactctttttgtgtaagttgtagttgtgataatatgtttgcttgtttttttttgtcaaccacacattattatatataatgtatgaaaataaaaattcttcattgataatctaatttggaaaagaaaaaattgcaaataaaactaacatgtcctttaactatggctgaacaagctaagatgatttataaagcaaaataaattcgtccacggaaggtttgagaaagtggataatttctcggggttacgggacatttgatcagcttagaacaattgtctcgaagtctaaaacttttttatcctattggaataataatgatatattgaaaatttggaaatgtcacaaaccacaagaaagaaagaggttaataaaccacagagaaacacaatgctcatgaaaatcaaattcatgcttgacaattttattaatcatttgttattttattttggttgttcgttataattaatatctattaatttatttgaaatgaagctaaaaagaaaaatcgtggggagcattcattaagctgcttactaagacttgttcttcgactaatacttcatgccctccaaatccttcctctccaatgccgacactcgcctgatttataaaattaataagatcctcttcttttaataatacactaatgttcatctaatttttattttttaaaatctataacacctaaacgttctttccttgatcctgtcttaaaatccagacatttatagagacaataaacacacgaccaatgtcgtaaaagaagttcttaaatactttacacaatcctctccgtctttcacattcattcatccctctacattagcacgaagattggtttcaagagttttcttgtaacccaagaaagaaaaagtttgtgtaacttgagaaacaacata

SEQ ID NO: 2090 - DNA, 3000 bp, Unknown
  misc_feature (1)..( 3000): cDNA_ID_3065892_gDNA_ID_1620487_Annot_ID_158504 3000 nt of promoter + ATG
tcattatatacaaaattgactggtaatgttagtccattttattaaatgttggatttaattttgtacctaaataagcatatatatatatatatacatatatataactgaaagtatttcttgagctaatggatacaaaatctacacaatacggttcggtttgattcaatagccaacactatttgatttttctaaaccaacgataaaatcggtctactgaaattactaccgagtttatcagttcaacatctttcggtcggaacgtatatgtatatgttggttgacctaataaagcaaatagactttggttcggttaagttcggttaaataaagaaaaagcagattctgagctttgtttgtgagattcagtttccaatatcagagaatctctgtgtcgcctgaagtgataacattctcattattcacccaaggagagagatcggagctaaaaagccatctctcgccggaaaatttctcagttttcttattaccttagccacagacaacaagacgacagaggaatctaatcttagccccctttcctctctgtctctctctatatctctgtctttaggctttgagatatcttcaacacgaagctttttgcttcttttttttatctctttaaaaaattccagccaatggttcgaatccaatagtagcttcaaaggtcatggatttagtcaggtgtgttctaaattctgatctccttatgtattcctttctctcgctattggtttctagttccgtagggttttagatacgtttgcaactgaggacaattaggtttcttttaatccacatcacgattgattcaaagttcattgtgtttctgtaggggtttgtggaggaaacatagaaggaagattttggtgacgacgacttgtttgggaagtgggtatttgctctataaactatacaatgcccatactcgtaagctcgctgatttggaacgagagcttgctaatgagcgtgaaaacgacgagatcatcaaaacccagttgagtttttgtaacctctcgtctttattttttgcttgtttatcgatttctagtccttattggttttgttctctctatgctctatgttagaatgaaggcacatttcgataacattcagatgattgctgatactactacattgcctcacgcaattcatcacttgagtagtcgtgtagttgaagagattgatgtctcgagtattatggataagctaagcaaaggcaaaggaatattgattccttctgagaagcttcaactctggaatgagctcaaaattttgagtgcgttgttgttcccttacttgtacttctcgtgctctgtggcaacattggatcttctcattaatcaatctttttaaatgtgtttccttgtgttcaggtttcacgagaatggtcttgtccctttggtcggtcactatgcttagtttgtacattagggttcaagtcaatattttgggcagacatttatatatcgacactgctagaggtcttgggagctcccatttacttgtaagacattttacttttctctttttattgtcttaagaatcattgttaagctacttctagcaaattggtcattctgataaaattttgtgtactttcattctacttgttgcattgtatcttgagatatcaaaatttcaaattgagatttcaaggggtagaagttgatattttgcatcttttcctttcaaaattatcgaaattagtgtattcattggtcttagatataactcttggctggattaccacaatctttaccaacgtcatttccttgatatgtttttttctcaggacgaactagatctcatagagagagatgatgaacaaaagtttttgacaagcgctgattttcttgcgaccagtggcatgccgagtttgatttctaacatgcagaacgcagtgaaagaagttctcaaggggtaatttacattacaaacctacttatcaaagatgtctcccttgtttctcatccttgaagattgattttatggtgcctcaaactcaaatgcctatgaagaatcactatacttttatgaacgtatagcgaaatctaactatgtgtgtttaattgcagaaagcagttaaaggatgtgttaaccacaagtgctcttcgagaaactgtgatgcggattctcgatgtgtttatgagcacaggaagtccacaccactgggtagattatctaatgatgtcccaagacgcaaccactgatgtttcctcttctgatgcaactgttaccaagtttcatctactcataaccgagacacgggaagtactcacaaggtaaaaaaaatctctgctctttaacccgcaaaagacgaacaatttcacttctttaaagccttgtcctcgtttctgcttcaatgctcaaagcaagaatgttgcaatgtagcctgttaaacatttcttggtcttgttttcatgttgcagcaatgatttttcaaatgtagcagagatctcactcaagtgttgtgccgttgcgttagtagaggagatggaaacgcagaccggtctggccacagggatgcaattggcaaagctattaccacagattgagaaaaccatgccggagatttcagctgagccggagaagaaccggttcttgcaactcatccgagatttgcctgaagttaaactcttttttactcttttatacgcaaatatgcctcagtagcattattaaaccccattgccaaaaattgtttcctgatcactttttatcatatgtttcgatttacttcaaaatagtaaaaccaaacatctctagaataattgttcaatatctatatcaaatcatttactaatatagtaatattgcagcaacaaaaaaggacaccgtgtattacatatctttcagtttttagggccctagaagcccaaggcccaataaaaccgggtcggtgatattaacttcttcttttttattaacttgggtctctccatctttctcagttctcactatctggacactttcgatttctgaagttgagagacgact

SEQ ID NO: 2091 - DNA, 3000 bp, Unknown
  misc_feature (1)..( 3000): cDNA_ID_3065896_gDNA_ID_1620487_Annot_ID_158503 3000 nt of promoter + ATG
ctgacagacataacggctgagactccttggaagcttttagagacggcaacaatggcggctacgaaagctctggaatttgttttgccgacgggcttcttcatccagccgtcattgaaccgtcgcggaggagttaggctctccgtcgtcaagtgttccatttcttcagtcacctctacaggcaccgcatctggtaacgctcgccgatttccccatttccgtattttcacagcttgattttttcccagaactttagattcgaattggctttcgattcaaatgttatgtatatatatgattttttcagattacttgtaggctcttgattcgtgccttaatcatcgttttggttattgtttcttttagtttggatgagctgaaaatgtgtgtgaatgttgaaatgtgattcaaacaagagtaaagaggggagttaatgtgtgttaagacacatttgtcagttttggttttacaataaatttgggggtttttatttttatgtttgtaggacataatgagtccatgggtttaatgggtgcagatacatttcttttctatataagcatgtagtctcatttgtgagaaattatcagagatatcagagacatctgaaagtcattcacagaattaagtatcattcagctaaacagttcttaacctctgttctatcatctctgtttctaacagtgaattccttgttttaccggttttgtaggttttttagagaaaccatggagctcatacaatgctaggctagtgttagaagatggctctgtttggtcagctaagtcttttggtgcttctggaacccgtgttgctgaattggtatttaacacctctttgacagggtcagattcttttttagattctaatttagatttctagatattataactgggtttagaacattactcattttaatcctaccagatgatcttgacacacgggcaataacccgtcgattaagagaaagcggcagtcttaacggtgtgcttagcactgatggatccaaaaccgacgaggaacttttgcatatgtcccgctcttgggatatagtaggtctgaattctttcactgccctccttaaaatatgatcagcgtggaatatgtgattgagctctgtctatctgcttggttgaatattttaggccttgatctaataagcgatgtttcctgtaaatctccctacgaatgggttgaaaaaacaaatcctgaatgggagtttaagacaacctcctcacgtcacagggaatcctacagagtgagttgtactttctcttctctaatttacattctcatcgatttcctcactagcttctaactctgttttcatacttccacttcaaaaggttattgcatatgatttcgggatcaagcaaaacattctaagacgggatttcctcactagcttctaactctgttttcatacttccacttcaaaaggttattgcatatgatttcggcatcatacggttgtgaaatcacagttgtcccatcgacatggccagctgcagaggcgcttaaaatgaaaccagacgggattctattcagcaacggtccaggagatccttctgcagtgccttatgcagttgagacggttaaagagcttctaggaaaagttcctgtctatggaatctgtatgggtcatcagttacttggacaagctcttggaggtaaaacctttaagatgaaatttggtcatcatggaggaaaccatccagttcgtaacaacagaaccggccatgtcgagatcagtgctcaggtatgctccatttactatctatagattataaccacacaagattaaacagtctaatctttcagttctaatatagtttacaaatatgatgggaaaataaaaattattaatcaaaacttagttatatacttatatatgtaactctgagaacttgttgttacatggctgtcgagttcagcttctcacttcctagtacagtaaactaaaaaaaagacgtctctgttttgtgtctgctgaagattttgattgatattgtttgtgcggattttggcaaaaccataactatgcagtggacccagcttctcttcccaccggcgtggaagtgactcacgtcaatctcaacgacggaagttgcgccggtctctcttttccggcaatgcatgtcatgtctcttcagtatcaccctgaggcttctcctggacctcatgactccgacaacggtattaaaccattctttcttttcccttttgtctggtacctatcaaaacgtaaacgctactaaaacgctatgcattaatttttgcctaatcttttcatatatgcagcatttggagattttgtggagcttatgaaaagatttaaacgaagcacttgatctcggctaaatcagtgatctagcgaaggagttttgtttaggtggattgaagttggagttgcgaatttttttgtcgtgtgagaaataaaatagcataatgactgccgaaataagacaatttagttgagaaacttatgcaagtttgatatttatactaacatcaaaagtagcttgcttgccatttttgttaggaactggatctggtattttgctcaagtatggttttcttggcccatccacttctaatgtgttttgtaactaatgcaaaatgtgcattagaagtggattggtcaagggaagcgtacttgtgcaaaatgcggcagtccaattcctaacaagtttggcaagcaatccatttttggtggcttgtatgtaccgagctattacagactgacggttttgttttgtaactaaagaggagaaaaaaactctagtatatgatttcaatatctatggatcctccaatttagttttctggtttagatttttttcttccttatcttggattttctggtttattaggtttagaactaaataaaactgttatgtggttggtttgataagattttggtttcagttggaatatcaaaaaatatataatgggtcttcaaaacattaccattcgttgataataaaccctaagaaaatcaag

SEQ ID NO: 2092 - DNA, 3000 bp, Unknown
  misc_feature (1)..( 3000): cDNA_ID_3065916_gDNA_ID_1620487_Annot_ID_158495 3000 nt of promoter + ATG
tctatctatggtgagcacgcttacccagctactgtggcgcgatattctccgaacggagagtggatcgcgtctggtgatgtgtcggggactgttagaatctggggagcttacaacgatcatgtgttgaagaatgagtttaaggttttggctggtcggatcgatgatcttcagtggtctgctgatgggatgaggatcgttgcttctggtgatggcaaaggcaaatctcttgttcgtgctttcatgtgagtttggttttgctttttagataaagatttgatttttatagtgcttagctcaatgttgttttcgttgattttgattgatcggactaaaggttttgtttttctgctggtgttgcttttattttgttgaatcggatcgatattaatcagattgaaattgagcattttgtttcttcttctcaactttgatggattattgactcattgtttgtcttggtttattaggtgggattcaggatcaaatgtgggagagtttgatggtcattctaggagagttcttagctgtgctatcaagccaactaggccgttccgtattgtaacttgtggggaggattttctggtgaatttctatgaaggtcctccttttaagttcaagctctcaagcaggtcagatattcatgtgctccctttctttaaagaaatatgacactttcgatatctgtttaaatttcctgcttgtgagtttctgaattgtttacgagattgctgtttattggtcgacagagagcattccaactttgtcaactgtgtgaggtttgcaccagatggaagtaagttcattactgtgagttcagataagaagggaatcatatatgatggaaagacttgtgagatactgggagaactgtcttctgatgatgggcataaaggtagcatctatgcagtcagctggagtcctgatggtaaacaggtactaagttatatctgtttgttgttccgtattctcaactcttgcctgattccctcatattacgctcaaactacattaggcttaaacaaggtctactagaatagcgtatggaagtaattggtctaacctgctgcagtatgacgtacataaatgaactatcttgggtgtatctatgaagactgaatgacatattctctatcttctagttgttgattacatcatggttgatgttatgctacgtctgtactcacgtgttgtatatgtttgaatcatcaaccaggtgctcactgtttccgcagacaagtcagccaaaatatgggatatatcagacaacggtagtggatcattgaatacaacattgaactgtcctggatcatcaggtggagtagacgatatgcttgttgggtgtctgtggcagaacgatcatattgtcactgtttctctaggtggcacaatcagcatattctcagcaagcgatctggataaatccccctttcagttttcgggacacatgaagaacgtctcttccttagctgtgcttaaaggaaacgctgattacatattatccggtagttatgatggactgatatgtaaatggatgctaggccgtggtttttgcggtaaattgcagcggacacaaaactctcaaataaagtgctttgctgcccatgaagaagagatcgtgacctctggatatgacaataaggtaaactggttctcactttaatttttattcacatgtaggacttgtcaccttgatttctgcagtgtctgaatttggtgtttaggggattgaatgtaaggacgaaacaagtgaattaggtttttttctctctgaaatattggcaattctaaagacacaatggtctcttaagattattaacactttggaaaaatatactaatgatcttgtggtttagagaatttaaaagagcgatcactgaaggccaaatggtctttaccttgtaagactagcagtgactaatattttttatttcgtaggttatctaattgcttccaagcattattgttattgaagcaactaactcacgtttattcactatgtgattcttattcagatatccaggatctcctataaagatgatcaatgcacaaatgaagagtctatcgacattggaaatcaaccaaaggatctaagccttgcaccactctcacccgatctccttctggtgacctttgagtcaggagttgtgtttcttcgtgatgggaaagtagtgtcaaccatcaaccttgggttcattgtcactgctttggcagtaacacctgatggaaccgaagctgtcatcggtggccaagacggtaaactccatttgtattctattaatggtgactccctcaccgaggaagcagttctcgagagacacagaggcgccatcagcgtcatacgttactctccagatttgtctatgtttgcatcagctgatttgaacagagaagcagttgtgtgggacagagtctccagagaggtaagtaattaagattatttagaatctctccatgaatctggaacacaaacactgatcttatatcgtccctttttttttaaacagatgaaactcaagaacatgttgtaccatagcgcccgcataaactgcttagcttggtctccaaacagcactatggttgccacaggatccttggacacgtgtgtgattgtgtatgaagtggacaaacctgcttcgtcacgcatgacaataaaaggagctcacttaggtggagtatatggtctgggttttgctgatgattcccatgtagtgagttctggtgaagatgcttgtatccgcgtctggagctttactcctcaataagacttgacgtaaattataaagatctctggacaagtcctatcttgtctctttggaaagcttctactacttttgaaggctttttttgtgaatcttccgtttggccgtggctgtgttgatgtgtgtgtctgtttttttttttgtctgcatatcttttgtcaaaaatgaatgctctgttttggtctgaaactgagatcttgagtcagattttttttcattatcagaagattactgatacaga

SEQ ID NO: 2093 - DNA, 3000 bp, Unknown
  misc_feature (1)..( 3000): cDNA_ID_3065912_gDNA_ID_1620487_Annot_ID_158496 3000 nt of promoter + ATG
gatctaactgacaaattcttctcaggagaaacaaaagggaagggttgggattctactggattttgtttggtttgagccacttacgagtagtcaagcagacaatgacgctgctcaaagagcaagagacttccatgttggatggtaacggttcaaacttttggactcatatttttccagttacattttggtgagcttataagaatatcttttgtgtggggataatgtttgaaggtttattcacccaatagtgtatggagagtacccaaatacgttgcaaaacatcgtgaaggagagacttccgaagttcaccgaggaagaagtgaaaatggtgaaaggttccatagacttcgtggggataaaccaatacacaacttatttcatgtctgatcctaaaatatctaccacacctaaagatttgggttatcaacaagattggaacgtcacttttaactgtaagtttttgttcatatgtacatttatccgttatgacttatgaatgaacttgatcttgcttagattatagaacatataactagctaagttagggtctgaatgtttcaaaagcaaatatgtcagtatgagaaaaattactctagacttggaccaaaagtaaggctggttcgtccttatgggatcggactgtggcaatataaatgtgcatgatattaatactgagaaatcttaatatgtgcagttgcaaagaatgggacaccaattggtccaagggtgagataaatatatgttttcttctgagttttgttaactctctctgatgattgcttagttgtctgattatgaattaatctaattttattcaggcacattcagaatggttatacaatgtcccatggggaatgtacaaagctttaatgtacattgaggaacgttatggcaacccaactatgattctctccgaaaacggtattcaatataaatttttgttccacatccaagatctctagagatgttaagtgtataatctttataggtatggatgatccgggcaacataactctaactcaaggactaaatgatacaacaagagtcaagtattatagagactatttagtgcagcttaaaaaagcagtagacgatggagccaatctaactggatattttgcgtggtcgttgctagataatttcgaatggttatcaggatatacttcaaggtgcggaattaactaatgaatacctattgggtatatgattatttctgagaaaatgtatattatatggtactcttctaatgatttttttctgcctaggtttggaatagtgtacgttgattacaaggacttgaagagataccccaagatgtctgctttatggtttaaacaacttttgaaacgggaccagaaatgatgtggtcaatgtgtctatgatttgggttgttaacgagaggtgaatgaatatgtcatatgtgtataacttaagaacttgtcttcctttgacatttcaacgcttacataaaacagcagcaagaaatttggttcttctatcatagaacttctacattcaacaatgtatgctatcatcctcatcctcatttttttttaatttctattcactttaccgtggctcagtttctatttatcaagtcattcaaaattagaaaaatattggatttaaaatggatgtgtaagttcttccaaatcacttgtatcaaaaagatagatgttgatgttatgtgacagggcaactaattattgcaagtgattggcaaaaaaggaatcttgatcaatggatattttgagatgctaaaatgcttgttagactcgacgactcaataatggatgtaatcattcctcttccactgaaaaatctcataacacgattcacatcacatatctttttagacaaaaaatctttagtttccgtaccgtttatcacatcaatggatattttaagcctaatgcatgcacgttctttgaaatgtgtggacttaaattgatttctttagtttctcttttgttgtcattcactactcactactcactagccgtttgtgctttcaagagttgaatgaagaagaactaaggaaaaatacgttttcacgtgaagatttgggagacaagtctaaggaagtggggcattcatggtccacgaggactgaacttaatggatcatgatttgaccagtttgcccttgtcggcttctgtgtgttcacgttttttcctttggcgctttacgattcgcgtgatgactttttctcaaaatgtgggccggacacgataattctgttccggccattacacataaatatagttgtttttatcttatgagaaaagttataaaaaagaatcatattccgatttgggtaaatttttttaagcaacattgtgactgattttcagatataatttggactctggacacagctacgtaaaaacttactgtgtttagaagatatgttttatggaataaatccatgcaatatttggcagtcaatcccgatatcataagagtatggatcagcttctacagattctctgagaattttatcatttggtaacaaatcaaattgttgcaattcggatttttacctctatataagatgatgtccttttgtgtcatctccctatgcataagcatcaatatactttctacttacgaagtcgttacaaatgttaaatgttagtaaaaaatcaattaaataaactcattatattataataaaaaaacaaagacaattactttctcacattcttttcaccaaaattctttacatagtttagaaaattatatgatatatagttttaaaatccgaatttggtgaaatatatctagttttatttagtattcaattttaaattcataatgcttacagccttatcctatttattaaaaaaaaatccaacctttccactaatgcactcccataacaatttaacatcgttggttcatgtattatttgttttgaaaacaaaaggcttttaaaagcctataaatatccacccaattgttatcctccccaaaccaaacggtcaaacctcactcacc

SEQ ID NO: 2094 - DNA, 3000 bp, Unknown
  misc_feature (1)..( 3000): cDNA_ID_3065908_gDNA_ID_1620487_Annot_ID_158497 3000 nt of promoter + ATG
taaagtcaactggaaaggagttgcttattacaatagattgattgattacatggttcaaaaaggtatcaaaccataacgtttcttataaaacactgatttgattatagaatgaagtttaacaaatctaatttaatgcttagggattacaccttatgctaatctgtaccactacgatcttccattggctttggaaaacaagtataaaggcttgcttggtagacaagtagtgtaagcaccaatatgcaaagctcttttatgcattcctcaaaagttacaaactttgataatgcaaattttacaggaaagattttgcggattacgctgagttttgttacaagacatttggtgatagagtgaaaaattggatgacgttcaacgagccgcgtgtggtagctgctttaggttatgataatggtattttcgcaccgggtagatgctcaaaagcatttggaaattgcactgaaggaaactccgcgacagagccatacatagttactcatcaccttatcttggcccacgcagcagcagtccaaagataccgcaaatattaccaagtaaacaaataacttctaatacgttttcttgatcttcttgatgtgatatgatgaaataaacctatatatatggctcttttgccagtgtactactaatcttaatgaaaattttccaggcgaaacaaaagggaagggttgggatacttttagatttcgtttggtatgagccgcttactagaagtaaagcagataatcttgcagctcaaagagcaagagacttccatatcggatggtaaatgttaaaactttttaacaaataaaaactcatattttaccatcaagtcttggtgagcttatagaatatcttttgttttcgggtcatgcttgaaggtttattcacccattagtatatggagagtatccaaagacaatgcagaacattgtgaaagagaggcttccaaagttcacggagaaagaagtgaaaatggtgaaaggttccatagattttgtgggaataaaccaatacacgacttattacatgtccgaaccacatcccaccaccaaacctaaggatttgggttatcaacaagattggaatgtggaatttggctgtaagttattggaagattcataacgatatgtagattttggattttgtttacagtctttagattttgatcgtgacaattattaacttgcagttgctaagttggggaagccaataggtccaagggtgagatatacacttgattatatgtttttttttttccctaagcaatatatatacaagtgtctaagttattaaataaaccacttatcttataggcttactcgtcttggttatacaacgtaccatggggaatgtacaaggccttgatgtatatgaaggaacgttacggcaaccctactatgatcctctctgaaaacggtattaaagaaacaaattaaaatcttcaatcaagtttctttttgttttgttatatttctataagattattataaattttagagctttttataaatgtttgaacatattttataggtatggatgacccgggaaacgttactctagctcaaggactacatgacaccacgagaatcaagtattacaaagattacttaaccaaccttaagaaagctagggatgatggagccaatgtggttggatattttgcgtggtcattgctagataatttcgaatggttatcaggatatacttcaaggtacttaaaaatttataccaaatgtatgatatgtagaataaatcaaggttataattaatatctgtttttgtttattgtataggtttgggatcgtttatgttgattacaaaacattgaagaggtaccccaagatgtctgctcagtggtttaagcaacttctgaaacgaaacaacaaatgatctcaatgtatcaatgccgggtggatttagtttttaaaaaggttggaattgatgattgaagaaataatggggccggtttagtcactttgtttattataaggggggtgaattgtaacttgaactctctccttcttcagttctttgacttttcaacacaaataaaataaaagtttaagaataaatttgcactatgaaatatgaactcttgtccttttcaattttgtgagtttatatgcatttagaacataacggtctttgaacattatagatttataaagttgcaatttgcaagcataaagttggtaatcgaattgatgtaattacccttctttactttgtactaaacaaagcgcacttagccacttaacgctaaaacatcgtaaggacatacctgtcatttccacaagtgccactcgatttcgccactcctacagtcctactcgtcgactgctcgcttaaccattgaaaaagtgagccaagggttttgattattttcgacgtctacggcgaatctctccgcatcttcatcgatttcccggcgacgtttactaccgccgttttactcaatcgtgccagcttaagcaatcgaggtacccattttaggtgttacgctttgattctgcttttaagcattggacaattccggagaatatgctttagtttcctctcttttggagaatgattcggttctaggggaaagattgttgatttcgtgtttgtattcatcattgattgaaacatgcatgatgcattttcgtggttcatggtttttcacggcttcttatcattttctctgtcttttttttttttttttttttttttttttttgtttcagtgtgtattgaggtataccagagatagacataaatgagatggatgttgacgagatcgagtctgctgggcagatcaatatttctgagctaggagaaagttttctccagactttctgcaaaaaagctgcgacatctttctttgaagagtttggacttataagtcatcagcttaactcctacaacttcttcattgaacacgggcttcagaatgtgtttgagtcctttggtgacattcttgtggaaccgtcttttgatgtaataaagaagaagg

SEQ ID NO: 2095 - DNA, 3000 bp, Unknown
  misc_feature (1)..( 3000): cDNA_ID_2149557_gDNA_ID_1620487_Annot_ID_158499 3000 nt of promoter + ATG
atttctgaaaatccgtagataatcacttgaggttaactataggtaccagaagttgatacagctgtacggtctttaactgttatgtgggatgggacaatggtagtcgctgctaacaaccgtggaacatgttatgtatggcgcttgttgcgtggaaaacaggtagtgttcctgatatgcaaacctttcttttgtttaaccatgttgtagtcgcattactctaattgtccatgccatttaaaaattcaaaatcttttacagacaatgacagagtttgagccccttcataagctgcaagctcataatggccacatccttaaatgtctcctctctcctgcaaacaagtaacatgtttcttatactttctcttttaaccgttttcttcatcctctccttttcgaagctcttacatatttgttagcagatatctagcgactgcatcatctgataaaactgtcaaaatatggaacgtcgatggttttaaactagagaaagttttaacaggtatgttctccatgttactgtcaacagcattcattctccattatcgtctcttacactatcatcaaatcttatataacaggacatcaaagatgggtttgggactgcgtcttctcagtggatggagaatttcttgtaacaggtactaatctctgtcttaacttaaaccactgaaaaacatatcagaacaatctttaaacgggtttctatgatgttgtacagcatcatcggacatgacggctagattgtggtcgatgccagcaggcaaagaagtgaaagtgtaccaaggtcatcacaaagccactgtgtgctgtgcacttcacgattaaaaccttaataagaatcaaagctaaattatgaacaaactacgattgtgttatttgtgttttagtaaactcttgtacatttcaatcgaattcgttcaaattgctcttatgttccctctctgatcaaacatttctcaactatatcacaacaaaaatgctccaacaaaatttatttcagaagaggcccatttatacctgactcggaaactccggcccaaatgagccagtctcctcgcagaaaccacactaaaccctaatttgattcatttttagacctagagtataaataccaaacatttcaatcgacctcgtaatctctcgctctgttacgccattttcgtgagtaagaagaagaaacccgaaaacctcaaaccatggccgagggactcgtattgaagggcattatgcgcgcccacaccgacattgtcacggccatcgctacgccgatcgacaattccgacatcatcgtcacagcgtcgcgtgacaaatccatcatcctctggaaactcacaaaggacgataagtcttacggtgttgctcagcgtaggctcacaggtcactctcacttcgtggaagatgttgttctctcatcggacggtcagtttgcactctccggaagctgggacggtgagctccgtctctgggatcttgccacgggagaaacaactcgtcgattcgttggtcatacgaaagatgtgctctctgttgcattctctactgataaccggcagatcgtgtctgcttctcgtgatcgtacgattaagctttggaacacacttggtgagtgtaagtataccatctctgaaggtgatggtcacaaggaatgggttagttgtgttaggtttagtcctaatactcttgtaccaactattgtatctgcttcttgggataaaactgtgaaagtttggaatctccagaactgtaagctgaggaactctcttgttggtcactctggttacctcaacactgttgctgtctcgcctgatggttcgctatgcgccagtggtgggaaagatggtgttatcttgttgtgggatttggctgaaggaaagaagctttactcgcttgaggcgggttcgattattcactcgctttgcttcagtcctaacagatactggttgtgtgctgctactgagaatagcattaggatttgggatcttgagagcaagtctgttgttgaggacttgaaggttgatctcaagtctgaggcagagaagaatgaaggtggtgttggaactggtaaccagaagaaggtacgtcattatcttatgatttcactatagtaattggttctctattgataggttagtgaatgcaccaaaagtagtgatgaaattatctttggttatgacaaaaaaaaagtgaaattttggttagaaattgcatgtaggaaatcttttcccttacccattagctttgaaactaggaattttattctttaaatgttgctctgctccaaaggttttgactttgatgttaacatataggaagagattgataatggtatctaatgggaatgtgtaatgaaaatgcaggttatctactgcacaagcttgaactggagtgcagatggaagcacattgttcagtggttacactgatggagttgtcagggtctggggtattggtcgttactagagacacaacaagatgaagaagaagtcacgaaatctccggaaaaaagtttagctgcttttaatttttccagactgcgtcagtattgtattagtctctcgcaaacctctattttggcaatttttgtttaatttccagaagagaaaaaaacaatccattgattatcatatcactatatatcaaaaggtcacgattttgattacacttaccttcgtgatcttccgattggtcttattgaggttcaatcttcacaattcatccctataatatatcactcttatctctttcaccggccacattacaagcctattagatttctaaagcccatgattggcccaattcagttagggtgggtttctttgtcttcaaatttgtaaccaccggaagcagaggagagtatcttctgaagcattaacctaacttatttatgatccttgagatgatgatggccaatcttccaagggatttagtgaaccttgttacggatacgtacagtatgaactctactacctcaagtcctcaactcctctaaaccacggatg

SEQ ID NO: 2096 - DNA, 3000 bp, Unknown
  misc_feature (1)..( 3000): cDNA_ID_2149553_gDNA_ID_1620487_Annot_ID_158498 3000 nt of promoter + ATG
ggcgccaaagtgaattacctctcgaggtatcttctgtttcagcaaatgttttgctatattttgatattcttgtgctacttgattatttgctttggatttttctgcttcagaaagtatcctatgtcgaatattatttacatatatgtatcacaacgttatctgcagatggaaatcaagcgagataaagatgacaatgaggtgagaattttcactgacgctggtagactactccgacctctcttggttgtggaaaatctccacaagttgaagcaagacaaacctacacagtatccttttaagcatcttcttgaccaagggattctcgagctgatcgggattgaggaagaagaagactgtactacagcatggggaatcaaacagcttctgaaggaaccaaagaattacacgcattgcgaattggacctatcattcctgttgggtgtgagctgtgcaattgtcccatttgcaaatcacgatcatgggaaaagagttctttaccagtctcagaagcattgccaacaagccatcggattctcatcaacgaaccctaacatccgctgcgatacgctgtcccagcagctgttctatccccaaaagccacttttcaagacattggcgtcagagtgtcttgaaaaagaagttctatttaatggccagaacgcaattgttgctgtgaatgttcatctcgggtacaaccaagaggactccattgtgatgaacaaggcttcattggaacgtggtatgttccgttcagagcagattagaagctacaaagcagaggttgatactaaagactcggagaagaggaagaagatggatgagcttgttcagtttggaaagacatacagcaaaatcggcaaagtagacagccttgaagatgacgggtttcctttcattggtgctaacatgagtactggcgatattgtcattggcagatgcaccgagtctggggctgatcacagtataaagctcaagcacactgagagaggaattgtgcaaaaagtggtattatcttctaatgatgaagggaagaattttgcagcggtttctctgagacaggtaagttccagatcatactgaatcgagctgtttttcagagaatgcattcttatgatgaatcaaatgttccattgattggcttttacatcttgcaggttcgttctccatgccttggagataagttttccagtatgcatggccagaagggtgttttaggctatctagaggaacagcagaattttcctttcacgatccaaggcatagttcctgatattgtgataaacccgcacgctttcccttctaggcagacaccaggtcaactcttggaggctgctctctccaaaggaatcgcttgtcctatacaaaagaaggagggtagctctgctgcatacaccaaattgacacgtcatgccactcctttctccactccgggtgtcactgaaatcaccgagcagcttcacaggtacattcttcacattgtcacttggtttttagctcgtaaaacagaatattgaattatatgcaatacagattgacatttggttcctagggagtacagatggatgatatcattaagggtaggaactaattattaataatgttgcctggttggagatgtttgaactttgggactttggctcaaaagctgacatgatatgcataataccagcaaatcgagctaatatactgcacaaggcactaagctagatttgagcaccttacttgaaacatgtcatagtggatctttgttttgtttcctagtaccagaagtgagcatgatttatatgacgggcaaatatctctgtaagaccaaaaaaactaagaagttggatgttctctggttgattaaattgtgcctgcaaaacgtctagaggatacacagaatgggctcaaaagccatgtatcagtatataattagttagaggattgatgctgtgagccttgtgattatgtatgattcgttgaacctttcttagatcattgttgattgccaatggtaaatatttgtggttagggccggcttttcaagatggggaaacgaaagggtctacaatggtagatcgggtgagatgatgcgctctctgatattcatgggcccaactttctaccagcgacttgtccacatgtcagagaacaaagtcaagttcaggaacaccggaccagtccacccgctcacacgccagccagtcgcagaccggaagaggtttggcgggataagatttggagaaatggagcgagactgcctaatagctcacggtgcatccgctaatctgcacgagcggctcttcactctaagtgactcttctcagatgcacatctgcagaaaatgcaagacctatgcgaatgtgatcgagaggactccaagcagtggaagaaagatcagagggccatattgcagagtgtgcgcatcctccgaccatgtggttagggtctatgttccttatggagctaagcttctttgtcaggagctgttcagcatgggcattactctcaacttcgacaccaagctctgctgattccccgtcattattatgtaaatagcttaatgccttaagaccatgatgatatgtgtagtttgcttcaatccctgttctggttagtgttggttttggtttggttgattctgtaagggttatccgaaacgaagaaatcgttaaaccaagccactgaactaaatcttaagtgttgcttttgtaagagttgactctttaaccgtaaatgatgatcggattttgtaaaaatcagttcttttgtcaacgctaaccggtttatatctggttttctatgtgttttataatgatccgacccagacccggcccgtttgcactgatgccgccaatgttaaattggtcagacataaataaaaccttaagtattaggaaaacattcatcgtcttcttcttctagaggcataaacccttggcttggagccgtttctctcattcttcgatttgattcaatttcattttcataaagaaggatttctctttctgtatcgcg

SEQ ID NO: 2097 - DNA, 3000 bp, Unknown
  misc_feature (1)..( 3000): cDNA_ID_1398444_gDNA_ID_1620487_Annot_ID_158494 3000 nt of promoter + ATG
actctttgtccctctctctttctctattactctgtctcctctgttccggcgatgttccaacacgcgccttcttccatttccctcatcatcatcttcctcttcaccattctatcacccgtttcacctgaaccggtcacagtccagccattccgggtcaaatcatccccacccgcaaccatacccgctttcccggagcaatccgatttctccggctgcccactcgatttaccagaagacctcttccacggcatcaagtcagcttgcagcggcaaaaagctccacaaaggaaaatgttgccccgtactaggcgcgtggctctactctgcttactcaaccactgctctaagccgttcgatttccgccgccgcaagaaactcatcctcctcctccgccgcggtaacgactcctgaagaagatatgcctttgcttcccgatgactcggagacttgcgttgacggattagggaaatctctgaggcagagagggattgagctcactagaccgaacgagacttgcgacgtcgtttactgctactgtggaatcagattgcatccgttgagctgttccgaggcttttagagtgaatgatgaagggagactcgttggagacgagagagttgatagattagagactgattgtttgagtggaagccacaacaatgctgatggattctcacctcttcttggttgcaacaagtgcttgaacagtctctataaggtaaagtcactaactttgctgctatatttagaagctgccactgtgaagttcaaatggaattaggttggctaaattggtaaaatgtgtgtgcaaatctagtaacttttagataatctatagataccctgaagcgttgttggtgtttagcttctggattttgtttgattgactgattaagacaattttttggatgagtaatgaggaattgatggactagttatagtagttaactatgtaaggtttagtccaaagtttagaagcccttttttaatgatatttatttggtgtttaaggattagggttttactatatgagtgagtgaagatttggaattatgtagtttaggattctttctgatctatccatcatatggcgaatggtagtaatttgggaaaagttttgttctttagctttttgttctctttctatctgacagtctgacacacatatacgcgctaacagaatccgtgatctccacgcgacgttttgtcttccatcatatgatttcattcttctgcatcttaatcaccaacccaccatagccaaaagcttagcaactagttgccacctttctactttctacaatcctcaatcattactttagtcagcagcaacaaaccctaatcaaaacaaacacttctgcttcattttgcagctaaatccgaagaaaacttcagggacaagaaacccatcaaaggaagaccgaaacagaacagcaaagatgcacaacaaagactgtgtcctcatgggtctcacttggcttctcgctaagaaccgtactgcttatttccccactgtcacttctgtcctccgagccgtcatgctgaaccacgatggcgtgccacgttcatgtgctctcggcagcgacggcatgcctttagccgtcgattcttccgaattctccaacggctcgccaacttcacttcagtatccgcaccacttggtccacttcttactttacagcgttatcacattagtcctaataaggtcgtggtgacgtggcacaccatggttggatttgattgtgacgtggagcacgtggcattacgtggttggttgagagaagtgaaattcagatagagagaaagagagagggctttggttctgtctttgtaaattagttttttggtgtcgttgttgttttagtagccatgttctttaacattttattacatcaaaaaaatcttgttgtattttgtcaattaaatattgaaaaatcacaatttgaaaatatttcaacaatattttcggtcatatcaaattatatgagcgcaatcaatataaatatatcagtttttgggaggagaagaataatagtcagagaaaggcatgtgagtaatggggacgaggtggtgtggctggtttgagagagacagagagacttgtgacagctttgttcttatgtttccttatcttctctctaaccacggatgctcctataacaataatacattcatgattcatccctatcatattctatattttatatgaattatcaatgcgaccaagagatgtaaaaagccccacgactgacactttattttctcatatagttcaaataatatttcattcaataatcgaatgcttccattcgttagatttttcctttgagaaatattatgaaaaagatatttcataacattttttttgtggtagtgattagatagaggttcactaatgcgccaatcaactgctagcgattcattgactttggcattattgcgtatataactgggctgggctaaactaacttgcccatgggccgcacatttacctttttggccaaataacacacccattagtctaatctaaaattacaatggtaaaaacatgagagattgaggaattgattaaaatggaatgaagataatagagaaataatttggttccactcatttctaatttagtagaaaatatataatttttcaaaattgttcataattcaaggtatttccaacaaaaatcaatggaagtttattattcttaatgttatatactactctgcattatgatatgtaagtcttaagaaacaaagtgattagcacaaaactattatacaactacactttacattatttttgggttatctaatgagtttgtgccagagaagtgaatgttgcaacaatgattatcattacattatctttctaattacaacaactaaatattaacaaatgtaatgtcaaacaaaactcaaaaagactcaaatccgtccttccattttcctcgtctctcttcttccccgtaaacccaaaaacaatctctgcaaagtcctcggttctg

SEQ ID NO: 2098 - DNA, 3000 bp, Unknown
  misc_feature (1)..( 3000): cDNA_ID_2724435_gDNA_ID_1620487_Annot_ID_158493 3000 nt of promoter + ATG
cttgctgaaaagtgccagcatcagtgcatctaaatgcattggcatgaaaccaagaaacaagtccgaggtaaaatatcaagaagcattagatgagatgtattatatagtacaagtttgtctacacttgttcttcagattcttgagttttttgcagtacggggaatcaaacaatgatacggttgatgctctgtctcaaaaggtcgcggctctccacacttgacttgtttcagagattgaggattgaaacttgttgctaacagtagacggctgattctacaagtcttgtacacatctctcagagaagacgaagaagaagtctgatcttgatagagatattgagagacatgactcatgagctatgaacaaaacaacttaaccttcattggtcttcaatttgtccatcaagtcgagttgtattaaaaatggatggagaatataattaaagaagaattgtgttaacccctggatttatgcctgacaagtatttgactttatcaggcattataaattatagttaaagtgtgtgttttcttcatgacccatatgtgcctaacctaacttgatttactgctgaatttcttctttttagtcgtcccatttactttttctttgttctcttttggtttacttactaataatctctttagagctggtgaaaatgctgttacaagctctacatatcataaataacttgaaaagatcaactttaaagtagtctataatatacaataatgggatcaattacgaggaaaccatagtaaagtatggtctcttctgaattcaggcatattctcaagtgattataaggatgggtattttctttttctctaaaagactaatttatccttttattgtttcttcattctttcttccttcttcaagctcttgattcagatgcgagtttgatgaagatggcttagttgctcatgattcacaatcagattgttttacagttgagatggatcgatctgtgtctataattaaagcctttgggttccctaaacatcatcccttagggtttagttttcttgcaacaaaacttgtttaattagttccattggattcatcgaaaaaggttggtcatagaaatgttgtgtgaatcatcggaggagaaggaaacgagatttgattgttgattgattcaaaattaaatctgggtatttatcgtttgtggagttatgggtttagtaattataggaagttccgataatgagtttatttttaatttggattttcatatcatgggttatgggtagttatcgtcttctttgtacttctcaatttcaatttggagacagtgaggttgttgtctcacgacggagaagatgaagatcatcatcaacacattcgagggcaaaatggtcatttacagaccaaaaagtacccagacttataagcccaaataaaatatgtttctattctaatttttgggtcaaaatatgcccatatgtacaaaaacccctacaataatgttgtaaattttagtttcttcttttactctatagtctaagtctatatccaaattgactgactaagtttatttttgatatgatatttgaagtttgaacacggtaagtatattataaatttaccatttgtaactctatagtaaaatagtctcttgtccttgtgacgtaagtgaatccatcttgcattacgttatagatagatacttttgtaatggcattcccgaaaaagggttttgtagtgttatagtttaagcagctttcactacaacaaaccattcgcatgcctgacattacctttttaacatggagctccacataattctttctttttcctttttactatcaaccaatagtgttttgtgggtaaaatggatataaaagtaaaattccatgaacatacttgtactattaatctcgagataaatcctagactcctagtgtttatgttcttgtggtcgtcgtcgtccaactagttcttgcttcaacaaaataagaaacaaaacaaaaccaaattaatagagactcctagaaatcaaaggactaaaaaacacttggaacaaaaagacagaagttagacttctttttcttttgagatagaatattttttttatttcatggaaataagagtaaagttgttatacaactctttatttttctttatcaaaaaaatgttttattacaactcaaaagtttcatgaaaattgacaaaacagctaaagtataagtctataaccataataaaactaatctgacgacttttttcttatagctatattagtgattgaaaaaattgcatggtctcttgttttccatgacatttaagttgcgaaaaattaattgcattatattgtaaactaattaacggaaaagtttatctgcattacgagacaaacacatgctagtactataattttgtagtttatctgcattgttgaaatcggactctgctaattttattgattatacagattacatatcaaatctagtaaatatgtagcgtttaaaaataaaataaaaaagtactcaaatatgataagctaaacttaaacgaatccttccaaactcttatgtattgaaattattaacaaataacagtgaacctgtcgatcacttgcctctgtgatctttcaagtttcaatgcaaagaacaatcgtcccgtgattcacaaccctcaatattcaactaaggttaccctaataagtaataatccaatatgatttcattattcataaaatagtcgccagcatggattacgattaaaaagtttattttttctattattgtcctacacactgaaaaatggagtgttaacgaagcataagaaatgttttgtaattttaagaatgtttgatcacaaatttttttccactgatttttttacattattaaaactaataaaaaaactgacttagtagtattaaattggtatatatcgagatcccatttgtgatattttattacacatctcttccagtctctcactctttgtccctctctctttctctattactctgtctcctctgttccggcg

SEQ ID NO: 2099 - DNA, 3000 bp, Unknown
  misc_feature (1)..( 3000): cDNA_ID_2149497_gDNA_ID_1620488_Annot_ID_158525 3000 nt of promoter + ATG
agtcatctaatctataaactaatccttgatccctaaaccaaagacttaaactttgactcattgatttttagatcaccaccaagctaaaggatctagattcaaacattcaaaagacccaacaaataaaaatcaggacttttcaaaaattgaagtgcaaaatctcaccaattcattaccactgctgctggaagaaaccatctttgaagaatcatcctcagagttcaaatctctagtctttctacttccccagccagcagttagatcggtgactgtagattcctcagccgcggagacgtctttattgccggaatgttcagagcgagtaaagactcgaccggagttaacagctaaacggagaccagagcgaacggcgtcgtttacagggaaaggccaaatctcggagagagtgtaagaagaaggattagctgcagagaaggaggaatcgttcactagtggagggtccatttccgatgatcgtaaaaagggttgacccagatttaggacccggatccgagaagtgaggaacttgatagaaaaaaagaaggaaaaggtttgagctttgcgaggtcttgtcttgtttatagggttgtgtgtgaggtggacaaatagagagagagatcggagaaggtaagacagatgtgggtagtgataatgcgccactagtatgcaatggaagatgatttatcaccaatactttcagaaaatctcattaattacacagcttacatcaaatattttgccgtttctgttataaaaaaaatattacaatggtaaaattttcgtttcgtttagaaacaaaattgaatagaaaagatatattatggcgcaataacctaaataatttctatcaaaaataaaaaataaaaatctcacaattatgtcttttagttatcctttgattaaattattttttactgtgaacaactttggtaattttactgtgaacaacttaaatacaccaaaggacaatgcatctctcttagaaaaaaatacatactagcaaaaccaaatcatgttactttggtaatttcattctgacgtgtttaaggaaaaaacgtatatgtttggattaaaaatttgatcttcgtaccatatgtccatcctagtaagtactcgatcgcctatgtttacaataatattcaccaattagtgtttttttatttaacatagatctcccacttcatagtcatatgttttatgaaagttagttgtgtaaagtgaagggaaccacacaccggtacgtaggatacgatcgaggatgtgacaatgggccatatatttaaattttaaatgcttaatcacaaaagccaaaattctagctaaatatataaaacgctaatatgaaggatagatgacatgtgttttagtctttttgtttgcatgtcaacgttcttcacgttaaatttttaaaaattcagaagctatagttttattatgttcaatgtagttttagcctttttggtagatgacatgttcaaggtagttgcggaaaaatacaaggagccaagagtgtcatttttcgtttcgatgatttcaaccttcatttgttgtgtttattataaaagtttgtatttttgaatgatgaatacagagatatcaaacgtttttaagaatacagtatataacaaacaaaaaagctctaaaactattcactgagttaaaacttttaaaagtcaattctatagcattgaatgctctaaatgtgtagcaagaaaattgtttaaagaccaacaaattagaaattgatgtttttctgcaaaacttttttaattattaattttattatcgaattaagtggaatatgtttatattttgatgaaataatgaaaaggtggaaaagacaagtgtagaaagagaagacacctggatgcaaaggtgtcacacatgaagcccaattcctctctttccatttttcccataaagcttttttgctctactcatcaagatacctctaataaaaaaacaagaaacactatttttttgttatcaatttcttctgttcatttcagtttggtcatgaaattaagaaaattaatagagagaaaagtcaaaaataaaaacatgagcataggagtactatgtgacttcattggtgatggaatgacacagttggccgatttagcaccgactaagtagacattaatcaataatagtttaaatttcaaaataagaatcatatctactaaacaatcaaatacatatgattccatctactattattgtttttttttaatttataaatcatatagtactaattaactaataatttcacattctgtctcgtgtaatcaagacaaccttttcgatttgtttttttggtcgatttgcttaaccttaaaaatcttattacttcaattataagattaaaattcgacaaaaacataacgtttttcctttttattctactggtggtggaaataatcatctagaataataaaattactttaatttgaaaagataaatccaacgaatctataactttaatcgaaaactaaataaaataaggaaaaagagaagatttaaaagcgaagaaaagattcgaaaaagagagagagagagatggaccaaaacggcggtttattcagacgtcagcagcactaactaagaaagaggagagagctttaactcttccccttgctgcttccttctccaaattctcctgacgcgtttctgttcatcttacgattttacacgtctctctaaagatttaaattttcgactttacgtttctttcgggttttgaattttctcactaaagatttgtcttttccatagaaagttcttgaattttctctcttcgtgttcaaagggtttttcagaatttatagtaacccaccaatctactgattgtctccgttcatcgtaatctctcaagatttgatttttatttgttttttgaaattttgaattttgagattctgttcctctttgatcatcatcactagggttttctgtttccagttaaaaaaaagtttggatttttcttcgtataatttagga

SEQ ID NO: 2100 - DNA, 3000 bp, Unknown
  misc_feature (1)..( 3000): cDNA_ID_1388852_gDNA_ID_1620488_Annot_ID_158537 3000 nt of promoter + ATG
cgattcccgaggctcgaaaaaaccctaaatctcttctccgttcactcatccaaccgaagatgcgtgagattcttcacatccagggtggtcaatgcggtaaccagatcggcgccaagttctgggaagtggtttgcgccgagcacggcatcgatccaaccggaaggtacaccggagactcagatctgcaacttgagcgcatcaacgtttactacaatgaagcgagttgcggtagattcgttcctcgtgcagtgctcatggatttggagcctgggactatggatagtctcagatctggaccgtacggtcagacctttcgacctgataacttcgtctttggccaatccggtgctggtaacaactgggccaagggacactacacggaaggagctgaactaatcgattccgttctcgatgttgttcgtaaggaagctgagaactgtgactgtctccaaggttattcttcttcttcttatagatctgtttgattttagtgttgataatgctttactagtgttttgaactgtgagatttccttgtgtagggttccaggtttgtcactcgttgggaggaggaactggatctggtatgggaacattgttgatctctaagatccgtgaagagtacccagatcgcatgatgcttaccttctcggtgttcccttcaccaaaggtttctgatactgtggttgagccttacaacgctactctgtctgtccatcagcttgttgagaatgctgatgagtgcatggttcttgataatgaggccttgtacgatatttgcttcaggactctcaaactcactacccccagctgtaagatttcatttcccaattatgctctccaccaatgttaagatgagttaaactatgcttgaaatgcttggtctacatggtgtttatgttaataattggtatcaagttcagatctgcaagcatctatgtaaagcttatagtattgttactgtttccattggtttgctctttgactatgtcactgttttatatcagaattctgatttgcaagtctctgtgcagaacttatacttttgttactgtttccagtcgttttgtacatatctttagcctcttgttttgtgtgatattgcttctgtttacctattttgatctcatcaccgaagtaggtccttaaactactcttattggaacaatactttctggttaagttgcaagtagaaatctgatacttgatgatcatcagtttgttgagtttactgtctgctttgattcttttctcatcgtactgtttggatatgtctaaagcttacacatacttggattttcttctgtgtgcagttggtgatttgaaccacttgatttctgctactatgtctggtgtgacttgctgtctgaggttccctggtcaactcaactctgacctccgaaagcttgctgtgaatctcatcccattcccccgtcttcacttcttcatggtgggttttgctcctctcacctcaagaggttctcagcagtaccgttccctcacagtccctgagctcacccagcaaatgtgggactccaagaacatgatgtgtgctgcagacccaaggcacggacgctacctcacagcctctgccatgttccgtggcaagatgagcacaaaggaagttgacgagcagatgctgaatgtgcagaacaagaactcgtcctactttgtggagtggatccccaacaacgtgaaatcgacagtctgtgacatcccacctactggtctgaagatggcatcaactttcattggaaactcaacatcaatccaagagatgttcaggcgagtgagtgagcagttcacagctatgttcaggagaaaggctttcttgcattggtacacaggtgagggaatggacgagatggaattcacagaagcggagagcaacatgaacgatcttgtgtcagagtaccagcaataccaagatgcaactgcggatgaagaaggtgactacgaggatgaggaagaaggtgaatatcaacaggaggaagagtactgagaataatttagttataactgctttaaaaacaaaaacaatttagtcgtttgctacttttcttttttttaaaaggaacacctcaactaccagttgtagtttttttctctgcttgtatttgacatatctggttgatgtttctgtacttttgttcttaatcttgttattgcctgtgatgtttctattaatattttccagttgtactgtcttcaatctttggtcttctatcctcatctttctgctacctgactacctcagtacctacttaaggactttaggtttgatctgtttggaaaatagattaaggttcgggatttgtgacctcagggcaagtgcagctccatattagaccccaaaacaaatttatcactgttctgaaatacaaattccccaacatgcctagctttgaggattgattgtttctaagctatttattttctttaccaattcacataaatactttaggataaagtggaaattgtcaatattcaaacacgttctcttccctttgttaacaagcaaaatatgaaaataacatgtgctcttccattatttcattttttgcaacccttatgaatgggcccaaagcctgccacaaacatgtgcacaatattagaaaagaaactctaaaaacaaaaacaaaatgaacattcttttttttgcaatttgtattataatatcaaaataatattttaaaactcaatttaatattggaaaataaaataaaatttggaaactaaacagttaccatagagaaagaaacggaccatttttaaattttgaatttcgagaaaaacaaaatcggcgcctcttattagagataattgggggaaaaaaacaaaaaacaaacacagagagagcaataataaaaactcactcactctcacttttttcatttcttcaacaaaaaaaacctaaagctctcttttctctccagatttcgattcccgaggctcgagagaaaaccgtaaatctcttctccgttcactcaatcaaccaaag

SEQ ID NO: 2101 - DNA, 3000 bp, Unknown
  misc_feature (1)..( 3000): cDNA_ID_2149529_gDNA_ID_1620488_Annot_ID_158536 3000 nt of promoter + ATG
gcacagacatcaaggaaagcatataatatgttgattttgaactcgttttctaggattgtttctttattctgtagctttgaatttgttccaactgaaattgtggtcattgttttgtcaaaaaaaaatgtggtctttttacatatatcagaaaaatgatgtttttacaaatctcgtacttgtgtgacaaaaaaaggtatatatatatatatatatatatatctacatatatatttttgcagtcattttgtgaaataaatcttggagttgtatattatttacaatggctgacattggcttttaattattgattttcttttggcaataaattgattaataaacaaaaaatattccaaatatattccaatcccatatatcacgcagatttctccaaaatttgaactaaatttcggaaattatttaaaataaaaaatatttgacaaaccaaaatacaattgcaatcccttaaaatgagcaaaactcacctaaatacattccttatcagtttactaaatcttatttctccaacatttgaattagatttcgacaactatttaaaacaaaaatttgtttgacaaactaaaatataattgcaatcccgtaaaatatttttttaaattagcggtgtaccgcagatttttttaacgggacgggtttggtagaacgggtttggaaggatgttacttaataacaattgtaaactataaaatataaatattttataaataaatataatttagataaatataatttacagacttttatatatactaattaaaaaaaaaaaaattatctacgcggtgtaccgcgggttataatctagtatgtcttatgcttgttagaagaaagtcggatgttttgttcttaaattttgaatacatgccactaccatgtgtttctaaaacaaaaacgaaaccatctttaccatctctagttttattaaatcgggttagttggttaaaattcgttattaaattaatttataacttattaaatagagataaactgttatcataaagcaaggggaaaaaaaaactaaatcgagcaaatacttgaaaatatgtgacgcacaaaacatagtatatattataatgttaataggtttgctattctggcatcaattatggttttacgtaaagttcagacgttttatttttttatttaaggattcttacatatgtttatgtttgttttttttttttttttttttttttttgagcaactacttatatatgtttgctgtttttgtccgaaggccaattagttttcctttaacacttgaagaatatatatttttctctgacataaaaattctaaaatagttcaacttgtacaagtaacggaatactaaattgcatgtcgttgttgttatcaataactttagattaacgcaaagtgtaggaacaaagaaccaaaaatagtaaataagtgtacatgtttgaaaacggataacaacgaatactaaaagatcatataacaaacgacgacggaagtagtagtggtagtagcagcggcagcaaggtccagtcaaaatcacttggcatttggctaacaaagtcatcgtaacgtactataaacaataatatcaacttctcttatgcgtaatgcatttccatttatttagattcctatattatctgcagaataaaatataacagaaaagaaaagatgacaggactacgaataagcatggtaaattctgaacccattgtttctcagtggggaatttttgagtaataataattgatatcaaatctgaactatagtacaaattttgttttttccctaaaggatatggaaatatggatttcgaaaattttggtacgaataataaagccaatcatcggactggaaaccatttttgtcggaatttttcaaaattcattcggctgatttaatgtaacaaatactcatatataaagcaaactgaaactaagaaaacaaaaaacctcaaattgaagaagaatcttagtatataataaaatagggtttggttatggtcaatttgagtccaatattcttttcagaaaaaccaagtgagaatctaaccgaattatttcccgactttattcggtacctcgaactcgtaaaccgaataaaccgattcggctacaggctctgtttcgctttcttgttggtcaattataattgaactagagtcaatcaatatcaatgtttgtggtcaaataattgaaaatgggcttttgtatcaacaactgttggcccaatttaaaaatggaaacccaaacatctttaccaaaatatccaatccataaacttggatcgttaagtagattttacatactttattgttatgatttattcacatgttgtcacggcccagtgttccctatagtttgattggattgtgtctaagctattgatttcctttaccaatttcattagccggtccatctattggaggaaaccttaagctacaatttattttctttaccaattccacatatacagtttaggataaaagcgaaattgtcttttttcaaacacgttctcttccttttgttaacaagcaaaataacatgtgctcttccaattttcattttcagcaacccttcatgaatgggcccaaagcctgccacaaacatgtgcacaatattacaaactctaaaaacaaaaacaaaataaaacattcttttttcccaatttgtattttaatatcaatttgaatcaaactcatagttttaaaactcaattttgtaatcgaaaacaatttttttttttttttttaaggaaacttacacagtagagaaagaaacggaccattttaaaattttgaatttcgtaaacaaacaaaatagtagcccttattagataattgggaaaaaaaaacaagaaacaaacacagagaggagtgagcaataataaaagctcactcactcacacttttattcatttctctgaaaacccttaaatctccggatttcgattcccgaggctcgaaaaaaccctaaatctcttctccgttcactcatccaaccgaag

SEQ ID NO: 2102 - DNA, 3000 bp, Unknown
  misc_feature (1)..( 3000): cDNA_ID_2149513_gDNA_ID_1620488_Annot_ID_158530 3000 nt of promoter + ATG
ggaacaatatccccgagctttatgctgattatatcacccggaacaagaattgcagcatcctgctcaccccatcttccatctcgaagaacctttacaaacgttttgacaagggagatgcaaatatacattaagcaaatggtatccgtctctcagctaagaaccaaatcaactaactgatataccagaaaacaatctatgacattgttgaaaacaagtagcaataagcaggtatatcaaacctttgcttttggggcaagacgtgccatgagtgcagcagcagcattcccggcattgttctcctctatgaaactgatagtggagttaatcacaagcagagtaataataccaacaaagtcttgccaatcaggtggcttcccctggtaaacaaagcatcatcaagaacacagaccaaatgaagattattaataaaagaggtaactttaaaacaatgaaaatatgtaagagagtatgctcactcctccattagcaagagcaatagccatgatagcagcagcttccataacccaagaaagagggttccacatgaaaccaagaaatttcaggaatttgctttcctgcaacaaaaaaaaaaaaaggaactttgcttcaggacataaaaattataatcgtttggagctatagaccaaaacccaaaattccagaaaaacacatgaatacaacatagagaaaggaacaaaaccttcttctcttcgagcttgttatgcccaaaaagagccagcctttcatcagcagcttctgtagtgagaccttctctgctacatctcagactctcaaaaacttcttcaataggtacattctcctgaaaaaacccaagaaaacaaatttcttcagattctttctctccaacatcagagaaacaaataaaaattaaaactttagagtagatctgttaccagatccacagtttctttcaaaacagcctcaaggacttcttccttgtcccccatattctcctgctacctcctagtacaattaaaaaccatacaaattatcagaaaaaattctccattaaaacaccaccagaaagctcaacaacttaaaaaaaacagagaaaatgttgaaacacagagatgtagaaacctgtttctcaagatgatttcctaatcttcttcttcgtttttgtcttttgggtttctcagaaaagagaaagaagagtagagaagatgagaaaaccgctaaaggttagtggcagtatgggaagctaacacactccgacctctctctctcgcaccacaattatatccttcatttatttattaatttcctttatatatttaatctattaaattctcagtcttgtttaggcatctttttcttactgcctttttcaacattttttcttcatgcgtcaagcaagattcatgacacctcatcatctatatcttttactacaatagggaattaattatttaattaacttgacaaaaaatctaattgcagacaaactagagatgttaatgatcttttcctaactcaaaacacatgaaaatgtatccaagttaggaaagtgagtcgtcattagagagtataaacttatgtaagttaaagtaatagccttgtaggcgtgaatgaccgttggaattaaatacaatacatgggaaataaaagcgagtaggtcacagagacactctcaacataagaaagaaacagccatgtgcatcacaaagtggtggccatatgcttgaagagatgatgctcccttggaaacttgacacgtgtccatgaaaaccacataaacagttcacattttacaacacacgccaaaacacaacccacgtgacgcagaccttttgttcttatttgtactatttcttttttttctttttctatgcgtttttttttttaaatatgaataaaggtaccatgttccgtacggtacccgtccgtagtagaacgagtgtgcttccaccactctcatgaactttttctctcatttttcttctttcgactttataaactttttttcgtttcaactttgtgtattattagtttgattcagtctttttgaacttcttctttggataatggaaatttgactaggagatgatccatcttatatcaaagtgaagtctcctttttatttttcttttggctttttccctcggcaacgttaacgaatatttttcttttagcttttatcgtttatcattgtgatttttgaagtaattaaacattacatctatatatcgcttttagtgttctatcctttatagtcaaaatgtgtcccatcttgcctgttagggaatatggagtaatagatggtgagtggacttaatctttatcttacatatatatgatcaaaacccttcttatatctatagattctgaactgtcttccaaatggctatgatctttatgctttggaaagaatgtaacaacctcttgcacaacgtgacatcaaaaaccgctgctgaaattcgagaagtgtcggtaaatactctacttgctaggagaaagaggaaagcttttgcaacccttctatatccaatggttcacatttgactaaacttctagtgctcaattagtcaattagtttcgatttgggaaaattaattatagtcaatcaaaaaaactataaaaagacatcctttttttttcttcttctgaaaaacaaaataaaaagacattctaaggattaaaatttcatgatgagaaaagtgaccgacatattattgatttgttattcaactttgataaaatgcatcttgttattgaaaataaaagcccatgataaacttattggaaacagaaattcgtccatgtcccaatggaggctcaattatttttagcccaaaggtttagtaaagtagtaatcagcccatgggctacttagattggaaaggaagaaatacgccaattttcaaaccctatagtcgcgactcgtgagctaccttgatcgtcttcctctgttctcttactcagatcctttttagaaaacaaaatattttggtcgaattaagacataagtaagtagctatg

SEQ ID NO: 2103 - DNA, 3000 bp, Unknown
  misc_feature (1)..( 3000): cDNA_ID_2105676_gDNA_ID_1620488_Annot_ID_158532 3000 nt of promoter + ATG
tttccagcatcttccaagacccacaagtccaccaaacccgtttgtttcatcatggtataatcaaaaacagctggttttccaccatactctataaatcccacagactcagaaaatgcagacaccttaagaggtccttggatcatactgaactcttcagaccgaacgtcaaaactgacaacgatatcacgacgcttccaagtggaagccaaataatatataactccattgacgcacaatcctagtctcgtagggagatgaggttgatcgaattcaattcttttccacgaacctcctggttctagtacgaagacccaatgctctgaggttatcctcttaagcctttttgagaatagtgcaacagtgcaaactactttgtattgatcaagaacaggatcgtatccgaaaaagtagaggagactattccagtgggatttttgagcaaggatgttggatttgacagcaggtaaggttacactttgtctggtggtgggattatagatagacgccgttctgcaaacaacgtatagaatcaagccgcgaagaaccaccatgttgcgtcctcccatccctgcaattgtcaaattttgttccaaagactcagcactgctactagacgacagcagtacagactcacatgggtagtggcaaaccatcagtgaattacacaagaggtggtctaccaaactcatgtatagacgaggtggtcgccgtggagttttgaccgtaagataacagttgctaaaaaatcgggaacggataagagaagaccataactttgagacgcacttgaatctcataagagatttagcaggcaatttagtcagaatctcgatcagtagatcgagagggatctccggcgcgaccaaagcgtcttctattcttcttcttctttttcttcctcttctcaacatcacctttgaagacctcgtcttgcatcgaaaggatgaaaacatagctgcagacatacgcatagctacttacttatgtcttaattcgaccaaaatattttgttttctaaaaaggatctgagtaagagaacagaggaagacgatcaaggtagctcacgagtcgcgactatagggtttgaaaattggcgtatttcttcctttccaatctaagtagcccatgggctgattactactttactaaacctttgggctaaaaataattgagcctccattgggacatggacgaatttctgtttccaataagtttatcatgggcttttattttcaataacaagatgcattttatcaaagttgaataacaaatcaataatatgtcggtcacttttctcatcatgaaattttaatccttagaatgtctttttattttgtttttcagaagaagaaaaaaaaaggatgtctttttatagtttttttgattgactataattaattttcccaaatcgaaactaattgactaattgagcactagaagtttagtcaaatgtgaaccattggatatagaagggttgcaaaagctttcctctttctcctagcaagtagagtatttaccgacacttctcgaatttcagcagcggtttttgatgtcacgttgtgcaagaggttgttacattctttccaaagcataaagatcatagccatttggaagacagttcagaatctatagatataagaagggttttgatcatatatatgtaagataaagattaagtccactcaccatctattactccatattccctaacaggcaagatgggacacattttgactataaaggatagaacactaaaagcgatatatagatgtaatgtttaattacttcaaaaatcacaatgataaacgataaaagctaaaagaaaaatattcgttaacgttgccgagggaaaaagccaaaagaaaaataaaaaggagacttcactttgatataagatggatcatctcctagtcaaatttccattatccaaagaagaagttcaaaaagactgaatcaaactaataatacacaaagttgaaacgaaaaaaagtttataaagtcgaaagaagaaaaatgagagaaaaagttcatgagagtggtggaagcacactcgttctactacggacgggtaccgtacggaacatggtacctttattcatatttaaaaaaaaaaacgcatagaaaaagaaaaaaaagaaatagtacaaataagaacaaaaggtctgcgtcacgtgggttgtgttttggcgtgtgttgtaaaatgtgaactgtttatgtggttttcatggacacgtgtcaagtttccaagggagcatcatctcttcaagcatatggccaccactttgtgatgcacatggctgtttctttcttatgttgagagtgtctctgtgacctactcgcttttatttcccatgtattgtatttaattccaacggtcattcacgcctacaaggctattactttaacttacataagtttatactctctaatgacgactcactttcctaacttggatacattttcatgtgttttgagttaggaaaagatcattaacatctctagtttgtctgcaattagattttttgtcaagttaattaaataattaattccctattgtagtaaaagatatagatgatgaggtgtcatgaatcttgcttgacgcatgaagaaaaaatgttgaaaaaggcagtaagaaaaagatgcctaaacaagactgagaatttaatagattaaatatataaaggaaattaataaataaatgaaggatataattgtggtgcgagagagagaggtcggagtgtgttagcttcccatactgccactaacctttagcggttttctcatcttctctactcttctttctcttttctgagaaacccaaaagacaaaaacgaagaagaagattaggaaatcatcttgagaaacaggtttctacatctctgtgtttcaacattttctctgttttttttaagttgttgagctttctggtggtgttttaatggagaattttttctgataatttgtatggtttttaattgtactaggaggtagcaggagaat

SEQ ID NO: 2104 - DNA, 3000 bp, Unknown
  misc_feature (1)..( 3000): cDNA_ID_2149519_gDNA_ID_1620488_Annot_ID_158533 3000 nt of promoter + ATG
tcgagctgaaaacaattttatgttggcctcatctttttttttttcattcttgtaaagctcagtgagggatttataatattactttagaacataagtcttcatatataggctaaacttcatctcaatatttaacattttagtagttgtagctgaattcgtaataatatagtgaaaagttgcgaaagtgaaagaaagtattctcacttggttgggttagttaggttagaacttgaaaaaatgcattaccgtcaagccgtaaagtcgggcattttgtaaatcgtttctacatctagttggcattatgataaacagaacaaaaataaaatgtactgtaaatatgggccttgagagaaaatgtatttcgacctagaaacataattttataatagttttggttttcactttaataaaattcaaaaatttaatagaatgattaatactttccgcaagtacaatacatgtgccactagatttatttggataagagacctggtcgcttacagaatgatcacaaaagatatgcctaacttcactcaccatcacataaatagtttaaaacacaattaaatgttaagcgaaattattttttctctgcttataaaaggatttaaactttgagtatagttatatatattgacaatatgttgaaagttaccaagtatcctttttcaataattcagcacaaacaagtaaccaattaaaaaatcggatcattactattttaatatcattatttttattttgttttatcaacttggacctacgcccgtacttctctcgaactaccattatgtctagtaattttaaataaagctattgtgtattgattttgttctaagatggttttgaataggttttctacaccggtataccccatagctccgttaagctatacttgagatttctattataaaaatatctgaggcgaaatgctacactagtttcccaaacttacaatcaccatatgattactaagtttttttttttttttgtttgacctcatagattgtcagtactatgaatcttgaactagaggcaataatttctttcataaattgttgatcgcatatctttgacaactacaagcaaataagtacgacaacatatgcttgaggccgattttaattgtggacctaagtggtaaaatgaaagggattaaagttgaattgaaagctgaagacctcaagttgatgaatttgaaaataggtacacatccttattggtgtcatgtccaattatgttcactaaaacatctcataaattactaattgtctaggaaacaaatttataaatgaataaggacaaatttgaacaacatttatttttaaaagcttttatatcaacagagttgagcattgtctatttttccgtgataactaggttatttttggaaaaatattaaagtaatatctacgttaattaacttctttcagccaaaaatattactttgtattttgtcattagcaagaattgttttttgttttctttattatatattaataataatagttcacaaaatgcaaatgaagtccacaaaattctatccaccaactgacagcgaattgaaattcgtcaacttggtgaaaattgtagatgtggcgtttttatagtttgtacgtgtgttaaaaaacagaaaattaaaagttctttgaaacttcaacggaaatcaattggaaaaaaaaaatcaataacacaaaatctggccgttttcaatgaagaaaaccgacaattggcttttaacacacgaaaaatggtggattaataaaagaatgaatctaagtacatatgatagcaaaatggtagataagagggaaagttgtttgcaccttagttggtaattgaatttttaacataaacgattcaaatgaaactaacacgaaaacgttggttgacatatttcttaacacgaaattgcagccagcacactagatttggctgatttctaactaacttataacttattccgtcaaatcaatgtaattaattaatttactagttaacatctaagaggtctcacactagcttaaccaactatggtagactgatcgagtggttgcaaatttgcgaaattgatcgaaattaaaacttacatctcatattcttgtgggtatgtgtttttcactatatatatatatatatatatatatatatatatatatatatatatacgctttaaatgaaaagaatcgaatgttttcttatacagagtttgaagtaattaattatatggtggttggtggtctaggtacctttaccaggttaattaacctcctaaaaacgtacttaattttttagttcatatatattgagatttcgtataaattctgtatatatatgcgcatgtcgtaagatagatagtattttcaaatacattcatagtagtcagtgtaactttcgaaaatgataatgtattataaggatatttgaatatttaattaaaatgcttggaaaaaactttataaaatcgatctcgaaatcatacagcatttaagtcaacgtcagttttacactagttaattaaaatataagattatgagatcaaaaatagtggaaagaagaagaataagattagaaaataagaaaatggatggagagcgtaaaagaaagtgccgttattaagagggagtgttatgatggggccacaccacttattaatggaatctacatttttcactgattttgctaaatggattttataagtttaattttggaagaagaaaaaaagaagaaattaatgaatatttaaatcagtaacagagctctctttcacggccaaattcaccaattaccactttgtcaagattccgacatctccaccatcctcttgctttctttcttaccactataaatagagagagctctaagatgaagaaaatagtcatcatttgtctctgaaactaaacaaaacacacaagaaaataaagatactacaaagtatacgacaacttctttttttgtttgtagtaataattatagccaaaaatatagacaaacaaaatg

SEQ ID NO: 2105 - DNA, 3000 bp, Unknown
  misc_feature (1)..( 3000): cDNA_ID_2149509_gDNA_ID_1620488_Annot_ID_158529 3000 nt of promoter + ATG
ttccgttttttcatggatcttggtgatgcaggtgcattgacacttctctttgtaagctattttagcagtttccagtaacttagtctagatactacttgcttgtataagagccttctggttttgaataaggctgaaataatctaaaatgaattgcaatggagatcctgaaactgcaaaccagattgccaatttttgggtcctgacgtgttgtttgttttctcagtttcatatgttaaaaaactaaatattccaagtggagtggttggggcttgtcgacttgatttggcatatgagcatttcaaggtatgccttgattggaactagtatcttgttatatactacatttgaattgtacgagaggctgagttttaattgtttcattttcctcaggagaaacctcacttatttcagtttgttccaaatgagagacaggtcagtgtgacactgtgacttggatttgtttgctcctttgattaacttacttctaactgaaatgatttctgattcgcaggtgaaggctgccaacaaacttctcaagtcaatgccacagaatggtaaaacacaaaaggtggagggtgtccctgttttcggtgctcaaaacctggacattgctgttgcaactgcagatggaattaagtggtgagtttaactgatgtaaagcagtgtgaatttgttaggacatgaaaatattttagcttcgtgtaatcaactccctccaagttatactatcagaacacatggcttttcaattttcttgctgacttgcctgtattttaatttgatagttgtgcaaaaaaattcttcgagcatttaccatttgtatgaaaaatcctgggattgttataactttttagtacctaattttatttacctttaccaggtataccccatacttctttgataaagctgtacttgataacattctggaagagtctgtagatcaacatttccatactttaatccaaacccggcatgtgcaacgacgacgggatgttgttgacgatagtttagcttcagaggttatggaagagatgggagatagcatgctagagccgccagaggtacacatattgattcttgttatgacaaaacaaacatgagcatgtaattgttatagtcaacaacaagagctaccggggtagagtttgtcagttgctattcctatcatcttgctgggtgcctccacgtagagataataaattttaaccagggtagcagaaaaagatattgataatgtttttgctttgtttattggtggtggttatagagtttctaaaaactttacggtttttcttcttgtgttaatcaaactgcaggttcaagaagccatggaggagattggcacttccggaattcctttgagtgttgtggcaaaggctgcagagattcagctcctatatgccgttgacagagtacttttaggtagtagatggtttcgaaaagccacgggtatccagccaaagttaccttatttggtcgattcttttgaaagaaggtatgcattgctcgtgcatctatctttttgtttcttaactatttcttcaaagctaggttttccaactcgtttaatgaataagctagtaatttggtctccaacagagttttatttacatagtgaaacgttattatgtcactttgacacaaaaactgggaagtttgctgaagcagaatttgaagtttggacatttattcagttctgtatatattcaaactaaaaagggtttcaatttcttctagttgagttatataggaggatttagattttcgaattttgctacagatccgtgcaagcaaaatcatattgatgtgatgtacacagaccaacattaaagcacttattaaatgcctcattagatagctaatattttctctctcgcttctcttaggagtgcattttctatccaaagagcgtcagggtcagcaacaagatgtcttggtgattcagtagaagcagatacttccgcatcactacttagagtagaagatgatagtccaagtgaagctgaaaagagacagcaacatctctggtttccttttggagattggatcagtcactctgtatcaagaaaagaacacacacatcacaagggttcatcagatcaaaggtaccaattgaaaacaaaaggttgttgaaagagtgtaaaaatcttaaaatgcacaaattttcggtttcagggatatggaatctagagaaagagaaatgctgcgaagtccattcttaccaaagataacaatggtagggatttcaacaggagaagctgcacagatgagtaaggctaatctcaagaaaacaatggaagatttaacagaagacttggagcaatctgatgaagggaacgatcatggttcaaaacgttacgactctctaaagattgaagagagagatcctctatttgttgcaaacgtcggagactactattcgggtttggctaaagctggttctgctcggttgtcacgtagaggtgatgaccagtaacgaaacacatcctatgggtcataacctatcttgtgtgaattgctcaagcctagttacttattgtaatgcttttaggcatgtattaagtttgttgtcatgttgaaaaaatatttttacccgatgtcattttatttatcggcgtacttttgaacgtgaaaatgcaatttttcacccatgctctcaatagtaataattttgtttataacatttttatcattggttacgaaaataatatgtataaaattactaatgggctttttcagtatacataagaaaatccacgaacggcccaagattcaattgacaatgaaggacaaaaatttgcttcgtagatagacatagatcgagcgagagtcagggaggagagaaaatccaatcttgtattgaggaaacaaaattcaaattatattgtgcgagagaaaagataaatctccacaagatctttgtttattccttgtaaaatatctgtgagcaaatcctaaatcggtgggagggagattgaagaacggtaaacggaaaatatg

SEQ ID NO: 2106 - DNA, 85 bp, Unknown
  misc_feature (1)..( 85): cDNA_ID_3065991_gDNA_ID_1620489_Annot_ID_158541 3000 nt of promoter + ATG
gatcccatttcttttgttggcttacttctctcgaatttacgcaggaagatcattagcagagaattctcatctgattcagtccatg

SEQ ID NO: 2107 - DNA, 3000 bp, Unknown
  misc_feature (1)..( 3000): cDNA_ID_3065969_gDNA_ID_1620489_Annot_ID_158550 3000 nt of promoter + ATG
tttcgtagttttaagtagatgaccaatcgctatcagtattcaatatcttacataaacctagaacttaatgtaggtcttgtggttgctaaatagatttataagatttaatttttacgtaccaaaattaagtttttaccatcagaaatatgtgaaatattgtgtattgtggagtttctgtagactatagagaacaagttttcttaaagttaatatatatgtaagttataacttataagatgttctcatatgatacattagacgacgaaaaaaagttattctattgtaaaaatttccgagtttgttaatgtattgtatcgtgttcaaaaagggaagatatatatacctctgcgtggctgcatattttatggggtgcatgtgtctccactcattttttttttaataaagaatgttttacaaagaaaataagttttggaaagaaatgtgtgaaaattcttataaatatgcttataatacataaatcttaagctcttaatttttgtctgtttagaatagtatttttttttttgtactaggaaatagaatcttaatcttaccatgagatgtacaactatgtgatttactgtttcgtagaattgttttacagactatattataatttagtgtactctcctttttattgcatactgaataagacacgacaccttgtttcttattgcatactgtactactactctcatctttttgtttatgtcgaaattagatatgtcaacgaccaatcacgagacagcagtattctgcattcaatcgcaaagttgctcaaaatgtctgcgcatgactttgaaagccgcaacgctactaacgattcaataatacccaaaatagaaaacaccttacatcttgtttttattcaaaatcagatcgaattattatatgctcttgcagctttctctgttaccaaataccaatgcatttgtaaaccatttgtgttttcataactatgtctatgtaacctggatattttaaataaataaataaatatatatatatatatatgtccaaaatgaatatcctactatattatttgggaagtacattttaaatataaccttattttttgtaagtaattacataggtatgccattagaaataaaattttaaagagtaaattaattcatttctttaaaaattaaaaagtcaaatactaatttaattaattaaatttaactcaaaaacgaaatacattattaatttccaaaaaagtaaccaattaaaatcaacaaattagatttggtatctaaattatcatattaattttttattaattattatagttcacctctcatctttatatgattctatttttgcgaaaaaataatatcatcgttataaaaaaataattagagttttttcgcatatgccacaatttgaattatcatattagattttttaatgtgtatgatgtgattcaatttttaatacaaggtgaaaaatcctagaattgacgggtttaaatcaatattaatacaagatggtatactacaggtgaaactataaaattaacaatcaaaatacaagtatataattttaaacactaaacaatataaataatatcaacaaaacatatacaactcgcagtttactatacatttaaaatcaaataaaataatatcatatatttataatcaactttacaataaaagtttttagtttaactaaaatataagcctacctgctgtataagtaataaagtcatatctattttatagagttataattttttataattaaatttatctataattcgaaatttaaattttactataatatgaatatttatagacctattattcaaatatttcactatcataaacacatacaacaaaattatatgatatattaatatgtagttatattacttatgtattttgaaacttgcctaacttaattgtaacaaacaattctttattccatatattctctcgttatctagtacactaaccacatcatgatatgctagtaattcaagtcaacactttaattctcttcccttgcatatagccatatagagtctcgtgttttttgtgtgggtatgtctaatgtctcggatgaccattacgtgaaaaatgtatatcaatgttaccaagttatcagaacgcacaaaaataaacagaaataaggtcatatgataaatcatattcatataacgtaataataaaaaaatatccaactaaaattactaattaatatgaggttaggtagcaaacatttaaactacgacacaaagtaaattttagccattataaattgataactattgataaaaatattttaaaaaataagtagaataaaatgaaagtagtacttgatatattattataattttttatttattgaatgttttaagaatatttatttaaaagagagattatatagaatttaacacaacaaaagacttttgattcttccttaattaattgtattaattttttatttaattaatatagaatgacacatgtcattttcttgtatgatgatgtgtcacttatagagagttgaccaactttcatatatatgattttgtctttataactaagaaatattacctcacgaccatacatagtcatgcatttctatctgattttcagagaatcaaatttctttctcgagtcaacgaatttccctgatttcatttagataacctttcttaacaaagagcaggaaatgtcattattattcatagtgacattttatcctcaggatttgataattttactttgaccattttttaatttattacattaatattaaggtatctaataccaacttaccatcattttactttgactattttttaatttattggtattcaacttctatataaatacagtaatatatacatattcaacttttaaaaattatattccttagtttaacaattttccaaccagcgtacagcttatattagtatatatatacaacagtaatcaataaacatcaaacacaaaccacaacaaaaaatctcgagacaaagatacaatg

SEQ ID NO: 2108 - DNA, 3000 bp, Unknown
  misc_feature (1)..( 3000): cDNA_ID_2105496_gDNA_ID_1620489_Annot_ID_158556 3000 nt of promoter + ATG
tatataactatttttttcagcaattgtgcttcttcctcctttttattaatagcgatacaatcttccgtctttgtgcgttacgattcccaaagaaccacaccctcatttcctcagagtctggtctcttacagcgacttctctttttctttcttttttggatttcctctttctgcttccaccatggagaagaacaaacaaagaaaaactcagtgttgtttctttccaaatttgaacactttgtaatctagtgatatcactttatcttactccaatttcaccggttaggtttggtcattaaaaatgatcaaaccaaaaaagaaaatgtataagtaatcaccagttcaccacttggcttaattcatccaaaaataaaatttcaaattggctatatatcaagttaagaaaaataaagctagacgaaaaaggtaggatatatatgcgttattgtattgatttctataactacgagggtagattatgtgttataatattagtaatgatgctaagttttttaaaatggagtagcaaaaaaaaaaaacatgtttattttttctctttcgcgagaggatctaaaaagtctacaaaaaagtgattacaaggcatgggaagctgcagtgaagaaaagtgaagaagtctcttgtttggtccgaaagtgttagtgttatggaaaactctttaatgagtttttcactttatttttctttctcttttgtttttgaggggaagaatattacacatatgaaattgacttcgagggttttcattttcttggattattgcaggtacaaacgtatttccagtatccatgcatagacgcataatgccgtattgtagctacatacacgagaagtagacagtagactcatttaacaaaaaaccaaatagactcaatcaattatatgttttgatgaatattttaacattcaacgattaatatatccactaatgaacattcttttttttccaacatccactgatcaacattttgttcgacgataagcatttttctataaaaaggaattccttagctcaggtttatgagcatgcagggtaattgaatcatcgtgagtggggacagtgaaagaacagttttttttttttttcaagtaaagaacaatttagccaatttcagatgattttttttactagattaaattaatttaacacattttacttagaggcatgtgatcccactcgtcttaaattacagtacaagtcctagtaaaaccgaacatttttgaaatccaaagagtataagaattgggacagaataaaacatatatataaccaaaaacctgtaattagttggaacatcagtcatgttccctgctaggattgggtaaattttgtctgtaattagtaaaaataaatctccgttgccgggactcgaacccgggtctctcgggtgagagccgagtatcctgaccagctagactacaacggatttgtaataaataatattaattagtcaatatgttagtaacaccaaattttttgaaaaaaaaaagaaagaaaagaaaacattaaacaagagaagatataacatccaaatcgtaaaggaaaacaacattcttctcaaaatcggttgtctaaacttggggatttggactaattcatacctggccccgagcccccgacttacctgaggatggtaattgtgggtttggaaccttaaagccctaagttattttattgggtcattggcaaaggtgcagaatccatcttagtgggcttatacgagccaaaaatatgggccgctacaaacatctggttatgttattttagaccaaaaatatatacatataccaaacatgttggatataaaaacttatgagataaatgatttcagagattttagtatgtaattgcctatttggtattcattatgaaatcaaaaaaattaggttatttttgttgaaactagtttatttctaacatccttcagatttctttctagtttaacgtttgataatttacgttgagatttaaatgtaattatcaaattaactaaagatataacctccaatcaagttagattttaaaatttacaagtttagtatattataaacaaaaattcaaaattttaactacatttatatgtataaaatctgtaattgcagaatagacataagagtcttgaaactggtgatatagtgtttgctaataccaaacctaaccaaatcaacatatattctaatctccagattagtgtttggagccgattgcttactaaaattagactattaatcgtatactccctttgttccatgaaatttgatgttttagattttatttttgtttcataaagattgatgttgtaggttaataatattattatttttgttaataaccaatagagagaggagagaaataagacttatattattaaattaacagaaaataatataaataatataaaaattacttttctttgtgtgaaaaacccaaaacatcactcttttaggaacagagggagtataaaataagaatccaaaaacaaaataaacaataattcgatattaggaaaaatgaaaaaaaaagaaaaactaagaaaacaacaattaccaaccgcaagtcaagaatcaagatcaatagcgtgagacggacctaaacacattaaaccaatacataaccggggtcttaaccggacaatctattataatctccttatcttccctaatagaaccgtaattacgaaaaaggacagtcacaaaactccaatctctctctctcctctccgtctctgcgcgcatgatcccccccatagtgttccactacgcaccgcccgtgactctctaatggtctgtgacttgtaatccatctctccttatttttatttcaattttatttctttccaaaattttaattaatttccacacacacacacacctatacatatatatacacacacattcgtctctaatggcttcttcgaaactccatcatcatcctcaccgcagaaaatccccaatacgttgcttctgtctcttaatcataacc

SEQ ID NO: 2109 - DNA, 3000 bp, Unknown
  misc_feature (1)..( 3000): cDNA_ID_2149658_gDNA_ID_1620489_Annot_ID_158560 3000 nt of promoter + ATG
agtttctcgccgggaaagatgatttcgtagcgatgcttgtggatctcattagcgattccagaaacttctctgattctcaattgctactcgttggagaagcggtgaagattctgagcatgattcgtcggaaaatcttcgatcggagacggttatcgaatctgatcttaacgaacggtggtgattgcttgacttccttcttcctattgattaaacgcgggaatccaaaattgaagatcgattgctccgccgtgcttgagtttatcgccgtcgacgcagagtcaaagcttataatcgccaagggagaaggattggtcaccgagattattaaattgataagctcagattccgactcaagcttaatcgaagcgaatttatctttattaatcgcgattgcgtcttcaaaacgcgtgaaactcgcattaatcagagaaaagctagtcacgaaactcacgagtttgttaacagatccaactacgagcgtttcagtgacggaaaaatgcttaaagcttctcgaagctatttcgtcttgtaaagaaggtcgatcggagatttgtgatggtgtgtgcgtggagacggtggtgaataagctgatgaaagtgtcgacggcggcgactgaacacgccgttacggttttgtggagcgtctgttatcttttcaaggaaaagaaggcgcaagatgccgttattagaattaacggcgttacgaagatactgttacttttacagagtaattgctcgcttaccgttaggcatatgctaacggatcttcttaaggtgttcaaggtgaactcaagatcttgcctttcggtatacgaaaccaaaacgacacatattatgccgttttgattatcccccctccgtattaacttctttagggattattacttgttggtaaaaaaaattcaagttgtaaggaaagagattttttggaaggtgaatggaattgttatcacggccaatgccattagaactttgagaataaattgcaatgttctttagtactagtatcattgcaatgttgatactctaaaccagaattttatgtttggacttggcaaaatcgtattaaaagtaaagctatcaatatgctctatcaagggagatgttgtctttgtatctaaaacaaactgaatcttgattgattgagcagtcaaaaacaaaattggatttaaaagattacaagaagtggatttggcatttggaggaacgttaggataaggaaggaggtctttggtgagttgcaatttcttgtcaacatcaaccttagtaccaatttccactttcattacttgaagaaattcactttccgacagaacagcctcacttgttcgacttctctaagattccctctacacccgtataactccaacaccttcaacgtatttccatcaatgctatacccacaagtacttacacactgaaaaccctgaaacaacggatagaaaagaaaagaacacacagtaagtgaaactccgagattaaatttataattgagaaagagaaaaagagatcatattatacatacaaaccttgaggatcaaagtttctagattgggagagctttttatcagagtccaaagaactttccaaccttttttcgtcttagactcaaacgatagtttaacaaggtttttaaacaagggaaattcattactacgccaataatcgaagcaatgacgcatcatctacaacacacaagcaaactggtcatgaatgaaacacaaacaaattggtcaagcatgaatgtaacaagatacatggagaagagagagacatcatactttaacggtagtagaagcaaggtcaagaatgtttttcatattcctcatattcatagggacaaaactcataaggcatagaaagatcgatgcgggcttctcgaagggaatccattgtgatggaccagtaatagtcttatttctttgatttttttggaatactatgacttaaacagtattagtataagcaaaacttacatggcgagcatatatgaatatcttgaagcatccaccgatgcaagacttaagttttcatccttgtgaagaagtgcaacaaccttaataaaggacttagccacaaaattacctagcatacaccccggttcagaaaatatgataagaaagttttgctctcatcgtcaagaatatatcaaacaaccatttcacttgttccaattatgtatattattctttatagtctataccataactatttcattaacgctaacaccgcaatttcttattaattaaaaaccttgaaaaaaatagagaaaactattcatatataaaattataagataaaaatttacaattgaaagatattatatatgtatataaaattatgaaaatcaatatggcgaaaaattcttaaatcggaaacagaaaattatgttaaaccataagacataatttattaaattttgtattttatagattcagatttatgtaatattacattgttggtcaaaccagaacactttggtttagcttgtcaaataaagaacttgagcctccaatgaggcggaccgactgttgggcttggcgttggggtggctcagttgacgaaattgacgtttactgtgtttgtattgagcccaccaacatatattttttttcaattgaaagatatctatttttgtaattacgtttgtatagtatagttaatactgtattaatttttatatcaatccctagtaaattaaataagtaaaatttagttaagaaatttagtaacaattaaaaggctttaatggttgtaaatttattagtatcacttacaatgtttaaaccttttaagacataccagtaattttgaatttgtcaaaggtcaaaaaaacaaaagagccgataaagaagagtctcaaaggaagaatcccaaattacactccaggtgatgcgcacatcagttttcgtgcgcacacgcggcggtgcacattagccccaaccaatcaaaatcatatatcccgttctccggcgactcttcgtcgtgagcttccgtcatg

SEQ ID NO: 2110 - DNA, 3000 bp, Unknown
  misc_feature (1)..( 3000): cDNA_ID_3408986_gDNA_ID_1620489_Annot_ID_158558 3000 nt of promoter + ATG
ctcttgttatctgtccagacaagtttggaaacatatctcgcttcattaatggcattaacaatcacaatccgtaagcaacaaattcaaaattgttttccccccactaaactggtttataacattgaatcatcacatcacactgattgttgcagggttgctaagaagaagcagaactgcaaatgcgtgaggtatagcataaacggcgaatgtcgagttcttctagtggctacacgcgatatatcgaaaggggaaaggctctattatgactacaatggttatgaacatgagtatcctactcatcacttcctctgatctttcaattctaacagttctacagagtctctagatcagatgttctttttgttgccatattacaggtcaattataaatgtagggctgctgaatatatggcctttaattatgaagttagcggtagaataattggatttggaatgacattacagagattaagatgtggcaaatgtcaattgctgaacttttgtttgatatcaaatgaaatcctaacctttttcttatatgttcttggagacaacttcaccaccttaagtggttgccaaataagttataatttcttttatactcttcttcataaatttatcaaaatgaagaactaatccaatacagtcattacctaaacagaaaagtataattacagtacttgcctagtgtcgtacttcttatttccagtcaccgaaatgtattaacgccaaaagagattcatctgttatgcataataatcgcatgctatgaattaaatgaacacatccaaaaaggatgaagtcacaattgtactacagtttcagtattgagaggaaagcttttttcactttgaccactttgattgaatcatatctttgaaattttaagtggtgctttgctacatattcaacggctcaacaagacagagagaaaaatattacgagaggagatagagagtgagagagacgagcaagttgaaggagcaaaacttgtaggtgagagcttgaatcagaacatttcaaaggagagagatggcaagtaaccctgattttctttggtgcaaagaagagaggaagcaggaaagcttcttcaaagttcttaagcgttccgacatgtcttcagaggacacggtaaactatgttctaaactctttatgttgttgaattagcttagtctagaaaggttaaactttcggtttcttaaaggtttgaatcttgtcgttaactgtctttatgggtctagaaaaagcttttgtttttcttttctgaggaacttttttcatggttttgtgcttctcttagttctcagttctctgtctgaatgtgaagatgtgtactttatttcttgtggatgagatctgttctgttcattttcaccgtcttgttgtgtttgtcatttgtgtgttatagctcactgatttcatggttagatttgaaactttgtactcagattcttgatgggatgtgtaaaagctcactgatttttcactgttttatattaatatcagacatgtatcttacttatatcttttcatctttcttttatataaccacagcgagcgattccgtacgactttgtgataaacttctctgacaatgagctctccggagacatgaagttcagagtgcaatggggaaactcttggaaagtaaaaatctccaagaacccgagattctacttcatggagaagtctggatgggagaagttcgtgatagacaatgccttgggagaccacgagtttcttaccttcactcacaaaggacagatgagcttcactgtgaaaatcttcaacaaagatggcaaggagatgatgcaacctccgcaatccagagcctctttcgcttcttctagtaagattttgattctctgattatgaaacagtgaaccggattaaagacattgattcttcatacttttgatgatgaaacaggtcgtgtcaaaacagaacaagatgtcaagagggaggaagaggtgttggtgtcttctgactcgaggtctcgtggcccgacaacagcagctgaaactaatagaggaggcagctacaaaaggaagctcaactttgggaagaagaaagctgaggaaacccaaacttacaagaggactgagaggacccaaaattccaagaggacggagagagtggttagtaaggagagagtttatgcaggcgaaccttcctcttctgttgcaggattcaaaatctttatctcgaaatcatacatcaaatccctggtatgataagagcactaacacacagtttctgatattggcttttgtgtcaaacttgatatgttaatgattgacgaacaaaattggtttggtttttcaggcgatcccgaaaccttttggaaattatatgccgaaggagaaaacaagggtcaagatccatcatccagatggggagaagacatggaaggttgtttttgtggtaaaagagaggggtcaaattttctctggtggatggaaacgtttgtgcaaggagtatcctgttgtttttggggacacttgcaaattcaccctcatcacaccactcgagctgcttctagttgtctcaaagccataagagagaataactcactgatgaatgatgctgatggatgtgaaggtgccttggataacaagcaactgaagtaaactacttttatgtttaatggtgttagtttggttatgtgaactttcctactcgtctgtagctttcatatgtttgggaccaatttttatttgtttcgtgtttccgtgagacattaatttgctttctcttagttatattcagcaaccaaaatctgttggaactttttttgaggcagattccaaattttagtttagaacagaattagtcaaaaaccggtttgtaggatatatgggcccttttgtccaaaaaaaagagaggatatatatgggcccaaagcccaaacccagtaggcgcttcacagagttacagtctctcctcctcctttagggttcttctctctgttcagagatcacttctccgacgcagaaatg

SEQ ID NO: 2111 - DNA, 3000 bp, Unknown
  misc_feature (1)..( 3000): cDNA_ID_3065965_gDNA_ID_1620489_Annot_ID_158552 3000 nt of promoter + ATG
tttagtgaatgggttttgtgaagagagaaggagataattaaagggattgtaaattgagaagtcagaataagagcacacaagtggtgacatcttttgtgaatcaaagagaaactcatgttcatataaagtaattcacattcttatagctagtggttattagtttattactttggtgaaagccactttctcgatataccctaaattcaagtctcaatgtgggagagggaaaccctagccaactcaaaactatctcattagtcaactggagctgctcattaaaaaaaaaaaaaaaaaagcgattatgccaactatatgtatacaaaagtgctacaacgtttataaacattttcggagcataaaaaaacttcttattcaactatatacaatttaatctttttctttggtaacgactagtgacgtccacttattgaaaagatacatataaataaaattattctttattttttctccgaaccaaaatccttaattgcatcaccaacctaacccctcatcatatgatcacctttctttttttcctttaatatatatatatgctcacacacacacatatatatatacatataagcatcgcctcaagcattaaaatttttacgaaccaaacaaacaaaaattatgaataattataatatgaacccatctctcttccaaaattacacttggaacaacatcatcaacagcagcaacaacaacaacaagaatgatgatcatcatcatcaacataataatgatccaatcggtatggccatggaccagtacacacagctccatatcttcaatcctttctcttcttctcatttccctcctctctcttcttccctcacaaccaccactcttctctccggagatcaagaagacgacgaagacgaagaagaacctctagaggaactcggtgctatgaaggaaatgatgtacaagatcgcagccatgcaatcggttgacatcgacccagcaaccgtcaagaaacccaaacgccgtaacgtgaggatctccgacgaccctcagagtgtggcggctagacatcgccgtgagagaatcagtgagaggatcagaattcttcagagactcgtgccaggtggcactaaaatggatacggcttcaatgctcgatgaagctatacgctatgtcaagttcttgaaacggcagatccggctactcaataataataccggatatactcctccgccgccgcaagatcaagcttctcaggcggtgacgacgtcatgggtttcaccgccaccaccgccaagtttcggccgtgggggaagaggagtaggagaattaatctagacaagatgacatttccattagtagtaactaaattatgctataatgtgtgagtaatggtgcaattatggaaagtgtttatatataataaaaatggatacgaaataagggtttgttaggatatataatatattgttgttgaccgtgaaaaggttgtggaataatcataacggttagcttgagttgtgtaccaccatatatttaatattatgttatcatttcgtatataataataagttcttgatttggagtttggttgtatacaagttttggccgggcatttttcgggcataagaaccatgacgccatcaaagaaccctatttaaatagtgttatcattactgtggacttttgtctttgtatacacacaacgcatatatttgtgaagtactatattttagagcatataatatgaatgtactctattgcttcattttcatctttttacgtacatacctcactttgaacgttaatacctatacatattgaaaatcgttttgttatgattagaataagctttaagaattcctaaattacaataagctttagggctttttttttaatatatagcttcacaactagcaacgaaaaatccaaaaagaaaaaagttgttatgaaaataatatccgtacgtttagtctattagattatacttgttagtatccgattaaacatcacctgaaaactaaaaagtctaacagactaaacgtatccgattatacttgttgtaaaaatgttaacgaaaaatgtttagctatagtaacgtttagcataatgaaaattacgacaatcatcccataaaatgatgttttgtaatataaagtaatctcaaattacaacaaaccgataaggtatacagatactctactccagaaagagagtatatatcgagacatattataaagaggatggtgcagagaaaatgtacttgctcgttttgtcttcgaattaatgaatagaagttcaactaaaacagttgcaagatctctttttaccttcccaataataaaaagaaaacctttgactacaaacaagcattaaaccaccagagctttgctccacacttgttggtcagaaaatctcagaaaagtagcagagaggttaattcaaggaaacctatgctccttgttcacttcactcatggatacttccgctgacttttgtgtctcctcacattcataggttttaataaagacacaatgaaatgtcagtgagattcatggaaacctagctatatccattttgctaacgaaatcatttaatatattttctttctttttgccacatagttatacattcattcacatcctagagataattgcaagaacttaacgtctaaccaaattatttagctcaaacaatgcattaatagtcactaaatagccatgggtatgattcatatattttcaaatctaattcgttttactacagaaatatttcaatgtgattcgagataattcttacatgatcaaacaactttctaattttatgaataaactgtgatcccggtgaaaatgtatgtacttcacaccattaaatatcaatatttttaacggcccataaatataggcccaattatgtgaaaagttactaatgggcctgatttatttcaagtgtccgtttttctctctctagttctcttactcgtatgagaaagaaagcccacccgggaatctccgacccgaccgagaaatg

SEQ ID NO: 2112 - DNA, 3000 bp, Unknown
  misc_feature (1)..( 3000): cDNA_ID_3065977_gDNA_ID_1620489_Annot_ID_158548 3000 nt of promoter + ATG
atataatatttcaacgaatcgtactctcattcatgtaaaaccgatctcaagtgtcaaattcgccgaaaatccagaaaacatttaatgcatttctcgtcaatgaacagtgtacatacaaacccggttctcttggattccaacgatgtgatccgtacgtacaaaccgggttcagtttcgtcaagggcattttggtcagtttttggctgaatggctaagaaatgaaaggccagcccacaatgtcaaaatctgaaattaaaagtggatcaacggctactgtgctcaatttaccctaaaaagaaaggaatatattattttggtaccaaatcgcgtcctgggcgattggtttccacaaaccacgtccaaaatgcgattgactaacttacccttttaacagttttttaaaagtttcgtagttaagtcttctggttttcttcttcacggtcacgcctcacgagtcatgattgtcgccgtcgtctctttgataaaggcaaaaatcgaggaaccctaataaaaaaatggagcgcactacgagaacgtcgtcgagggagacagagaggggagaaataaaatgagttagcaatttaaaatgtaacgaaaaaaatggtggttcaagctgggtacgagccagcggatcatagtggatttgtgtgacgacgaaccgtggtccatccactgctgagagcgggaggtagtcgctgctctgtgaagccagcctaacgcaataccctcaacctttagcaaccgtacggaccaaaccttcgcttggttcatacggttcactcacagcttggattgggcagtccagacctacgggtttgttttaggtacattgtttcggattgcgattcattaggtattttgtatggttcacaacactataccaagactccagaggaagcggcagctaaatctatactggcaggtttggatctaaattgtggttctttcttgggtaaccacacagagaatgcggtcaagaaggggctgatcgacgaagcagctattaacaaagcaatttcaaacaattttgcgactctgatgcgcttaggattctttgacggtaacccgaagaatcagccatatggtggtttgggtcccaaggacgtgtgcacggttgaaaaccgagaactagccgtagaaaccgcaaggcaaggcattgtcttgctcaagaactcagctggttcgctaccgctctctccttccgccatcaagacgttggccgtaatcggaccaaatgctaatgtcacaaaaactatgataggaaattacgaaggtaaattcataacttatatcaaattaattttaaactcaaacctcgaacgtggatcaaatataattgttatgttttcaggcgtggcttgcaagtatacaacaccgcttcaaggacttgagaggacggtgttgaccacaaagtatcatcgtggctgtttcaacgtgacttgcaccgaggcggatttagactcagccaagactctagcggcatctgcagatgcgacggtgttagtaatgggagccgatcaaaccattgagaaggaaacattagatcgcatagacttgaatcttcccggaaaacaacaagagcttgtgactcaagtggctaaggccgcgagaggaccggtggtgctagtcataatgtccggtggaggatttgacattacattcgccaagaacgatgagaagattacaagcattatgtgggtcggatatcctggagaagccggcggtatcgccattgctgacgtcatcttcggtcgtcataatccgagtaagactctgttctccgatttgaaccagtgatttatcgaccggtttggttttaagattgtcattttcataaccggcgatttttttattggttaggcgggaaattaccgatgacgtggtatcctcagtcatacgtggagaaagttccgatgacgaatatgaacatgagacccgacaaatcaaacgggtatctgggtcggacttacagattttacatcggagaaaccgtttacgccttcggagatgggctcagttacactaatttcagtcaccagcttattaaagctccgaagttcgtctctctcaatcttgacgagagccaatcctgtcgatcgccggagtgtcaatctttggacgcgatcggaccacactgcgagaaagccgtcggtgaaagatcggattttgaggttcaattgaaggtaaggaatgtcggagacagagaggggactgagacagtgtttctgttcacgacgccgccggaggtacacggatcgccgaggaagcaacttctagggttcgagaagattcgtttaggaaagaaggaagagacggtggttaggtttaaggtcgatgtgtgtaaggatctgggtgtagttgatgagatcggaaagaggaaactcgctttgggtcatcatcttctccatgtgggtagcttgaaacattccttcaacattagcgtgtaatagggacttattcggtgaatttatttttaatggtcaaatttgaaaagactaaaagtttgagggcttaaaaacgaaaagaatatgttattttggtaccaaatcgcgtctgggcgattggtttccatttcaaaatgaaattgactacattacccttttgacaatttttttaaaactttcaaaaattagtcttttggttttcttcttctcagtcacgcctcacgagtcgtgattgtcgccgtcgacggtctctttgtcgccgtcgtctctttgataaaggcaaatatcaaggaaccctcataaaaaaatggtacttgtcttgtctctgtcgtcagattttaaattaataaacaaattttaaaaagagaacgacgaccttcgaggaatttaataatgaaaaaaaaggagcagatactacgaaaactcactttttctgattccaactgggttttaatttcttactttaggggaaaaagtttcgatctttcttctcttcaattgggtgctttttttttgttggtaggcattgggtttaagcagtgaagaatcggagatg

SEQ ID NO: 2113 - DNA, 3000 bp, Unknown
  misc_feature (1)..( 3000): cDNA_ID_2149611_gDNA_ID_1620489_Annot_ID_158545 3000 nt of promoter + ATG
attatcgtcctcttctttgctcaatccatgaaaaataatatcttcgagttggttcggatggatgttgagtagagaaatggagaggactgttttatcacggtggtggttttgggaagtgctaacgtgacacgatagtgtttgtggtttttggcgtgaactcattggttatattacacgtggaagtaaagtattggttggatgtgacagcattagggtgacgggggtgtgaggttagctgaaagtcatgaactagatggacttttgcggcagtttggtggggaccagttagtgttttaaaagcgtgtttaattaaacattattgatactatgtgagacaaggccatggttttgactaatgactattaattaatcaattaccactgcaatcatataatgtctgaagaatatatccattttttctgaaagataccaaatattggagaattcacgtgaatctttgcttcaactccaagagagagatactaagtgatagtataacaactaaatgcaacatattagagaacaagatcaaatcaagatctagtaaacaagagtttttaaatgatgaaagaacaaatgaaatgctttgttcacatcgatttattgaggtgaaacaatcaaattaactaaattaccaaatccttcaaaagtataattgcctgcatgctgaagctaaagtctctgcaggacaataagggcatttgaatgtgcggaaagcgcagttcttgctgagtctcatcattgactgcttgctaataacatgaccacaaggcaactgcatcggcgggttttcttcgctgctttgatctctactcacgggacaaacaaaagccgagtggaacttatactcattccctaactccagaggaaccggaagctgtttcattgcttgccattcttgtttcgtcaatgccattagatgaaccagctttaacagtgacggtaagctctcataacccgcggataaagcgactttcaacggggagttaattggctgatcgagaagatggtgatattccatgattagctctttggttaccttgtcccaacatgatggagaaactatctctgcataaggacttttctcaaagtttccaatccataataaacaagtgataagcttttgtatctccttaaaatggagtggatattgcgtaaaatgggttcttgcatactccaaagcatcatcactctttccttctcttaatatatcacagtacttcaaacttaagagcttaaactccagctttgaactcttttgcttcagctttccgcggttcgcaaagatccatctcattgcaggctcaatgtttctgagcttcaatgagtccactatctggtggaactctaagaactgagatctaacctcagtttcttcctctcttccagcctccttaaccagacaatcaccaacgtcgaacaacccttctcggtaacaatggtggataagtatcttattcactaagttgatatcgaaatcaacgctaaagcaggctagagatatatcaggatggtaagaaacctcaagcaatttcaccaacttactaagactccatttagtttccttatgtgatttctgaagctggataatcggtaaaagagcatcaagcttgcgtctcaactcggtaagaaccgattccggttctactccatcgtcgttacctaattggattcgagtcaatgtatcttggattccatcacaaactagatcaatgacatcttgagtaactgagtgatacagcttctgttttttagaaactcgatcaaatgcatctctcacagtcacagtgccagtcacatccatatttgttctgactaataagcttaaagtgtactaccaattagtccccaaaacgcatcaacaactgcaacaagatgatggaaaatagttgatcaaacatctaaattttgcattttttaagaaacaactttcctaggaatttgccctaatattaagtagatcacaaaatcccaaaattcacagaactaaacttaattttgcaccaaatcttaattttgcaccaaaattggaaaagtgagactctttaagcctaaagttttatcctttgatcaatagaaaccgaaatcaattgggattaagatagaagaaagggaaaggtgagcagtagtaccggaaacgcgactgagaatttctgattgtgccgtcagaatttttcacagagacgaaccaaaagccattaaatgatgatatatagagggagatgatgattggcaaagatgatccaagccgaatcactgagtatctaaatcgttaagattggtttctggaaacaaggaacaactattttattttcaacgcccagcaaaattatctagctaggaaaaaaaaaacagatatttttcccaaattctacgattaaaatctatctatttaacgaaaattaccaaaaaaaaacttataaattacagcatattcttcgcataacagttattttaatttttgtgagtaattatatttatctttattttcttttaaaaatatattaaaatgtttcatattaacttattgatttgataaccttaaattcccaattcgagagctgatagaatgaaaatcaaagctatttgtcgttttccggttgcaaaaagtcaaaaaggaacatgaagctaactaaaattagattagcaacagtatttaagtttaaggtacaaattgattaagctgacaaatcaactgagttacgttgactttcccactggtgcatctgatacttggtttggtagtggagtccttgacttcttctattgaaccggttggtctggtacggttaacaacacgatgtaaatgcctcaacacgcttataaggtagacgatagccacgttctgatcactgcgtagctaacgtgtctttacgtaatttgctttttttggttttattctcgtaattaattacttgctttcttctttcttattgagtttaaggttcttcgttgacatactattctctgttgtagcaacactaagaagaagcagagaaa

SEQ ID NO: 2114 - DNA, 3000 bp, Unknown
  misc_feature (1)..( 3000): cDNA_ID_3065981_gDNA_ID_1620489_Annot_ID_158547 3000 nt of promoter + ATG
cagatcttgttttttggggtctcttctcgccagcattttcgttactaagtgatgggattgcataatttgtactgtgtgactacatttttttttctggttaacagtaaattgtaacttcttgataccaacccaaattaaggagccgagatagataaccgaacaaaaccaaaaaatacgaagacctttacacaaaaccgggaccaaattacaagttcggattgaatatctctgacctgaaccgaaccaaaattgtatcggatatccaacaaccccaaaacaaaaccgaattagaccgattcgaatttggtattttgattgcagcctccagagaagaacatgattattctcataagaatccttgacggccaattagatctctccctctttcgtcgctctttgttttctccactggtctttgtttctcctttgattctctgtctggagcagtctcagatccaccaggtatctatccaattttcttctagtacatctgatttcccttgttattgtttgcttgatatggattcatgaatcagaattgcaaatctgtttttgttagattaaagtttccgaatttaagaaattcccacccaataatccctattatcgtcacctttagactttgcttttgcctccaactttcgtttgtttagatcttcgtcttcttcttcccgtgagtgctttacatagactttaggttttgtttctaactgatacgaattgttatgcaaactgcgtgcagattaagctcaagatggatactagtagagatgatgatttcacattctcaaaggttggttagtttccactcatttcttcatgatttcaatgtttatgaaacgtgaaagttctagacttttatgattgattcttggtttgttttcaattttgaaggtttcaccaccagatagtgaagttaaagatcttgcatcagatgtaggtagtattacccttaaagatgggttagatcaacaaaaaagcaatggtcttatttggaaagacaagtctcttcctccaaaggaagaaacaataggttctttgtctttcacggtgactgattcttcgtcttcgaaaaagcaatccaatgaatcctctgagactttcaaaactccagctagaaagcctatcactcgtaccaaggttccatttgaaaagggttatagccaaatggattggttgaaacttacacgaacacatcccgatcttgcaggtaagcaaagctttcttttcttagtcctctttttcctaaatacattttgatgtgttggttaatgaaagagacaatttgtttatgcaggcctgaagggagagtcaaacaagaggcttattccaatggatgaagtaaagaaacaccgaacaggagattcgatgtggactgttttgaaaggtcgtgtatacaacatatcgccttatatgaattttcatcctggaggtgtcgatatgctgatgaaagcggttggaagagacggtacgctcttattcaacaaataccatgcctgggtcaatgttgatatcttacttgagaaatgccttgttggagttttggatgataccaaagtgaagaagcaagaaccctaattgctattgctaaaagagttcactcttgtagagaattcatacataagtcaataagaattttttaatgtttacattctgattcttcaaatgtaaactctgattacaatatgtactgtattagaaatttataatttttggtgtcaatatattcaaagtttccatatcagtggcatcatgttctcttttcttttacaatatttcagaatggcaaattatagatgagtaaatagaatctacacaaatttcggaatggattatagggtaaaccagaacaaagttgatgtcttaaaaacaaattccattacaagttttgttttagcaaactatcaaatccccaatcagaagtgagggctaaaagaccgagggtagtttaggtatttcacattgtagacaaaacctgactcctcgacgcttataataattccactatcatatttgccaatttgccaataatctttttgtcttctatcttcgacacctgtttctgaaatcttcttcttgtcttctccttggaattctatctgtgagcccgagtttcagatccaccaggtatttgaattctcttcttcatccttcattctcttactcaccttatacatctaaattttcttctggatttttatcattaattttgcttaatctgagttcatgacttactaataataatgcatgactgtttctatctttagactttgtttggtctatgaaatcattgttatgtagattatgctgagagtattataattacatgataaatcttgttttttagatcttcttcttctccaaagtgctttaggttcttttttgtttattggtttgtccataagttttctgatactaggatgagataaccttttgtggtgttttctgaccctgctttcaatagtcaatcttccaagtcaaacttctgaaaacaaatattttctcagattttaggatcttgtgaacttgtgtttggatcttcaatcattctaatgacaactgtatcacagaggaaaaaatcttgactttggaccttgtaaattttgattatatcatttgattaccattccccaattctgttctatcatgaattatatttgagtaaagatgtctcaagcagagtacttagctacttagcttccaatcttgtgctactacttcaaatgcctttgattgttctttgcttcggtcagccttatgctcctttcagttttttttttttttgattgtacaatgttctttgctcttcatgcttcttgttaactctcaagttgcatcctttctggatttattttcaggtcatgtggacagttctcaacagtagcatacttcaacaaagatcattgcttttcagcggaacctgataatctccaacaaacattcttcggtttacagtattaacaccagcaggatagtgctgttttcccattcttgaagatg

SEQ ID NO: 2115 - DNA, 3000 bp, Unknown
  misc_feature (1)..( 3000): cDNA_ID_3065985_gDNA_ID_1620489_Annot_ID_158546 3000 nt of promoter + ATG
aactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaattaaaactcttaaacagcttcctaacgagaggaaactgaggaacacaacaatggagtttcgtggagatgccaaccagaggattgctaggatttcagctcatctcactcctcaggttttctttacctttgctgttaactcaagttatctttttttatattcttaaattcgatggttgttctactaaaaccagaatagtttgtattcactctcaaacaaaactgatttgtctagactcatcaacgttctgaatatttatagttcaaccatgaacttgacattcgcttctacaagtgtatatttccatttcttgaaattagtaactgaagatttctgatgccattagagagaccaatctgtttatgactccgttgaagtcatctaggactgatagtgaaatttcttcttcttattcatgattgatcaaccattagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtaagtatctctcttaaactttgaaaacttcacataagattacttcttcttgctaatgaatgagtaatgaccactcttgattgattaggtccgcgggttcttgggagcgaagcagcttgaggacgcgctaacgggtatggatcttgtgatcataccagccggtataccgaggaaaccagggatgacccgcgatgatctgtttaaaatcaatgctgggattgttaaaacactatgtgaaggtgtagcaaaatgttgtcctaatgctattgtcaacttgatcagcaaccctgtgaactctactgtccccattgccgctgaggttttcaagaaagctggaacttatgatcctaagaagctccttggagttactacactcgatgttgctcgtgccaacacatttgtggtaataatgcctaatgattcctcactccatttggttttgttgagttttaaacactaagaatttatctttttaaattcttgtgcaggcagaagttcttggccttgatccaagagaagtcgatgtgccagtagttgggggacacgccggagtcacaatcttgccactactgtcacaggtatcatatgaataggacgaaaggttcatttccattacattagcttctctgctaactgattgtttttgcataatcctttttcctcaggttaaacctcctagcagcttcacacctcaagaaattgagtacctgacaaaccggattcaaaatggtggaactgaagttgtggaggcaaaagctggagctggttctgcaacactttcaatggtaaaaccaaaccaaatcactttaatacatcatcattacacctgtttatttctctggaacagtgtactgaatccatgtgaaatgtactactactataggcatatgctgcagccaagtttgcagatgcttgccttcgcgggttaagaggagatgcgaatgtcgtagaatgctcttttgttgcttcacaggtgaatcttgaaaactctttcactctctttcattgtttcaacggttttaacttgaaatggcaattgaccacaggtgacagaattagctttctttgcaacaaaagtgcgccttggccgtacaggagcagaggaagtgtatcagcttggacccttaaacgaatacgaaaggtcagaaaaaacataactcatctctttcaaaatacttatctcagagagatagaaagagagttctcaagcttaatttccttattcttatgtaggattggtctggagaaagcaaaagatgaattagccggaagtattcagaaaggtgttgaattcatcagaaaatgaaactgagagataatcagagagatacaataagttatttcctcaactatatgatcatgtactcatcatcacatcatgcctatgtctcctctgcttctgatacaactttgtataaatccttatcagtttgtgtacgatatatgtgaccttttcaacgtacttctctattgttttcgattatccaaaaccaatctttaggacccaaaacagagttcatcttcacaaattaaaaaacgaaaaataaatttggcttcgcccgggttcgaaccggagaccttcagtgtgttagactgacgtgataaccaactacaccacgaaacctttgtgcactctagtccaaatttgaactatttatctattattactaaaggttggtaatacctactcaacagaaccccacgtgatctataacataaaataaatctttgtttttgtttttgtgttctgtctttcttggtggtgtgataaagaataaagagagccagtcgagggtaaaacgaaaggccaccattttcaatctttccacaataatg

SEQ ID NO: 2116 - DNA, 3000 bp, Unknown
  misc_feature (1)..( 3000): cDNA_ID_1378727_gDNA_ID_1620490_Annot_ID_158578 3000 nt of promoter + ATG
acccagaaccttgaacgtgtatgcgtgtggaaacctcaacacatgcacaaacatgcacacacctaaattgcgtttaacattacgatttaaatgtgattttctcaattcgaatccaatttatgtataccaccaaattattacgtaacaatccgaattctaattcttgaatgactaacacagatgaatgaaaaaaaaataaaaaaaatagatgaatgaaatccatattccgtagtggagcaataatgtttataaatatatcattttctaatctcttcagcttaattagcttagagctgtaatacccacctacaatcatatattcatataaatttatgttaaagttatatttattctttaaatttcacatataagtatattattaagtgatttgattgtgaattatcatcacatttggttgccatgaataagatcgtgacgaaagaacaacaaaagaaattgtgtcttcatctggaaataagtaaacaaagacaaaaatatctctgtcgtcttttatcatcagtgtgttattgtgctaaaaaaaagttatctttgattcgaatatgatagagacccaaaggagtatataattataaatcatttttattcctatatatagtccgaatctatcttatgttcactaatatttgattaatttaaaccacgaaatcaatgtatttctttcacaaattaatgaggtagaacggatgcatttgcatttatattcagtaggaaccttatttcgaaaagcgcaaagaatttaatataatgaattaactcactttcaattggttataaaataaaaatttagtacttttttcttttcttttttttgccaatttcttatctccatacgttcttaatcagaaataattaaatattattagtcagaacctacaacggatcacaaaattgttatacttatatcaaaaagatttgaatgatatatcacttctcacttctgaaacgcaattcgatgaagtgatactattcataaaatttcatgttaaatgataaaagttaaaacgatttttcaatttttcgcacattttaaaattacatctaaaattattaactttttcaataatattttattgtttatttgagagtggaaagtaaaatgaggaagtggcagaggaacagagccatgtaggagccacacgaacatgtgctttgtggtaacagtcagctactacatgttgcagccgtaccaccataatatattagttaatggattaactcttttaataatcctctcttattgcttagtaagttagtttacaaaagcaaacgatctttttaaagtctaataatcccaaaataaaagaaaaacaaatattgacaaaatcctaacctaatcaacatcagtctcttgttttaatgttaatttcaacttggcagttcttatctatcccaatctcatatggtttattatcattttttttttttgtctttttatcactatggtgtattgtatctagattgaattagattcttgaaatgatgtaattgtaagaatatctaacgtcaagaactttgggattaaatttaaatttataggaaagaatggacttaagtaaggagataatatttgcagctatatatttgacaatggatcatgtcatcatacatttttttgtcaactcttaaaatcttaattcaagaaatgtttttttttttcttttgttttaatctgtttttgtcaatattaaaaccctattttgtacaccagggtcattttcattgagtaaaattcttaaaaacttcaaaagtttatgttgttggcaaaggaaatacgtaagcgtgtaatatgtacagttggaatagtgtttttgctaaaaagaaaagaaccatatgattgaaacaatggaatatataaaaagacatgtgataaaataaaatacaaaaatagtcaagaacagtttaatggattttccttgcaagtcgtcatgctcatgaacctgttttaattgcatgcttacatataaaaataattaactcaaaactcaaataagatcaaacaaaatatcaaacttttgatacaaatttaactgtcttatatccttgacaaaaaaaaaaaaaaaaaaaaatttaactgtcttatatcttggttcttaatcccttgtgaataaccataattagttgctagaaacaccttgcaaatttcataatcaaagtgattcctaatttatgtgcgaacagaatattaatagttgtaagcaatgcaaaaacaataccaaaacgattattcttgatgaaaagatggaaaaaagctaagcacaactaatgttcaaatttctaaaattagttaggcagtaatctggcatttaaacatggtgtaatacctagtaagccaatcagagattaattggaattttgtttttcccgtattctcgtttttattgtaattttaccacttctagccatttataaatattcaaaattaaaaaaaaaaaatatcttgtaggactttattttttttggagttttaaagttcactgataatttaaccaatttagccaaaattaaaatatttgaatgttttgataaatttttaacatttcgttttccaaacatgtaaatttgaaatcgatacatttacaagattagcacaaaccattatgctaaagttttagtcggtgcaacatatataaatatgaaaaaataaactattgaatatatacacaacaaaagacaatttctctattattatgttgagaaaaaaatctttttagattaaataatagtaatggctttatgggctttttactctatcgtgtccacagtacccccaactaaacaaaaagaaattgttaaagagctctctctctctctctttcataaaaaggcaagaggagagccaagtaccaaactttttccttcagggttttcctctcaaaatcccaacttggcctctgtttttgctttcttttatgttctcttcttctctaaaaaccatctcatacttccaagaatttctctcacaaagaccaagaactcaaa

SEQ ID NO: 2117 - DNA, 3000 bp, Unknown
  misc_feature (1)..( 3000): cDNA_ID_3066015_gDNA_ID_1620490_Annot_ID_158580 3000 nt of promoter + ATG
agctgattacttacttgcactccggtatttccagattcagagtttgtattgagcgtcgtcacaaaaaactcccgcagcgaggaaggatcattcccctagatatatatttagaagaaaatttaacgaaaatcaacatacaattcataacatcaaactatgtagcctaagtaataatacctttgccaggaaagacttcaatttcgcaaagattaatggatccatcaattcttgaagtaccatttttgccatcatgaatccaacacatctttgatcatgaaaaagaaatttaaaattaagccgagtaatgtcaacaaacagatattataattacgatctcttctcaaaatacctcatgtcaaatgctatcatcatttgtcgtctgtccatggtactgtaagcgttgctagtacttggaacatccccgttaaagtcagcagcatttccgagaatccctacctatagtcggaaatgaactctgattttaattgacaaaactgaaacatgaataataaaacttcactactcaaagtctaaactaactttgatatgtctatccacagggctaatatgcacattttccaatctcagttctgtgtgagccagaccatggctgtgcaagtaattgaccttcaagtttgaacaaacaccaaaaaacatgttaagaagatcacaacgaaaagtaagaaatatgctgcttgttcgaaggaccaaattacatactccgatcaaaatatccctcattagtgtacggattagtcttaactgccttgaaactgcaggccctccagtagtatcatcacccacccttcgaaaggattcttcatctaatgcaagagtagcttctaatgttggaatccaatcagattgttgaagccagtgcctaatcgagaaacttccatggcactacaagaagagataaaaattaatgaatggtagaaaaatatgatgaaacagtctatatgcaccattttgaggcacttaccccatgtacaagggtaaatgagtactgatcatcgcttaagttattggtgatataaccgtgaacttgcattgagtaagaatggtagagaagtctccgacgaactagcttcttaaaaacctgcaagtagtaaaaaccccggtcaacattctgaagagattacaataagtaacataatagattaaaagggaggacgaacttctatagctcttcttcctcgtctttgagctcgagtggtattcaatttccgaagaacaactccttggttaaacaaagggctgtgaaattgaagcaccacagatgaagcctctgaaattcatcttgaaatcttgtaatacatatgaagtagaaactgacctatctggaacctgaactatagcttcaaacacaagctcatcagcctgtaagaaagtaaaagtcaatgagaagctaatccaaaaaaaagatagaaaacatttgacaatcatcaaatttggtaataccctgccgccatgaccaatgctaacacgatcaagaatcctaaaatcagaccacttgaactgcatcacatgtgctgattcatcctctaatgataccgaaggattatcatctatctcctccacattagatggtgactgtcttaaggacgatgaacaatgaaatatcacagatttagcacgaaatgatgaacttctgagctgccatagactatggtttcgtttataaccaatgctcgagttcctaacagaacgaaacacttgtaaattcggcagatttggagtcgaacaaacaccacaaagtgccatccaacaaaaaccctctacatacaaattcaaaagtaatcaacttttatatcaaatcactcacaaacaaagcaaacacagctacttcacattactattaaaggaaactcaattcaccaacactgatcttccaaataatccagaaagtcataatctttatctaattttaacacaagagaatcgaagagagactacgtgaacaacttaatgccgtaaatagacaatcatttcatcaatcattacaacactcgaatcaaaagcttaccaatcaaacagatagagagataaagagagatcttgagacgaaagaagcaacttcacattcaaaagtttgattctttcccaaatcagaagaaaaactgaaagtcgtatataacgacagagaggctcgtgatagttgcgtgatgaagtacgcctgaggcatcgcgcctcgaggtcgacccacgtcaacctctgcctctcaaatatctcatcccaactctcattgggccttattgggccactacctacgtaatggtccttttatgggcttcatctgtctccagttttgagttacgtgacgtaataaaccgaagcactgctttactaaaccggacgaaagcgataacgttaggggatcagggcataaaccgtaataatacccacgatcactggttaatatggtcattagctaataaaaactctcattgggcattactaggccaataacttcttaatgggcctttattgggctccagctgtttccagtttttgagtcgcggcgtgacgtggcacgacgctagcgagaaataaccgaaccactactttcccaaaaaccggacgaaagcaaaatccgatctgataacgtgcgtggcaaaaaactgtaataaaacccacgattaaaggataagatagtcattaaacaaataatcccttagtcttcctcttgtctgaaaaaaaacagtttctcgttttcttcaacattgaaagggcattaagcctcctctctctctctctctatcttctctatatctcccgctccgtggttcttttgtaattttctccaattaaatctcgccgccggctttcaaatcgccggcgatctagattcttccgccgccgtgagagtctttttttaatctttaagtccgctgtaagattcaatcaaaccaaagtccctaaaaacctcaatctcgatttagggtttgaaaattcgatatttttggggggttttgcgattgttagagattgtggaagatg

SEQ ID NO: 2118 - DNA, 3000 bp, Unknown
  misc_feature (1)..( 3000): cDNA_ID_4359917_gDNA_ID_1620490_Annot_ID_158584 3000 nt of promoter + ATG
atttatgttattttccgttaatgttgtccatgttaaacataacacctttaattttattttgtccttaaacgtgacatttatattgatggaatctctatacttttaagaggaaaaaaataaaaaaaattggaaaagagaatggggatgagtaaattgaaaatgatgtcataaataaagtttgtcgtgtcgatagatgaggtggacagattcataggaatggtcacatttatgatgaagtcgacatattggtttcgtagttaggccacctgctcttctcttcataactcttaagttgcttaaacctatttggtctttatcgtcaaccgcttgtcggagaatgtgttaatttttattagctccgaccgcatcaagttagttaaccatgttagttatgtttgtatgatcgacaatgtgtattttgtttttttaatagtgtgggaagcatctttatatatgtcttgcatatctcttttcgaactaatccctttaacaattttataacttttgatacaaatgacataaaaaaaacattcatcaactacttatggatattaactagtcactttatacatagtgttagcttcaccatttgttctacctacctaacatttaaattacatgtggttggtggcagaattgatatattgcttcattttttttttgtaaaaaatatatttcataattcctttactataaactatacactgttgcatgtaacaaaatatttatacattattcaattgtatgcgtatatttttgaaagaggtataatttaatagagaaacactaaacatatatagtcgtcaactttttggatgcatagttcgattcgtttatcagtgttgtgtgttgttacatatttattcgtttttggtcctcctagacatagaatgacactgataagaagtcattaaaattatataatattaataactattcaaaggtattttgttgttgtcaaaaacaaaaacatttgaaagatttcttaccaaaaaatatgttaattcttgaaagggtcaacattttgttttcctcactcctattaaatccaagttcaaaccaaattatatttaagtatttaactaatgtcgtaagattactatttgtttttttttaatgagtaattacggttggccgccgcatatggaaattagaaaacaaacttggtgcagttcaattcaacaaatgattcatcatcaatggcgtcacgttacgtgtccactgtccaatgattcaatttccattactaatttttaacacatataaccaaagcttgactatgaaacgtatcaaattagtaaaccaatctccgactaattaactactttatataattatagtttaacccccaaaactaatcagatattaagactaaccccatctattaattttgacagctgtcttaacagcggatttgtggaggctcgtagaggttttttttttttttttgtattaaatttaaagtagccatcaaagattgttttcatctatggtggtacacactttaagtagttttcttgtgtcacatattacacgtaacaatcaactaccaaaccccacatatataaaaatctaaaatttatccacttataatttttatttatttttaattattattttagttgaatgcatttaaaaattttctttttatgaaaccgttggttttttaatattaattttttttacagatattcgagatggacgaagattatctgactaaaatattaaggctttgagattattgggtaaactaaatttattgcttataaccaataagatgaattagttacacgttattaacttgaatttttctaatcacaaattggaagtttgctacttacttagcttagtagtttaatcaattcaaaggtaataatagagtctaatggtaacaatagattttatatttgaacatgaagattctaaaaactgacaaaatattttcattttcttaaatttcttaaattatacatatatatatatataaattttttatataatgtgagaagatatgataaccaataaaattttgctttcatatttttattgacaaaaactccaaatatgacgaaaccgcacggtacaattttaatagaaacaaatatatctatataataatatccgcagttgaatcgcatgtctccattgggagcctaataacaacccaactaataacataattattttaatacttagtttacatattaacatttttaaaaattgttggcttaaaataaaataaaagataaaataatgaaaatgaaagattctttttaaaaaaatgaaaaatctctcttatctaaaaagcaaaacaaattttttctttctaaatctggacccaaaccccatatctctcctctataaatataaacgtctcgtctcttaaaaaaatcgtataaactcttatatactttctctagccgccacattttaatagaaataaaaatatttctataataatatttgtagttgaatcgcacgtctccattcgaaacttaataacaacccaattaataacagaattattttaatacttagtttacatattatttcttttttaaaattactgattcaaaataaaaaaaataaaaaaaaaaatttaaaagaaggaaaaatctctcttatctaaaaaagcgaaacaaaattttctctctcttataaagctggaccaaactccatctctctcctctataaatataaacgtctcgcctcctgagaaaaacgtataaactctcacactctccctagccgccacctaccctccgccgcctccttttcgccgcctgcttcgctccgccgcgcgcagcgcttttagtctttttctgagactgtttccgaagaatctctctgttaggattttgtttgattctggtcgttatccagatcagagaaatccgtgatccttttttctctctcactttcttctctgaaataggaaaaacaaaaaacaaatctgataatcgaaactgatcactcactgctgattccgtaacctaaaaa

SEQ ID NO: 2119 - DNA, 3000 bp, Unknown
  misc_feature (1)..( 3000): cDNA_ID_3066019_gDNA_ID_1620490_Annot_ID_158579 3000 nt of promoter + ATG
tttgtccactagtgaagtggtttttgtggtgtttaagtgttaagtagctaacttttttttttctggtgaaatttttgtagccacttgatgagatattttggttccgctgacatgagcaaaatgtgtttttggctgctgagaaagttgagtaagaaaaaattaggttttttcaaaggaataaaaacggaatcttttttctgctgcaaaaagccaaaattttcttttccattgaaaaaaggagttttcttgggacaccaaagaaagtctctcttttttgtttgtgggttttgattttgataatgggaatttgctcctttttcacatgagattccgtgttcttcaagacttgttctgttctgatttataaaactatagaattggttttgtgttatttaattggctctttcttctcaaaaatcaatactccactaaagaaagaagaagattcttttttctcttaccctttttgaacgaatccactcaacaaaaagatctatgtttcactgtctgaatgtctctaactatgttctgtcttgtgtggtcactgattcgatgttacttatgattgtccttttttttgcagaacaacacttttgttgagtcatcaaacatatctgagtatgatattggagaagaaagtgatctttttagagctcctgatccaattcttgaagaaccaatcttaaccgttgatccactctctgctgctttgactatgatctcttgtggtgaagacacttcacaaggtctttgtgagcttcctgatcttggttcattgcagagtggtcaacagcttcttgacaaagctttttatgaatgtgagcaagatcttatgatgaaatcagctatggagtctccattctctgatgttttagacatcaagaacatctctgttgtgacgacaatcaatgagaaccaggatatgcaaaagagtgttagctcggggaatttgagctctatggattggtcacatgcacaacaagagactgtaatgattcagaattttcctgatttcgattttggttatggaatgcgaagagcctttagtgaaggcgacatacaggtttggcaaaacattgatgtgaaactttgttagctaaatcatcaagaatttgaataagttgtatcctttctagactcttgatatgaatatgattgttgatttgagtctcttttgtttttgataagcagaaacttggggcaggtcttgttcaatctccactagataggattattgtgagctgcacttcagaagatcgccgtgagaagctttctcgatacaagaacaagaagagcaggcgaaatttcgggcgtaagattaaggtatacaagcaaaacacttgaagtcattttagctcaaaaacaagcacttgaagatcctctaaatgttgtttggtttggtttcagtatgcttgcaggaaagctcttgcagatagccaaccgagagtccgaggaaggtttgcgaaaacagaggagaggaaatagaatggttcaagaaaagggctcaaaggaaggagactaagcaaaaggaagaaacatgaagaataaggagataaagcccatctcattagaaactagttttgttttatatatctatgtataaactttaaaatcttataagcatccaattagttttttgtatataaagggtttctctaaataagctttaagtaaagaaattgtagctaaagaaagtttgtattattgtagtttaaagaagtaatgtatcagtgggtgagagatgtatatacataatctataattctacatatttttataaatcatgtgatgtttctttgcttgtaagcattgcaacaagttagatttcaatcttctttgacaggtttcacatattgtattttcattttacatttttcatctttttgacgctatactaatagttctcaatgttaacgctagcaatcaataaaagtatttggatgctgaaatatcatgtcatgtcatatcattgctggtttgtccctaatgattttgtttctatgattggctatgtagccaaccataggacgtcatgtagaacgaaggcaatacattcaccaagtaaagaattgtgctatcctagcttctgatcaaacccgtttctcgacattcatccttagagtaaccagttcggtcctatacagatgaatttaccaaaaaatgctgccttacggtaacaatacgcgtctctcgaacttcgatcttcttatgatcccctcagctcgaaggtatggacaaatgatagcacccgaccccgggtcgaaagatcactaaatgatactaacacccggtttgaagttccgtaaacctcgataattactgagattatgaaatttctattagtaaaacaccattgatgtcaaattctacaaaagagagtttcatctttcatgtatgtgtgtggaagatgaatggaaaatgtttgtctttgctcaaatttcttctctactcatagttcatcttcttcttgttttattaacaagttgcacatgtttcttgttcgataaccacttttagcaatatttttcgtgtaactgtttttgagtacttttacttgatttattagataacaattgcagtgaacacattgacacatcaatttcacctttcaaaaaaggcattcttttggtgctttcaaaccactcttacgttttctttgtacggaattgattcgattgtattacattttatttctctctcagattcaaatcccagaagttcttttaatcaagtcaaggacttccaacgaaaaacaaaaaatgaatctgtgcctaccaaaaaaaagttgacttcttttcacaattatattaagaaaacgagaattaactttaaaatcaagtgaatgaaataaataagaaacacaaaacagctcgcgtgtacagtgtcgtaatcgtaccatgtaactaactttccagttccatggttcttggagctttattattaccttcaaaataacagaaacacagtttgattttgaacttgaacgaaacaaaaaaaaac

SEQ ID NO: 2120 - DNA, 3000 bp, Unknown
  misc_feature (1)..( 3000): cDNA_ID_2047453_gDNA_ID_1620491_Annot_ID_158592 3000 nt of promoter + ATG
gacttgcggattttggtggccggaaacctagagctcgatctaaagctagtcgcgattcggacagtgaggaatcgtggaatcggagagaagaaggcgagagaaggaggagagtcaacgagaggagatgaaatgaaagagcagcagagaacggagagctttgtagtagtactagtagttgccattttctgcaacactagaaaacacgaccttttcttcgattacgttttcatttattttttttgacagtaactggttggtagttgttgttgctcaagcacacaaaatttggtttgttttattgtttaccaaaaagatggtgaaaagtggatatttatttccccaaaaggagtgttttactttatctggtcacatatggattaaagcaattttagtttcgttctatttggattcggctagaatggttcatgacatggtggtgttcgtttgaggaaacgcataatttgttattgtgggcctagtttgggctttatattcgctaaataatttgggctggtataagtcaactagacggaccacaatttgatttcatcaaataatttttcatgattaataaatccctaatttagttacgaaacacaattcaattattgtgctactcagattcgagaaacataaaaaaaaaaaaaaaaaaagtgattcagattccctcacatgggttgccgagacacatgaccacacgtctcttgccttgtttaatcttttatcaattttgcatcaacttgtatataccataagaaaattattttaattgatttcaatgtgagattttctttagtattttttgcatcaaataatgccaacctaatcctcaattatccatctttattttttttctgaaacaatcttatattatttatctgttggcaaaagaaaaaaaatcctcaattatttcgcaaatggtatatatgtttatctttaaagagtacacttgcatgtgttttccaggtgtgcgggcaaaagaacatcagaattggttctggatatagttctctccactttttatttgttattgttttaatacagtacgttttatgagagttttttatatatataataaattatgcgtttcctgatagttgttggtccaatatcgagaacaaaaaaaactaactacaagctaaaaacctaaaactatgaagatctcagaaaatataaatatacacgctcacgttagcgagtaaaaaagtagacaccagattaacaaatgattagtgtgatcacagtaaagaaatgttttgcaaaattttaagcaattttttgaaatcatgttgtatgtaataaattgagtaaattcatgctgtacataaattaaagaccatttctttgttagtcattgaaatcataaccaatcaaccaataaaactgaatttttttcgttcattagagagataagttaatatcttcaaagtttaatgttaagctcaattgtttagataggagataaccgataagaaaccacataactagttaacctacctatcttggcatcacatgaatcaatgacgttggatagtcagagaggcttattttaattatacccgaaacgaaccaaccatctataattctctaaactatatttaatcatcatataactctgtaataaacccaaattttcacaaattaaaagccataccaatatcttcaaatatggaaaaaaataacaatttaacaaagaaacaaaatatttcctcaccaaaaaaacagaaacaaaatattgttttaaaaaaggaaagtggtctttacacaaaaaggaaagagaaaggaaagtggtctggttcgtatcgcacccaataagaaccaccaactgttgaagttcgtaaactgttccacaaaaaaatgcataaaagaaagaaaaacagatatgagattcgaccattttttttccatataaatgttttttgggtttgcaaaaatcgacgccattactcttttttctccccaaattattgacctttttataaaaataatttatattctcaatcacacttcatcgtcttcttcttcctctctctctctctctcctttttgtctctgcactgtgtgttgtcaccggagacagagcttgtgttttcaactctctctctctctctctctctctctctctctctctctctctctctctcttgctctctccgtctccctcactctctctttacttcaaaatcaaacccttttctcagatttctgtgatatagcaaaatgcgcaatctcaaactctttgagagatttaaaagcactcaagtccacgcctttactacacaagactctccctctacaagcagcaatggtagccctcgaatgatgaagttccttgggcatcccaaatccaaatctcgttcacttctccctcatggctttcccaccacagacctcctcgagcctcccttggactcttacctcaaacctatcgatttggtggagtcattatcaaatctatatcggagaatcgagtccagttcggaatccgaggcatcgatgctctaccttgagcagtacgctgttctccgcagtctcggtgatgccaagctcttgcgtaggtgccttctcaacgctaggaggcacgccattgatgtcccttgtaaggttgttttctctgcttggttgagattttttaggagagaacatgaacttgtgggagttgaatctatggattgtaatgggcttgcttctgaatgtccgaagactagtttgactcatggttgtgatttgaatgtagacgacgagggttgtgaatgttctacggtatgtgaggatgaatttggtagtgatgacgttaaaatctctaaggctgatgagttttcgggtctagatgaggttagcgatatttccttctgcgtaggttcagagaaggctaagtgtgttaggtcgagaatcgcagcgctttcgcgtccttttgaggccatgttgtatggttctttcgtggaatcaacaacttctgagattgatttctcggaaaatggcatctctattgaggcaatg

SEQ ID NO: 2121 - DNA, 3000 bp, Unknown
  misc_feature (1)..( 3000): cDNA_ID_2047410_gDNA_ID_1620491_Annot_ID_158605 3000 nt of promoter + ATG
cgtatatatatttgattgagatttgagacaagtaaaatcagtttggataaacacacacttgttgtcgtttctttataaataagacggacacgaatctgtaaccgatgcatttttaagattcttttaattatatcagacagagagatatgacttttgtagttcgtcttcttgtgtgtctcttattgacgcttacaattacatcttctctagcccgcaaccctgtttccgtttcaggttcgaatctcatcttcttgtttccttccttcgattcgttcatgtttttctctatgtctgaatgatttcgtttggattaggtgggtttgagaattctggattccaaaggagtttgttgatggtgaacgttgaggactacggtgacccatctgcaaatcctaagcacgaccccggcgttcctccgtcagcaaccggccaacgtgtcgtcggcagaggctgacgtaatgttttagttaacgcagaaggaaagaactcttcttgtttacattttcagtttgtctgagattaaatctcagttcatatagctttctctaatctgtctatatagatattttctcgtaatctccatacaacttcatttatttttttcttatggcaatgactttgtaccttattttccaatttgtgtctatgcaaaatgattgaatcaaaagagttcactctaggtaaaccaaggtatgctacatcaacagattaactgaaacatagaagacacttttggcacatgagattgtaccaccatctcgtattaaaaatacttgtgagaacttcacggaaaggttccagcgtttctatcttctgatactactacttcagtagctgctgcctgtgagtatgctcggtcgtgttagagttttactgatgagatctctcagctcgatctctcctgggaatctaccttctttcaatttagagaacacctgaaatagaaacacaggatttagtacaaactgatcttacatatctggaaataatcttaaaccattaattactaaccggttcgccgttgcagtgaacttcaaaggcgcctgagctttgaaggtaagactgcagaaagtttccgataagccaagtggaagccatggatccaaatctgttggccctcaaggagtggaaccaagcaggtgggttcgtaattccaatcatgggaaggatacgatcacctgcaactatcataccaataactcccatctgaacaaccggcacaaccttagctagaaggcgttttggtgctggtggtgggtaatttgcgagaatcacatctaaaccgggaaaagccgtctctaacatcttcttcatggtgactgcagttcccctacaaattaaaaaaattgggatgaacaccagtcacactgataaagaaagctagagttacttatgccttttgcggagaagttcaaaacagtatccaaagaagtcatgtcatttagcattcataatcatatataagaaccaaagtcaggcctttcaggttttctagcatctaagaatcatccccaatcaacaaagttgatcgaccacacatctctaaaatcctattcaccttgcagctataatgaatcctataaaaatcaatagtcaatgggaactgaaaatcatatacatgtatagacattgcagcaggaataagccttgagatataatcagtgcaaacaacagtcacagagatgatgtttttatgaaataaaatctcaaactgtctaattgcagtgatttgcttattgaagacactgaaacttatgacaatgttaattaggatgttcatgtatctgactacaaggaagcaatgacctcaagcatgaatcagatagttcttatgtagtttccacattatctaagttttctttctcaccacgaaaacctcacttacaagctgcttaagattctctgactacactagaataactataaatccgattctaagtaaaaacattaaaatcaaaatcgaatttcttaaaatctaagtaagaaaaattgaattacttgtaagaacaggagacgcagaagttgatctctactgtatttccatatccaattgctcctcctaagccacttgtcttctgcaaaataatgggagcttagagatcaaaaccgtaaccaatagaagtgaaatacacgaaagtataaaagaaatttaacctgtgaaggaaagtctagggtttcggggatgatcgcattaggacgatgctggtgaggaatatgcggtggctgatgaggacggtgaggctgaggtttaggaggcggaggagtgaagaggttgaagagatccgaacaaaacaagaatataggtagacctaacaagatcaattgtgctctgtccatggcggatatttagatctctcgattaattcacagtgaagcgcgagagagagagacgagggaagaagtagtgtaaagcgaatcggagaagacggaacgagagagttcaataagacttgtttggatgctggaatattattatcctgctcattgttgttgacgtcttatattttgaaatatttgcttaaatacccctgtatttatattttattgcacttacacccccgcttgaatgaatagaagtaacataaagcccactgaaaagtatcaaaacggcccaaatatttgatccgcaactattttttcttgttgactcggttcaagaactaaaaagaacaaaagtgacagaggtttgttataaaaaagcggcaccggacgacatgaatttctccgggaattgacttgtcaaaacgcgtgcagtgcacagcgtctcaactgttgtctattgctttctcaatcacaaaaagtacaacaaaaaaagctgatttacattttgtttttgactgagaatgttagttcaaattctagatcccgctctgagtttgttcacactttttgttttgctctccatcatcactcaaccgaaaaaaaaaagtaaagacaaaagttattttccttatgcgttacttctccgttagtttcgaaacactgacactatagaccatg

SEQ ID NO: 2122 - DNA, 3000 bp, Unknown
  misc_feature (1)..( 3000): cDNA_ID_2047397_gDNA_ID_1620491_Annot_ID_158609 3000 nt of promoter + ATG
atctgattcatgcttgaggtcattgcttccttgtagtcagatacatgaacatcctaattaacattgtcataagtttcagtgtcttcaataagcaaatcactgcaattagacagtttgagattttatttcataaaaacatcatctctgtgactgttgtttgcactgattatatctcaaggcttattcctgctgcaatgtctatacatgtatatgattttcagttcccattgactattgatttttataggattcattatagctgcaaggtgaataggattttagagatgtgtggtcgatcaactttgttgattggggatgattcttagatgctagaaaacctgaaaggcctgactttggttcttatatatgattatgaatgctaaatgacatgacttctttggatactgttttgaacttctccgcaaaaggcataagtaactctagctttctttatcagtgtgactggtgttcatcccaatttttttaatttgtaggggaactgcagtcaccatgaagaagatgttagagacggcttttcccggtttagatgtgattctcgcaaattacccaccaccagcaccaaaacgccttctagctaaggttgtgccggttgttcagatgggagttattggtatgatagttgcaggtgatcgtatccttcccatgattggaattacgaacccacctgcttggttccactccttgagggccaacagatttggatccatggcttccacttggcttatcggaaactttctgcagtcttaccttcaaagctcaggcgcctttgaagttcactgcaacggcgaaccggttagtaattaatggtttaagattatttccagatatgtaagatcagtttgtactaaatcctgtgtttctatttcaggtgttctctaaattgaaagaaggtagattcccaggagagatcgagctgagagatctcatcagtaaaactctaacacgaccgagcatactcacaggcagcagctactgaagtagtagtatcagaagatagaaacgctggaacctttccgtgaagttctcacaagtatttttaatacgagatggtggtacaatctcatgtgccaaaagtgtcttctatgtttcagttaatctgttgatgtagcataccttggtttacctagagtgaactcttttgattcaatcattttgcatagacacaaattggaaaataaggtacaaagtcattgccataagaaaaaaataaatgaagttgtatggagattacgagaaaatatctatatagacagattagagaaagctatatgaactgagatttaatctcagacaaactgaaaatgtaaacaagaagagttctttccttctgcgttaactaaaacattacgtcagcctctgccgacgacacgttggccggttgctgacggaggaacgccggggtcgtgcttaggatttgcagatgggtcaccgtagtcctcaacgttcaccatcaacaaactcctttggaatccagaattctcaaacccacctaatccaaacgaaatcattcagacatagagaaaaacatgaacgaatcgaaggaaggaaacaagaagatgagattcgaacctgaaacggaaacagggttgcgggctagagaagatgtaattgtaagcgtcaataagagacacacaagaagacgaactacaaaagtcatatctctctgtctgatataattaaaagaatcttaaaaatgcatcggttacagattcgtgtccgtcttatttataaagaaacgacaacaagtgtgtgtttatccaaactgattttacttgtctcaaatctcaatcaaatatatatacgtttcttataatgcggagatgatgaaaacaggtcagaagagtaagaccatgtagatgacgacacgtgtcagctaagaaggcgggagtgggaggtgacgtgtgcaacgcgtggtgccacgtatgtcacatcaaggccaagcaagtggaagtgtggaggcacacaagacagtgattgtcattttgtgcaaatcgtcaacgcttattaccaaattttaagatcattttaccaatttctcccactcccaaacttttttgttgacttttttctttctctttatggggtttcctcgaacttctcgccagaaaataataatttatagctcactctcctcactgttctttctaaacgaggacaaaacatgtttactacatttccaaaagtcaaaatatgttcatgagacagttttaaccaaagtaagtgaaattcgtaatgagattggtacttcaccgattatgccttaccatgcattgtactgccctccagtaattgtatttagaaaaatcttttatttttaatgtagttgtataatttgctacaaagattttccgtgggttctattgggctccttaaaacctcatattggatccgactaatggtgattggtgatacgcatcaaacatgctctcgtcaaattgatagatttttggtttctgttggatgaattcaaaatatataagaagaagtagacaagattatttacaatataatacagtacatatttactctacatctgcttatataatttcgttgtatagcagtatcggtataattacgaataagttcttttaattttcatttaaaaaccaaaaaatgttttgattaatttagaaaaatattgaaactttacgagagatgggccgacaagtaagattaaatggtacacgtacccacatcgcatgcaacttggtctcttcgtttatacagaatctatgccttatttgtgttacagacataaatccgtgacaagtgacatcaattcattagggaatattatattataaggaggtgttgatctatagatatatatattatggaaaatttatcattttttggaacgtaatcctttgtaactaaatgcacctatagatacacatcaaacacttcatttgttttaagtaatttaatagactttttaaaggataaaatcgaaagagatctcaagagaaatagggagag

SEQ ID NO: 2123 - DNA, 3000 bp, Unknown
  misc_feature (1)..( 3000): cDNA_ID_2047385_gDNA_ID_1620491_Annot_ID_158612 3000 nt of promoter + ATG
ggtcttgcttttgtatgtattggctccatggaactgttattattatgtttctcactttgatgaaactacaggacattgacaaaggaagtgaagttgggaaaatgtttggaatctattaaagctaatgcctttgctatttcaaagtatcctgttattattactcttgaagaccatctcacgccaaaacttcagtttaaagttgctaaggttttctttcttttcacctctatagtcttgagaccttaaagtagttcatggttccgtctatgtatatatgaataccgtaaagtgtttgctctgcagatgataactcagacatttggagatatgttgtattaccatgattctcaaggttgtcaagaatttccttcaccggaagagttgaaggaaaagattctaatttcaacaaaacctccaaaagagtacttagaagctaacgatactaaggagaaagataatggagaaaaaggtaaggattcggatgaggatgtatggggcaaagagccagaagaccttatttctacgcaatctgatcttgacaaggtttgttctagctttgcaactgtatatcaaaataacaattgaagcaaaaacttgtagcatcataccacttttgattgctttcaggtgacaagcagtgtaaatgatctcaatcaagatgatgaagaaagggggtcttgtgagtctgatacgtcatgccaattacaagcaccagaatacaagcgtcttatcgctatccatgccgggaagccaaaaggcggtttacggatggctttaaaggttgatccaaataaaatcaggcgacttagtctgagtgagcaattacttgagaaagctgtagcatcatatggtgcagatgttatcaggtatataaatatcacatgctaaataggcactgtatagctagtgtttgcttcttgtatttcaagttaatttattaaaacccttatacgtgagcagattcactcagaagaattttctgaggatatatcccaaaggcacaaggtttaactcttcaaactataaacctcagatcggttggatgagcggagctcaaatgattgcattcaacatgcaggtttgtctcaaatcctcatttcgtgtatcgtcatccaggttttactatgatcatgaaactaaataatgattgaaaacgtaaatgtaggggtatggcagagcattgtggctgatggaaggaatgtttcgagcaaatggagggtgcggttatgtcaagaagccagattttcttatggatgcaagtcctaatggacaagatttttaccccaaagataattcgtctccaaagaaaactttaaaggttaggctttagatttaaacacccgttggttccttcatctatgcctcccacgcttctcggttcttaacatctaacaatggcaggtgaaagtctgtatgggagatggatggctcctagacttcaaaaaaactcactttgattcttattctcctccagatttcttcgttagagtatgtgaacgacaatcttgatttttcctttatcccttatcttgattgaaatggaattataactggtcaatacaggtgggtattgctggagcacctgttgatgaggtgatggagaaaacaaaaatagagtatgatacatggacacctatttggaataaggagttcacattccctttagcagttcctgaacttgctctgctccgtgttgaagttcatgagcacgacgtgaatgaaaaagatgattttggaggtcaaacttgtttaccagtttcagagataagacaaggcatacgcgctgttccactctttaatcgcaagggagtgaaatacagctccacacggcttcttatgcgcttcgagtttgtctgagacgccatttttggtgcgtgtatccatctagatttatatcttcttactttattcgatatgctgtgttttatgtgtcttatgcttcttcattgatgaataaaatttgatctttacatgagaaatatatagatcttctgaaatttcctttatggtttcatttatatatgttaccagtttcttggtcttgggatgaagttttgttaaataagaaccaaaaccaaagaacttatgataacattaataagcatctctcatcttatcataaaaacataacctctttattctttttctggatgatttggtattggatagcttaaagtagttatttatacgcatgaggacttataatagattaagaagcttcatatcttcagctacattgttagttatttaagcctttgtctctctgtttgctgcactaaacacgtgaaattctgaagtagagtatagtattctggaatcttttgttgttatatgaatctctttatgcttattaatcaattttcttagcatttctttacattaaacaacttaaaggaatttattcttaatccatagacaaagaccacaccacccatatatgcttattagtgaagaaaaacagattcttgattctgtagattggtaacttacagatgtattgagattcttcaatgactttaggagaatttcaacagtgacttgaaagaggttgcataccgtgaaatgttgaaggaaagaaagaaaatgaaaagtgttgagaaacccaatcgttgaatccgtgaagcttccttgagctacatgcctacatcatatgcttctggaattagataccataataattgtttaagcttgtttttggaaagtgaggctttccaacatgagtctcttggctgggaatatatggaaaaagaagaggaaagctaagagcactgagcaaaaagagtaataccactataattataataaagtatggaagaaaagagaacgacttatagttgatttatgagtatgaagttcatgccaaatatgcaggagttgttatttaactaaattgcaggaactttttgaagagaatccagcggttgaaaaatataaatagaggttggctggtgtgattgtgaagtatctgggatgaagagagatatggggagttacaaaatg

SEQ ID NO: 2124 - DNA, 3000 bp, Unknown
  misc_feature (1)..( 3000): cDNA_ID_1023494_gDNA_ID_1620491_Annot_ID_158615 3000 nt of promoter + ATG
gtaataataacaggatactttgaaatagcaaaggcattagctttaatagattccaaacattttcccaacttcacttcctttgtcaatgtcctgtagtttcatcaaagtgagaaacataataataacagttccatggagccaatacatacaaaagcaagaccataccttccatgtttaacgcagacatcatcggtaccacgtggccaaagatccaactcaacaactctcacgcctcgtctcaatgcatctgcaataggaagttcactgcagttgctacttagctgatttccagttaaataggaattgtggcctgtgaatataaagtaatgtgacaatggagcatccatgttttgatggacctgaaataaacaaccaacaatgttttagttatatcactgaagaattgagaatcttctctctgcagaagtaagcaactactagaatagaaagtatccaaaatagaaacttctaaatttagacaggttaatcaaacagtcagattccagaatttcagcagcagctgcagagtacacaccaagaacatatcatcgagaaaagtttcacccttttattgggatttgatgaattattcataagcattaagaagaagctaccaaaagtgatgatttttattttctctttgatcaaactaaatttaggccagaaaatagcaaaaagagaaaagagtcaaatagcgatgagagagaaaacattctgagattttccggtaaaaccaacagagagaagaatctaaagtcgtaatctttcaatctcaatctttatcaagaaacaaacaccatcaaatcccagattccaaaaagtctcagacttttcttcccaggaacaaaaaaaaaaaaaagagtttgacttgaaaaatttataaacctgatcggcgataggaggattaagatcagtagaaaagaggtaataattgaaatcatcaagagtaaggtttcgtctggtgaactttgcaatgtgatgtttccggcgaagaacctcgtcaacgattctctctgcttcctctagacttgtttctccttctcctccttcctccgtcatgagcttctgtagctgctccggcgacatatgagcatcgccttcggtgtatttctcgaaaagatctctgacgtcttcgacaggaccagactccgtcatcctgaacttccttgtgaagatcagacagaatttgtaactacccatctctttttttccttccatgtttgtgtatgtatcgtcgtcttgttcagatccaagaatgtgattctgattctacataaatactcggattgttcctgagttttaatattattttaaaacttcgaaaccatttcagagaaaacctcgtcaaacctcctctcttacacgctcacacctgaacacacaaaaatacaaaaacaaaaacttttttttactgaatctcgttttttgtaataatttacaaattagtctcctcgttaattttaaaaccagggaaaaaattgactaatttaaaagggatgagtaaaaatagtagttactgagattatatcgccaggtgttcattgtttttgtccctccccataaataacatactacaaaagatattttcattttcatttttgtgtgaagtgtgaacacaaaatcgagactattgagaaaaaaaaattagatatgttgaaatggcaaagcaacaaaataaagaactggtctggctacattggtggggcagatgcagatctaaatcttttgcaatttgttgtgttttgtattgtctttgtttttcttctctcaacagaatacattcttccattgaaataactccaagattaatatcgtctattgttgtaagttttgttactatactgatagacaattatctaccgcaagattacactctcgaaagctaaaggtcataatttcttgttggtgtttgaatatcttgttgataggattgagtggcgggccaaactgtagagttttgaaagctttggatctgttttgaacataacatcatggttattcatgatgtctcttttagaccaaaagtgtaaaaatatattgttttgttattcatagtaaaattaattcatatatttccattttattttatagcatgcttgggaattatttttcccccaaattatttgatgtttgtaacaatttgtatttttgcactatttatcagtggttgaatttctttaattatctattaaatgatgttttatgtaggaaaaaacaagaaatgcgaaattcaatttaatttttgaaatacttcagatgtcggccaaaagaaaaaaaaaaacagataacattagatatgttgcaatagcaaagcgacaacaaataaagtgttcggctatattggtggtgcagctgcaggtctgttgtctttccaaatccatcttttaggccaaaagttaagtactaatctcgccctttttaccctttctttttactaatagtaaaatattatcaatgatgtagcaaaataaaatgtactggaagactggcccaggaaagttgacagtatttaaatgtcatcgaattcttaatatggatggaaacgtgcttaattaaaatgatactgacaattaatatttaactaaccacttataaagttaagtaaccatattaatattagctggaacaagagtaatgtgacatgcttatggtattgatgttgagtctttttgactaagaattaaaaatgacttttgggtatccgatccagccatgagccatttcttccattagggttaccaactctgaattactattattatcatttcttaattaacaacaataaagaatcatagaattcacaaagattaatgggctgtaaccaaaccactcattagcccattacggttctacaacgatccgggcccaattacaattgtacacgctacaagccaggtggcggaatttaattggatattgacgtggctttggtgagaaatagcggtggacaagggaaaaaaaaagggactgtggagaaacactttagcacggtgcgacaag

SEQ ID NO: 2125 - DNA, 3000 bp, Unknown
  misc_feature (1)..( 3000): cDNA_ID_3433962_gDNA_ID_1620491_Annot_ID_158618 3000 nt of promoter + ATG
atcttgttgttgtctcaagtatggtctgccactacttcatcttattatatgtcacaatacattcacatttgttcggacgcgtttacgaaacctgactggaattttggttatccactgcttggaatctaacttagctattgcatttcactgcaaaggatttatgtttaatgatttagcttaaaaggatttgtggaaagctcattattcaaacaaacaaaacttacatgaggattattgatcaagtacatatataccgtgatctacattgctaatgtacaacatgtgttacaaaggaatgagtttttcatctctcatcacatcaatccaatacaaaaccgaatctagggttctatatttcctcttaaacccaaacctatctactttttctcttttcccaagaagcttaaacggacatctaaacagagcatccaagaaataccaattcgccaaatcctcaatctctgtcctaacaagcttctccttcacaacaatctcatcccacacatgttttctctcaaccatctctctcccaaaccagaaaccttcatcaaacatggttgtttcgttaacttgtacaccaagtttcttccctatttccggccaaatctccttccaagtaaaccctactccattaatggcgttaaaagcttcccctttctcgcgtactttcccacttgttgcagcgaatatatgctgctccgcgactaaattcgaatcagagccatctatgtaactctcttcccaacattctcttgttcctccaaacacaaaaggaagattcaaatacttacacatcgctccataaacacaaagacttcccatgaagttgtacagagttcttgaagagcttcccattagcaaaccaggtctttgaaccgaccaaacaacggaactacgagtgatcttctccttcagcaagtcctccaaaacatagtagaaattcttcccagagctctttcttggacactcctcgctgtaataatacaaactcgaaccttctccacgagccattgtctcttccaccaaagacacataatgcttcatccccgtttgaagcgagaaatgctttaacctcttagcgtttgggagaatcgcgtccaaagcgttcatcagcatcgtcttgttctgtacgcaacattcgtcggtatccaatggaaactcaccagaccacgtgacccaaaacacgtgactcacgatgtcttgtaatggagacaacctctgtttagtctcagatgcgttaagcagatcgcaggagatgaagttgtacatcttcgtcatggaattgatctccgggttacgcgctacgccgtagattctccatcctggtttagacattaatagcgtcttaacaatctctcgacccacaagcccggtgacgccaaagattaacgctacattctcgtctacttcgtttcttctcatcaagctgccattttcagaccccattgtgattattagtgagttatggactttgatcaaagcttcatataaacgcttagagtaaagacaaaaaaagtttgtgggactgattcaacgtgttttaggatagtttcaagactcgatgcttacctgttttaaaggctatgataaattatccaaagcaagttgctttgaacacagctacgatgtagcataacgaagcaacatttgtttaagataaaatagactaaagtcaaacagtgttttgggtttcatgttaacgtgtttatcaatttaatttgtggttctggaatgtgttacgaaagcaacagttgttacaatagttttttaaggaaccgtcgtgtacagcattttgtccggttctcaatcggacggtcaagattttgcgagaggcagagtctggcccgtggttgctggccggcttttaaaattatagtacacttcaagtgggtctctactctaatagtattcattttagttaacagtctcaccggtcaaaaccgaatattagccgacaacttattcaatgaactagttatatatacactcgtgagtcgtgatgattgttttttcataactagaactcatgtacccgaaaccaaaccgatttgagatctaactgtcgttcgattcatgcagtggccaaacatgtatcatatcgaatttcatcaaatgaaacaagttgaccaatggaattgagaaagtaagtttttggattagcgaaatggaagaccataatttacattatcaaacaactttttgattgatcaaaattattcttctgttataagtcaaagtctttgatcacgtataacgttttaatatgagaaaattgaataactaccctgtctacgttgaagaaactgaaagggggaaatgggtacagtgtatctcttgtcccaaaggacattgaaaagctaaaaaactaacacacttggctacgtttaaggctttaaaatggaccatgttttgtggtagacctacacattactcttctttcaattttgttttcctccgtattctatgcattgaatagacccacttctcatctttaaattttctgtggaattgtgaaagagtgttctactttggcgacaacaaaaaaatgtttcttggaacttggaagaacttcaataaaacggcatggagttttgacttccaagttagaaacggagtgtacctcaagaaaagggatctaagcgtaaataactaaaactaagaaccctaaaagaaaatacatgattatgaaaggactgaatcataaatgcctgtcctccaatgttgagacgaattgaaaaggaaccagaacaactactatcaacggtgatcgatttcgccgggaacggagaagaaaaccctagatatggcggagaagcttgcgccagagaagagacacgatttcattcacaatggtttctcgctttctctatcccctcgctctatttctctaatttcagctgattccatttcacgagatttggtttgaatgttcttcgatttccgatggttataggtcaaaaggtatttgagtgggatcaaaccctggaagaagtgaacatg

SEQ ID NO: 2126 - DNA, 3000 bp, Unknown
  misc_feature (1)..( 3000): cDNA_ID_2047358_gDNA_ID_1620491_Annot_ID_158622 3000 nt of promoter + ATG
cattactatgaacaatctctcggcttggcaaatctaagttcccgaagatagagtcccatattcgaatacggttgtcctgacacgtcgtgaggattttcgtgcctgatgatggagagaagtaagcagagttgactactcgtttgtgtgcaagatcatgaagagaagctttaggttgtagtttacgcatatcccagattcgcgcctgaaaccataaccaggaaaatctattaaacaagttctgaaagaattcagataaacatctaaacgaatccaaagtgacagcatgatcttggttttgtttgatagacttacaaaatgatcgttcccacaactgagaagaagctcaggctggacagggttgcagtcgaggccacaaactttgcttccttgcttgtgtatcagaataggctcacccgtactgttattggtacgatgatcgatccttttacaaaagcaatcacgagaaaatcagtttggcactcatttaaaacagtaacaaagaggctagtctataaacagttcaaggggatgaaatcacttacatgtgaagaaacccaaaattatcagcagcaagcactacacctttctccgagtttatatccataccgtacagcattttccaactgtttgcgccctataaaccgatgatatgtcgtaataagttaaatgaatcagagaagacaaattagagaaacgagacgatggtgtgacctgccatccatcagggttgagattcagcaaagttgatgaagttccagtttccaggtcagtataaccaattgttccatcagaggatgcagaataaaccatgtcatcatttgtgggactaaacctgcaataccaacaaaagaagataaatttgataaaacaaaagacatgagcttttgtttccagatactataatgcagaaagtaaaaccacaacatatactgtaagattgaaagccagatttaaaaacttaccgcatattattaacttgaacagaatgtatgtttccatacacattcttctcatacacttttccaaaatcccagactccaatttgccctttcttcagagcattaaccataagaccaacaacagaatcgaataaaaacaatgagaaaataaacgcagaaaattagttacgtatgacttttgtttcattgtaaaaccttatctccagagagaagaatgttgttctttgttggatggaactccaaacatgtaacacgtctgctgtggtatctaataactgcacaatgaacttgatccgggatcacatattttggtttaatctgtccagcaaaggaaaaagagaaaagatccagtcaaaaaatctcatcaggtatcaaaaaatgtttggcgcttgaacacgtaaggacttacaggaggaattctcggttggagttggcgcttgaacacaaagtcaatagggttctttgtattcctatgagaagttgggagtattccgtggtcagtaaccactctatgaggacaggacattgtggtgtggccttcaagtgatgcagtagaaagcgaaaacattgagtaaattaacattttctccactcaccatcatcaaaaagctcacatgtaagcaagaatcgataagaaatagcaggagctttaccaggcattttacacaagaagcaaggcttcataggacaatcgatatacgttgctcctttaaatccagcttcatggccaggctgtttacaaacctataaaaccaccatgaaacaacaacagatacgaaacaatcaaagccaaacaccaaaatcctctgtctctgcatccaagtgaagaatactaataaacaataaagtgaatttcaggcaccattataatgggaaccaatacagtgaatacttctaatatgttcgaaatcaaaatcaaaagtcattacttattccacataagcctactcagaacttgaaatcataagccaagtaagaaaactcattagaaaagttagggtttttagaatagcgttactttgcaaactttcttaataagcttaacggtaatgggtgctttccctttggctttattcttctccaattcaattttccctccatttttaaccgcttcatcttcctcctccgactccgagaaagggtaattatcttcctcttcttcttcttcttctgacgaacttaactcggaatctgtatctctagcgatgacgatttctgggtccctttttcttctgctcctcgttgaactcattttcggtaaaaatctcacgacccgacaaaaggaagagagtacgaatcaaacagttttgtttctttttgggtttgatacgacgcagcggacacaaactaaagccggttaggtcgatgaccggtttaattatttacgcggataaaaacacttttactcccatttagatttaccattataccccctccagatcttgtaatatgttcctgtaataatgtgagggtatattggtatataactaactatctcgtggcgggagaggttaagacgtggcgaattaccggccggaagcaccattcacgtggctctcacgagcaatactagtattgggcctttttattcagataagtaatgggctatggcccaattttcatttatcccatatttaaatttgacttacaaacaacattaattgaggttctttgctggtatgttgacaaacaacattagttgaagttctaggaggaggttttaatgcatttattttctttaagaaaaggaaaattaggagacgtggacgaataggaactcgtataaaccacacaaaaaagaaataaaaagacaggagcttggaatttcttaacgataaagtttgtttgtggcgctcaatttcgaaaaaaacatgtcaacatcatcttcttccacaccgacaaaacacgtcgtcgttttcaaacacttaccagaaccatctgtggaggaaagaaagttccaaccttctctgcttataatacaatacttcccctatgctatcaaacctatcacaaagcctagagtaaaatcgattctcttaag

SEQ ID NO: 2127 - DNA, 3000 bp, Unknown
  misc_feature (1)..( 3000): cDNA_ID_3066055_gDNA_ID_1620491_Annot_ID_158621 3000 nt of promoter + ATG
caagacatgtggcagtgataatggacggaaaccggagatgggccaaacgggccggattgctgacgtcacaaggccacgaggccggagctaaacggcttatagagttctccgagctttgctttaaattggggattcatacagtttcagcttttgccttctccacagagaattggggaagacacaaggtgtgatatttcagactatgtagcttacattctcactcaactcttgactctaacgatttgttggtattaataagattgaggttaagtgcttgatgtctttgatccaacattacctcaagtccaagatccaatatttccaaaggtataaagtacaactcaattgagcttttttgttgacaaatgatctgctcatggattaccaaaatcttgttgtttcagagaggaaactcgagtttctgttatcgggaacctaacgaagatccctgagtctctcctccgaacagtccaagagatagaggaagctacgagaagctataagaagaagcatctcatattggcaatagattacagcgggagattagacatcttgcgagcttgcaagagtattgtgaagaaatcagaaaaagggttgatccgagaggaagatgtagacgaggcattgatcgaaagagagcttctgacaaattgtactgagttcccaagtcctgatctattgattaggacaagtggagaacagaggattagtaacttcttcttgtggcaacttgcttatacagagctcttcttctcgccggtcctttggcctgatttcgataaggataagcttctagaggccctggtttcgtatcagcgccgggaaagacgatttggctgtcgggtttgatcctctgctccgctctgttctgttatgttcatctgagatttctatcaaactacttgttccacagtcagagatcattatgctgttgtaactttatgtcggtaaattgaaaatttgctaataaaaatcagcggttactttgtcgttacttatcactaaaacaaatatcttgcaacacaaggaactgtactatctcaaaagcatagttcttgaggtatattacacatcatattcagttttcattacaccatttgcaagaaaatcaagatttacgaccaccaaagcgtcgttgtctctgctgaaacgacatcaaagcttcgataaaaccgcttctcccaaaatcaggccaaagttcttgagcaaagaaaagctctgtataagccaattgccacaacaagaagttactcactctaagctcaccactcgttcttataagtaaatccgggtaaggaaactcagtacaattcgtctccaattcttcctcaatcagtctctcgtctatctcctcaacttcgatttcgccatctttcactctcctcgcgatacctctacacgcttgtaaaacatcgtatttcccactgtaaccaaccgctacgattagctgaagcctcgtgttgttctttgtaacttcctcaacttcgttaatcactcttaaaagagatttcggaagtttcgaggaatctccaatgatcgatatccgaacattgttcctacatataaaagattagcttttgagacataattaatcaatcacaaacacttcttgattacaaattatacgcaatacttacttggctaagttctgaaattctgttttgagtgatctctcaaataaactaaacaagaaatcaatctcaatctgcagaggaataaactcataatcgcatcaaaatctgagatttcgaaaagaaaccctaaaatttaaaaattaggtttgtcactcactcttggtctaatccaattatcagtagagaaagcgaaaactgtaaggacttgaattccccatttaccacaaagctcaacgatctctttcaaagcttcaacgccagctctgtgaccatcccaaggttgaagaccacgattcttcgcccatcttccgtttccgtccattataatcgccacatgtttcggcatcagctctgcatgtagctcttccggcagagtttcttcttcctccgccgccgtaaacgaaacatccgatttggaagatttgactccgaatcggaatcctctgttttcctcgaattttggcgagaaagagagaaagctatctctacttaaccgccatcgccgctctaaatctccggcttgatatcgccggaaatcgaaggaagtgggagtaggaactcgtagagataacatcttaagagaatcgattttactctaggctttgtgataggtttgatagcataggggaagtattgtattataagcagagaaggttggaactttctttcctccacagatggttctggtaagtgtttgaaaacgacgacgtgttttgtcggtgtggaagaagatgatgttgacatgtttttttcgaaattgagcgccacaaacaaactttatcgttaagaaattccaagctcctgtctttttatttcttttttgtgtggtttatacgagttcctattcgtccacgtctcctaattttccttttcttaaagaaaataaatgcattaaaacctcctcctagaacttcaactaatgttgtttgtcaacataccagcaaagaacctcaattaatgttgtttgtaagtcaaatttaaatatgggataaatgaaaattgggccatagcccattacttatctgaataaaaaggcccaatactagtattgctcgtgagagccacgtgaatggtgcttccggccggtaattcgccacgtcttaacctctcccgccacgagatagttagttatataccaatataccctcacattattacaggaacatattacaagatctggagggggtataatggtaaatctaaatgggagtaaaagtgtttttatccgcgtaaataattaaaccggtcatcgacctaaccggctttagtttgtgtccgctgcgtcgtatcaaacccaaaaagaaacaaaactgtttgattcgtactctcttccttttgtcgggtcgtgagatttttaccgaaaatg

SEQ ID NO: 2128 - DNA, 3000 bp, Unknown
  misc_feature (1)..( 3000): cDNA_ID_3066047_gDNA_ID_1620491_Annot_ID_158626 3000 nt of promoter + ATG
gattgagccagccgctaaaatctttaaatgcataaattttgttgtattatataaattggtaagagacgatctaattatgatagtttctatagtgaatttattgaaagtaaataaatagcatttttaaaacaaagacaacaatttaggtctcatgaaattaaacaaccgtatcactacgtactattgcatcaactatgagacatgcaaattctaagttttaaactcgtcgaccgaatcgcctctgcctttgctgataccaagtcaaggcctcaagatactcagcttcgccaaaatcaggccacaaaacagttggaaagtaaagctcagtgtaagcagattgccataaaaagaagttactgatcctttgctctccgcttgttctgatcaacaggtcagggtttgggaattcgctacactttgtcaacaactctttctccatcgccttctcgttaatgtcctccacttgaatcagcccgtctttcactttatttgcaagacttttgcatgcttgtaagatatcatatcttccactatagtctattgctataatgagattcttcccttcgtaactctttgtagcttcctctacctcttctatcaaacctagaagcgactcggggagttttgtacggttcccgataaccgagatcttgatcttatcactaaaaaataaaggggaaattagcatcaagacatataaggctttaaaagaggataaagaaaaaaacatcttggagtagataccttcggaggtaaggcatatcagacgctaagtatttctcaaacaaggccatcaagcacttaacttcatcctgatcaaagaaaaagaaaaaactgaatcaaaatgaattatataaaacacaaaagttttcaaggtcacaaattttaacctgcggtgagaagaaaatactaattagtaattaacatgcatgcaagttatattcgtaaggtccacaatttttattttttttggttttagtccataacttcttggttactcaaaagcagattaaaactcttggaacgttttgtgtaatcacctctggtctttcccaattttcggtggagaaagcaaagagtgagatagtgtttgtccccatagcgaaacaatccttagcattctccatgagccttctcgctccggcctcgtggccttccgatgtcccgagtcctcgtttttcagcccaacgtctgtttccgtccaatataaccgccacatgctttggcattatatttctccctcgtttctgtttctctcccattgtaccactacaaataagtaataagaacaaacaaagttagtatactttcataatagcaaaagatgcataaatacgtagaaactatgattagtaaaaaccaaactaccgtttctcgttcctttcttcctcatcatcgtatttagaagctatgattttgatgaatctgaggatatttgtcaacgacaaaggaacatttagtcgccgagagatgaagagaccagggatgagaaaaagagctagaaaagtaaaaacaacagagaataaagacaacatattttttctgtttttgtcttttgtttttcagtgtttgttcgaattggagcgctagctcgtcatgtacttaaagagcttcgggttcaaagacgcacatgatgatcaatggaacctactttctttctctcacttgctctctgtctactccttgatgctacgcaaagacagatcatacgtattaagttttaataagatcttacgacacttgaaaatcactaaatggtttggtcacgtgattttctcattaaacaaagacatttttgtaagttcagattttgactttttcgatcagtataacttgcttgattttaacattaatgtccaagccaatcgcatagacatagtcatgcactcatgctctcacggtttgtctacacgttactaaaaaaactgaacatagaaatatacggggctttggctgtaattaaggcccatgactacacttcagaaggagggtcattagctatgatcatattcatcctagtttttatccaactcaacacaattatcagtgtgtatagtctatttattttatcgcactacccactttaattattgctatgtacagtgggatcactaaattgtttgttggggacattgaccttatccacatattttttaattgatccatacctctatcttttattttactcacccactttttatctattgtttattgatcaatgttgaaaatctcttgacatgtggaaactcttgaggtgttgtggttttccaagatctttttaacgctcaattcagtaaataaaatcatatacgatctagcaaaagcaaaagaggaatgaacttaaacccgcaaaactcctttaaacattaaattgtttcaaacggttttgtaacacatttctccattaccttttcttgttgtgttttgttaatatcttttcaaattgtgtagtagtcttttgtaaaaaatagatacaaaatcacacaatacaagtcaaagtgagacggcgtgaaatactacagtactattttacaataacgtggtcgccaaattattatttccaagtggaaaaatcctttaatagaaactgccgaaaagccctggttaggccaaaaaccccagtattggaacaagggtatatccgtcattgcacgcataaatttcgggacttttcttgaaaaagcagcttcgagaatcgtaactgatgaatcgctaaagagaggtttatcgagaaaaatccaagatttactaaaaaaccactatctctctgctcttcctctgtctacattaatgtaattttgatcatcggattgggtgaaagaaacatcaaactcctaaaagagaagcctttaaagtttttttttaatcaaaaacaaaaggaagaaaattttcctttttgttttagatggcatgaatcatcatcatcgctttgctttcttgattctctatttcgtttgatgggatttgtttttctgggaatttattcattcacctgctgcc

SEQ ID NO: 2129 - DNA, 3000 bp, Unknown
  misc_feature (1)..( 3000): cDNA_ID_1441072_gDNA_ID_1620491_Annot_ID_158617 3000 nt of promoter + ATG
ttcataactagaactcatgtacccgaaaccaaaccgatttgagatctaactgtcgttcgattcatgcagtggccaaacatgtatcatatcgaatttcatcaaatgaaacaagttgaccaatggaattgagaaagtaagtttttggattagcgaaatggaagaccataatttacattatcaaacaactttttgattgatcaaaattattcttctgttataagtcaaagtctttgatcacgtataacgttttaatatgagaaaattgaataactaccctgtctacgttgaagaaactgaaagggggaaatgggtacagtgtatctcttgtcccaaaggacattgaaaagctaaaaaactaacacacttggctacgtttaaggctttaaaatggaccatgttttgtggtagacctacacattactcttctttcaattttgttttcctccgtattctatgcattgaatagacccacttctcatctttaaattttctgtggaattgtgaaagagtgttctactttggcgacaacaaaaaaatgtttcttggaacttggaagaacttcaataaaacggcatggagttttgacttccaagttagaaacggagtgtacctcaagaaaagggatctaagcgtaaataactaaaactaagaaccctaaaagaaaatacatgattatgaaaggactgaatcataaatgcctgtcctccaatgttgagacgaattgaaaaggaaccagaacaactactatcaacggtgatcgatttcgccgggaacggagaagaaaaccctagatatggcggagaagcttgcgccagagaagagacacgatttcattcacaatggtttctcgctttctctatcccctcgctctatttctctaatttcagctgattccatttcacgagatttggtttgaatgttcttcgatttccgatggttataggtcaaaaggtatttgagtgggatcaaaccctggaagaagtgaacatgtacataactttgccgccaaatgttcatccaaagtcattccactgcaaaatccagtcgaaacatatcgaagttggcatcaaaggcaaccctccctatctcaatgtcagtttctttcgctatctttcaatgtttttgatccgtttgtctcataaatctgagttattcgatgtggtatatataactcgattcaattgtctaaattttgtcaattttcagcacgatcttagtgctcctgtgaagactgattgctcgttctggactctaggtactccattttttgtttttgtgtctgtattgggtgcttgtttttgatggttaggtttctgtttttagacccgttcactattgctagagaggataaactgaacctggaaatgtgatctgagtttggtataaatagtgggacatatagtttggaatgtggaaaatttgagactaatggagggatgatggaatgtacagtatattttgggttatattatcagcgtatgtaagttactggcatagtttttttaggttcatagtctggcactgattgctaatctggattgttatgtttgatttggcagaggatgatataatgcacattaccctgcagaagagggagaaagggcaaacatgggcatcaccgattctgggacagggtcagttagatccttacgccactgatcttgagcagaagcggctcatgctccagaggtttcaagaagaggttagctacctgtaaaagtcctcttggtttcatatggtttctgcttttgaaaaaataaatgttgttttctaggtcttctaattgatctccaaagcaaatcttaggcaccactactgagtagaatgaatctatgtcaaagtatgattactttgccataaatgatcgttttggatgagtcatgtcccatgattgttttctttgttcaagctctcttattttgtttcttatgtctctctcaagtagtgaatcttttgtgttcatggataaacagtctgcatagagctggtgatagtaaacctatagtgtagccggatttttatcagtttcatgaataaacagtctgcatagagctggtgatagtaaagctatggtggatgaaattgctcagccttagtctaaccggattgagcaaattaacatggcaagactgcacacatgggtgtgattcatgtatgccttaatggctttgtcttattggttttgtttctgcttgtatgcatgagtttctatttactttgtattgagctcaagtatgcttttctttactctttcgaccaactttccttttacatgttctttctctgttggtttttgcagaacccgggattcgacttctcgcaagctcagttctcgggtaattgtccagatccaaggagcttcatgggcggtattcgttctgactaaataaataatagtcccactcttgttgctataatagtatgtccattataacaaactcaaaagtcaccatgacttaaacaaaatgtctcatgtctcataaataaaccccctgactctctgtttctataactcgtaatggcaatcatataaatcgtctttcgtctctgtttagttgtccttttcttcccgacaacagaatcggagcatctactaaaagtccactgagccgccgtgcgcttcgaatcttgttttggtatgtgacagctttttcaaaaagaaattgtcttggataagtggaggagaataaggaattcgaacaaaataaaattggagaaaaatgatcatattctctattttattatttaacatcattttatttcggttacaaaaaaaaaaaggaggaaaattaggcgcgcgtcatctccctcgcgacacatatatcataagacagagagcagggaacgaatctcaagacgttacgtattagcttatagccattagttttgtctcttcttcttcttctcgttggtcggcttcttcgtcttactaattccatgattcttcttcttccttctgcttcactttctcgatgatcctctgcaccagccgcgatcatg

SEQ ID NO: 2130 - DNA, 3000 bp, Unknown
  misc_feature (1)..( 3000): cDNA_ID_3066063_gDNA_ID_1620491_Annot_ID_158613 3000 nt of promoter + ATG
gaaatgaactccccttgtaatggagcgccttcccattcttacctattcctttctcccctgtgagtataaagtttaagtaagcttttcatatcaaggtagataaactgctgtgctggcagagaaaagttaacagataatcgattggcataggatgagaatgagcaatatattgttttcttaccagtgcataaagctcggaaattctctacagttttggggactgtcttgccaaatagacccatgacaatacgacctggacaaaaatcatcaatcgatatgagatgttttcaggggacaagacaagaagaaaccacaaagcatttcatgcagtctaacatatatcatcataagataaaactcaggaacaaggtcataccagctgctttcccatcaatttcaacatcaaaataaaccttgtgtgtgatctcctttaagttttccttagactttttggcctggaacatgaaaccaaacatccagaaatcaatataaacactagatcacaaccgtttcataatatatacatcatcccaacacatttagacacaaattaggcgcacttcatgcagtaactagctctctagtgttgaatctaatcatatgttaaggatcaaattcagattttccaaacaaccatatattattaactccagtttctttaatcaaataagtccataattcaacagaactctttcggcttcaaatctcaaacactatatgactcatgatgaacgtataaaggtttgttccctgatcctaggagaaattacccgaatcgtccgcgattaagatgattgaaactaatatcagaaacatgtcacatcaaacaccgaatcaaataataatcaacatgaagacctaagacaattatataccgttaaccaatcgcaaccaaattggtattatctagatcgtgcaacaatctaagaactcaatcataaagctttgcagaaatcgatcgactagtgagaaggaaacacacgaatatacctgaatagcgcttagtgtaccgagaagaagaagactccatagaagcagcgtcactgagctcgccatcttgtcgcaccgtgctaaagtgtttctccacagtccctttttttttcccttgtccaccgctatttctcaccaaagccacgtcaatatccaattaaattccgccacctggcttgtagcgtgtacaattgtaattgggcccggatcgttgtagaaccgtaatgggctaatgagtggtttggttacagcccattaatctttgtgaattctatgattctttattgttgttaattaagaaatgataataatagtaattcagagttggtaaccctaatggaagaaatggctcatggctggatcggatacccaaaagtcatttttaattcttagtcaaaaagactcaacatcaataccataagcatgtcacattactcttgttccagctaatattaatatggttacttaactttataagtggttagttaaatattaattgtcagtatcattttaattaagcacgtttccatccatattaagaattcgatgacatttaaatactgtcaactttcctgggccagtcttccagtacattttattttgctacatcattgataatattttactattagtaaaaagaaagggtaaaaagggcgagattagtacttaacttttggcctaaaagatggatttggaaagacaacagacctgcagctgcaccaccaatatagccgaacactttatttgttgtcgctttgctattgcaacatatctaatgttatctgtttttttttttcttttggccgacatctgaagtatttcaaaaattaaattgaatttcgcatttcttgttttttcctacataaaacatcatttaatagataattaaagaaattcaaccactgataaatagtgcaaaaatacaaattgttacaaacatcaaataatttgggggaaaaataattcccaagcatgctataaaataaaatggaaatatatgaattaattttactatgaataacaaaacaatatatttttacacttttggtctaaaagagacatcatgaataaccatgatgttatgttcaaaacagatccaaagctttcaaaactctacagtttggcccgccactcaatcctatcaacaagatattcaaacaccaacaagaaattatgacctttagctttcgagagtgtaatcttgcggtagataattgtctatcagtatagtaacaaaacttacaacaatagacgatattaatcttggagttatttcaatggaagaatgtattctgttgagagaagaaaaacaaagacaatacaaaacacaacaaattgcaaaagatttagatctgcatctgccccaccaatgtagccagaccagttctttattttgttgctttgccatttcaacatatctaatttttttttctcaatagtctcgattttgtgttcacacttcacacaaaaatgaaaatgaaaatatcttttgtagtatgttatttatggggagggacaaaaacaatgaacacctggcgatataatctcagtaactactatttttactcatcccttttaaattagtcaattttttccctggttttaaaattaacgaggagactaatttgtaaattattacaaaaaacgagattcagtaaaaaaaagtttttgtttttgtatttttgtgtgttcaggtgtgagcgtgtaagagaggaggtttgacgaggttttctctgaaatggtttcgaagttttaaaataatattaaaactcaggaacaatccgagtatttatgtagaatcagaatcacattcttggatctgaacaagacgacgatacatacacaaacatggaaggaaaaaaagagatgggtagttacaaattctgtctgatcttcacaaggaagttcaggatgacggagtctggtcctgtcgaagacgtcagagatcttttcgagaaatacaccgaaggcgatgctcatatgtcgccggagcagctacagaagctcatg
